United States Patent 11,180,807 (METHODS FOR DETECTING A GENETIC VARIATION IN ATTRACTIN-LIKE 1 (ATRNL1) GENE IN SUBJECT WITH PARKINSON'S DISEASE) - sequence listing, part 43

SEQ ID NO: 644 - DNA, 20712 bp, Homo sapiens
taggaaaaatgtcatttattcaaaatatgaaattttattataattgatgtttaatgcaattcactttacgaaggtttttgtggttttccctaaaatttctgttttaatgaaggctcctgatcatcctggatgtcgacaagttttcttcttcatgtgacgtctctgatgcacaataaactgattagtttttctaaaactgattatattcatagggtttcatctcactctaacataaagtttaagctaaactacgtccatttaactaataagccaaatttgtaagagcttaacagactataaacttaactcttgctttaaagcaacaaaaacaaaaccctgatgaagacctggaagtgaattgttcgtttttcagactctagcttccttgaccttgtgctctatggttttgaacacacaggacccaagtttgctgcagaaataacctccaaatccatcttatgaaccaggaagactgtgagggtttttcttttttttttttaagggccaagggtaaatgtaatatttatcattagcaccacatcccatggtcagccccacctgaataaacggcatattgggatttttccacaaactatgagcctaatgaaaaaggaaatggataagggaaacaagttcccagcctatgtcacatgagtttctgcactacgtgttatgtggtaaggtatgcattccctcaggacttcccaaatccattacatgctagggttttctctctggtatgcattctggtgtgatgtaccctaagagctgccttacggacaaaagttttcccacattcatcacattcatagggtttctcccctgtgtgaattctctggtgtactctgagagttgaattttgggcaaaagcttttccgcattcattacactcatagggtttctcccctgtgtgaattctctggtgtgcactaaggtgtgatttctgggagaacgttttcccacaatcattacattcataggatttctcccctgtgtgaattctttgatgtactctgagggttgaattatgggcaaatggcttcccacatacattacattcgtagggtttctcccccgtatgaactctctgatgtgcactaacatatgacttctcagagaaggttttcccacattcactgcattcatagggtttctcccctgagcgagttctaagatgtgctctgagatgtgatgtcttggagaaagtcttcccacagtcattacattcatagggtttctcccctgtgtgaattctgtgatgtgccctgagggctgaattatcagcaaacgttttcccacattcattacactcatagggtttttccccagtatgaattctctgatgtgcacagaggtgtgttctttgggagaaagttttcccacattggttacattcatagggtttctcccctgtgtgaattctttgatgcactatgagggctgccttatagacaaaagttttcccacatacgttacattcatacggtttttcccctgtgtgaattctctcatgtccactgaggtatgatttctgggagaaagttttcccacacttgctacattcatagggtttctcccctgtgtgaattctccgatgtgtactgaggcgtgtcttctggaaaaaagtttttccacattcactacattcatagagtttctcccctgtgtggatattctgatgtgctctaagggctgaattatgggcaaatgttttctcacattcattacattcatagggtttctcccccgtgtgaattctctgatgtattttgagggctgaattatgggcaaaagttttctcacagtcactacattcatagggttttctacctgtgtgaattctctgatgtgctctcagggctgaattgtaggtgaaagatctcccacattcattacattcatagggtttctcccctgtgtgaattctttgatgtgccttgagaacagaaatatgggcaaaagaccttccacattcattacattcataaggtttctcccccgtgtgaattctatgatgtgctctgagggctgaattatgggcaaaagttttctcacagtcactgcattcatagggcttctcacctgtgtgaattctttgatgtgctctcagggctgagttataggtaaaagatttcccacagtcattacattcatagggtttctcccctgtgtgaactctctgatgtacactgaggtgtgtcttgtgagagaaagttttctcacattcaacacattcatagggtttttcacctgtgtgaattctctgatgtgctctgagatgtgatgtcttggagaaagttttcccacattcaatacattcatagggtttctcccccatgagaattctctgatgtcctttgagatgtgatgtcttcccatattcactgccaccacagagttccatctctgcatctgttttctggtgtcctatgaggggtgacttgtaagatctcccacagccattgttatcacaaggtttctcttttgtgtgaattctcagatgtttactgaggtttgaattctgacagaaagctttcccacattcattacattcataaagtttgaatcccacataagttccaggatgctgaataggatgtgaacttgaacaaaaggattttgcacattcctcatattggtaagttttctctcctgagtggggcctctgatgctgaatgaggtgtgctttccggtaaaaggattttctgcatttcccatgttcatcagaaaggtagaatttatcttctgtgtgaattctctgatgtgctgtaaagtctaatttctggtagagggcatctgtacattcattatgttcaccaaatttatctccagcttgtgttttctgatgtactatatgggctgagctctggctaaaattttcttcacatttattgctttcaaaagcactccatcctgtaatagttctctgagattgagtgaggggtgacttcctactgaaattaatccccctttcattacactcatagtgtgtcatagccatgtgaactttattgtattcaacagcggtggttttgtcacaggatgtcccatattcattaagatcagagcatttcccccttgtgtcagttctcatgtggttaaataaagtgattttatcaaagttttttctaaattcatcatccttacaggacttttctcctgttagaaaactctgaggtgtaatacaaattgtcttatcatataaaccttgtccagatccatcacattcaaaagattcctccaaagtttgaaatttccaatgctgatctttcttataactgaaagctttagcattttcaccatgttcataagatttctcttcagcatgagctttctcatgcttaatatcaagctgcagtttctcacacacattcatgtattcagtcttctttcttgaatattttctttcacttataattaattgagaagcaactggcaaattcattctgtgtgagtcacatttacaggatattttttctgaaagctctggagctatttccagattaaatggtttttctaaaactttctgtccttctttactcaatgttttgtcagcatcactgatgaatatttcttgccacagaggtttttcttgtttttcccggatccctttgatgtgatcaactttaaaataccctaaaatgagaaaaattgaaaatatagtataaatcttacatttctcatggagaagaacttatactcatattttgattttggttttggtttttgaaatagggtattgctctgtcacccaggctggagtgcagtggcatgatcatagctcactgcagccttgaactcctaggctcaagtgatcctcccacttcagcctccctactagatgggactacagggatatgccaccatgtcctgttaattttttttatatttagtggagagagggtcttgctacattgcccaggctgatcttaaactcctgagctcaagcgatcctcctgccttgacctcccaaagtgctgggattgcaggcatgagccactgtgcccggcccctgttttgttatgtattttattctattgtttctggtcatgtttccaaatattaaatacttcatgcacacagacagactctctcctcatccatgctgtttataaaacaggtattatttccggggccagtcaaggtggagtagtaacccctttcctcccacatcttccctcttacaattaaaaatccctacagaaaaaacaaaacaacaaaaaaagattaacaaatatacaaatatacgaatactacaaaatggaaagaaagtggacttcaggacttaagaaatgacacagtatggaattccaaggctattctatatcctagactgggtgctgaagaaacctacaatcctgcactgacaggcacagacaaaaagagcacaaagaaaagcctgcttcttccagccagaggtctgagaaaatggtggtctaacagaacaggaaacacttttgatgttttctcatgctcaggccaaaccaaaatgatacaatcctgtggttccatggaggctgagcagggagctaatgttccctgccgtagatacacaggatctgcatgctcttatatgttttcttccatgagccatgaagaatcctgagaaagttccattcttaggatatgctgggagatggtcacagcagccactaccaaaattctgcctagaaccaaattattatctaatttatggaacaaatgtcttaatctgcaagggcaagaatataataagttgttttagggcactgacaggaactcatagcagctatgggaaggaaacaagaaaaaaagaagcacagaagtaagaggagaggcaggaatacacagtagacccaatactcaagcagaagagataagataaagtagcacttgcaataaccatggcttcaaacctgaagacacaatgcattcaacagctgaattcacattcttctgaaatgcacatggaacaatcatcaaaacagactatattctagactgtaagacaaaccttcagaaatatagaagaaataaattatacagaggatgatcttgggccacagagaaattataccagaaatcagtaaacacaaatttatctggagaaatacaaaagaactgtaagttacacattcctaattaacccatgggtgaaagaattctcaaatgagatattttgaagtgaatgtaaacaaaacaacttagaatacagaaatttgtggatacagctaaggcagtacacagagataaatttggggcttaaatttttttggccagacgcggtggctcacgcctgtaatcccatcactttgagaggctgaggtgtgtggatcacaaggtcaggagtttgagaccagcctgaccaacatggtgaaaccccttctctactaaaaatacaaaagttagccgagtgtggtggtgcacacctgtaatcccagctactcaggaggctggggcaggagaattgcttgaactcgggatgtggaggtgcagtgagccacggtactccagcctgggtgacagagtgagactctgtctttaaaaaaattatatttgaaaagaaagatctccagtcagatgcttgtttcccccttaggaaactagataaagacaggacattaagttgaaagaaagtagaaggatgacaaaaaagtcaaaccaaaagcttaattttttaaaaagtttttttaatgataaaaaccatcagagagaaaaaaagagaagacacaaattaccaataccaaaaattcaagagaggactaactactaacagacattcaagagataataaaacaacaataacaataactctgtcttagttcgggctactacaacaaattaccatagactaaatggcttaaagaataaacatttatttttcccagtgcaggagactggaagtctgagattagggtgccaacatgactgtgttcttgtgaagacctcttctggtttacagaccactcacttcttgttatatccttacatggtgaaaagtgaagtagctagctctgacaccgttttgtaacagcattctagtctctctcttttttttttttttaactataaaagcaaactaactttatttggacaatctaagtggaaagaagaggcaggtgaatgtgtattgtaaccacagagaatatattctatgtcaaatgttaaaacataatggcagaataatctaaaagactttttttctaaaggagctgtcagtgaaaaggatatttacgacaacatattaacttacttcattatgatggaggatatgttaactgaatgtctaatttactcaaattttaactatgtttgcatatgtaaataaggcttaagaatgtaatgaaatcttcctctatatatgtgtatgtgtgtgtgtgtgtgtgtgtgtgtgtgtgtgtgtgtgtgcaattccaaagaacaacttctggaccaaatagttttaactagtaaattttaccaaacatccaaggaagaaataataccaatcctacacaatgtcttctagaaaataaaagatggaatatttcccaaatcattttataaggcctgcctcatcctcatagcaagattaggcaaatactattcaagaaaagaagctttcagaccaatatctcccataacataaatgcaaaaatgtcccaaaaagtacactgaaatatataaacatagataatgtatcagtgaaatttacctcaaaaatgccaaacagttactacactgcaatactataaaaactatagtttttatgctgcatttcaggtcaatgtaatctcctatcattagtctgaagaactaaaatcacacactacatcaatgccaaaaattttaacaaaattcaaaatccatttattaatttaataaaagtaatctataaaaagcctataactaacattatactcaagagagactgaatgtcttccctctaagatcaggaaaaagacaaagatgcccactaccagtagctttacacaagattgcactggaaggaccagccagtgcaaaaaggtaagaataaaaacacaaagatacagagtaaatttacacagaaagtttaaaatcaaaaaagttccttgaactaataagtgtttttagcaagggcagaatctaaggccaatatacaaatctatgcctacaaacatacaatgatgaattggaattttaaatcacagaaacaatattacagcaccaaaacaaaattaaaaacaaaaattaaaaaagcctcgttatctgtgttctaaaaactaaaagacattgatgaaagaaatcaaagaaacagtaaataaatcagtagggatattttgtgtatggactggaagactgtacgttgttaagatgtcaattctcctaagttctacagattcaatgccactccagtttaaatgccaacatgtttcctttgtaaagattatgaacctcatttaaaaatttatacacaagatgaaaactggagaagtacttgacttcaaaacttaataagctagagtaatcaagttaatgtggtattggcataaggaaagacatgtagatgaatgaaaaggaatattaaactacaaaaatagacccccaaatgtacagccatctgttttctaagaaaggtggaaatgctgttcagtggagaagtaacagtcttttcaaaaagtgatgctggaataactggactccctgttccaaaaacatttaacttgacacataactcatactttctatagaatttaacacaaaatggattatcaactaagtgtaaaaactgaagctgtaaaatttctagaagaaaataggattcctaaatctgttactttgagtttcaaggtttctagatagaacaacaaaagcaggttctgtaaaagaaaactagtaagttggactttatcaaaattaatattcagttttagtgagcctcctctgaagttatactagcgggagtgaggtgcagcatcactgcctgctacgtggggaaggaagtccagttccccactgatctgaccccctgggggtggaagaggaggcttctacttttttttttttttccttccttttgagacagtttctctcgtcacccaggctggaatggagtggcgcaatcttggctcactgcaacctctgcctcccgagttcaagcgattctcctgcctcagcctcctgagtacctgggattacaggcacctgccaccacgcctggctaatttttgtacttttggtagagatggggttttgcaacgttggtcaggctggtcttgaattcctgacctcaggtgatccacccgcctcggcctcccaaaatgctaggattacaggtgtgagccaccgtgcctagctgaggcttctacattaaccctgggcatgggtgaaagatcaggagccccacaaggactctgataacactaaccaccttgtattttgtcaggtgccaagacccctagtgcatcttcattcttctttccacccttcagtagtgtgatctcagctcaccataacctccacctcccagattcaagcaattctcgtgcctcagcctcccaagcagctgggattacaggcacgagccaccatgattggctaatttttttgtatttttagtagagacagggttttgccatgttggctaggctcgttaaactcctggcctcaagtggtctgcctgcctcggcctcccaaggttctgagattacaagtgtgagccactgtgcctggctagatattgcattctttacaaactgaaggtttgtggcaaccctgagttgggcaagtctgttggtgccatttttccaacagcaagtgctcactttgtgtttgactcagcagtttttagcaaacaaatattttaattaaggcatgcatactgttttttagacatgttattgcacatctaaaagactaaagtatagtgtaaacataaaacttttataagccctaggaaaacaaacattgtgtgtaacttgctttattgtgaaatttgcttcattgtagtggtctggaacagaaactgcaatatctctgaggcatgcttctatatacagatatttagctgcacttagtgggtagagtagaaaggaatacatttactccatccttcccctgggtaatgcattctgtattttattaaatccttccctaagaagagtcattaacctattctatatgatcttctagaatatttctacttttgttttgataattaggtcttaagccaactgaattcgactttttgttttgttttgatctatatggatacctcaagatcctttcctcattgttctccagtgtcatctatctaagatgtctatcaagtatatgttttttcttttgtcttttttttttttttttttgagatggggtcttgctctgtcgcccaggctggagtgcagtggtgcaatctcggctcaatgcaagctctgcctcctgggttcacgccattctcctgcctcagcttcccaagtagctgggactacaggcacctgccatcacgcctggctgatttttttgtattttcagtagagacgggtctccatctcctgaccttgtgatccacccaccttggcctcccaaagtgctgggattacaggcatgagccaccacgcctggcctcatgtttttttctttaactttctactctgtttcactaatttactaaatcatcccaccccccagctccatgctacttagctacacagcactttacataaagcctcaatatctggtagagcagcaaatcctcctgtatcactcgtttttatgaatgggattgtgtttggtatagcgttatctctttacagatgtatcctgacttgaatttattatataggtgtttcctctcttttttctttgatagggttagctgaagtttaattcattttatttttcttgtaagaaacattccatttctgttttccattttatttttaattttacttttaaattcttctgttttcactattgtatttttgatgctgttcttgcttaattaatgagactacgaacttccttctgtccactactttagctatacctgatggtttctaacttgcagttacaattatttcattacagaaatcaaatccaaaattgcattacacttttttgtatattgtttaaaagagatactaaaattttttcaagtggatttttttcattttattattaatttctggatttaccaaactaggttcagagaatactgtttgtgtttattctaatttgttagatttattgaggttttctctttagactaatagtatactctattttatcattattcaattaaaacatgaaagttttgttttttgcattagcatacatatacacaaatgtatggttcactttaatacaaatgtaatttatagcctctctaggcatatttatttaatgtccactgtacctactgtttaatcagatgagacattatgatgtcctaattctaatgagttttaagttcttagaactccattattttatgttttagaaacattgatattatattatttggtgcagtcattcaaatccttaaaggttttcatttccctgtgctcttgaatgagagcttttcctactttaatgaatttcttgcctgaattcaaatctgaatgatatagaacatgaaatctacattattttatctttattgactcaacaactttactgattttttttttttttttaattttttgggactgagtctcgctcttttgcccaggccggagtgcagtggtgctatctcggctcactgcaagctctgcctcctgggttcacgccattctcctgcctcagcctcccaagtagctgagactacaggtgcctggctaattttctgtatttttagtagagacagggtttcaccgtgttagccaggatggtctccatctcctgacctcgtgatctgtctgccttggcctcccaaagtgctgggattacaggcatgagccaccacgcctggcccaactttactgatcttttataatgatctttctatgttacttatttagggatatcctttttagacaatcaatatgatccaataatttacatttagtgactcagcaacatacttgatctaaattatgtcactctttatgtgatgctatttgttggtatggcttcaaacaaaaaccttaattgtgcttcacttctaataagatgattttacttttttattctaaaaatgacattgaaaactataactttttaagatttctggaatcatttattcgtacaaagcctaataggcatataaaaagatgcctgatatcattggtgaccagggaaattgttatagacttatttgtgtccttcccaaattcttatcttgaagccctaacccccagtgtaactgtatttgcagacaaggccttcaaggaggcaaaaagggtaaaaatgaggtcacagggaaggaccctaatccagtagtactgatatctttataagaagcggaagaaacaccagagtattctctctctcccactgcatgtgcacagaggaaaggccacatgaacacacagcaagaaagtggctgtcttcaagccaggaagagacgcttcaccagaaaccaacttattagtactttcattttagactcccagcctccagaatcatgagaatttctgttgtttaaactacccagcctatggtattttattatgatagccctagctgactaatacagaaatgtacatcaaaaccacagtgagatatcacttcacatccactggggtggctagaatcaaaaagtcaaacaataacaagcactggtgaggatgtggagaaatcagaacccccatatgctgttgttaggaacggaaaaatgctgcatttagaaaaacagtctggtggttcctcaaacagataaagacacagataccatatgacccagcagtttcactcctaggaatatacacaagagaaataaaaccaattgtccatgcagaaacctgtaaataaatgtttatattagcattatttgtaggtggaatcccaaatatctactgactgataaatggacaaacaggtggtacatccatacaacgggacattatttggccataaaaagaatgaaacatgtattttatatcagttgtaaacattatgctaggcaaaataaaccaatcacaaaagaccacatatatgatccaatttatacaaaatgtctaaaataggcatatttatagacacagaagtagactgtggttacctagggctgcagagggcaggggggatgggacagtgataactaaagggtacaggtatgtttgaggtgatgaaaattaactgtggtgatgtctgcatatacagtcatcccctggtatccatggggaattggttccaggattctcttaaataccaaaatccacaaatgcccaagtccttgatacaaaatggcatagtatttgcatataacctatgcacatcctcttgtatactttaaatcatcaccatattaattatgctacctaatacaatgtaaatgccatgtacatagttgttatactatattgttcagggaatagtgacaggaaaaaaatgtctatacatgttgaatgaaagtgcaatatttcttccctgaatagttttgatctgtggttgcttgaagtcactgacctgtacactttaaaggagtgaattgtaggcatgtgaattatatctcaataaagctgttccaaaaaaactttcaaaggtgctctccctctaaagactaagtacccccagggggctccttctgttaatgcccactcacctgggtacctctggttcaggaattcatcttctaaagaccatggctcttctcctttctccaacttggagatcaccttaggtttagtaatgcaatatcctgtaaacaaaataattgacatggaccagattcacaggcttttggatttccaaagggaaaaaaagatatggcagcaaagcattaactgagggtgttcatttgaaatttttaatgggaaagtaatgacatgttgcttttgtttctgtaaaggtttcaactacttcaaaccttttaatccaaagccctttaatctctataaagggtccatgtgttttgatactttttaaaaagggacatatattctcgagagagccccatggtaagctatgctcacccactgagatgaggtggctgtagttctccagcatcacatctctgtacagcgtcctctcgacagggcccaggtgctgccactcctcccgggtgaattccacagtcacgtcctggaatgacactgatgcctgtaacaacatttatcacaacaaatataacaatggtttgttcaagggttcagaattgggtgacacagaaaatatctttgagagctactactaaaatgaatggttataaaggcctattttagacccaaaattgtcttaacatatgtaactcaaaacattttttaacttgccataatttctctatgtatttatgaattctaggtttttgtaagacaaaaaaaaatcaatgtaaaacaacttccttccaaccacctccttccttcttccacatctccgcaaattatccggggtagtctctaggacattcacaccctccctggacatcatcactgtaaattctgggggctaaggaagagatatatgtgaagtctggagataccctgaccaaactttatatagggtagagcaggtgaagagcagagaacagctataatagttgtaaccaaagagactggcacaaaagaacacttcctacactgaggtcacagcaatggatgtaagaatagggatataatcacagaagagaagcaacacccatttaatacaatactttcttgtacagctactcaatctagctgtatgagaagctccttttaaaaaaattttgtttttaattgacagaaagacaaatatttcaaattatagtcacttatatgtggaacctaaaaagttcaaactcatagatgtagacagtagaatggtggttaccagaggctgggggtgaggggtgaggaatggggaagcattggtccaagggcacagagtttcagttacataagaggaatagtttttgagctattgcacaggatgatgactagaatgaaaaataaagtaatgtatatttcaaaataagcagctgcttggtggtgccaaaactggtatctgggaaagaagaaaacgtgttagaagattcagtgagagttctgttcatgttgatacgtagctagaactgttcgttcaaccaggatacatatgattttagagcacagaaggtaagatggggatgaagataagcatttaggagttactagcaatttaggtggtgagtaaaattagcagagacagacagctccttgagcacacagggattgaagaaagaaaagaaccaaaaacaacacctgaggaaccacaaagcagaaaaagtacaggccacaaagccagagatgttttccaaaaaataataacagaatcaggagggggcagagtcttagaaattgagaaaagagaaagtttccacaacaagaagacttcaaattcaaattagcaagtgatgacggtgaagatactgaagatccaagaaaattccttcttccataaaagcaatgagaaaccggcaaaaactgcagaatcaactttttcagaactctagaagctaccaaaggcttacagcaatctgcggaacattgatatgagaaaaacagctgcatcacagtaagaacaatgatcttgtgtcatttcaacctgccctatatccatccctctcactcccactcggcattagctttgagaaacatctgaaacaacaggagaatccagcggcctggtatccactggatgaggcagactgggtcacaggttggccaaagcctcactcccagaaaatcctcattatctgacctaatctgtggttccctggaagagctgacttgaaaggctgattgaattaagtcagagttccccagtgtgaaaagccttattcttgaaggcatttgccaaaaacattcaaaggcaattgtttaactcagcagctaactgaggcggtggataacacctgacataaataacagcctaattgaaaagctttttagaaaggaaaaactggagaatgggatgttcataaagcttttgaaaagctcctatagattctagagactctaggtcacctacatgcatagagctgagcatatgcccagggctgtgattatgctctggaaagatgtgagaaggccctaaactgtcaccctgggtgaccctaaggtttggggtgaactggaagtgaaggaagtgaaggttaacatggggttataaattgcctggatgtctgttgaaggaatgccccagcactcatgaggctctttggcaaagactgagagccttacttaaggtttcaggcatttaagaaaatttctgcagacttctgcagccacacatgacaataaacacaggctctactgaatcaattaaaaagtcactagacaaatttcaacaacaactcctgcaaatcaagaaagttttctagagttgccaccttatttaaaatgtatagttttcaacaaaaaatgcaaaacaagaaaagaaacaacaagtaagacccatatgcaggaaaaaagtacaatcaatagaaactactcacgaggaagcaggcattggacttaaacagacgatgactttaaatcaactatgttacatatggtcaaagacttagaggaaatgatatgtaaggaccaaaggaaagtattagaataatatctcaccagataaaggatataaataaacagaaactataaaaagggaccaaatagaaactttaaagttggaaagtacaaaactaaaacaaatattttaccaaaaacacctgttcaacagcaggtctgaacgggtagaatgaagcaactggacaacatgcccactgagattatgcagtgagaaacagaaggaaaaataacaagaaatgaacagttggacagcatcaagcttatcaacatatgccaaatagactaacagaatagagacagaaagggtctaaaacaatatcagaagtagtaatggccaaaaaaccccacaaatctgaaataaatgataaatctacatgcccaaaatgcttcacaaactttaagtaggataaacttggagaaagaaatccacactcgctgggagcagtggctcacacctgtaatctcaacactttaggaggtaggcagatcacttgaggccaagagttcaagaccagcctggccaacatggtaaaaccccatctctactaaaaatactaaaattagccagacatggtggtgaatgtctggaatcccagctacttaggaggctgaggcacaaggattgcttgaacccggaaggtggaggttacagtgagccgagatcatgccactgcactccagcctgggtgacagagcgagagactgtctcaaaaaaaaaaaaaaaaaaaaaaaaagaaaagaaaaagagaaaagaaaaaagaaaagataaatccacacctggacatgagaatcagagtgttaaaaagacagacaatcggaaagctgtaacagagaaacaagtcatcatattacaggctgatttataatgagaaactatggaggacagagggcaatgggatgacatattcaaagtgctgaaacaaagactgtcaaccaataacctctatatccaggaaaaatagagaaactggaattttcccaggtaaacaaaacctgagataattcatcacaggcaagactgcctataagaaataataaagggaatggttcagcaaaactatggagatagaggagtaggttagtggttgtttggggctcagagggaatcaagtggtagttacagtgtacacagcttctttctaagggaataaaaatgttctaaaattgactgcagtgatattagtacattatctgagaatgtactaaaaaaatcactgaattctacactttaaatgggtacatggtaagatacatgaattgaatctcaaaaaaagcagttttaaaaaaagaaaaaaacaagggaagacaaaatcatttggagacaacagagaagactaaagagccaaggacagaaactgaggctgagccgagtgacaggacaaggaaggtggctccatgaagacatcagccggggaaggaccagtgaggggcaagtatcactaacggaaatgttccaggacagagtgagacattgaggcaagtgctgcggaaaagccaagcaagttaaggaaaagaccacatccactggatttgattatactatgggtagggacactggaggtcccaggcaagtggcaagaaaaaatcaaggcatcccatggagagttgacgttaaatgctaagtgtggaaatatctgaaagagaacaattttggaccatctgctgagcaacctgaatatcatgggtactcaaaatatttatggagagtgattttaaagacattcagttgattcatcagaaaaatgttaaattcaacccttgcactggagtacttgaaaaatagtactgaacgtgttcaaatttagcattacaatttctacttctattgaggaagtaatattctgttatttggcaatttattaactaagtcacctacttgaagaacaataaatacattttgttatctttatgtttatattccatgataaatcagttggctttatctttctcatcaatgtaaacctttaagtattgtctgtctgacactccaccatgactgtcaataacctcagaaataaatctgaagcttaatttggtaaatttgtaatatcggaggatctgcatctatccacatgccactttgctctgctattcatctgcatttctacatcttctaggaatgtgtctgatccatctctatttctacttttccatgttaatgtacggacacataaacccttacaaaacctattgtaaaataaaccggtttttaaaaacctaactcacctgagacatgttcattttctgctgctcctggaagagtgtagaggactgtggaggttcagctggggaggaggaaagagcagtggggtcatgagagacctggtctgcctctcagttcttacagagatggtccctgacatgagatggttcgacttgataatggttttactgcgacataaccccactgtaatcaaggagcatgtaatcctattcatgtgcctaaaaaaaaaaatcatcgcactcagctggagaaaaggattcccaatgcagaatgtccctttgactcttgaaaagggacaagaaggaccactcaaagatagccacacctgaatatgtgcatctctgatacgattatgtgcgcttaaacttacattttcactgagtaaagtaatactgttttttgttgatttactaataattatgttgatttattaacaattatgttcccttttgactaagaaaaaagtaaaaataaaacaaaggattaagcaagttcaggtacacagagatgaagctgtttaccttcattaaagctaatgtcaaagaactactcagccgggcatggtggatcatgcctgtaatcccagcagtttgggaggccgaggggggtgaactgctggaggccaagagttcaagaccagcctggtcaacatggcgaaatcctgtctctactaaaaatagaaaaaaataaaaaataaataaatttaaaaataattttttttaaaaaagaactactcaggctgacttaatcaagttcttactgcctttacacccagaattagcacttccacggaaaaaataaagatgggatgttttatgcaaggaatttcaggcccaatatttttgggcttccaatataggaaattcttcctctactacccggaaagaggcagcattagtatcactctaaatgccacatgtggtgatgaacacggtgtgagagggactcacaatgtggaagaagtgaaggcagaaaggaaactaggctgccgtttgggatctggacagctgattacatcttccctggatatcatgacctaaccagccctccagtaaagtgtctttttccacccagcttgatagtcactcatccctctcaacccctgggaattgccttctgcaagttagtccacagcaaagtcacacggtctgtgatggcttctggatgtggcaacatcacaaaatctgatgcatatatagggagtcaacaactgcctctggggaagcaatcaggacctgctcctttctagaatcttctgcctctgctctgacgctctagaagaggtctcggtcatatgggctgttcttctatggcagtagtccctaggactccctcttgactgcctcataggagctgctttgctccagaggggctgggacttaggcctgagaaacaaactcaattgaaaccttcacctaataccctaaacctgactcttgagattcactagaaatgtgctatccagcactgcagccatcagccacatagaaccattgaacacctgaagtttggccagtgctacaagtcgaatatttaggaaggaatgagttaagtaaaataaagcagtaaaactgactttgcctgcctcttctttttactgtagctactgaaaaattctaaacttttttttcttttttgagacagagtctcactctgtcactcaggctggagtgcagtggtgcaatcttggctcactgcagcgtccgcctcgggttcgagcgattctcctgcctcagcctcccaagtagctgggattacaggagtgcaccaccacgcccggctaatttttttatttttgtagagatgggcttttgccatgatggccaggctggtctcgaactcctggcctcaagtgatccactggcctaggcctcccaaagtgctgggattacaggcatgagccaccgcacctggccaaaaattctgatttatatttgtgttttgccttatctttctattggacagcacagcaccagaatatcaatctgtgcctttgaggagacagcgggaacagtacaagaggattcaggagcctcagcctgaatcagagacccgacaaatcgcagaatgtatctaccacttggtgagattctgtccacatttacttcacaatcatctacacagatctggtgacaggccactctgcataagcgctctgaaggctttaggcaggtactggcaagtctgggtttcaggcagacagcatgttagaacgagcaggacagggagtcacatctctcagcatttgcatctcacctactagtgtgtgccctggggtacccatccccatgaactttcgtccatttttttaaaatggaacgtttataccaaagaggtcgttgtgagggtcaggtgaaataccaaacgatgagaataagtgtctcataattgtgagagcagcttacatttcacatagtgactattacagacacttaacaaaatgctttacaggtgacaacttatttaattttcagaataggaacacgagttactagtaacctcctcctgttcgccgtcaacctcatccacgcacatttcctcttcccggcccgcaaccccgcggggcccggcagcccctacacctgcggacaggactcggcctgggcccgcgcactgggccggggaggagaggggagggccatcctggggactcctgagactgcctgctgctgtcctccgcacacaagcccgcccgtccccaggttcctgggccgcgcggagccctgtcaccgacgctctcaccccaggtgcgcagcctcggctcccgcgcagacctaaagactcggacaccgtgtccctttcaggcccgggagggcagacggcaggaggtggggctgggtttacacatgc

SEQ ID NO: 645 - DNA, 34987 bp, Homo sapiens
agatcaagatgcgctttaactgagaagcccccaaggcagaggctgagaatcagaagacatttcagcagagtgagtggggctccaggcagggtggggatggggcagcctcctcagtgcccagatctggaagggtcattccctgggtaccatacagcgaggaggtgactgagggattgtttggggaaggagccccggctgggagtggaagtcccggctttcttgttatggtgcagtcctgtgttgctgtgtgacacaggcacatacaccttctctctgggcctcagtttccttacctgtaagttggttgttgggaggaccagcggtagagcagagatggcagggatgcactgggctgggctgtcagcagaccatgggggtgggacgaggagagagctgaagaccaccggcagtggaccacagggggaggcatgcaggccagagacgggtcagctgccggcttgctggagtcattcctcccacgcagtcccctcctgaggggctggagctggggctggagggtttcagcagtcagggctggagataagagtctgtgctggagctagagggaactgggctagagaatcaggaggacagacagggtgaggggacttcgggctaccttcatgctgtctgttagagataaagataggagtacaaaggggaatttttgggtgaggtacacgggtgaaatgagttttcagggcctcatcctgtgtgttcaccttctgtgtgtgtgtgtgtgtgtgtgtgtgtgtgcatgcgtgcatgtatgtgtgtgtgccggtcctggacagtcacagcttaagttagcagcaagagaacttgaggttaaaggtatagcacgcaaatatgaggctggagccactgagtagaggctgagggcatctccacagtccaaagctgggctgcagacagggaaggtcagcaggagcactggagggtctggcctggggttggggtcctggggccagcatgggtggggtggggctccagggcgtcgcctcattggctgagcaccgctcctccctccctgttccttggctgggttaagggagtggcactagcaggagctgccccagggcttctcccctggggacaaagatctgatggaagtgtggggccaagttctgtgtcctccagccctagtgacctctctttggctcctcagcatctacaaatctgaaggacaaaacatggttcaagcatctgggcacaggcggtaagtaccccaccctcttctcaccctccagccccctgtcctccacccagcccacttcagtgccctccctgctccatcctcagcctctcccttggggcagctgtcccccctcgacctcctcctccccacccacccactcgcctctgaggtcccagaagaaaagcatcttccacctgttgcctgggctgggtcctggggtgaggggaggctcagaaatacttggatgagggtcaaggcatgcaggtggccttcaactcaactgcactcagcacctctcaccctctcaggctcagctgtctttggggtgaaaaagagccagtccttgcaatggccaaggccctgcctatgtagtccttgttagctttctggcctccccactccagccccctgctctccctcctccagccacactgagtttcttttctggtttttttttttcttttctttttttttttttttgagatggaatccagttctgttgcccaggctggagtgcaatggcaagatcttggttcactgcaacctccttctcccgggttcaagcgattctcttgcctcagcctcctgagtagctgggattacaggattacaggcacacactaccatgcccagctaattagttgtttgttttttttttttttttttttgtatttttagtagaaatggggtttcgccatgttcgccaggctgttcttgaactcctgacctcaggtgatccacccacctcggcctcccaaaagattgggattacaggtgtgagccactgcacctggcctcacactgactttctttgctttcttcaaacatgctgagagtcctctggtgactattccctccatctgagaggctttctgcagttaacatacagcccactctcatctccttcatggctttgctccaaggccaccttctcaacaaggattactctgactgccctatttgaaatcacaccccatctccagcccctgcactcccaattcccctctccttgctctgttttttcccataggagctggtaccttcgcttatacaaatgtacttacttattacatttcattgctgtcagctccacgcaagcagggatatttgcctgttgtacacttggacggagagaatgaatagtgcccctctgttgacatcattgcctctagcctacgtctctttccagggctttagatcctgtttctagagacccactggtgtctcacaggcaactcagctcctagatggaaacagcctcctccgccccccacaagtccactcctcctgtgctcttggctcagtcaggggtccccttctcttcagttgctcaagccagaagtcaaggtcatgtccttgatacttccctcttccccatgcctcacatccagtcaccaatctcctaaaatatctagaatgtgcacagcttccaccattctttctaccaccaccctactcccccatggccatgtcaggccaccacccgcccattcttcaaaactcccttcaggcctcacctcccatgcctcccctgagttcccccagtcccaggctgcttctctctggtggtgttgccattacccatctcttctattaaacagagtgacccaagagtggagagtgggttttgactttgtatccctggtgcttgactcataagtaggtgctcaacaaaaattttttctttttttgagatggagtcttgttctgttgcccatgctggagtgcagtggcatgatctcagctcactgcaacttctgcttcttgggctcaagcgattctcacatctcagcccccaccccagctgggattacaggtgcctgccaccacgcccagctaattttttttttatttttagtggaaatggggttctgccatgttgtccaggctggtcttgaacttctgacctcaagtgatccacctgcctcggcctcctgaagtgttgggattacaggcatgagtcaccatgcctggccaacaaatgtttgttgaatgaagaaatgttggttagcaggttgaattgttggctcgtggttagttggatagtttatggttgactggttgattagataattcaatgagttaatagctggttaacaggagaatcagttagttggtttttgataggttagtcaaagggttaataagccaccgggcatgttggctcatgcctgaaatccctgcaccttgggaggctgaggctggaggattgcttgagtccaggagtttgggaccagcttgggtaacatggcaaaaccccatctctacaaaaaataggaaaaaatagccggtcatggtggcatgctcctgtagtcccaactacttgggaggctgaggtgggaggatcacttgaaccctgggaagtctaggcttcagtgagctgtgactgtgccactgcacttcagcctgggcgacagagtgagaccctgtctcaaaaaaaaaaagaaaaagaaaaagaaaagaaacaggcgttagtgagttgttagctatttagttccttggttaacagattacttaggggatctggttggctgtcagtttcttgctttgtaggctggctttcttgggcccctcttcttagtctgtaccctctccttgagctctctcatctatgcccatggctcagatgaccatctgtgatttgctgtcctccaaatgtgtctgtaagtgagaccacatgaccagctgcctcctcactggccatcccacccaagtgtctagcaggctcctcacactcaacatgtccagaaagggcctccttgtccattcttccacagcttctctgctgtgccccacgctagtcattccgctgccctagccaggacctgagggcatcgctgagctgccccgctcccttccctctctaaccgaacaccaagcctgtcagcttgactgtgttcttgtggccattggcactgccatccttgtggctcagactgccaccacttctccacccatctgtggagaagctgatgctcaccctgcctccactccacttcctccatcctggcctccacaggggaggcagctctcctgctgaaaccctccacttggcccatggccctctggtagagttcagactccctaatgtgggccatgaggccttctgccacctggccctggcccctctctgcccatctcatgccacctccactcctccgtggccagcccattcctgcacattggatactgccttagctgcaggcctttgcacatgccagtcctacgcccagagtgatccctgcctccctggaggctcctttaccctccagccttcttttcttgacctgaatttccctttctctgggagcctcctaccccctcctctaggccattcacttcctccacatgccccacagtgcccactctttcagctggggcaatgctcatcacactgcatagtaattgctcaattgattgcttttcttcccacaggctggattgtaccagtgtcttttactgcagtgactgaacattctaggcacagtagattcaagaaatcttgagttcattggctggttggtggttatctgttgcttactgtgtcttgcctgctgtgtggtgatgaggaaggagccaggcttccaggattctcttggtgttcttgtctttccgctctgtccacttctctctcctcttctgtggttacctccagcatgggaggtggggttggatgggagccagtggagggtcacctcgccctgctagggagagcagcagcattcctcagggctcctaaattcccctgacctcacagcagcaaaaagtaagcagagggaatgagagacgtccaggcatggaataaaacatcttccacttttcagctgagaccctctgttcatggctcacccatcccagtccttgctctattccttactccagagaaacaaaaccagggatgagtagatggagggggatgcagagttgcgcggatattccactggcccccatccaactccagctcccatgcagcatcgtataggggtctcattatcccatgaccagcctcctcagccctgaagaagagaccctatcaatgcaagcagcagcccaaagacagtcctgggaaggtaccatagaggcaggggagaggtagacagagcagggagccaagaacaccaagggaatcctggaagcctggctcctttctcatcagcacagagcaggcaacaaccagccaaggaaccaaagatttattgaatctactatgcctactatgttcaggcactgcagtgaagcaaactggtatgatcccagcccttaggaagaaaaaccgttaattaattaagctttttttttttttcttttttgagacagggtgtcgctctgtcacccacgctggagtgcagtggtgtgatctcagctcactgcaacctctgccttctgggctcaggcaatcctctcacatcagcctccccattagctgggaccacaggcgtacaccacaacacctgactaatttttgtattttttttttttttgtagagatgaggttttgtcatactgcccaggctggtcttgaactcctgggctcaagcgatcagctcgcctcagcaagtgctgggattacaggcgtgagacactgtgcctggcctaactgagcaattactatgcagtgtgatgagcattgccccagctgaaagagtgggcaccgtggggcatgtggaagaagtgaatggcctagaggagagggtaggaggctctcccagagaaagggaaatttaggtcaagaaaagaaggctggcgggtaaaggagcctctggggaggcagggaaccattctcggtgtaggactggcatgtgcaaaggcctgcagctaaggcagtacgtgatatgcaaggatgggctggccagaggagttgaggggctggtgtcagcttccgggcatgcagacagtgagatagcagagtgactaaggccacacttagaggtatctgtatccctcttcttcctctttttttttttttttttttttgagatggagtctcgcacttgttgcccaggctggagtgcagtggcaagatctcggctcaccacaacctccatctcccatgttcaagtgattctcctgcctcagcctccgaagtagctgggattacaggcatgcgccaccatgcctggctaattttgtattttttagtagagatagggtttctctatgttggtcaggctggtctcgaactcctgacctcaggtgatctgcccactttggcctcccaaagtgctgggattataggcgtgagctaccgggcccagcccctcttcttcctctttatcctccagtcccaccccgccaccttccccaaactccagtcctatacctctccctatacgcagatttggaacctgttactcacctgtttcatctacctttccatctaaccgtgcacttaactaaatataaatcaagtgccaggccctttggcaagctctgaggatctagttgggagtaagacagattccccagttttcacccattcaacaaatacttattgcacatctactatgtgcctggcatggtgctgggcactaaagatacaccaggaagtagatccagtccttccttttctccctcccgctctcttggtcattcattcattcattcactcactctctcacaaacctctgtttgcactgacctggttgcacagcctggtgcattttgctgaccccttcatttttgacagaacctggcgcatgtttcagtgctcagtgctgtttacagagctcggcagcagactttgtcacacttcatgctgtttgtagagtgcctcactgttgccaggccctggcctgtgaccccaaagttctggctctagcagataggcagacagacagatggacagacatagactactgagctctactttccagcctgctctctcccaccctactttttcccagaggcttgttggcaccgtggattgcactttcagctccccacctgtccgtctgcaaagtggcctcattggtgtgccatttttactggtccagtcccaactacaaggggcatggcttggccatctaccccagttcctctccatgtccccatggctctcaagtgtctccaattccagctgtcccagctgccccgggcaagaggaggtgtgtgtggcaagtctgctgggttacctattaactcagctgtgagttgaagagccgatgggcagcaggcagacttgagtctcctttctgtccatgagctcgggccactgtatcaggtccacccgtggctccaaaatggtctcctggtccgtgatagcaaagatccaggaaatatgatgcgaggaagatgagaggaagatggcgcgagagttcctggccgagttcatgagcacatatgtcatgatggtgagtgggcgggcagcacgaagtgggtgggctctgccagggccttccatgaccccctccccattctgaccccatgggtcacattgtccattccttgcctctgagctgggagcctggggaagcagcgaggaaagtaaggggggggggggctttctcatcaagtctttttggacagaaagggctcataatatgtgggggtcaaatgaaaccatgcactggggtatccggggcaaggctggaaatggggagaagggaaacccagagtaaagagattgaagaggcccaggtgcagtggctcatgcctgtaattccagcactttgggaggcttaggcaagtggatcacctgaggtcaggagttcgaaaccagcctggccaacatggtgaaaccccgtctctactaaaaacacaaaaattagctgggcatggtggcggacacctgtaacctcagttattcaggaggctgaggcaggagaatcgcttgagcccaggaggtggaggttgcagtgagctgagatcacaccattgcactccagcctgggtgacaggagcaaaactctgtctcaaaaaaaaaaaaaaagaaaagaaaaaagagagagagattgaagagaaacttgatgatcaggctctgataatgaatccagagggcaatgggcgatgttgaaggctggcaagcaggggagtgacatgatcagatttggattttaaaggtaattttgggtgcagtgtggagcataagcaggacaggcaaggctggcaagaaggaaccagttaagaggctgtttttgatctgggacagagagagggtgatgactgatctggggttggagaagaaagcacatgtttgagagggctgtggaagatggaatcggggagactctgccagcagaacatgtgggcaaagcgccgatgagctgttctggagcacggggcccagcacagggtgagaggcaagatgcctgtagggaaatccaggagatagttaaacacaggcaagggtctggagctcaggagaggcttggtctggaaggaaaaagttgaagttcatcacaacacaggtggtggttgtcaacactgtctagaaggagtgtacagaaagagaaaaggatggtttgaggacagagccctgaggaatgaagaggggcacgcaaaggagcctgagaaggaatggtcagagaggtgggaggagaaccagagccgactgcatgacagaggggggcagtggttccaccaggaagaagccatcagcggcatgggcagcggcagatgggccacgcaaggtgagcactggcaaggggccttagggtttgccaatgtggaggttgctggtaaccttgacaagggctcttctttagtgtgtgattgggacagaatccagactgcaggtgggatgtgaggttgctccctctccacctgcttcagccctgccacttaccccagtgagcctctgcccttaacatgactgtagccatgtttattgcatcttatgcagggtccagggtctagagaaagaaggggcagcctctgggaagggaggcaaaggcagccaggtgcatgctagaggaaggtggggtgagagaggctgttcgtgtgtgtggtggggcccatggagctcaagggagagaggaaattggaacaccaggtttcttagcctgaccctgccactgagtgaccagttgccttgggcaggtctctccctggcttaaagcctgacttctcacttatatcgtgtagaattaggccttcgtgggctttggagctgtgtttgaatcctagctctgttatcttctagctgtgcgactatccacaagtatcttaactgttcacaaatttagctttcttgtttttgagacagggtctcactctgtctcctaggatggagtgcagtggtacgatctcagctcactgcagcccccacctcccatactcaagtgactctcttgcctcagcctcttgagtagctgggactacaggcatgtgccactgtgctcagctaatttttctatttttagtagagatggggtttcaccatgttggccagactggtctcgaactcccgaattcaggtgaccttcctgcctcggcctcccaaagtgctgggattgctggcgtgagtcacctctcccagcccacaactttagcttccttattggttaacaggaggacttgtgtgaagaaggccaagtctcagcacccagtgtggtacccatgtattggtcccttgttattaggacgggtgctctagctgctgtctcctctctgtctctggccctcccctactcctctcttacctccccacctgctttggctcctgagctgtgaggacagcagttggatcctgtccctccttaatccagggcaaagtaattcacttaccacaagacattccagccccatgagggctgttaacccttggagcctcggaggcaggagggtgcatcctctgagagctgttagggaaataggcaccgcccacatgcttgatacctgcccacatctgtgttcctcttccttttgttgagattttcattgagcacctaatgcatcccgggctctgtgatgctaagccccttacgtgcagcatcttcccaaatcctcgcaatagccctgtgaagtaggtactattattatcccagtttcacagatgggaaaactgaggctccttgagactaagccttttgcccaaggtcacactttaagtcaagattaaatccagtgcagtctaatatcacagtcttttttgtttttgtttttgtttttttgagatacagtcttgctttgtcacagtggtgcaatctcggctcactgcaacctctacctcctgggttcaagcgattcttgcatctcagcctctggagtagctggaattacaggtgcatgccaccatgcccagccaatttttgtatttttaggaaagacaaggtttcaccatgttgtcaaggctggtcttgaactcctgacttcaagtgatcctcccacctcggcctcccaaagtgctgggattacaggcatgagtcaccgtgcccagcccaatatcacagtcttgacccttaacctctatgctctgtaccttagcttaaatattgccagcttttaaagactcgcttgttaatgctcccccagccagggtaaagtcctcactttcaggtagttcaagatgcctctctcggcctcagtttccccatttatagagtgggagaaaaattcttgctgtgcagatttgttgtgaggattgaagacagtagcacttgtaaaagaactttgtgaggcgtaagcctaaatcggatattgtggtgttgttatttttagttgccaggctgtgccaagaagtgagggcttttttttttttttgtaaatatatatataggaatctcagtgagtcaccagggtgaagttttgccaaaaaagctagtgtgaccttggccccatttattgcagccaggacaagggaagtggactgatccgtgttgcagcttccaggtgtgttgcccttggagctggcctcctggctgtgggggagagttggatgggctgggccacattcactgatcagggagaggaggggctggagccatccgggccctggaaaaccagccatacacatgagacacggggcaagggttgtagatcacatgctacgggggccaagagagcggcaactcagggcggtggggactttggctggctgcagagtgccaatctgtgcaaggctgtagagctgctgccactccagctgactgttgccatggagggtggaatgcaggccagtgttgcttgagctgctcatttttcaagagagacggaaacttctgttcttcaaaaccaagttatctaaacaaaatctgtgcgctggatgaattaggtgcatgagttgccagttggcaaccctgacacaaggaatcatgtggggttcattcattcacccagtattttattttatttattttatttttttgagacagagtctcaccctgttgcccaggctggagtgcagtggtgtgatctcagctcactgctctgcctcccgggttcaagtgattctcctgcctcagcctgccgagtagctgggattacaggcatgtgccaccacacctggctaattttttgtatctttagtagagacggggtttcaccatgttggctaagcaggtctcaaactcctgacctcatgatcggcctgcctcggtctcccaaagtgctgggattacaggcgtgagccaccacacctggcctatgctcatccagtatttttagcacatggtattggaatgcgggaaaggccatgggggcccctctgttttcagaccctccatgcctcctccagtccctctacctcttgaccctgccagcctgtcaacctgtcctgacctcactcccccctgcacccccatctgttcctgtcctctcctgctgtatcttatcctggatctgaagccagcctagctctgggctcccctgctcctgtcctggggcttctgagggacccagtgggccctgctcagctgcctctcccccaccatatctgggctatttcacattttctcagacttccccaaagctgctctgtactctttttttttttaaatcagcaaatggcttgatctgctgcttgataggtaaaataatcaacacttcctatgttcagctcaccctcttgtccctcttaccaccagacccattaaccacccgtgtatccacatatcaccccttggctggggtggggtcctctccttcctggaggacacctccacttctgcaccaatccagctgtccagcctattcaggtactttactctgtcctttttctctgtcctttatcttcagcccatccctctctcagcctataaacatactgaagtttctccactgaaaacaacacaaaatgaaacatccctcccttcaccctgtcagccccttcacgggatcatgttctctcttccccgctcctcaggcgaattctcgaagaggagtctacactggtgcctttcaactcttttttttttctttttttgagatggagtcttgctctgtcgcccaggctggagtgcagtggtgtgatctcagatcactgcaagctccacctcctgggttcaagcaattctcctgtctcagcctcctgagtagccgggattacaggcaagcaccaccacgcctggctaatttttgtattattagtagagacggggttttgtcatgctggtcttgaactcctgacctaaagtgatccatccacctcggccttccaaagtgctgggattacaggcatgagccaccgcacccggcctggtctgccttcttaccttgtaccctctcctggggccttctcctctgtcggctttgactttggcccttatgtctacaattcttcaggttttctcctttatcaactctagaacagagttctccaggggaaatacaatacaagccatctgtataatttaattttttctagtatccacattaaaaaggtaaaaagcaacaggtgaaattaattttaataattaacccatatagccaaaatcctatttcaagatgcaatcaatgtaaaattattaggatattctggccaggcatggtggctcacacctgtaatcccagcactctgggaggctgaggtgagaggattgcttaaggccaggagctcgagaccagcccgggcaacatagtgaaacctcatctctacacaaaataaattgaaaaacttagctgggatagggctcaatggctcatgcctgtaatcccagcactttgggaggccaaggcaggctgatcatctgaggtcaggtgtttgagaccagtctggccaacatcgtgaaaccctgtctctactaaaaatacaaaaaaatagttgggcatggtggcatgcacctataatctcaactactcgggaggctaaggcaggagaatcacttgaacccgggagttggaggttgcagtgagccgagattgcgccattgcactccggcttgggcgacagagcaagactgtctcaaaaaaaaaaaaaaaaaattggctgcgtgccgaggcacatgcccatagtcccaactacttgagaggctgaggtgggagtatcacttgagcccaggagatggaggctgcaatgagccctgatcatggcactgcactccagcctgggtgatagagcaaaaccctatctcaagcatcaaacaaacaaacaaataaaacagaggcacaagaaagcaaggcatgcatggagcagcgcagttgtttggtttgaggccatctggcacaggtaactgcctggatttaatcctggctcaccatgtacaggctgtgtgaccttggacaagccattcaagttctctaagcttcagattacccatctgtcaagtgggggagaataatagtgcttaactatcatttgcaacatctgagtttctggctcggccaacggggatggggaacatagagtgaggagcaggtgtgctgtgagatggcgaaccttcaacagagcctgagacgtccgcggaacaccaggagagttgcagtggggatttgcaaataggcatctggctcccccacggagatgacgggaatttcagcgcatcaggcatagctgagactgtctacgtggtaaaaccatgcctgaaaagacctttggaaaatcaggaggttgctggagcccttggagagagctttggtgtctgtgacatgtggaaatggaagccagattgaggagggggtgcgagggaaggggtgaagcagctggccagtgtgttctctcctgcagcctgactgaaacagggagggggcaaccaggaacccacagctggagaaggacactgggcaggggtgggacagtttgctgggaaggatgagactccagtgtgtgggaaccgatcaatgggaggatggaaggtatgggggagacggaggcctctgcagagggagaggatagcacaggagccagggctgaagggaacagtggctctagactgagggtaatgggcctgaaggtaggccccttcccctgtgaaggcagcattatctgaggagccgtgagggatgggcaagaagcagcagcttgggaatgccgcctgaggtcagtggaaatgaagctgagggcaagacagttaggggcccactgttccagcattgtgggaattgcggtggagtgtgtgtgtgtagggaggggttcctggcagagtcaggcatggatggatttggaggtcccttgaagaaacttccttcaggtcagcctgaagtgtgagggactctgagggggtgcaatgcatgccagccatcccctcctcgcagccctgcctcaccccaaaacttcaggtgggcctggggctgaggtgcttggatgtttgtagtaagagcttctaactctgccgctccacccggctctcagtggctcaggtctgagaggcctcagcaggggcaaggagaggaggcagtgaggagggaaggctctggaggaagagggcatggcagagggtcttcgaggcaacgccagggaggcccagggcatgagggtgaggagctagaactgagctctgagccctcctctgaggttggggcttctgggcaggcagcccccttagaggccctcccttgtaggtattcggccttggttccgtggcccatatgcttctaaataaaacatttgggagctaccttggtgtcaacttgggttttggcttcggagtcaccatgggagtgcacatggcaggccgcacctctggtgagtgagcccaggccctgccggaccgggcaagaccaggtgtccccaacaggctctttcctgcccgcctcagccagctcctttgccagcacagccagtgcctcagcctggccaccgggcgggaggaagtctcctctgaaccccgtgcctatgacgtgtctgccccagattcttcctggcccccccgacctaccattttcactggctgggtcatcttaggcaagccatcgcctctgtgttcctcagtttccttaagagtgaaaggaagacggtggcccctgcctcacggggtggttgtgagggctcaaggagagaactctgtcacggagcatgctgtcatacacactagccatcgttgttctcatactgtttgtcactgttgtttgttctgctctcactccctgacacacttgcctgctgcccgcaggagcccacatgaacgcagctgtgagcctcactaactgtgcactgggccgtgtgccctggaggaagtttccagtctatgtgctggggcagttcctgggctccttcctggcagctgccaccatctacagtctcttctacagtgagcgtcctgcccgggtgtccgcctctggcctcagctgcctcctatgaaatatgggcagattggacctcagtgtcctgatttgtaaaaaatagctgggagaaaaaagccttggaggtctcccaccctctaacctataacctaatttccgggaccctggtggggcttagctggggacaggttcgcatgatagtctgtgtctccacagcggccattctccacttttcgggtggagagctgatggtgaccggtcccgttgctacagttggcatttttgccacctaccttcctgatcacatgacattgtggcggggcttcctgaatgaggtcagtggtccaggatgagtacccctccccctgccctccacccctcaggacggagccagcagggagtccctccggatagacaggacaagaactctggatggagactgtaccaagatgtgtctctgctggtgggcttgggtctggggcactgccgaggtcctgtggcttggggaggggcccaggtgagcttccacagcatctgctcctcaggagtggctgaccgggatgctccagctgtgtctcttcgccatcgtggaccaggagaacaacccagcactgccaggaacacacgcactggtgataggcatcctcgtggtcatcatcagggtgtaccatggcatgaacacaggatatgccatcaatccgtcccgggacctgcccccccgcatcttcaccttcattgctggttggggcaaactggtcttcaggtactgcccctgcccaggcccattcctttgagattttctgtggggcccctgtgtgttgaggtgtggggggtgatgtgaggggcagcacaggagggtcctgcagagcccccaggtggcctggggagcaggagtgagtcccaacatttccccaggccagtacagatacagatcctgcacctgcactgagtgtcaaccctgtccctgaatcgggctgaggctgaccagggccccgggttgggggtgtttcctgggttagcctgaggatgactcctctgctcaaccagtcttggcccgaggtggatgagggtgctgtcctgggcatcagccccctcagccggcctctgcctcttgcctgcagcgatggggagaacttgtggtgggtgccagtggtggcaccacttctgggtgcctctctaggtggcatcatctacctggtcttcattggctccaccatcccacgggagcccctgaaattggaggactctgtggcatatgaagaccacgggataaccgtattgcccaagatgggatctcatgaacccatgatctctccccttaccctcatctccgtgagccctgccaacagatcttcagtccaccctgccccacccttacatgaatccatggccctagagcacttctaagcagagattatttgtgatcccatcccttccccaataaagagaagcttgtcccacagcagtacccccacttcctgggggcctcctgtggctgggcttccctcctgggttcttccaggagctctagggctatgtcttagcccaaggtgtagaggtgaggcacctcaagtctttcatgccctgggaactggggtgccccagggggagaatggggaagagctgacctgcgccctcagtaggaacaaggtaagatgaaagaatgacagaaacagaatgagggattttcaggcaagggggaaggaagggcagttttggtgaaaggactgtagctgactggtggggggctggctttggaaatactttgaggggatcctgagactggactctagactctcccctggttgttcccttccccgagttctggccggttcttggaccagacaaggcatggcccaagaaggtagatcagaattttttagcctttttttcattagtgccttccctagtattcttccagattttttttcttaatcacatgaaattttaataccacagatatactatacatctgtttatgttctgtatatgttctgtgctttatacgtaaaaaagagtaagattttttttcacctccccttttaagaatcagttttaattcccttgagaatgcttgttatagattgaaggctggtaaggggttgggctcctctttcttcttcctggtgccagagtgctcccacatgaaggaataggaaaggaagatgcaaagagggaaatccttcgaacacatgaagacacaggaagaggcctcttagggctccaagggctccagggaagcagctgcagaggttgggtggggtgaggggccaggatccactgaccctggggccaggcaggaatcactctgttgcctggggctcagaaggcagtatcacccatggttcctgtcattgctcatgtattttgcctttcaacaattattgtgcacctactgtgtgcaggccctgcctggacactggggatgcgcagtggatgcactgggctctgcctttgagggttgcagtttaatgggtgacaggtaattataaggaagaaggtgagtgcagagtgggaggcttggaggctgtggggcttggggtgggggagctcacatccagcctctgggccaaggccaggaggcttcccagaggaggagacagagcagggtattgtggtggggggtgtcctttttggggctgggattgcactttacagtttgaggggatgggcagaggaggctgggcttcattctggaggtggggacatggtgaggtgaggtttagaaagcacacctgagccgcagtgtgtaggatgctggaaatggtggagatgggcctgcgaagagagtgctgggaagtgatgacccaggagcagcagccgggcacctaacaatgggtcagcaccgtgggcgtggagacaagggccgggattgatcaatacccgagaagtacaatgtacaggacttgggctccatttggatggagtgggtgagggaggagtcagaaatggcttccggtttccagcttgggcctggggattggagatgtccccactgagagtagggcacaagtgaggaaattgtttggagaggaagatgataagttacatcatggatgtgctgagtctgagttgcctatgggacttggaatggggggtggcaaaaggtgtgtgatcttgagcaagatattcaactcttctgggccttggtcttctcatttgtaaaacggtgataagaatattacttcccatttgtgttgctgtgaatattaaatgcgctaccacatgtaaaatgttgagaatcgtttctagctcagagtaagtgctcaataaacaccattatgccttttatatggtctggagctcagaagtggaagacagggttttgtgaagtcatggctttgtggatgtagctagattgtggagtaatggcaggagggtcgggggcatggcacaaggtaggtggtcaagagacactggacacaacccaaatgtccatccacaggggaacagatacatacactgctgcgcaattgcacataatagaatcctctacaatagcaaaaattaaggcacaacagacacctgcaacaacacagaaaaattctggaggcataaaaagtaatacagtagctgggtgtggtggttcacacctgtaatcccagcactttgggaggccaaggtgggtggatcacgaggtcaagagatcaagaccatcctggccaacatggtgaaaccctgtctctactaaaaatacaaaaattagccgggtgttatggcacacacctgtagtcccagctactcgggaggttgaggtgcgagaactgcttaaacctgggaggcggaggttgcagtgagccaagatcacatcactgcattccagcctggcgacagagcgagactcggtctcaaaaaaaaaaaaaaaaaaaaagcctggtgtagttgggcacctgtaatcccagctgctcaaaaggctgaggcaggagagaatcccttgaacccgggaggcggaggttgcagtgaatggagattgtgccactgcactccagcctgggtgacagagtgagactgcgtctcaaaaaaaaaaaaaaaaagtaatacggtagactatatacagtgtgacacaaacttgtagctgaaaaataagcaaaaacacattctttgatatatatatatgtatgtaagaaaactactttagaaaaagaaataattcctacaggcagatggggaagaacacaggagtagtacaagctattaataattttctagttttggagttggacatttgtgagtttattatatgattgtgcttgataacatataaatgtgatacatattgtttgtatgagatatatatatatatatatatacccacacacagatagatgattgctgacaaggagtttctaaagatcatatatatatttttaggtaaaatagaataacattctgcttctggtcttcataataaaagagaaatcaggactaagaaatcaagtgtttattatatagagttttaatttttattcttttatttattgatttatcttctttaggcatgtgcagagatgaactcactaattgttcaaaataaacaatttgaattcaaagcaaagtatatttttggaatatcaattatcacttattgcagataaatgataatataaaacaccaactttggaatttatttgttttacttctgtgactctcagccttctttttaaaatatagtgtatgttttaggtaagttcagacagcagccagcactacatttggtttaaaatccagctttataatgacttcatctttcaaccagccaaagggtagttaccttgtgtctgccatcgtgcatatgctctcagctcctgactgagaaaacatgcctgcaagcacttccctgcctgagattatattaaaaatccatacctgtgctagcagcatgagttcaagttgattattgttctagatctgtgacttcccattcatcctcctaaagatataaatgattgcttttcaatagaccacatacttaggaatgattatgaaggcaaggtttagtaacaataatatacatagtactctaatgggattgaattggaacacccacattaaactctcttaaaatatatggagcagaacacatgagagaaagcaaaagaacaagtgcacacagcagagctgcgagttgcatactctgtgcatgctaataccatcgcaacaacatcactaaggcttctgggtaacgtttgccacatcatattgtgacgtgcatttgtttttatattttaccctaaaaggcaaaataactctccatgtgatgaaagaaggagcacacacaaaaaaaaccctctcagaaatattaaaatggttgcaggtaattcaaatggtatactgttttaaaaggtacttgtctaacactttaagttggaaaagcatcttggaagtcattagattcatatttacattacttgaattgtgaccctagcttgacatttccatggtgggagacatattttatttaggaggcagcagtctatttagtttttgagagcttaatcgatagatggttcagattttctactgaaccaaaatctaaatgcctacccattggttttcgtagccaacgtcaatatccaactgctctttcatacaacatggcttcaaaggctatgtaactaacatcatgccactgcacctatgtctttttaaagccaagtacctctagtgcccctcattatagctcatatttcaaggtatctttcagcaacaatgaattgcattaatcaaactcactttttttgcgtgtgcttcactttatagctcttcacaaataacacatttttcacaaattgaaggtttgtggcaatcttgcatcaagcaagtctattcattctatttttccaacaacgtgctcaccttgtgtctctatttgacattttagtaattatcacaacatttcacattttaaaattattattattattttaaatattttaacttttaggttcatgggaacgtgtggaggtttgttctttaggtaaattcgtgactcaggggtttgatgtacagattattttgtcacctgagtagtaagcatagtacccaacaatttttttttccctgaacctcacccatctctcatcctcctccctcaagcacaccctagtgtctattgtgctgctctttcagtcaatgtgttctcattatttagctcccagtgataagtgaaaatagggagtattgggttttctgatcctgtgttactttgctaaggataatggcctccaagctccatccatgttgccgcaaaggacagatctcattcttttttatggctgcatagtaattcatggtgtatatgtaccgtactttctttttccagtctaccactgatgggaatttaagttgattcctgggtatctattacctaaattacatataaaagcagaaaagaaaaatgacaagtagaacatgaaagttaaacagtatcttttcaggttcaatgacataaatattcttattatctaaaggtataaagtctaatgttttatttcctatagtgcttttatagcaaaacacttttcagaattagataaaccagattgaggccccagtcttactacctattagctaggtaaacttgagctttgggattttcagattcagatcttgcaggcaaataagatttatttgatattacttgaggatgacaatgtctatcttgcagattattatggtaatgagtttatttatgtggattgttttaggatattttaaaactatgtacagacctaaaaaaatcctcataatctttgcagaactgggaaggcatacaggcataatacaactgtaagagttactgtttctcatgcttttgttttctaactgctctggccactgttttagaaggaagggtgaatatatgtaaatattcctgaaaaaataaagttttagaatattaaattattacatatttcattcagaattttttgaaaggtaaaaccaatgattgaacgtagttcatgggatgatctggtccatattcatctaccatgatttaacaaattttttttctcatctattgatgaggaaaaaattaaggggaaatgtagaaatgtaaggtaaatgatctgcaaagaaatacacacaggaggtatgtgggaatgtaacagtgtaggtccgcaggcaaactaggtgaaggaggaaggtgaggaagaaaggaatttaagacttactctttctgttttcttctcaattttaaagcctgatggaatataattttctctacagtaaatgttgaatgaaaatcagttttgtatgtgttaataatgacttcaccaagagcatttgaagctctgtctatcatattttgatgctcaaaataaaacattgtttttatagcttaatagtctcatacagtcaattattgcctcccctccagactgacactttgaacattattattaacactgctgtccttaaaccatcatcggcctgcagtgcagacaatttattgatagctaataaaacagtgttcagatgctgcctgagtgcaggattcagaattgtcataccaatgcataaccacatttgatcttttggaacaagttccattacttaaaaattatggtttcattttcttatttttatatctagattttaacattatatgcatgcctatataagcattaaatatgttattcagttatgtgtgagtgtaactgaaatttcttgtaaagtgtatgtacagtttaatataagacagattattgattaggaaatagttaacaattaataatagacattggccaacctcaattactaaaccagaaaataagtttatttatttattgtattatttttttattatactttaagttttagagtacatgtgcacaatgtgcagtttatttaaatgtattgactgttttttagtcactacacaaatcatctaaaagaaaatacctcagatgaaacctgcagatccactaactagttatcagtttatcaagactgatcgtgtccactcccttcagaaatcacatggatttgtgcattatgcagatcttttttggtcttccccatcttttcccatcctgaactagaagtagaagcctattgcatttttatctggtactttcttttgcatttagtagaaatacatacacatactacccgaggctactccgcagtacattaaaatttccttttgctttccagtaatttcaaatatctcaactaaatatctcagttgaaaaatcaaagttttaattcttatccatctttcaacataaaaacttttaatattgattataatgtgttgcctgcacttttgttttttttttgttttgttttgagacggagtttcactgtgttgcccaggctggaatgcagtggctagatctcagctcattgaaatgtcccgagtttaagcaattctcctgccttagcctcctcagtagctgggattacaggcaagcaccaccatgccctgctaatttttgtatttttagtagagatggggtttcaccatgttggccaggctggtctcaaactcctgacctcaggtgatcctcccgtctcgggcttccaaagtgctggggttacaggcgtgagccaccctgtctggcccagcactcttaatagatatataaatcttactctattaattgaactaagaacatctttataattttccaaatatcatttataattattaaatattaaaacacatttattctgcttagcaaactttgcatctcctcagaatgcctaaatattttgccatatgaaggttccagtggaagtttcagacaatacattttgatggcaaatggtgaattttcctattgagaaatatgttgattacaagaaataagagagacagtagattttcaaaaccttttcaaactatttcagatgaatattcagaattattttacttatagattgcactcttctaaggcacttacatattctgacaactatgtgtttttgaagcaaattttgactgaattaataaatgacagcacagatcaaaatttaaaaacttacaaaattctcaatagatttcacaattgtgcaaagtcccatgctttcttttaatattgtatacttactatacttttaaggggtactttttaacagttgatttattatcaaataaactttctataatttgacagaacaacataaattcttgtttttctcctttctacctagaacatacatatgatagttgagaaagacacatattctgatcatgaagaaataaacacaagttaaatatgactaagcagaaagatggaaggaccaggaacggtgatgctaacttggaaccacgatgcaggctctaaactcctctacaatcatcctcccttgtgagaaaaatacgtaagtcacttttaaaataaatagaaacctgaacacacttcttagctggtttaagtattttaaaaacattgatgaattaaacacagaaatatggggaaatctcattacttaccttaaattttgaaattttctttacagatcatgagttacttaatgctctttcactcctgagtttacattgtaaattaaagttatgtcagctttaaaaaataaccaattaaaaatgatctaaatttatactttaattttaacgaatagtattatctcttattatttacctctgataaagtccaaatgtttgtaggcctatagctctggttatatacaatgaaatatctttctcatgagtgtagaatatctagattatatttaatgcatttactttttgaggaaaaggaaacccttaataaaatagcttcaaatatttggttttaaaaaatgagaaaacaaatacattacaggacttttggatttatcaccaacatgtgaagggctcagaagttgtcattcctggccttacaataataataataataaaagctatacaaattgaaaatcaatgacatttccacagtgggagacatattttatttaggagacagcagtctatttagtttttgagagcttaatcgatagatagttcaggttttctagtgaaccaaaatctaaatgcctacccattggttttggtagccaacatcaatatccaactgctctttcacacaacatgacttcaaaggctatgtaactaacatcatgtcactgcacctatgtctttttaaagccaagtacctctagtgcccctcattatagctcatatttcaaggttttctgttcctgcattagtttgctgaggataatggctttcagctccatccatgtccctgcaaaggacttgatctcatttccttttatggctgcatagtattccatgttgtatatgtaccacattttatttacccagtctatcattgatgggcatttgggttgatttcatgtattagctattgtgaatagtgctgcaatgaacacacacatgcatgtatctttataataaaatgatttatattcctttgggtacatacctagtaatgggattgctgggtcaaatggtatttctggttctaggacttcgaggaattgccacagtcttccacaatagttgaactaatttacattcctaccaacagtgtaaaagcattcctatttctctgcagcctcaacagtatcagttgtttcttgactttttaataatcaccattctgactagtgtgagatggtatctcattgtggttttgatttgcatttctctaatgattagtgatgttgaactttttttttgcatgtttgttggccacataaatgtcttcttttgagaagtgcctgttcatgtcctttgcccactgtttaataggattgtctgtttttttcttgtaaatttgtttaagttccctgtaaattctggatattagacctttgtcggatggataaatagcaaatttttctcccattctgtaggttgtctgttcactgtgatgatagtttcttttgctgagcagaagctctttagtttaattagaccccatttgttaatttctgcttttgttgctattgtttttggcatttttgtcatgaaatctttgcctatgcctatgtcctgaatggtattgcctagattttcttctagggtttttatagttttggattttacacttaagtctttaacctatcttgagctaatttttgtataacgtgtaaggaagggggtccagtttcaattttctgcatatggctaaagttcttccatagttcttccagcaccattaattaaatagaaaatcctttccccattacttgtgtttgtcaggtttgttgaagatcagatggttgtagctgtgtggtcttatttctgagttctcaattctgttctattggtctatgagtctgtttttgcaccaccactatgctgttttgtttacatgctggtttggtagccttgtagtgtagtttgaagtaaggtagcatgatccccccagctttgctatttttgcttaatattatcttggctctacagactcttttttgtccatatgaattttaaaacagattattctaattctgtgaaaaatgtcaatgttagtataaggggaatagcattgaatctataaattactttgggtagtatggccattttaatcatattggttctttctatcacttcccttcttagctgtattcctaggtattttattctctgtaacaattgtggaattggagttctttcatgatttggctctctgcttgtctgttgttagtgtgcaggaatccttgtgattttcacacattgattttttatcctgagattttgctgacaatggggttgagacaatggggttttctagataaaggatcatgtcatctgcagagacaatttggcttcctctcttcctatttgaataccatttgtttctttctcttgcttaattgttctggccagaacttccaataatatgttgaataggagtggtaagaaagagcatccttgtcatgtgcctcttttcaatgaaaatgctcacagctttttcccattcagtatgatatgggttgttagtttgtcataaatggctcttaatattttgaggtatggtccttcaatacctagtttattgagagtttttaaaatgaagggatgttgaattttaacatgaagtgttgttgaaaggccttttctgcatctattgagataattatgaggtttttatctttagttctgtttatgtaatggattacatttattgatttgcatatgttgaaacagccttgtatcccggggatgaagccaacttgattgtggtggataagcttttggatgtgctgctggatttggcttgccagtattttattgaggatttttgcatcgatgttcatcagggatattggcctgaagttgtcttgttttgttgtatctctcccaggctttggtatcaggatgatgctggcctcataacatgaattagggaggagtctctcctcttcaatcatttggaatagtttcagaagaaatagcactggctcctctttgtacatctggtagaattccaccataattccatctggtcctggtctttcattggttggtaggctatatattactgccttaatttcagaacttgttattggtctattcagggattcaacttcttcctggttcaatcttgggagtttatgtgtccaggaatttatccatttcttctagattttctaatttatttgcatagaggtgtttatagtattctctgatggttgtttgtatttctgtaaactcagtgttcatatcccctttatcattttttattgtgtctatttgatcttctctcttttcttattagtgtagctaaaagtctattttgttaatttttttcaaaaaaacagttcctggatttgttgattttttgaagggtttttcctgtctcaatctcctttagttttgctctgatcttacttatttcttgccttctgctagctttggggtttgtttgttcttggttctctagttctttaaactgtgatgttaggatgttgacttgagatatttctgatgtggatatttagtgctatacatttcctcaatgctgttttagctgtatcccagagattctgggacattgtctctttgttctcattagtttcaaataacttcttgacttctgccttaatttcattttttacccagtagtcattcagaagcaggatgttacatttctatgtagttgtgtggttttgagtgagtttcttaattttgagttctaatttgattgtactgtggtctgagagactatcaagattttagttattttgcatttgcagaggagtgttttacttccaattatgtgatcgattttagagtaagtgccatgtagctccaagatgaatgtatattctgttgtttttgaatggagagttctgtagatacttatcaggtccacttgatctacagctgtttgagtcctgaatatccttgttaactttctgtcttgataatttgtctaatattgacagtggggtgttaaagtctcccactattattatgtgagagtctaaatgtctttgtagttctctaggaacttgttttatgaatctgggtcctctagaattgggtgcatgtgtatttaggatagttacctcttcttgatgaactgaatacttaaccattatgtaattcccttctttgtctttttttatctttgttgatttaaagcctgttttctcaaacactagaattgcaacccctccttttcctgctttccgtttgcttggtaaattttcctccatctctttattttgagcctatgtgtgtctttgcatatgagatggttcacctgaatacagcacactggtgggtcttgactatccagtttgccagtctttgtcttttaattgggacattcagtccatttacatttaaggttaatattcttatgtgtgaatttggtcctgtgattatgatgctatctggttattttgcagacttgttaatgttgttgcttcataatattattggtctgtgtactttactgtgtttttgtagtggccggtaatggtttttcccttccatattcagtgcttcctttaggagctcttgcaaggcagtcttggttgtgatgaattccctgagtatttgcttgtctgagaaggattttatttcttctttgctcatgaagcttagtttggccagatatgaaattctgagctggaaattcttttctttaagactgttgacatgaagtccttgcccatgcctatgtcctgaatggtaatgcctaggttttcttctagggtttttatggttttaggtctaacgtttaactctttaatccatcttgaattgatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgtggcgttatttctgagggctctgttctgttccattgatctatatatctgttttggtaccagtaccatgctgttttggttactgtagccttctagtatagtttgaagtcaggtagcgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgagattgattcttcctacccatgagcatggaatgttcttccatttgtttgtatcctcttttatttctttgagcagtagtttgtagttctccttgaagaggtccttcacatcccttgtaagttggattcctaggtattttattctctttgaagcagttgtgaatgggagttcactcatgatttgtctctctgtttgtctctttttggtgtataagaatgcttgtgatttttgtacattgattttgtatcctgagactttgctgaagttgctcatcagcttaaggagattttgggctgagacaatggggttttctagatatacaatcatgtcgtctgcaaacagagacaatttgacttcctcttttcctaattgaataccctttatttccttctcctgcctaattgccctggccagaacttccaaaactatgttgaataggagtggtgagagagggcatccctgtcttgtgccagttttcaaagggaatgcttccagtttttgcccattcagtatgatattggctgtgggtttgtcatagatagctcttattattttgaaatacatcccatcaatacctaatttattgaaagtttttagcatgaagggttgttgaattttgtcaaaggctttttctgcatctattgagataatcatgtggtttttgtctttggctctgtttatatgctggattacatttattgatttgcatatattgaaccagccttgcatcccagggatgaagcccacttgatcatggtggataagctttttgatgtgctgctggattcgttttgccagtattttattgaggatttttgcatcaatgttcatcaaggatattggtctaaaattatctttttttgttgtgtctctgcctggctttggtatcagaatgatgctggcctcataaaatgagttaaagcaatggaaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcggaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaagtggaaataccatttgacccagccattccattactgggtatatacccaaaggactataaatcatgctgctataaagacacatgcacacgtatgtttattgcggcattattcacaatagcaaagacttggaaccaactcaaatgtccaacaatgatagactggattcagaaaatgtggcacatatacatcatggaatactatgcagccataaaaaatgatgagttcatgtcctttgtagggacatggatgaaattggaaatcatcattctcagtaaactatcgcaagaacaaacaaccaaacactgcatattctcactcataggtgggaattgaacaatgagatcacatggacacaggaagggcaatatcacactctggggactgttgtggggtggggggaggggggagggatagcattgggagatatacctaatgctagatgatgagttagtgggtgcagcgcaccagcatggcacatgtatacatatgtaactaacctgaacaatgtgcacatgtaccctaaaacttaaagtataaaaaaaaaagactgttgaatattagcccccaatttcttctggcttatggggtttctgctgaggagtccactgttattctgatggacttccttttctaggtgacgtggctcttaacaattttccttcattttgaccttggagatactgacaattatgtgttttgggttgatcttctcatggatcttactgaagtcctctgaatttcctgaatttgaatgttggcctgtcttgctgggttggggaaattctcctgaatgatttcctgaagtatgttttccaacttggtttcattctcctcatttctttcaggtaccccaatcagttgtaggtttggtctttttacataattccatagttctctgattatttttcattccttttcagttttttctctaatcttatctgcctgtcttattccagcaagatagtctttgagctctgagattctttcctctgcttggtctattcagttatttatgcttgtggttgcattgtgaagttctggtgttgtgtttttcaggtccatcaggtcatttatgttcctctataaactggttattctggtttacagttcctataatgttttcatggttattagcgtctttgaattgttttagaatatactttagctcagcaaaatttgttattacccaccttctgaagaatacttctatcagttcatccacctcaagcctccacccagttctgtgcccttgctggagaggtgttgcaatcatttggaggagaagaggcattctggctttttgagttttcagcatttttgcattgattctttctcatcttcatgagcttatctatcttcgatctttgaggctgctgatctttggaaggggtttttgtggggccatttttgtggatgtttttgttgttgttgttttctgtttgtttgtttttctttcaacagtcagacccctcttccttagggctgccgcagtttgctgggggtccactccagaccctattcacttggtccctcccctacctggaggtgtcaccagtggaagctgcagaacagcaaggatggctgcctgctccttcttttttgagctccatcccagaggggcactgatgtgatgccagcaggaacactcctgtataaggtgcctggagacccctgttggtggtctcaatcagttagggagtatgtacaggatcggggaccacttaacaaagcactctggctgccccttggcagagagggtgcactgcactggagggaatctcccttgtccagaatgtccagacccttcagagccagcaggcaggaaagactaagtctgctgaaccgcagagactgtggctgtccctccccacaggagttctgcccaggaagatcagagttctgtccataaacctctggctggagttggtgaaattcccacaagggggccccacccaatgagtagggatggatccaggttccacctaaaaaagcagtctggccatgatctgccacagctgctgtgctcccggtctaaacctccctgtctccccagcaccaccaggggaaaacagccaactgatgccacagtgatagcaaccaccccttcccctgggaactcagtcatcttagacagtctccagtctgctgtcactggccacagcctgagcggtgatgagagtctgcacagctctgtgcttggcacccaaggccctggtggtgtggactcacaaggggatctcttgatctgtgagttgcacagatccatggaaaaagcatggttcctcaggaaagggagcacaatcactcactgcctcccttgactgggggtgggagtgccccttgccccatgcagctcccaagtgaggcattgctccaccctgcttttccttgctccctgtgggtcaggccaatcaccttgtcactcccagtgagagaatctggatacctcagatgaaggtgcagaattcactcgccatttttgttcttctagatgggagtcacagaccacagctgcttctaattggccatcttggcacctcctcatttaaccttcttttctcatctaaaggggataaaggatgaaactgtcccaaagaaaagtttataaaccaattaagggagaaaataaaattcaactaggcttgcagaataatcagtggcaatcatgaaatccacttcccaatttggcctacttccttgtagctagttacttcttactcccccaagatagtgtagcccttgtcacaagaatgtgttccttttcttttctatagataagatctaaggcacatgagatgatatgctttctgtttgagtttctcctttatgttacgcatactgataaaattgttgatgccagttgatctgaaggtcccagcaaggagccgactcacagaagaatgcagttttcacatcatgatgatttaatcttccttgacctgagcaattgacaaccccaattctccagaacctcacccgccacaatccccttaaaaaccctggcccagaacccctcaagcagacagatgtgaagcttgaggattccttcatctctttgcccaatggcattgtgattattaaactctttttctgctgcaa

SEQ ID NO: 646 - DNA, 43121 bp, Homo sapiens
ataaaaattatgagctaattattaatataaatattcaaagtaaactataaataccagtgggaaaactaaaccaaatatagttttgctaagttttaccacatttatcctaaattatgattttataacaagtaggtgcctttaaaacattacatggtcataaaaacacgtaatttgacatattttcagatttgttaatatgaataataacaaagctataccaactaaaatacataaaaagctagttaaagcaaggtattacaagacacagcaatacacttcaattcatctggggaatctagaattaagtgtcgaagaaaatcacttaattaaattttaatttgaaaatactcacttcaggtgtaaacatttccatttataactacattatggtcttaacatgtggcaacataaagacattaaaattactatttcagcaatacagaactatctaccttaaaatatgactctgtgcctaataaaatttcataggtgacacaatgtcttttctcaaagtaaatcatctctcacctctatcttttatttcctagaaatgaggcatgtttctaagccgatatagtaaacacatttttcctttttttattaaaacagctttgttgaaatataatttacatactatagaatgtatctgttttaagttaaaagatttttagtacatttactgagttgtgcagccatctctacaatccaactttagagcatttccatcactgtaagattcctcatgcccattagcagtcactaccagcttccagccccagccccttgcaaacatgaatctactttttgtccctatacatttatcttttctggatgcttcatgtaaatggaattatacagtatggtaaacacacttttaatctagatttttatattcaactaagttcaacatgtatccagaaccaaatgtttaaattgtctttctagaagtttgaaaatatttatcttccttgatacttactactccttctgttttctctctctcatactgaaagagactttcttttaaatgatcacattcattcattagcttcttacttttctcttctagcacgaggtctttctttccactctcaataaagcctctttggatattagttactatctctttatgatcctctttctgatgaacgtcatctagttgctgtacaagccacgcattttcacgttggaggtgacatatcctctcttctacacagttccactttccagtggaattattcactttagcttctgcattttgatacatctctttcatttcctgtgtttgctgctgtgtttggcttaggtcgttttgtacagtttctaaagccaatgacttttttctgagactatctcttgtcttacggaacttatcttttaaggcattgaatttaatttgtgtttcagaaagttgttcagtaagaaactcattctcatcttttactttggaaatagcagaactcatttctacttgtacagaaacatctcgtgttctctctaaagcaagttttaggtttctttctgttttcacactttcactgtgtttgcttatagcagcagccagtctagactgataagattcaatgtcagcttccagtcttttcttgctttctttttccttcaacagttcggcattgagccttgtattctcagccttgagataattaagctcttgttgataccggaatgctgtttctgttatcatttcctcattgagttttatatacttttcaagggcagcatttgtttctttaacaattttaatgtccttaagatatttattttctttttccaagttgtcatttttcattgtacatatttcctgtctgagtatagcaatatctgccttcaaaatgcaattttcatccatcagacctttcatttcttcatgattatgaaaatcctaaataaaacaaaagaaagttttagctagtactcaataaaataacatatcatgattacctctgaagttaaagaataacctgcacatccgtaccactaaaaagtttaccataagtggatatccacctggagaaaaagttgaagcaaaactttgaaccttatagagcataaattccagaaagttcagaaatgtatttagagtcaatgaatttataaaagtaaacacacacacacacacaccagagaatttttaagaatatcagaattggaaaagcctttccctgaattacaacaaactcaaaagcataaattaaagcattaacaaatttgactaaattaagatatatcaaaaaattgcatttacactttgatacctaacccatacaccaccctatagtaagaacttttgttcacacatatttggacagataaaatttcccagagttattacagttctgtttcactgataacattctatttcagtttgactcttttaacacttttatagtcagttataagaattacattcactaaatcataaactagacattatactagtcactcctatatacattcattgatgaactcatctagttaccataattttgaaaaagaaatgttaaaaatataagcaagctacaggattttccccaggacttctgactctacttctagttctccaacagatcacagttacttctgtggtgtaaatacatcaatacgaaagaaaacttttatttcaaaatgccaatagtaaataagataaaatttatagagctcttcttagaatatcatgagattatttgcgattgcaataatttctgcttcctctttataatattaggtgcagtaatcaatatgaaataggggaaagtacaaggaaaaattttacctggaacaaaatttttatcaataggttatcactaagtataaattatggcatattattgttttcaaaagctctttgtaataaaataatatcctatgtggatgccaagatttataataaatattaataattgtacctgtaagtgtcatcattcatttttaaaaatgagataacatttatggttttagacctaaacaatatatattaaatcaagtggatattataagtaacagtgataagataaagtttaaaatatagaatttttaccaaagattgatttacccgatttggagtatttcttgcagtctttgatttcatctctagtgactgaacagttggttcaagttgttttgcttcaacttctttcttatattgtttctctttcctttctaattcttctctattttttttgtacagcatattaacatttgttttttcttcattttcttgttttaaggtgcatctgcagataaagacatttgtcttaaaattcattttgttaaaaaataaggagttcatcctgttatctacctctgcagatgttgtttattatcctaataaaatttctatgttctggattatttttcctttgcagttctcagatatttaatttctcacttcaacatcttcaaatgaatgcatatacttgaaaagtagtaaggaaagaatattctgctaaagtttttgttactagtcactctaatatatattataaaaaaggataccagagataattcagtaaagttacaggttcaaaattacctttttaaatcacacagtcataattactccctaattagaaaagatcatttacaatcaactaaatttttaaagttactatttattgacaagcgtataagttcactagaaataaattttcatctttatgaaatattgcaggtgtttctccaaatgatttacagagtgagatgacaccttcagatgtctctcacacaaactatatctgcagatgactgtcatccaaaactaggctgaaaagtctaacatctgtttccccacactttttatatttctttcttaatactttcaattcaccttcttattacatatattttatatattcattaacctattgttcattatgtgtaatatataattaatgcatgttaattatatattaataagtgtgtgtatgtttacaccagttatgttttcctgtgaaatctagtcccagaagtggagttgttgagttaaagggatgtcaggctatttgaaattttgatacacagcactaagttacccttcagaaataatttactaatttcctataccaacagtgtatgagaatgcctttttcctcacatttgccaacactaataattactttttaaatatcagcatgactttacaaaatatatcttattttatgttaatttgcttttttctgaataccaggcagggctaaatacccctggtaaaaatataaaacttgttaatcataaggaatattagtccaattttcaattagtttatagcacaatgacaattatctcctgtgaaatactgctataggcggccaggcacggtggctcgctcctgtaaacccagcactttgggaggccgaggtgggcagaacacgtgaagtcaggagttcgagacgagcttggctaacatggtgaaatcctatttttactaaaaatacaaaaaattagccgggcatggtggcacatgcctgtaatcccagctactagggagactgagtcagaagaatcgcttgaacccaggaggcagaggctgcagtgagctgagatcacaccattgaactccagcttgggcagcaagagagaaactccatctcaaaaaaacaaaaacaaacaaaaaaaacccaaaaccaaacaaacaaacaaaaaaacactgctataggcttacctatcatgctcttccttcagcttcttgggaaattgctgaggatacgttttcccaatctttctttgttgggttaatctgccagcagcagcagaagatgtactatcacatatattttctgaaagttgtattttttcacttttgtttgtattatttccttctttgacctttaataaaagatgaataataattgttattattttattcaataaaaagaactttttccctgatttttattacttgattcaggttaactatcaccactttaatgataaaagtattttgtgcttactttaattttatcattatacataattattataattataagatactcttattttatcatcgaaatttttgtcaaatctgctcatttctgtttgagggaatagaagaattttccaaaatttcaaaaagggctcttctccattttgtgcttttattcccatccactctttgctatctggtataaatttttatgctatctggctggcagaaacagagaaataaaaagacacaggcataatatatgtcttctgtctttactacctggattttacatgaaatagccagattaagaagatgtgaccttgtaggccttcaggaacagtaaagaagttttcccttttctgtactgagctactcttttccccactgccttttatctctcttttttttttttttgaatcctgtgatatcaaaaaagtaaaggttctctttgaattatgggaaccaacgtttgccacaacaaaagaagcagagtgaaactgctgagtttctagtgcagaattctggaaaatgagatgcttcccagatttcacattcaattaccacaaaagtttataggtggaaaacatatggtacagttacctactttaaccccattatctactgataatgggagtcaaaccaaccaagacatattaaatgtttcatccagagctcttgaggtggcattcactagcatttcatggcaccatataacatgatacaattccatattgctgaattacataaattaccagataaatttatcaaattagatatattaaaagtctaacttgagcaaagcaatttaatgcctcagagggtggaaaaaggcctcatctgcttttactttgaaagaagaaaatctctagatttttgtctatctttagaacacaatgtacagaactcaactttctactaaagagtcaaaggctaaatttttggctaagaaattatgcttcttatatgataaaaatcatacatgccaaaacttaccatactttattaaacaacataacgtaaggtctgattcaacagaaatattgcagagtggtgattttttaaaatatgtgtaagtatatgtttgttttcaaaaatattggaaataaccatgatgggactgtaagttcaaacagtttgagctaagcagataaacttgcatgcatgaaaacacattaaacagactcatttggctgggaatattcgttgcaactctcaaggctagacgtgtttttgtggcttgtctcagtcattgcttccctcccattgtattcccattctatcattaaataaatgtaaattatctctaaatgaatacaagaaaaaagaatctagaatctagagcttgtttctttagcaatttctttatgttgatctggttcagaaggtcacatggtatgtggcttaattagtttcccagctcatacgccacttggaagactgatagtgagacataggttgattaatgaacaaacattatgagaacattctccagaaccattatttagatagcagaactaatctactttgacacataattacacatttagataaccccactgtaactgtacacatgagattttcttgaatagaaaatttgactaaatcaaataattgataaagaggaaaaagaagcagcaagtgaacctctgtctttttgaagttggacttgcttttctccaaagccaggaactcaacttgtaacatgcctacctcattctttttttaattattattatactttaagttctggtacatgtgcacaacatgcaggtttgttacatatctattcatgtgccatgttggtgaccttggaatatcttcccataagtcttctagctatatttttgatgttctctcactatgtggtaaagaataactcacattttataattcaagattcatgcttctgtagttgttagcactgggattgccatatagtggctgctggaataaacgctgtattggttttctgtttttataagtatctgtagcagcagaaatactgtggctttctatctgaatcatatgcttcatttctttggggtgggtaaacaacaaatcaaaaagactttctggatctctagactgaggccaatgcctaatgtccaatttccaattagtggtatctgggtttacattttttgccatttgcatgtcaaactcttaatcatctttcatttcaatcataattactgggttccttaattttttggtttcagtatcattacaaaaattttcatcatctgtgttagaaacaagctatgtgtctggtttgctatcatttttatagtctgatttattttcatttaaatgaagcttagaagatgactggtaactgtatttcagggacctggagtatgaatggaataaaaagacatttgacatgggcttcctctgttcaggcgctgcctggaatgccacagagttagaccctccagatgcatcttcctcctcacaatcagggacctgattcatcagattagagggcactccttttttgttcgtccctctttagagttactatgtaggagctcttcctcagggcaagcagtaattctggagttttcaaaactttcaccaatattcagcttgaacttgtttgtaatgaattttaaagaaagtcgtgaatatacagacagattattccctttatcacaattcttacccagttctggttcttgagacttttttttttttttggcaggtgcaaaatggaaaacaaatttgcttgttttgtttctcagatgccttttctgtcagagtgcatgttttaaaattagctttaatcaagtataaacaaaaatactagaaaataattaaaatttaactgtgaaacttaatctatgtgttgccactcttaaattatgggattgtaactaaaaagtgaaaaataatttgccttggcttaacataggacagaaatatgaactggcaagctgaacgcttagcatttgtttggattaaacttaatgcattatgtgtaaaatctaccagaaatgaattcaaagctgataggtagtattataaaatcttcctctcttacaaagattttacctcagcataccagaaaaagtgagcccctacagtacgtgtatatttctgaagattaactacagactaggcaaacactgaattattaagagccaaactgaacaccaataagaaagggaagcaaaattttaaattctaattcaaataatatactatgatagtgttatgtatctagatggattatctgcttatatccacttctaatatattttaagttccactagtgatagtggatggattttttaaattttagtaacatttactatgtatttatgtcaaaataaagttattgtttgtaccctgacaccaaaggtcccattccacaaggtaggattctcttaataggcaactgggttgacttttatgaccccactcactccctgaacacagacacagaagtcaaatggtgaccacaaaacagaataaatctttaacctcggcactggtgaccagcaatataaaactgcaacatttgaaccattggcaatgatgactcctttaacactagtttaactcagtggccatcattgttaaattgttcacaatttctattccttaataatatgacccaatatttcatgttaccttctgtattatgagtaaggttataacaataaaagagcaagataattctgaaaatgtcttgcctcaattccaagggtaaagacagctatgagttactagagatagtaagaattaccagaataactaatagttactagagatagtaagaatatcttaagtttcataactggttaagatgttttaaaaattaaatataaaattatgatctatcggattctaaaggtatagtctaaaaggtcatgtcatttggactatgctttgttactgaagcaaaaaaacaaaacccaatattaaacaagaaacttgaattttcatatacctgtggttgcttcttttcacttctttcatgcctttcttgctcttcctctgaagccactggtaaggcttgttctgttgacaaattcattggtttagttcaaatgaactaagaacagttagataaagactataatctatataaaaataaatagagaataacatttctttgtattttatattttgagagtttcaatgaagcttaatgtttactgaaatatttagttctttaagaaatacttctaatcatccaaaatttcaacaaaccacttggggagacattagatatcaccaggttcaagccatatgaaatctcagggtcactcacaaattgttccacccaacataaatcaacaaaactgttagaaacaaaacaaaattttgaaatacagtcaaaatatacaatgtaacactttactatacttcataacagtatctttttaacaagacactaattgagttggcagttactaataatttgcaaaattattgttgtttataccttaattagtgtgcaccccattttttacatcgcaaatgttttcccctactattctgaaaaatttattttcatcttttaagactcagaaagtaggctgggcataatagctcacatctgtaatcccagcactttggaaggccaaaatgggggaactgctcaaggccaggagtttaagaccagcctgggaaccatagataaccttgactctacaaaaaattggacaggtatggtgatatgtgcttgtagtcccagctactcaagaagcttaggtgagaagatccctcgagcccaggagtttgaggttgcagtgagtctcgatcacaccattgcactccaccctgggtaatagagtaagaacttgtctccaacaacagaaaaagaaaaaaaaaggctcagaatgctgtgtgaagtcttccttgattctagctgtctttctccacacacacaggtgtctgcttcattggagttccttagtactttgtcaacttttccagcgtcactttaccacctgaactgcacatcatgtctttacatgttgatcccctttgctgttagactgtagaggacaatcttttgaatcatctttgtataaacagtcttaattttgctaaataattacttattgagttcctgctaagtgttaggcactggggtataaggaaggaaaataaaagctgtcagggatggctttcctaaagatcatgcatgagctgagacttagagagtaaggttagccagattaagtgaggcagagggcaggaaagggtgagcacatgccaggcagcaacaagagagggagagaagcctccaagagagtatgtatttctctgcaaaagaggaatggtgagggggccattaccagcagctcagtaattccagagaaaaaggcagatggggaaagggctacagatggagatttgggcagaaatcagtttccttttcttttctttttttgggacaaggtcttactctgtctcccagactggagtgcagtggcatgatcttggctcactgcaacccggcctcccaggttcaagtaattctcctgcctcagcctcccaagtagctgagattacaggcatgtgccattaccacctgctaatttttgtattctattagagatggggtttcaccttgttggccaggctggtcttgaactcctgacctcaaatgatccacctgcctcagcgtcccaaagtgctgggattatagacacgagccaccatgcccaacccagaaatcagtttctgaaatccttatataaaactttaagatgcttggacataggtattcaggagtggttcacagatctatttgcattagagataattaactctaattattgtgaggagcataaaattctgaggcatataaatcaatgaacaaagataaaatataaggcagtgttgcaaagatgatgcaggcctgaggagatgttttcagaaatatttaggacataagtatcagtggccattgtaagcatgaatttttattgaatgaataaatgtatatatctgggtccctggagaaatacactctgctcattactttacaaattttatcaaatgagaagtagaataatatacataaactgtttcagttacttgtatttactttacactttttctgtttcagttttactgtgccaaggaaatgcatttgggttttgtggtggttgttgctgttgctgttgttgttgttgttgttgttgttgttgttgttgagatggagtttcactcttgctgcccaggctgaagtgcagtggtgcaatctcagctcaccgcaactgctgcctcccaggttcaagtgattctcctgcctcagcctcccgagtagctggaattacaggtatgtgccaccatgcccagctaattttgtgtttttagtagagatgtgtttctccatgttggtcaggctggtctcaaactcccaacctcaggttatctgcccgcctcagcctcccaaagtgctgggattacaggcacgagccaccgcgcccagccacatatggggattttgttttaaaagttctgtttcctggatctaccaagctcatgagaaaatagaagcaaacaagtcatttgcataggtaagaaactttggatttatactttgtcatcactactctagaagattatcatcatgttttgtaaaataaaatgttaattctagacataaggggaaagagaaattaaaactataggggtgaaaaaatattgcataatttattactgttgacctgaccatatgactgattaagggcactgaatttaacttgtatgtgaagtagaccccatattagctgcagttaatcaatagaccaggtattctagcagaattaaatttgatgctcctgtgttatctttaaatgatacagctcttctgaaaacccatactcatagtgcatgattatccattaagacaaggtgatggaatgtgtgaatacagctcaggagacaccacaaggcaaatgctcaatggttcccattaatattggggaaatcaacattataatacagaaaaccataggcattatttaatatttggttttggaaggtatttttagtgacactgcatagagttgtacctaataattgcaaaattacagatgtaaaaataaaacaaaggcacattgtgtttgagtaggaaatctgtagacgtctagctggttttctattccaggcccaaaattctaaatataatcatggtacccgcacacaaatttatgttaaataccaacttcaatgaaattactctttctcctcattctctttgttatttatatgttgctttccttaagggaagaatacaaatgccttgctaagaagcattttgtttggttgtaggctgcataaagggagtaaacacaaagtacatttgaccacagaatgactttttaaaagccagaactatggtagcatgaagccaactgaggtaatctagaataaaattttctatgtttgtttcccttctttgctctctttctactctaataactgcgattcacagaggtaatgaagagtataattccctgataaaaacacagctccaagattaatcctttctttaactatgaagttcgtgtgtccaaagtcttgtagttgctgatttttgatcacgaatggtgatacagatatttatcatcaactcacaacttcccaaatctttgaaaagtcttactattgatggttcaactagtagaaacataatctaaaatatctgaaaataaagtttttattagaatgtaaatagtaatacaaattgtaataaggtgtaaaagttctttcttcactgaagcaggaccatgatgtcctctaccccacaaacacactactccctcatggtctaatgtatcttaaaagtcctgtaattgctattaactcagacaagtttacttaacttgttctaagcttctgttatttactacaatttactttatcactcaacaatctctattatatatgttgttttccatgagaaatttttttattaataattaggattcttcagggataagaaaatatttgaataactaagtttgtgcataaacacattaaggtcaaatacccatgacaatattgtgtgtttctctgtactagagacaaaaacttcaaaaaaatttttaatgaatatacattaaaaactgctttcattaaactgagatgatcttccctcaatgcatgaataccttcagaattcacatagaccaaagaattgtataaaatataatagccttaaaaatcttatttgtacctggcacagtggctcctgcctgtaatcccagcatactggcaagctgaggcaggcagatcacctgagatcaggagtttgagagcagcctggccaacatggtgaaaccccatctctactaaaaatagagaatttagcagggtatggtagcacatgcaggtagtatcagctactcgagggcctgaggcaggagaattgcttgaacccgagaggcagaggtggtaatgagtcaagaccgagccactgcactgcagccttggtgacagagcaagactctgtctcaaaaacacaaacaaacaaacaaaacacctaattgttcccacataagtctatattcacacaagatctgaagagtacacaacaccgtgagacaggacagacataaattttaaaagttatattcccagtttctgtaaaaataaaacggttgaatttaagcttttaagacaagtcaaggaaaagagcaaaaaatgcaaaagtgaaacttgaaaggtcattttcccatcaagggctcatgatccactggacattcacaaactatattgttcaaaacattagttctgaattttgatctgagtatccctggagttgcagtttcattcaaagatgtccaagaggtcaaataagacaatatcatttgctattttcagttttcttttctgagaacagcacaacaaacttcttcagagaaatgaattgtcctaacttcataggctaaaggctcatgagtcacagttctaagggcatttataaaatatggtggtgcatgcttgtattctgaacttttcaactttaaactctcatatagtaaatattaatagatacaaactgattaaagaaaagcccacttaatctgacattatttttatttttctttctttcttcatttatcagcaacaggagagtctaactaaatgtggtaaagtggtataagggaatacaatgaaaagtgtaaaatgaattaaaccagagataatcatatcaatgtggatacatctggaaaatataatacaaaatacaccaaagaaagtggcagaaaggtatgtaaagtgtataaccactcacataccattttgggacacaaataaaaaattctgcatattatttctgagcatcacaatatagttaaagatttcaaaagggcattgaaatgaaaaacaaccaacttatgatgtcggtagcctctatgcaatcatgttttaaaaaccttaacaccaaaaagtctcaaaatcaccattttaaaagactgtgtctaccagttataaatgaatcattactttcctcatttttaatagtcaaagatgccacaaacacacacatacacacagctatatatacacctacacacacagtcttgctcattagaacatctgattggcttcagatcatcagtgtaataacactagcagcaagcctctaaagttaaaacagaatctgacatgttaataagtaaagctttcctctaggtaaagttcagaactccaagtagcacttaactcattggaaatatcttagagtctcaaaattcactgctttgaatccctgacaggtataaaaattttatactgaaaacttcatgctattcaaaacattaaaagagaaacatctgagttaaagcttacatttttaaaatcttttttatgcttctaaatttatttttattcaaatatggataccaacaataacatttatgtcaatgccttccattcaattttgaacaaatagaattaggaataagaataatgtgagtacttccaatcattgaatgtacttatttccagtattccattaaatgtacctgctctcaatgtctgtacattctttctttgtactgctcctttcacagcaggatcttctacttcagtgctaggctgaatgggttttaaaagaaaatgattcataaatcatatatattttatacaacatggagttagtgattcaaaaatatacataattaattaccttcaaggaaggatgttttgcaggaggccctacaaagcaaaggggatatgtcatcaattatatgtaagtatgacagggccaaccaaacattcatgcagtggtactatcgagctgaattctcatgcctggctataaaaataattacttaaggttttgagggttcttcttggcatcttttcattgcctaggacggcaacatgacagaaacataatgaggaaaataggaatataggattcctaaaatgcacagtttacatttcagtagtgagattatgtttcaaatgcctatacctaaaatagaaaagcatggatatcaccgtgaacatgtggactgatgaggagaaaagggaccattaaacagaggagcaaatcaaacctgagggaatcgacgtcaaagctgatggtgaatgtacagagtattttaactcaacacagcagaggcattgctgccagcatgccacaaacaaattccccttgtcttgtcactgaggaaatacacagttgggatgacagttcaggtgaatgtgtgattcacctctcatcaaagaaagtgttctacattgatcagctagtatacacacttatgaaatgacagctaatcaaactactcatttttcccatgatcacatgggctactgcagcacctacatttctcctatcccctcatttggccttgagttagagctccttgatccactcatgcaaggatcacataaaataaaccatgtcgaataagcttccgatatcaaaatatttatcaaaaaagaaaacactgaattaccacagacttgctggatatgaatacatatttatatttcaaaatcagtgcagtatttattgaaaaagagaattttggtattcacagaatgaattttgtaatatcaaaaaaaattagccaaagcatctatatgcaacttaatcacatcttattcactcatgtcagtgaaacttctctctctgaggcctgacagttatcaagtgaaatgagctgctgtggtttaccccaactctagcactccctcctgcctccagtactctccacagcaataacctcttttgtgagactgggcatatgctgaagcaactggaagtgagttgtctcaagtttacttggcttcaactcccaagaccccagcaaatgtctttctttcctccctccgtgtcctttcacaatccctcttcctttgaaaaagtgatttttagaactgtcatcctgatgcttcccttcctaactgctttttatggataattgtgaccacttttttcatctgtattcagcagtagtatacacctgtaatctctctgttttcatctcattctccttcccctgtggctagaatcatgctcagaaataaaaggaaattaatgctttccctggattctgttattttttaaattgctctccaatggttctttttccagagttctctaaaggaaggctattcccttgctattcagagctgtgtccaaggaccagcaccaaaaatcacctgagtactcatgagaaatgcagactcccatacctgctgaatcagaatgtgcaccttccagaagctcttcaactcattcatgacaatttgaatgccctgttctacactgatgtgcttccatattggtttcccctaattgcccttttggcctagcctcaatttcttccctattatgtccctcaatttaatactacattataagccataatgtttctaatgaacttttaatcaggcaataacttcttgaattaatttcttctccataaatcacccaacactattcaattatgttaatttggcctatatgatactatcctatgaggttacaacattttctataaaaacaaattatagccatacatggctgaccatctttggtgatgttcatctatggtagataaaacacaggtctgtgtggtgaggtgcctcaatccttaatgcctccccagtagcgaggatgacagcaagagaaggaaaatgttactgtaattctctgacacattttggtactggaagctcactttatcttctttcctgtttctaacaccatgttcttccttcttctacagatcaatttgcctttactatcctctcttacttacctctgcatatgcttttttatttattccatgtacaatccgctctcctcattctttctttctctttattcatttcctcttccctctctcctgacttgcctcaggtcttagagtatcttaaaatggaactcacaattcagctcctttagtggtactcccaatagaatcaactgctgacccttggttagagacacaacttatcaccatttcacttctcctttacttattatacagttaataggacactttctttagctattacactctattagtgctcatattttcaaagaaacattccatcaaatgactttttttgttttgttttttctgagacggagtctcgctctgtcgcccagggtggaatgcagtggtggtatctccgctcactgcaagctccgcctcccgggttcaagccattctcctgcctcagcctcctgagtagctgggactacaggcgcccacaacaccacctggctagttttttgtatttttagtagagatggggtttcaccatgttatccaggatggtctggatctcctgacctcgtgatccgcccgcctcggcctcccaaagtgctgggattacaggcgtgagccaccgcacccggcctccatcaaaagactttttaaataaaatacggttctcaccttctccttgtccattgactattctgtttcctttttcatgcgaagatccaggtaaaggctctgacactttctcggggacacactgctaaggtaatatcaagaattagtttccattttaaaattataatgagttgcatcaagagtttcttatcaatctctttttatgaaactgggtctcactctgtcaacccagggctagaatgcaggggcctgattatggctcactgttgtctcaaactcctgacctcaagcaatcttcccacctcaacttcctgaatagctggaactacaggtgtgtcccttcatgccatgctaatgtttttattgttatctttgcagagacaaggcctcattatactgcccaggctggtctcaaactcctgagctcaagtaaatcttccacttctgccccccaaagtgttgagataagcagtgtgcaccaccacacccagccctaatcaatttctttaaatcaatctcaatgttgcccaggcatggtggctcacacctgtaatctcagccctttgcaaggccaaggtgggtggattgcttgagttcaggagtttgagaccagcctgggcaacataatgagaacacatctctactcaaaaaataccaaaaggagtcaggcatgatggtgtgcgcctgtagtcccagctgcttgggaagctgatgtgggaggatcacttgagcctgagaggtggatactgcagtgagccaagatcatgccactacactgcagcatgggcaacagagcaagaccctgactccccaaaaatttcaatttaaaatatgagaatgaagagagatacaaacaaaaaacaagcctaattggtcaatgaaatatgagcttaagccaagaaagaaaagagacaacatgaagtacaataaagtacatggggaaatagatctataacagagccttttgctctttcatatccctgataatactaattaatatttatgctacaattagttttttgtaagtacttctgtgatatagcttattactataagacattcaattagctaaatatggtcatcgaccactacctgaaagaacattattataacacagagagaaaactagaactttcaatcaactttccacccagaaaaaaattggtcaccagaattctaaagagtaacgtatggcagacacatgaaaaaatgctcatcatcactggccatcagagaaatgcaaatcaaaaccacaatgagataccatctcacaccagttacaatgacgatcattaaaaagtcaggaacccacaggtgctggagaggatgtggagaaataggagtacttttacactgttggtgggactgtaaactagttcatcctttgaggaagacagtatggtgattcctcaaggatctagaactagaaataccatttgacccagccatcccattactgggtatatacccaaaggattataagtcatgctgctataaagacacatgcacacgtatgtttattgcggcactatttacaatagcaaagacttggaaccaacccaaatgtccatcaatgatagactggattaagacaatgtggcacatatacaccatggaatactatgcagccataaaaaaggatgagttcatgtcctttgtagggacatggatgaagctggaaaccatcattctgagcaaactatcgcaaggacaaaaaaccaaacactgcatgttctcactcataggtggaaattgaacaatgagaacacttggacacaggatggggaacatcacacactggggcctgtcgtggggcggacaaggggggagggatagcattaggagatatacctaatgtaaatgatgagttaatgggtgcagcacaccaacatggcacgtgtatacacatgtaacaaacccacacattgtgcacatgtaccctagaacttacagtataagaataataaagagtaatgtatggcttgaaaacgtatatttaatagaacatgagttagagctaataaaaagcttaagaaatgttaatctaaaatctcaatgttaagattccagttgaatgatactagaaaatatattgtaaccctatttgctactgatgacctatttctattttatttcctttttaattatggcataatttctcaacataacatatcaaaacttatacacccttaaatattaaaaaatacaatgtaagcaatattttaaatacaatatttaattattagatacattaggtttattatattacttataacattccattatataaaaattcatttgtctatttattcagattaaacaactattaaggctgaatgtcttatgcctgtaacccagcactttgagaggctgaggcaggcagaacacttgagcccaacagttaaagaccagcctgggcaacaaggcaaaaccctgtctctacaaaactcagctgagcatggtgacacaggtctatggtgacatagctctattgtttaaactacttggatggctgaggtgtgaggatcacctgagcccaggaaatggagattggagtgagccaagatctcaccagtgccctccagcctgggggacagagtgaaaccccatctcaaaaaacaacaactaaaatgcttcttacatggaagactgtattctaggtactccaggatacacacaaatatgtttactgacctccagtagcttacggtatgcaggagcttccaatgattatttaaacaactaaatagaaaaccttctgaaattcaaaatttcagaatatgatatgaggactttgagtggctattttattttttaagatgtagtcttgctctgtcacccaggctggagtgcaatggtgcgatcttggctcactgcaacctccgcctcccgggttcaagcgattctcccaccttggcctcctgagcagctggggttacaggcatgcaccatcacgcctggttaatttttctgcttttgttttgttttgttttgttttggttttggttttttttagagacagggtttcaccacgttggccaggctgatcttgaactcctgacctcaggtgatctaccgacctcggcctccaaaactgctgggattacaggtgagtctccacacctggtgaagtaaatattttaaataaactacaatgacaaaattatgaggataaagtcttaccatccattggtattaagagtctctgcttctagaactggttatttgcagcaaaatacatgttattcaattagatgaagtgccttatataaactcttcatggacaactcataaaccacacaaaaattcctttgcaatacacattttgagaacataaatttaaatttctatatttccacaatttatatttttaaatcagatacgatgttgcccaggctgttctcaaactcctgggttcaagcaatcttcctgcctcaaattcccaagtagcagggactacaggtgtacaccaccacactcagttatttttctacaatttttatttttttttgtctcactacagaaccaataatataagtagaaaaacaatctctcgtaaaaacaatatgataccaaaataataagtttccaagaacaaaagctatatgctatgtgctgaatattcttgccactaaaaatcaccaggaggatcccatgattactgcaaataatttgatccactgaagatttatacaggcataaatattaagaaagtcacactcgtatgatttaaaagtcaaagtattagtatttatccaaataaaccttaagcaaatttcatatttcctctattggagaaagcatttcctaatgtgattttcctgtcactactaattttccagttcattttttttcagctcccaccctgtcacagtacttatcaatctttgttagttaccaaagttaaacacattttttgaatcaactagccatatgtatgtttttctctgaccaactttccattaccaccataaaacaatgataggtaaaccactgctaaatttgaaaagtaaatactatgcaaaagtacattcagagtgagaaaattaattttacaagagaccactttaccttagtagcaacattcaagtctttgtcatccgatgcaggcaatgaatccacacgcagttcatggaaaatgcttgagagcaaaaacacacaacgaaaatgagcaagttgatttctttacaatttttttaactgccagtttatatccagcttccccctcaaaaaaggaaaccataatctagggaaaggtcagcaatctatatattaaatagtgattcttgatataattaaaatatgtcctcttctaaaaatagattttagttacctatttctgcctccacttgtctaaatctataaaatattcaatgaaaactaaccttgagctttataacaaatagtgacagtcaataaattggcagagcctgacaatgatttgccctcacaaattatctgtcctgaagctgaacttaaaattcaattaatggatgacataaattttgttacctaaactggaagaaaactaacaacctaaaacaaggtagaaagatccactgtctcttttccatgatctgtctctggataaaagactaatctgcatcacttcaatatggcagtcttgattcctcagcatggaacccacttaggaaggtcctattgctttcctttgccctaaatcagtacaggaaagcccctacaatatttgaaatgtatgaaagctaaatgtacagaagtcaaataacaaaggtgtatgttcttattgagaatacttttcccagaaagattgaaatattaacaattataaaatcccattattttcaccctataggtcctaccttattcaggtccacataaactagcaagcccttaaaacttttcataggcactcagacacccaaggagagagactgtcagaaaaaaacagagtcctggtaggtgtacctctatttccctaagtactctctaagtatctgtcttcctatgggctcccacttccagattccacttctgcagggctccacagaagtctccaatctttaaatcttcagtctatgaaagcacagattcctgaaaggatggcctcaaatgaccaggactaggagctctctatatccctgctcctgaaaaacaagctaactggagtctccatcacctgcccccagctagacacactaccaactacccaactgaactccatgactgatttgccagccaatcatgcccctgaaccagcccacatggacatgggaaggacatcagtgaatcgggaaaagaggcagaggtgaggagacacctgtactgggccacagatctatgtagttcagcaatctccagccccttagtactccaggggctctaagccacccctttctaagtcaggatggaagtagatgacaccacatttctatctgctgcagacgctcctcccagtgtctcaaaatgttttagcatctttcagtaaaaatcttcaagtttgtcagtccttgatttaaaaaaaagcagcaaactttttagagctcccttgaaccttctattttaatgtgccttcgtagataattcccaacatcttgtgtccttcatttttataatttatctttatcaaacttgtcataaaccccaatattttgatctcttatagaagagtctgtactcctatccaatccagtgttgtttatcttcaaacttggacttcccctgctcattccattcttatctacttccattgggttccccagctaattccattctcattctacccacagactcactcccgtttgtattattaaaacacacgccaataggatataaaaagaagcaagagtactgggctttaacatgagttcaaatctcatttctgccaattcctatgtctaaaaaaaagcatcctaaactctttgagcctcacattctctatctagagaatcatttgaccagaatgttcaacacaggtaaaaatactagaaggtattttaattcattccaagattccttaaaattctgtaattctatgtcctcttgattctgtctatagaaaaacttagaatacatagccagcagagtttgaaaaaataatagaacaaaagaaataccaagaaaagcagagaagaaagttttaaaaaatgaaggcaagattatagaaaagtcacggaaaaagcaacaagactaaaaaatgtattatggaagtaagcagaaatacttgcctaaatggaaaaccaaactgggaagtcaaataatttgtctctaagacttgcctaaacttgcttttgtaaaacttacacccctatggcaaagctaagtaagatctgccctagagcctttgatggtaaaaataagatactggttaccactgaaattgtcaaatttattaggacaaactcttggactaaccacattctaatgataaacttaaatgagagttcaaggtatttaaactctcattaatttagacattaatcaaattaatcaatctgactaatctgattcagacctataccttgatccaagggctgcacagatatctgtcaatctatgctgaggagcaagagacaggatttggaaggcaggcaggctgatggtcaaactgtaggccagctactttgttaactatgggatcatgaggcaattaatcagctctaatccatagttgtttatttaataaacagtaggttataggaacacagatgttgtgatggctttatgagatgataaacgcatagaacatattaggatgtctagcccagaatacaacactcaacagatattcgtttcttccatctatattttcttagttaacataattttttaaatctataaaatcctacctgactgcagattcatcagaacttccaacatctattaaagaaaaaggtaaaatgcattttaaatcaataacaaatgtacagaatattaaaagcataagaatgcacagtgatgcatccctctaatccaaactacttgggaggctgaggcaggaggatcacttgaggagcccagaagtttgagaccagcttgggaaacatagtaagactctaccttcataaaaaaattgtgcacacttgtatgtatgctttagatcctgttttttgttgttgttgtttttgttttgttttggtttggttttttaaagcataagactgatgctttgttacaaagcattcctttgagagcatgcctgggaccttattagaattaacattcgttatacatattggtaggtaattaatgcagtaagaactcttccctttgtatttattagatgcaaagaagaataaatttattaaaatttggtatctacaagtgaactgcagtatgcaagtcatcttagccaaaccctatgaggttgagtaaaaatggtattgttagcagaacaggtgtgatgagtcaccagtgtcaaagagcatgatttctggaccaaaatatgaggcgccattaaaacagagtacacagtagtaccccttatccactatacgtgcagaaagacatacttgacacatttttctctactgtcacaccacagcaacaatcatcaacaaagaaggcttctgtgaccaaatgtgtggagggtttttccccaccaacaagcaagcaatcattcctgctgatgacacaattcaattctcacaccttatctgctggtaacatcagattcaatttaatttataaattaaactttagcatagatatgtatgtatagggaaaaacagtttgtgattcagtactattcatggtttcatgcatccacttgggggtcttggaatgtatctcccacagttaagggggagctactgcacttattttgttataacacaacacagcctctctagctcttcagttcaaactgctcagtttagaataaaacaccctaacaccagatgtcagcaaaacataggaatccgaccagaaacaggaatccttgcaaagactttccagccgctagtggaaaagagctcaaaagagatcaatgtattactctggctactactctttggggaaggtgctgggtggtttacttagttgtagctatttgctctgccctacatatagcaaggcccaaattcacctgccattttacctcccacagaaaaaccactggaaagatcactcctttaagagcttatacgctaggaaccacacctcacattcagagagaagctgaagaaacaccagggaggtgtggcaggctgctggacagtactatatgatgtgaaaaatatatagaaagaaaaccatcaatgcccttttactaccagaatgttccagtgcttgcccttctccctagtaggggaaaaaaattctttttcacctcacagaaagcaaaactctcttgctatccctcatgacagaatctagttgtaggtgagtcacatcatcataatacaggctgttgtcaacctcatccctcaaaggaagaggatcagtgaggaacctatgtacttacctatagcattcactgtctggtcttatttccaaccgaaggtaagtatgaaagactttgtgattccagttttataaagtacaaccccttgcacttgtccccttccattgctagagaatctatctggacccacctcacagagcaagatgctccagtttgtgctgtgtggtacagcatggtgtccttttcctcaaccctttctattatgtgcacatatctatacaaatcatgttttctaagtatgtaaagcatatgtcatcagaatatatcattctttacaatgataaagaagcaaaagaaaaacaaaaggacaaagaacatcttaaatgactacattcaactgccatggagctttaattttttaactattcaaaaagatatccactgtattattccaactatgtgactcttctgaaaaaagtaaaactatgaagacagagtaaacatcaatggttgccacgagttactagggagaaagggaaagatgaacaggcatagcacagagaatttttagggctgtgaaactgttctgtcgataatattacagtaatagatacatgtcatgtcattatacacttgtccaaattcacagaacgtacagcatcaagagtgaagcctgatgtaaactatgaactttgaatgattataatgtgtcaatgtaagttcatcagttgtaacaaatgtaccactctctggtggaaaatagtaataatgggggaggctatgcatgtgtgggaggcatgggatatatgagaaatctctgtaccttcctctcaattttgctgtgaacctaaaactgctctaagaaataaggttattgatttaaaaaaagatattcagctgggctcagtggctcatgcctgtcatctcagcactttgggaggcaaagatgggtggatcacctgaggtcaggagttcaagaccggcctggccaacatggcaaaacctcgtctctaataaaaatacaaaaattagctgggcatggtggctggcacctgtaatttcagctactcaggaggctgaggcaggagaatcgcttgagcctagaaggtggaggttgcagttaactgagatcgcaccactgcactgcagcctgggagacagagtgagactccatctcaaaaaacaaaaagatattcactgtctatgcatcccaggatctccagaacaattacaataaataaataaataaataaataaataaataaatggctgggggcagtggctcatgcctgtaatcccagcactttgagaggccgaggtaggtggatcacctgaggtcaggagttcgagaccagcctgactaacatggtgaaaccccatctctactaaatacaaaaaattagccaggcatgattgtgcatgcctgtagttccaggtacctaggaggctgaggcaggagaatcatttgaaactgggaggtggaggttgcaatgagccaagattatgtcattgtactgcagcctgggcaacaagagcaaaactccgtctcaaaaaaataagtaaataaaataaaaaataaagatattcactgaacctgttactatgatatatttaagcaagacacggtgaccctaaaaattagagatcattgaagaccaaagtaacaacatgtggtcattacttctcaaattgaactatataaaatatataaaataaataaatttaattgcatgcttaggtaagaaaatattgataaaaataattgaatattttatcttatttcataattctaaacagggatttagcacaatatgaaaactagactattcatgtaatcaaaataaaagacaatttttattctaatgttaactcagaaattattttgcttatttaatttaacaattttactgaaaggttaatgagataaataggacagattataattacctaacattgctatggtaacttatatacaaatagctgttcatcaccaaaagtcaaaaaagtaacaagcactgcaacttaagatggattatacaacagaaattagtaccaagttaccttatcttataatattatgttattaaaatgaaattttaaaacaacaccaaaaattaagttggggttacaagtgttgtgcagaaaagatttcatatagcaggcaagaggctgccatccttagaaaggcctgcatgcaaggctggcccttggctggtgtttaggaaattggaaatgggagggtttccaccattccctgagaagagtggctcactgtgtctaaagtgcttatagaaacagtgtatttactctaaacagctgctttccttgtaagagtctggaatttgggtacatgtgagggagagtaacctccatagaaaaacttgggcacttagtctctaatgaaactctggtactggtagacatcactgcacatatgttgtcaaaatgtgagcctgggagaattaagcagatcccgggaactccacaggacagaactcctggaggcttgtgccttgtttcctccagaattgaccacatgcacctttttcctctactaattttgcttgtccccttccttgttatcaattaaagatctgagtatgactatttgttgagtcctgtgagtccttctaatgaaccaccaaacctggggtggtcttgggaaaccttgacacaaattcattgtgtaagatttgtattaagttgatatgatacgtgtaactgtaatcagatggttatttcacagaataactttacctaatctgtttttcttttctttttttgccttgatatttgacttggagattctcgtatttctatatctatccaattgaataaagccatagaaggaataaatgaaaaaataatgtcagaaaataatgtgaaatgagcagcaatcctcttttatctgaataaaaaatagagaatctgggtgattgacaatatgttctacaatatgaatgtttctagaaaaaaaatgaaaaagtggtcaattttctgcaactcaactgggcttcattcctttttataataattttgaaggccaggtgcagtggctcacacttgtaaatccgagcattttgggaggttgaggcaggaggatcacttgagcccggaagttccagaccggcctcggcaatatagtgagacctcatctattaaacaaacaaacaaacaaaaatcccttaaaaagaaaattagccaagtgtggtagtgcatgcctgtagtccaagctacttgggaggctaaggtgaaaggatcatttaaggccagcaagcagaagttgcagtgagccaagatgacaccactgcacaccagtactgacaacagagggagaccctgtattaaaaataaataaacaaataaataattgtgtatcaggccagatgtaaccacacaaaactgtagtcccagctactcaggaggatgaagtaggaggactgcttgagcccaggagttcaaggctacagtgagctatgattgcaccaatgaatagacactgtattctagcctaggcaacatagagagaccccatctcctatgataataataattgattaattgtgcatcattcaagtaaattgtgtaactggagaaaaacatatgactattgaatatactattatagtctactactgaccatagagttcctgtttacttgcttctaatctttttcttcatttctcataaaactgaaaacatgatttaaacccattaaaggcagttcatcacaaaacaagtcaaaaagtcaaaagaattgcatccaaacagtaggatgcgttatccaccgctctctgtgaacagttggatttggtcattaagaatcagcaggacttttaactttgtgtctgtgtgcacaggtgtgtgcacatgtgcacgtgtgtatgtgtatgtatgtaaactatgacagataaaatcattttgcttgtgtacgaatatgtaatataacttgtgcttctcacaaaggaattgcttttccgtctcctgtgctcagtagctgtcttcaaaaaataatctcctatttgtatgggtgcacactggttcagttctacagttcttattgccatttatttatggtaccagaaagggattgctgagttcctggttctaaagatagttactttcttagtgacacaaatcaatatgtaatacagttcacccttgaacagcaagggtttcaactgcagggattcacttatatgcagattttcttctgcctctgcaacagagagacagcaagatccacctctcctcttcctcctcagcctaatcaacctgaagatcatgaagacctttgtcaggactacttatgctttatgaaaagtcaatatgtttctcctgatgatttcctttctaacagcttcatttctctagcttattttattgtgcgaacacagtatataataatgcagcaaaaacaaaataggtgttcatcaactgtttatgttatcaggaaggcttccagtcaattgtgggctattagtagctaaggtgaaggaatcaaaagttatactcagattttcaactgcacagggatcagagtccctcacccccacattattcatgggtcaactgtagttatttgtttactaaatataaacaatttattataaaaatgaaatcgaagatccatttgtataacaagtccaatttgttataatgtgactatagaggaaacatacaacatactaacttaaaaatcttttttcttatttatgcaaaaatattatataggattttagggatcataattaaataaatgaatgttttcagacaataatgtttgagattgtaaattagctacaactaccttcttaaataaatctgaatttcaaactaaagaagttaaattttaaaaattaatttacatatgtatatacatatatacacattcaatttacacatatttttaaactggtcttttttgactgaaactaccttaatcttacatcttactttgtattttcttatcaagagtaggaccaccaagacaagtaagaaattcacaatcagaagtcttacctgatttctcctttttaagtatcttctttttatgttccaaaatttgttgttgaattctatgtatacaaaagtaataaataaaattgccatttttataatgaaataaaaaatattcaccaaacatattaaattccaaaacactttcaagcaatatcagacctaatatcagaattttaatgtcccatacacttcaaatttgtaaaccttacaagcttattaagcttataattaaagaagaaaagaaagtgaagtactcataaatggaggaagcacagctcagtaaatgaactctagttagctggatatcatgcaaagtgtcctgcactcagagtaagtccttgctctgtaaccaaaatacctcgctctgtaggtattttgtcttcagacaagttgcttctcttaggctccatggtttcttctaaaaaacaaggattctgctaccttacttcactaggttgtttggaagatgtaatgagattacatgtttatatgttcagagaaatagtaaagcaatggaataatttattcttgaactttattgctgaaaccattttggaatcccaaataatgctcggtgtgtgtttttctgtaagttctaatactcaaatgttgcagttttcagaaaatgttattaagtgctaattttggttattacttgtattcattgtggcttgtaattcagggcattttacctaattcataacttattactaaatttctatatatataaatttagtgagctcatcactgagctcatcaatcacaccaagggcagaaaactaataggtgtcaaaacctggcttggacaactaccactccttctctacctcctcaaactctgagccagcagatctgtgcttggctgctggatctccatggtcctctccaactaacagacaagacaaaaccctgctttgattgtttttcagttccatgaaggaaatacaagttgacattttctcatttccaagacatgtactaacaacatgtaacatccccttattactcagctctgttcccatttcagagatcaccatacatcaatagtttcatagcgataatcacaatttcaatattgcgtgtcacctgttttggttttgctcacactgcttccttggagctactcaacaaatagtcaaatggcctacctgggactaggcaaaatatggaatgttttctgaatttgtgtgccatccctaggcagtagccatgcttatctgctctgtattgatccaattttaaaatatgtgctgttgaaataagtacaaagccctgtttgatacatggatattcatgagtcatggatgaggcttagctctattaaatccaactcacttacttcagattcagagaattttattgaatggcttcctgtgaggtagaattttaaaatatattgaaaacttgaggaagagctgcaagtagcccaggagattttcatgattatagagacacattacttgaggggccaactgcaagctggttcccactactcagtggaaagataacatggaacattccgctatctaaccaaagctgctgcacaggatataaaaaagcctcaaggtacagatctgatagcaaaagagacagggaactctgatctcttcctgcaacattatttgaacatccctgactattgagaacaatcccaactaatattggttaaaggaaagacaaacatggctctcaaaggataacataccacgaaggcctaggcaaagtctagctaagacgtgggctccaaataaggtttttagtgtagggtgagcatcaacttgctcaatatttgtgtggataaagctaggaggcctagctgccagagcagggtgctgggaacaatgactgagcacaagtacataaactaataaacaccgtagctttgacctctatatatgaatcaccatgaaaactgaggggtctgaatcagtgaaggcatcctggtggcaaaggtcaatcattatcagattgcaggaccagttataatggcaataatacagcaagtgagtccatggaaacaacagaatgattagaatggccttttttccccttcttctgacttgtaaagaaagattgccttccttggacttaggaaaccccttagcttcttggaaaattcaaagaaggaagacacaggagagagccccaggggacaatacatgattttctgttaaactggacattacaagactcaataactaattagaaaagtcaggccaggcatggtggctagcactttcagaggccgaggcagggggattacttgacctcaaaagttcaagaccagccagggcaacagagtgagaccttgtctctacaaaaaaaaaaaaaaaaaaaaaaaaggaaaggaaaggaaaagaaatcaaagacatggctctttttatcccatgcatggggattatacttagaataaaatgaataacattgagatccctagggataaatgtctcaaaaatccagaaaaaatctcgcactctacttctaactaatctagacttctgcttgatttctggctaaaaggtagactaactcttcgctatttcaaactatctgaaccaaactatgaactctcacctaatgcataagatggagtagttgcaattattttaaacttcaatttagcattaactggccttttaacataaacacttactttgtcaaatgatgagaaatagcataatcttctgcatctcgtccacacatgtcttgagcgaagacatcaatattttgcttaagaaggatattgacaatacctggtgagtcatagtatacagcaagcatgagagctgacctaaaacaacaaagaaataactccactcaagaactttaataaagacttttttaaaaagctagtttgatacactttaccagtttaatatccgcctgtcagtatagatgtaataactatttgcatgtactagcttgggtctataagcatctagggtgctcaagtgttcatctttgtaaattgtcaccaaggctaaaagaaagggacaacagggaagcctcttgtcccactggggtaagacataatacaagttgctaacttatagtcctttgatggccaagaaactgtgctgaggtcacttatctaaagtaggcaaagatttagatgaagatttccccattgctttcctagtcaaatcagctaggggtcagataagagttatctgcaggctgaaaacaacaacaacaacaataataataatgacaatgctagtagtcataaactaaaagtccacactttgaaaatgaataaaacttgtcaggtgcagtgtctcatgcctgtaatcccagcactttgggaagccaaggagagcagatcacgaggtcaagagatcaagaccatcctggccaacatggtgaaatcccatctctactaaaaatacaaaaattagctgggcatggtggcgtgcacctgtagtcccagctacttgggaggtcgaggcaggagaatcgcttgaacctgggaggtggagaatgcagtgagctgagatcacaccactgcactccagcctggcaacagagcaagactccatctcaaaaaaaaaaaaaattaataaaactaatacaaaaccctttagctaataaaagattacagtacgaaaaacatctgattataaataccaaactctgtatattataagagaagatgaatcctactatatactattctttatgttactcagtccaaatatttgcttgtctacctgattattcatggtgatatttttcattatatgccaataattatgttaatcttcttattaatatttctgacttgagtgaccactctagaatactcaggttttatttttaaaaaaagaactactgtaccgtctcagcctatcaacggcatgtgaacttgctttccttttcaataaaaattccaccattttctctttcttgcaaattatagcaaataaaagtggggtattattgtcctataaaacagcagaaaaaattaataattcacaaaattacatatttctcaactgaactgaaaatcttctccaggatgctttgaacttcaacatacaatatagaaaggaagtaaatgaaaagcagtcccttcattctcactcctctgtgctttctgatgtgctgtgctttgccttgcaaacaaccctcctctgtctccctggattaactgtggtcattgccaaaactcactttaaacatttactagtcccaagaatccttgctttgatcacagcacttatcatggtacattgtagtcatttcattgtttcccactgaaaccaagagcttcttgaggcaagggcctaaaaccctaagacacagtagcaaatattttaagttttttacattaattaatgatctaaattactatctctaaagcagtgtctcttaaactatattccaaagaatatttgctttatcagaagtattataccgcaagagaaagactccatgaccatctgtatttgagaagtattacaaaactgtattttatgtccaataatcaagaaatctctttaatttcacctaatcccctttcacaatactatttgtggcaaacattaacatttgaggaattaagagtttcagagatacagttgccagagcttcccaatacaggtggcagttccctctgggtggtacaaacttgcttgattcacttttatcaatggtgtcaggatcccagatgccaatgtcaggcactcctgctccaaatgggtcaccatggaaatgagctttgaattaagagagattggcttcaaatgcatttattttccttattattaaatagtccatgggtttttcccctaatacaagagaagagatttttatctttactgttagaaagctcagtatattctgtgtaagagagataggtttaaaaaacttaagaacaaatattttaaaaaccaaaactcagtaagaaatactattctcaattataatggtaatcccgggaccctagtgcagctctactttttaaatccatttttactggcttccacttaaatggctacttaaaattattttttattttagacaaaatataaatcagaaataaaaacataatggcttatcaatagaagttctcatactgatccacatggattatttctggcataatacaagccaataagtcacttgcatccttaaggaagagcactgaggagaaggatgtactgtctgcaatattcataaattatccaactataaccaggaataacctaaaaaggcttctaggcattcttatgggcagagaattatttgtggtatatataaagaaaagagttaaaaacttctaaactctaaaattcaactccataactgagggatttatatactctatagactatatattataaacaaatacatgctgacttaaaaaccttgaaatttttatcaaaatatactataacataggagttgtaaactcagatacttacaaggacaaaggaaggttgcctgagtaagggaagtactaaggtgggcacagtagcaaactggagaatacctgccttctataaaggggcaacttctgcacagcagaccaaagaatgatagaaactcaggggacaccagatttgattttttaggatatgcctgaagtccacatttcttcacgagtcttctaaattttacatgttgattcaacttatagaggcaaacaaacaaatctgtgtaccacattagaatacagcccttgttttttttatattcgctattaatgtgttactaaatggttgtgtataatccaagtattttcatgtaaaatattttctttctctggtatcatatgttctaccaaaaaatcaggctctcatatataataaaaattgctaaaaagactcacaatacctgcttcaagaatttttccaacatgtattcatttaaaatatgtttgtatataattttcccagattgttaaccaaatagataattggttcacaagactgctaaaactaaattattaaaagaattcctatctatattcttattaacttcatggatttcagtgtttaaaactgacattttgggtatgctaaagttctataaacttaacaaacatactgagatagttcataacaaaacttcaactaaaaaaaatagtttaggatttgctactattctaattgagaaagccaaacttgtaatgaacatttgttgacacataatcacctgcgtggtgacaaagggacatgaaatcatgaaagggtcagcctctacctattgaaagattactcataagcaaatttctgaagactctctgaatggtagtgaatgattcatggtgggaagcaaaacatgttattctgtaagctgagagatattgccaatgatattacctttcacttcccagtcacagatgtagagaaagacagataagtcaggctaatataattgaaaaggagaactttgaaggaagtggcaactatcaaatgccaactcttctagagatttcttacatttttgagatacagaaatttatatattgcacttatctattctggggtttttaatcaagagtgtatcccaaccttgaaggttttttgtttttttgtggggtttttttttggctattattgttgttagagacaagagtctcactatgttgctcaagctggattcaaactcttaggctcaagctgggactacaggaatacaccactgtgcccagcttcaagaaaacatttttaaacacgttcaggccttaataggtctattacatcaaaatcttcaggggaaagcctacaattgtagatttttaacaaaatgtcctcaggtcactgtaatgcacaattctgagaatcagtgcagcagacaatcacttcagtctcacctctcacccacatggctaattcctttatcagttggagatgtggccaaaaagagaaaagagtaagagatagtgtcatttattaaaactccagttaagtttcctggctacgggtagaacagggacaagtaaactcaaaatcccacttgattttgctatttacaagctccttatctcccaccttcccactaagacattctagatttgagaggaggctttaggttcttatctaagtggctgtttctgccaggatgagcaataagtcagttaataatttgttccaccttctgctgaagtgtttctcacttcgtcaccacatattcactgccaatctggtttcctcagagtcctcctaaaattcatctctaggcaagttgcaattcattctttttcaaaccaaaaattattagacccaaagctaaacagcaccttgtctcaacacataaaacaaacttaaaaacaaaaaaaaacctcttcctggcattttccctcattatctaatatccaagtgacctgcatatttctgattgctctctttctcccctcccatttttccctcttaagccttgccactgaaagatgatacatcagtttttcagaaaattagcagcaacagcaacatgtccctttattgtaagttgctttagttttgtttgagttttaagataaagcctaattccggggaatattttctttcctgtgttgttttacactaattaagaaaaaaaaaaaaaaaagaataagcctgtgtagaaaaaaagttgaaaaggttttacctttaacaaattcacaaatattttccaaagtgcattttataaagctgtgccctttaatgcttctttaaaaatatcaatatttaaaataaaatcttagacaattaagttatttcaaaataacttaatttgtatttgcattcagggaatggttgagcttccaaatataaaaaattgacccttacctatgtcaatgttaaaacaaatattttggaaagaaagttgattgacctataccttgtccagtgcttcaatatgtgcaccatgggaaagcagtttttctgccagtgaggtgctctcactatacacggcataatggagagcagtgttgccgtagatatccttaaggtttggattggcgccatgttccagcagaataacggcacaagcctcttcctggcaatggacagcctgtccgtgttagaccaagaaacagattgtaaattccaagaattcaaaatacacattccacaggtttcaccaactagttatatgtaaatgagatcaatttattttaattctatatatgtaaatcaaatccatgtcatgctaaaagagttggctctaatatacctgtatcaaaggcgttctgttttctttgtcacagacatcaatctggcattttctgttaaccaggagagtgaccacttgcacatggccactggcacaggccaagtgtagagcagttctatgagagtaagaggattttttaagaaactgtagtacaatatctcaaaacatacaatcattcatgtaatgtaaaaactgaatagcatgtttttcctctgccttcaaaacaaataaattttttgaagaaagtacaatacttactagctcttattgctcactgccttaatgaaaacagcagcctatttgagtagaaagagctcagtctttggattcggttcaactagggcttgagtcctactttaagccttgacacttaccaactattgcttagcctttctgtacctcaacttcctcattaataaagatgacaatagtagctatctcataggacaccatcgtgatgcttaaatgagaagctatgtaaagtatgtagaacagttcctacgacaactcaataattgtaagatttttgttttttgagacaaagtctcactcttttgcccaggctggagtgcaatggtgtaactatacctggaactcctgggtcaaatgatcctccatccccagcctcctgagtagctgggactacagatgagcaccagcatgcccagctatttatttaaaaatttttgtagagtaagaatctcactttgttgcccaggctggtctcaaactcctggcatcaagcaatcctctcaccccagcctcccaaagttctgggattacaggtgtgagccactgcacccagccagatattataattattactattactactacttaacaaaaccattttaattaggtagaatgatacaattatacctactttgcaagatgacttaacgagtaggtcacattttaacacctctgacattggaatgccacttataattcatgatttgttataactataattggtagcattttaaaaattatcttattgatatataaaatatcggggcatcacgcaatccatgagaccttacattaagtagaatatggtatactcagcaggtctagggcagttctaggcatgtaactgaaacttaaatacattttagttcttaaaggtactatggggaaagagcactgaaataacaataatgcattttttaaacaaattaattctttgattttcaaacaacttgaaaccaaaggaaactcatgattcaaatgaatacatatggctcattgtattcaatatttatacttagaaaatatatgcaaatacgactttccaatgattaatattagtatttaagactgataaactttcgaaagagcagttaaaggttatcttctactattttctaacttcagaaatgcttttgtttgaaaggtgggagataaagtttcaaggagattaagtcccaatattcctattttaaatctctcagcttgtgcaggcggggcaggtaaacatgaagtgtttaaggatggacgggtcctgagagatgatagaatatgtctgctacatagcaggtactcaggttatgcttgatccataaatggaatgaaagaatggataaatacagttggggagttcattatttttaaataaactcctataaagcaatatttttgcaatagtaattatttatatgtgttgttttatttttaaagaacacaattaaaatgaaatgattatgtttgcataaatggaatgagtatataagcaaaacatatgtacataataaaatatatagataataaaatctggaaacagataaaaacattccttttttacttctgaagaggctaaaagctcaaagaagataacaacacacacaataatgataaaaaatagaaagtgagaaattattttcatcagcgcaagattcatattcctctcttcccaaggattagtccattaataataaacttttactagaagttttgtactcactgcagcaatcacagataagaaaaaggaaaaaaactttacttaaaatacaaatgctcagaaattacaaattttatattttgtacatatttttgctaaaacaagaccatagtatgtttgtgtatgtataatttaactaattttttctccttgctagctataacaaaatacatctttgcacatcaacgtacttctgtatctactgccaccttcagtggtcacatattattccatcctatggatgcaactgaaatttatttataggatccattctatgggttctctttaaagtaagtactgtgaaaaataaagtgcatgtatctttatttcctaagggtattttagtataatggaattggtgggtaaagggcatacacattttttaaatgtagtacttaccattttcaaatgagtactttgaaaagtaatcagcaacttcaagcagcagtataaaacatcctcacaaatattgtggatagaaaactgtttcattcctcttttagtttaaattcttataccagaaatgcgaaggattttttcctatgtatataagtaacttgtagatctggaaaaaggtactttgcccacttttagagtgtttgatgatttgatttgaaagaatttcctgtaaaatgaagaggtacttttcatctaatgtgtatatataactgatatatataacatattatatgtgttatatatgtatacatatcagtaatatatatatatcttatgatatataataaacaacataggccaggcgcggtggctcacacctgtaatcctagcgctttgggaggcggaggcgggcagatgacttgaggtcaggagttcgagaccagcctggccaacgtggtgaaactaaatatacaaaaattagccaggcatgctggcacctgcctgcaatcccagctacttgggaggctgaggtaggaaaattgcttgaacccggcaggcagaggttgcagtgagccaagattgtgccattggacaccagcctgggcaaagaagcgagactccgactcaaaaaaaaaaaaaaagaatataatgaattccctataaaatgaaaacatacttttcatctgaaaaaatatatatatataatatagtaaatatttttcaagtaagctctcttatctgagaacttttcgcccactgaaacaactcacggttatttttgataggggaacaagtactctcattaggcacctcctataatgtatataaaccatgttttaaacgtgtacgttaaaaataacaacgctgtatatgcttaactttgtgagttaaatcactcaaattctccaactgctccagccagggaattatgagggatggaaaacagatgagagtccgtttggctccgccgctccgagggtgcccggcgccctgcacggccccgtcccagggtctgcggggaagccgggcctgggggccccctcccacccccggctgagcccccgctacctgtgctgcttgtccagggcgtccaggtctccgctcctgcgcgccaggcagcgctccacctccgcggcgtcgcctttgacagctgccctgtggatcttctgcagttcggagtcccggattcggtatccggaacccgtgtagacgtggtctatggagccctgggccgtctggcccctgcggctcccgaagccgaataacttcatattggtgacttcttctcagacccccaaccaccggctcttgagcgagggcagctccctgtcaccttttcaccacccccctccccgaccccggccgacccagccccaaatcccc

SEQ ID NO: 647 - DNA, 43574 bp, Homo sapiens
attcaccttcttttaatcacatgtacacatttttatttattactgaattcagtgagggatgcagaatatgttctcttcctgccaaattggtattctcttacttacacaacagattcattccaacattcaatcatctcagaagctcaactcagcctcaaagttcctaacatattcaatcacctgttcaaatccttccaacagattcctatctcagaataaaagtaaaattccaatggcctttgaggccctaggtaaaaaggcctctacctccctctctgacttcaaagctcctacaactccctcctgtaattactccattcccactgtatgtgaagcctgccacccctcagtctgaaaatggagatgtagtgcctaactcgtaaatcacagacagctacaagtatctttgtactgaacaaaattatattccaatgacagtcattgagccttgcaataaaaattatgagctaattattaatataaatattcaaagtaaactataaataccagtgggaaaactaaaccaaatatagttttgctaagttttaccacatttatcctaaattatgattttataacaagtaggtgcctttaaaacattacatggtcataaaaacacgtaatttgacatattttcagatttgttaatatgaataataacaaagctataccaactaaaatacataaaaagctagttaaagcaaggtattacaagacacagcaatacacttcaattcatctggggaatctagaattaagtgtcgaagaaaatcacttaattaaattttaatttgaaaatactcacttcaggtgtaaacatttccatttataactacattatggtcttaacatgtggcaacataaagacattaaaattactatttcagcaatacagaactatctaccttaaaatatgactctgtgcctaataaaatttcataggtgacacaatgtcttttctcaaagtaaatcatctctcacctctatcttttatttcctagaaatgaggcatgtttctaagccgatatagtaaacacatttttcctttttttattaaaacagctttgttgaaatataatttacatactatagaatgtatctgttttaagttaaaagatttttagtacatttactgagttgtgcagccatctctacaatccaactttagagcatttccatcactgtaagattcctcatgcccattagcagtcactaccagcttccagccccagccccttgcaaacatgaatctactttttgtccctatacatttatcttttctggatgcttcatgtaaatggaattatacagtatggtaaacacacttttaatctagatttttatattcaactaagttcaacatgtatccagaaccaaatgtttaaattgtctttctagaagtttgaaaatatttatcttccttgatacttactactccttctgttttctctctctcatactgaaagagactttcttttaaatgatcacattcattcattagcttcttacttttctcttctagcacgaggtctttctttccactctcaataaagcctctttggatattagttactatctctttatgatcctctttctgatgaacgtcatctagttgctgtacaagccacgcattttcacgttggaggtgacatatcctctcttctacacagttccactttccagtggaattattcactttagcttctgcattttgatacatctctttcatttcctgtgtttgctgctgtgtttggcttaggtcgttttgtacagtttctaaagccaatgacttttttctgagactatctcttgtcttacggaacttatcttttaaggcattgaatttaatttgtgtttcagaaagttgttcagtaagaaactcattctcatcttttactttggaaatagcagaactcatttctacttgtacagaaacatctcgtgttctctctaaagcaagttttaggtttctttctgttttcacactttcactgtgtttgcttatagcagcagccagtctagactgataagattcaatgtcagcttccagtcttttcttgctttctttttccttcaacagttcggcattgagccttgtattctcagccttgagataattaagctcttgttgataccggaatgctgtttctgttatcatttcctcattgagttttatatacttttcaagggcagcatttgtttctttaacaattttaatgtccttaagatatttattttctttttccaagttgtcatttttcattgtacatatttcctgtctgagtatagcaatatctgccttcaaaatgcaattttcatccatcagacctttcatttcttcatgattatgaaaatcctaaataaaacaaaagaaagttttagctagtactcaataaaataacatatcatgattacctctgaagttaaagaataacctgcacatccgtaccactaaaaagtttaccataagtggatatccacctggagaaaaagttgaagcaaaactttgaaccttatagagcataaattccagaaagttcagaaatgtatttagagtcaatgaatttataaaagtaaacacacacacacacacaccagagaatttttaagaatatcagaattggaaaagcctttccctgaattacaacaaactcaaaagcataaattaaagcattaacaaatttgactaaattaagatatatcaaaaaattgcatttacactttgatacctaacccatacaccaccctatagtaagaacttttgttcacacatatttggacagataaaatttcccagagttattacagttctgtttcactgataacattctatttcagtttgactcttttaacacttttatagtcagttataagaattacattcactaaatcataaactagacattatactagtcactcctatatacattcattgatgaactcatctagttaccataattttgaaaaagaaatgttaaaaatataagcaagctacaggattttccccaggacttctgactctacttctagttctccaacagatcacagttacttctgtggtgtaaatacatcaatacgaaagaaaacttttatttcaaaatgccaatagtaaataagataaaatttatagagctcttcttagaatatcatgagattatttgcgattgcaataatttctgcttcctctttataatattaggtgcagtaatcaatatgaaataggggaaagtacaaggaaaaattttacctggaacaaaatttttatcaataggttatcactaagtataaattatggcatattattgttttcaaaagctctttgtaataaaataatatcctatgtggatgccaagatttataataaatattaataattgtacctgtaagtgtcatcattcatttttaaaaatgagataacatttatggttttagacctaaacaatatatattaaatcaagtggatattataagtaacagtgataagataaagtttaaaatatagaatttttaccaaagattgatttacccgatttggagtatttcttgcagtctttgatttcatctctagtgactgaacagttggttcaagttgttttgcttcaacttctttcttatattgtttctctttcctttctaattcttctctattttttttgtacagcatattaacatttgttttttcttcattttcttgttttaaggtgcatctgcagataaagacatttgtcttaaaattcattttgttaaaaaataaggagttcatcctgttatctacctctgcagatgttgtttattatcctaataaaatttctatgttctggattatttttcctttgcagttctcagatatttaatttctcacttcaacatcttcaaatgaatgcatatacttgaaaagtagtaaggaaagaatattctgctaaagtttttgttactagtcactctaatatatattataaaaaaggataccagagataattcagtaaagttacaggttcaaaattacctttttaaatcacacagtcataattactccctaattagaaaagatcatttacaatcaactaaatttttaaagttactatttattgacaagcgtataagttcactagaaataaattttcatctttatgaaatattgcaggtgtttctccaaatgatttacagagtgagatgacaccttcagatgtctctcacacaaactatatctgcagatgactgtcatccaaaactaggctgaaaagtctaacatctgtttccccacactttttatatttctttcttaatactttcaattcaccttcttattacatatattttatatattcattaacctattgttcattatgtgtaatatataattaatgcatgttaattatatattaataagtgtgtgtatgtttacaccagttatgttttcctgtgaaatctagtcccagaagtggagttgttgagttaaagggatgtcaggctatttgaaattttgatacacagcactaagttacccttcagaaataatttactaatttcctataccaacagtgtatgagaatgcctttttcctcacatttgccaacactaataattactttttaaatatcagcatgactttacaaaatatatcttattttatgttaatttgcttttttctgaataccaggcagggctaaatacccctggtaaaaatataaaacttgttaatcataaggaatattagtccaattttcaattagtttatagcacaatgacaattatctcctgtgaaatactgctataggcggccaggcacggtggctcgctcctgtaaacccagcactttgggaggccgaggtgggcagaacacgtgaagtcaggagttcgagacgagcttggctaacatggtgaaatcctatttttactaaaaatacaaaaaattagccgggcatggtggcacatgcctgtaatcccagctactagggagactgagtcagaagaatcgcttgaacccaggaggcagaggctgcagtgagctgagatcacaccattgaactccagcttgggcagcaagagagaaactccatctcaaaaaaacaaaaacaaacaaaaaaaacccaaaaccaaacaaacaaacaaaaaaacactgctataggcttacctatcatgctcttccttcagcttcttgggaaattgctgaggatacgttttcccaatctttctttgttgggttaatctgccagcagcagcagaagatgtactatcacatatattttctgaaagttgtattttttcacttttgtttgtattatttccttctttgacctttaataaaagatgaataataattgttattattttattcaataaaaagaactttttccctgatttttattacttgattcaggttaactatcaccactttaatgataaaagtattttgtgcttactttaattttatcattatacataattattataattataagatactcttattttatcatcgaaatttttgtcaaatctgctcatttctgtttgagggaatagaagaattttccaaaatttcaaaaagggctcttctccattttgtgcttttattcccatccactctttgctatctggtataaatttttatgctatctggctggcagaaacagagaaataaaaagacacaggcataatatatgtcttctgtctttactacctggattttacatgaaatagccagattaagaagatgtgaccttgtaggccttcaggaacagtaaagaagttttcccttttctgtactgagctactcttttccccactgccttttatctctcttttttttttttttgaatcctgtgatatcaaaaaagtaaaggttctctttgaattatgggaaccaacgtttgccacaacaaaagaagcagagtgaaactgctgagtttctagtgcagaattctggaaaatgagatgcttcccagatttcacattcaattaccacaaaagtttataggtggaaaacatatggtacagttacctactttaaccccattatctactgataatgggagtcaaaccaaccaagacatattaaatgtttcatccagagctcttgaggtggcattcactagcatttcatggcaccatataacatgatacaattccatattgctgaattacataaattaccagataaatttatcaaattagatatattaaaagtctaacttgagcaaagcaatttaatgcctcagagggtggaaaaaggcctcatctgcttttactttgaaagaagaaaatctctagatttttgtctatctttagaacacaatgtacagaactcaactttctactaaagagtcaaaggctaaatttttggctaagaaattatgcttcttatatgataaaaatcatacatgccaaaacttaccatactttattaaacaacataacgtaaggtctgattcaacagaaatattgcagagtggtgattttttaaaatatgtgtaagtatatgtttgttttcaaaaatattggaaataaccatgatgggactgtaagttcaaacagtttgagctaagcagataaacttgcatgcatgaaaacacattaaacagactcatttggctgggaatattcgttgcaactctcaaggctagacgtgtttttgtggcttgtctcagtcattgcttccctcccattgtattcccattctatcattaaataaatgtaaattatctctaaatgaatacaagaaaaaagaatctagaatctagagcttgtttctttagcaatttctttatgttgatctggttcagaaggtcacatggtatgtggcttaattagtttcccagctcatacgccacttggaagactgatagtgagacataggttgattaatgaacaaacattatgagaacattctccagaaccattatttagatagcagaactaatctactttgacacataattacacatttagataaccccactgtaactgtacacatgagattttcttgaatagaaaatttgactaaatcaaataattgataaagaggaaaaagaagcagcaagtgaacctctgtctttttgaagttggacttgcttttctccaaagccaggaactcaacttgtaacatgcctacctcattctttttttaattattattatactttaagttctggtacatgtgcacaacatgcaggtttgttacatatctattcatgtgccatgttggtgaccttggaatatcttcccataagtcttctagctatatttttgatgttctctcactatgtggtaaagaataactcacattttataattcaagattcatgcttctgtagttgttagcactgggattgccatatagtggctgctggaataaacgctgtattggttttctgtttttataagtatctgtagcagcagaaatactgtggctttctatctgaatcatatgcttcatttctttggggtgggtaaacaacaaatcaaaaagactttctggatctctagactgaggccaatgcctaatgtccaatttccaattagtggtatctgggtttacattttttgccatttgcatgtcaaactcttaatcatctttcatttcaatcataattactgggttccttaattttttggtttcagtatcattacaaaaattttcatcatctgtgttagaaacaagctatgtgtctggtttgctatcatttttatagtctgatttattttcatttaaatgaagcttagaagatgactggtaactgtatttcagggacctggagtatgaatggaataaaaagacatttgacatgggcttcctctgttcaggcgctgcctggaatgccacagagttagaccctccagatgcatcttcctcctcacaatcagggacctgattcatcagattagagggcactccttttttgttcgtccctctttagagttactatgtaggagctcttcctcagggcaagcagtaattctggagttttcaaaactttcaccaatattcagcttgaacttgtttgtaatgaattttaaagaaagtcgtgaatatacagacagattattccctttatcacaattcttacccagttctggttcttgagacttttttttttttttggcaggtgcaaaatggaaaacaaatttgcttgttttgtttctcagatgccttttctgtcagagtgcatgttttaaaattagctttaatcaagtataaacaaaaatactagaaaataattaaaatttaactgtgaaacttaatctatgtgttgccactcttaaattatgggattgtaactaaaaagtgaaaaataatttgccttggcttaacataggacagaaatatgaactggcaagctgaacgcttagcatttgtttggattaaacttaatgcattatgtgtaaaatctaccagaaatgaattcaaagctgataggtagtattataaaatcttcctctcttacaaagattttacctcagcataccagaaaaagtgagcccctacagtacgtgtatatttctgaagattaactacagactaggcaaacactgaattattaagagccaaactgaacaccaataagaaagggaagcaaaattttaaattctaattcaaataatatactatgatagtgttatgtatctagatggattatctgcttatatccacttctaatatattttaagttccactagtgatagtggatggattttttaaattttagtaacatttactatgtatttatgtcaaaataaagttattgtttgtaccctgacaccaaaggtcccattccacaaggtaggattctcttaataggcaactgggttgacttttatgaccccactcactccctgaacacagacacagaagtcaaatggtgaccacaaaacagaataaatctttaacctcggcactggtgaccagcaatataaaactgcaacatttgaaccattggcaatgatgactcctttaacactagtttaactcagtggccatcattgttaaattgttcacaatttctattccttaataatatgacccaatatttcatgttaccttctgtattatgagtaaggttataacaataaaagagcaagataattctgaaaatgtcttgcctcaattccaagggtaaagacagctatgagttactagagatagtaagaattaccagaataactaatagttactagagatagtaagaatatcttaagtttcataactggttaagatgttttaaaaattaaatataaaattatgatctatcggattctaaaggtatagtctaaaaggtcatgtcatttggactatgctttgttactgaagcaaaaaaacaaaacccaatattaaacaagaaacttgaattttcatatacctgtggttgcttcttttcacttctttcatgcctttcttgctcttcctctgaagccactggtaaggcttgttctgttgacaaattcattggtttagttcaaatgaactaagaacagttagataaagactataatctatataaaaataaatagagaataacatttctttgtattttatattttgagagtttcaatgaagcttaatgtttactgaaatatttagttctttaagaaatacttctaatcatccaaaatttcaacaaaccacttggggagacattagatatcaccaggttcaagccatatgaaatctcagggtcactcacaaattgttccacccaacataaatcaacaaaactgttagaaacaaaacaaaattttgaaatacagtcaaaatatacaatgtaacactttactatacttcataacagtatctttttaacaagacactaattgagttggcagttactaataatttgcaaaattattgttgtttataccttaattagtgtgcaccccattttttacatcgcaaatgttttcccctactattctgaaaaatttattttcatcttttaagactcagaaagtaggctgggcataatagctcacatctgtaatcccagcactttggaaggccaaaatgggggaactgctcaaggccaggagtttaagaccagcctgggaaccatagataaccttgactctacaaaaaattggacaggtatggtgatatgtgcttgtagtcccagctactcaagaagcttaggtgagaagatccctcgagcccaggagtttgaggttgcagtgagtctcgatcacaccattgcactccaccctgggtaatagagtaagaacttgtctccaacaacagaaaaagaaaaaaaaaggctcagaatgctgtgtgaagtcttccttgattctagctgtctttctccacacacacaggtgtctgcttcattggagttccttagtactttgtcaacttttccagcgtcactttaccacctgaactgcacatcatgtctttacatgttgatcccctttgctgttagactgtagaggacaatcttttgaatcatctttgtataaacagtcttaattttgctaaataattacttattgagttcctgctaagtgttaggcactggggtataaggaaggaaaataaaagctgtcagggatggctttcctaaagatcatgcatgagctgagacttagagagtaaggttagccagattaagtgaggcagagggcaggaaagggtgagcacatgccaggcagcaacaagagagggagagaagcctccaagagagtatgtatttctctgcaaaagaggaatggtgagggggccattaccagcagctcagtaattccagagaaaaaggcagatggggaaagggctacagatggagatttgggcagaaatcagtttccttttcttttctttttttgggacaaggtcttactctgtctcccagactggagtgcagtggcatgatcttggctcactgcaacccggcctcccaggttcaagtaattctcctgcctcagcctcccaagtagctgagattacaggcatgtgccattaccacctgctaatttttgtattctattagagatggggtttcaccttgttggccaggctggtcttgaactcctgacctcaaatgatccacctgcctcagcgtcccaaagtgctgggattatagacacgagccaccatgcccaacccagaaatcagtttctgaaatccttatataaaactttaagatgcttggacataggtattcaggagtggttcacagatctatttgcattagagataattaactctaattattgtgaggagcataaaattctgaggcatataaatcaatgaacaaagataaaatataaggcagtgttgcaaagatgatgcaggcctgaggagatgttttcagaaatatttaggacataagtatcagtggccattgtaagcatgaatttttattgaatgaataaatgtatatatctgggtccctggagaaatacactctgctcattactttacaaattttatcaaatgagaagtagaataatatacataaactgtttcagttacttgtatttactttacactttttctgtttcagttttactgtgccaaggaaatgcatttgggttttgtggtggttgttgctgttgctgttgttgttgttgttgttgttgttgttgttgttgagatggagtttcactcttgctgcccaggctgaagtgcagtggtgcaatctcagctcaccgcaactgctgcctcccaggttcaagtgattctcctgcctcagcctcccgagtagctggaattacaggtatgtgccaccatgcccagctaattttgtgtttttagtagagatgtgtttctccatgttggtcaggctggtctcaaactcccaacctcaggttatctgcccgcctcagcctcccaaagtgctgggattacaggcacgagccaccgcgcccagccacatatggggattttgttttaaaagttctgtttcctggatctaccaagctcatgagaaaatagaagcaaacaagtcatttgcataggtaagaaactttggatttatactttgtcatcactactctagaagattatcatcatgttttgtaaaataaaatgttaattctagacataaggggaaagagaaattaaaactataggggtgaaaaaatattgcataatttattactgttgacctgaccatatgactgattaagggcactgaatttaacttgtatgtgaagtagaccccatattagctgcagttaatcaatagaccaggtattctagcagaattaaatttgatgctcctgtgttatctttaaatgatacagctcttctgaaaacccatactcatagtgcatgattatccattaagacaaggtgatggaatgtgtgaatacagctcaggagacaccacaaggcaaatgctcaatggttcccattaatattggggaaatcaacattataatacagaaaaccataggcattatttaatatttggttttggaaggtatttttagtgacactgcatagagttgtacctaataattgcaaaattacagatgtaaaaataaaacaaaggcacattgtgtttgagtaggaaatctgtagacgtctagctggttttctattccaggcccaaaattctaaatataatcatggtacccgcacacaaatttatgttaaataccaacttcaatgaaattactctttctcctcattctctttgttatttatatgttgctttccttaagggaagaatacaaatgccttgctaagaagcattttgtttggttgtaggctgcataaagggagtaaacacaaagtacatttgaccacagaatgactttttaaaagccagaactatggtagcatgaagccaactgaggtaatctagaataaaattttctatgtttgtttcccttctttgctctctttctactctaataactgcgattcacagaggtaatgaagagtataattccctgataaaaacacagctccaagattaatcctttctttaactatgaagttcgtgtgtccaaagtcttgtagttgctgatttttgatcacgaatggtgatacagatatttatcatcaactcacaacttcccaaatctttgaaaagtcttactattgatggttcaactagtagaaacataatctaaaatatctgaaaataaagtttttattagaatgtaaatagtaatacaaattgtaataaggtgtaaaagttctttcttcactgaagcaggaccatgatgtcctctaccccacaaacacactactccctcatggtctaatgtatcttaaaagtcctgtaattgctattaactcagacaagtttacttaacttgttctaagcttctgttatttactacaatttactttatcactcaacaatctctattatatatgttgttttccatgagaaatttttttattaataattaggattcttcagggataagaaaatatttgaataactaagtttgtgcataaacacattaaggtcaaatacccatgacaatattgtgtgtttctctgtactagagacaaaaacttcaaaaaaatttttaatgaatatacattaaaaactgctttcattaaactgagatgatcttccctcaatgcatgaataccttcagaattcacatagaccaaagaattgtataaaatataatagccttaaaaatcttatttgtacctggcacagtggctcctgcctgtaatcccagcatactggcaagctgaggcaggcagatcacctgagatcaggagtttgagagcagcctggccaacatggtgaaaccccatctctactaaaaatagagaatttagcagggtatggtagcacatgcaggtagtatcagctactcgagggcctgaggcaggagaattgcttgaacccgagaggcagaggtggtaatgagtcaagaccgagccactgcactgcagccttggtgacagagcaagactctgtctcaaaaacacaaacaaacaaacaaaacacctaattgttcccacataagtctatattcacacaagatctgaagagtacacaacaccgtgagacaggacagacataaattttaaaagttatattcccagtttctgtaaaaataaaacggttgaatttaagcttttaagacaagtcaaggaaaagagcaaaaaatgcaaaagtgaaacttgaaaggtcattttcccatcaagggctcatgatccactggacattcacaaactatattgttcaaaacattagttctgaattttgatctgagtatccctggagttgcagtttcattcaaagatgtccaagaggtcaaataagacaatatcatttgctattttcagttttcttttctgagaacagcacaacaaacttcttcagagaaatgaattgtcctaacttcataggctaaaggctcatgagtcacagttctaagggcatttataaaatatggtggtgcatgcttgtattctgaacttttcaactttaaactctcatatagtaaatattaatagatacaaactgattaaagaaaagcccacttaatctgacattatttttatttttctttctttcttcatttatcagcaacaggagagtctaactaaatgtggtaaagtggtataagggaatacaatgaaaagtgtaaaatgaattaaaccagagataatcatatcaatgtggatacatctggaaaatataatacaaaatacaccaaagaaagtggcagaaaggtatgtaaagtgtataaccactcacataccattttgggacacaaataaaaaattctgcatattatttctgagcatcacaatatagttaaagatttcaaaagggcattgaaatgaaaaacaaccaacttatgatgtcggtagcctctatgcaatcatgttttaaaaaccttaacaccaaaaagtctcaaaatcaccattttaaaagactgtgtctaccagttataaatgaatcattactttcctcatttttaatagtcaaagatgccacaaacacacacatacacacagctatatatacacctacacacacagtcttgctcattagaacatctgattggcttcagatcatcagtgtaataacactagcagcaagcctctaaagttaaaacagaatctgacatgttaataagtaaagctttcctctaggtaaagttcagaactccaagtagcacttaactcattggaaatatcttagagtctcaaaattcactgctttgaatccctgacaggtataaaaattttatactgaaaacttcatgctattcaaaacattaaaagagaaacatctgagttaaagcttacatttttaaaatcttttttatgcttctaaatttatttttattcaaatatggataccaacaataacatttatgtcaatgccttccattcaattttgaacaaatagaattaggaataagaataatgtgagtacttccaatcattgaatgtacttatttccagtattccattaaatgtacctgctctcaatgtctgtacattctttctttgtactgctcctttcacagcaggatcttctacttcagtgctaggctgaatgggttttaaaagaaaatgattcataaatcatatatattttatacaacatggagttagtgattcaaaaatatacataattaattaccttcaaggaaggatgttttgcaggaggccctacaaagcaaaggggatatgtcatcaattatatgtaagtatgacagggccaaccaaacattcatgcagtggtactatcgagctgaattctcatgcctggctataaaaataattacttaaggttttgagggttcttcttggcatcttttcattgcctaggacggcaacatgacagaaacataatgaggaaaataggaatataggattcctaaaatgcacagtttacatttcagtagtgagattatgtttcaaatgcctatacctaaaatagaaaagcatggatatcaccgtgaacatgtggactgatgaggagaaaagggaccattaaacagaggagcaaatcaaacctgagggaatcgacgtcaaagctgatggtgaatgtacagagtattttaactcaacacagcagaggcattgctgccagcatgccacaaacaaattccccttgtcttgtcactgaggaaatacacagttgggatgacagttcaggtgaatgtgtgattcacctctcatcaaagaaagtgttctacattgatcagctagtatacacacttatgaaatgacagctaatcaaactactcatttttcccatgatcacatgggctactgcagcacctacatttctcctatcccctcatttggccttgagttagagctccttgatccactcatgcaaggatcacataaaataaaccatgtcgaataagcttccgatatcaaaatatttatcaaaaaagaaaacactgaattaccacagacttgctggatatgaatacatatttatatttcaaaatcagtgcagtatttattgaaaaagagaattttggtattcacagaatgaattttgtaatatcaaaaaaaattagccaaagcatctatatgcaacttaatcacatcttattcactcatgtcagtgaaacttctctctctgaggcctgacagttatcaagtgaaatgagctgctgtggtttaccccaactctagcactccctcctgcctccagtactctccacagcaataacctcttttgtgagactgggcatatgctgaagcaactggaagtgagttgtctcaagtttacttggcttcaactcccaagaccccagcaaatgtctttctttcctccctccgtgtcctttcacaatccctcttcctttgaaaaagtgatttttagaactgtcatcctgatgcttcccttcctaactgctttttatggataattgtgaccacttttttcatctgtattcagcagtagtatacacctgtaatctctctgttttcatctcattctccttcccctgtggctagaatcatgctcagaaataaaaggaaattaatgctttccctggattctgttattttttaaattgctctccaatggttctttttccagagttctctaaaggaaggctattcccttgctattcagagctgtgtccaaggaccagcaccaaaaatcacctgagtactcatgagaaatgcagactcccatacctgctgaatcagaatgtgcaccttccagaagctcttcaactcattcatgacaatttgaatgccctgttctacactgatgtgcttccatattggtttcccctaattgcccttttggcctagcctcaatttcttccctattatgtccctcaatttaatactacattataagccataatgtttctaatgaacttttaatcaggcaataacttcttgaattaatttcttctccataaatcacccaacactattcaattatgttaatttggcctatatgatactatcctatgaggttacaacattttctataaaaacaaattatagccatacatggctgaccatctttggtgatgttcatctatggtagataaaacacaggtctgtgtggtgaggtgcctcaatccttaatgcctccccagtagcgaggatgacagcaagagaaggaaaatgttactgtaattctctgacacattttggtactggaagctcactttatcttctttcctgtttctaacaccatgttcttccttcttctacagatcaatttgcctttactatcctctcttacttacctctgcatatgcttttttatttattccatgtacaatccgctctcctcattctttctttctctttattcatttcctcttccctctctcctgacttgcctcaggtcttagagtatcttaaaatggaactcacaattcagctcctttagtggtactcccaatagaatcaactgctgacccttggttagagacacaacttatcaccatttcacttctcctttacttattatacagttaataggacactttctttagctattacactctattagtgctcatattttcaaagaaacattccatcaaatgactttttttgttttgttttttctgagacggagtctcgctctgtcgcccagggtggaatgcagtggtggtatctccgctcactgcaagctccgcctcccgggttcaagccattctcctgcctcagcctcctgagtagctgggactacaggcgcccacaacaccacctggctagttttttgtatttttagtagagatggggtttcaccatgttatccaggatggtctggatctcctgacctcgtgatccgcccgcctcggcctcccaaagtgctgggattacaggcgtgagccaccgcacccggcctccatcaaaagactttttaaataaaatacggttctcaccttctccttgtccattgactattctgtttcctttttcatgcgaagatccaggtaaaggctctgacactttctcggggacacactgctaaggtaatatcaagaattagtttccattttaaaattataatgagttgcatcaagagtttcttatcaatctctttttatgaaactgggtctcactctgtcaacccagggctagaatgcaggggcctgattatggctcactgttgtctcaaactcctgacctcaagcaatcttcccacctcaacttcctgaatagctggaactacaggtgtgtcccttcatgccatgctaatgtttttattgttatctttgcagagacaaggcctcattatactgcccaggctggtctcaaactcctgagctcaagtaaatcttccacttctgccccccaaagtgttgagataagcagtgtgcaccaccacacccagccctaatcaatttctttaaatcaatctcaatgttgcccaggcatggtggctcacacctgtaatctcagccctttgcaaggccaaggtgggtggattgcttgagttcaggagtttgagaccagcctgggcaacataatgagaacacatctctactcaaaaaataccaaaaggagtcaggcatgatggtgtgcgcctgtagtcccagctgcttgggaagctgatgtgggaggatcacttgagcctgagaggtggatactgcagtgagccaagatcatgccactacactgcagcatgggcaacagagcaagaccctgactccccaaaaatttcaatttaaaatatgagaatgaagagagatacaaacaaaaaacaagcctaattggtcaatgaaatatgagcttaagccaagaaagaaaagagacaacatgaagtacaataaagtacatggggaaatagatctataacagagccttttgctctttcatatccctgataatactaattaatatttatgctacaattagttttttgtaagtacttctgtgatatagcttattactataagacattcaattagctaaatatggtcatcgaccactacctgaaagaacattattataacacagagagaaaactagaactttcaatcaactttccacccagaaaaaaattggtcaccagaattctaaagagtaacgtatggcagacacatgaaaaaatgctcatcatcactggccatcagagaaatgcaaatcaaaaccacaatgagataccatctcacaccagttacaatgacgatcattaaaaagtcaggaacccacaggtgctggagaggatgtggagaaataggagtacttttacactgttggtgggactgtaaactagttcatcctttgaggaagacagtatggtgattcctcaaggatctagaactagaaataccatttgacccagccatcccattactgggtatatacccaaaggattataagtcatgctgctataaagacacatgcacacgtatgtttattgcggcactatttacaatagcaaagacttggaaccaacccaaatgtccatcaatgatagactggattaagacaatgtggcacatatacaccatggaatactatgcagccataaaaaaggatgagttcatgtcctttgtagggacatggatgaagctggaaaccatcattctgagcaaactatcgcaaggacaaaaaaccaaacactgcatgttctcactcataggtggaaattgaacaatgagaacacttggacacaggatggggaacatcacacactggggcctgtcgtggggcggacaaggggggagggatagcattaggagatatacctaatgtaaatgatgagttaatgggtgcagcacaccaacatggcacgtgtatacacatgtaacaaacccacacattgtgcacatgtaccctagaacttacagtataagaataataaagagtaatgtatggcttgaaaacgtatatttaatagaacatgagttagagctaataaaaagcttaagaaatgttaatctaaaatctcaatgttaagattccagttgaatgatactagaaaatatattgtaaccctatttgctactgatgacctatttctattttatttcctttttaattatggcataatttctcaacataacatatcaaaacttatacacccttaaatattaaaaaatacaatgtaagcaatattttaaatacaatatttaattattagatacattaggtttattatattacttataacattccattatataaaaattcatttgtctatttattcagattaaacaactattaaggctgaatgtcttatgcctgtaacccagcactttgagaggctgaggcaggcagaacacttgagcccaacagttaaagaccagcctgggcaacaaggcaaaaccctgtctctacaaaactcagctgagcatggtgacacaggtctatggtgacatagctctattgtttaaactacttggatggctgaggtgtgaggatcacctgagcccaggaaatggagattggagtgagccaagatctcaccagtgccctccagcctgggggacagagtgaaaccccatctcaaaaaacaacaactaaaatgcttcttacatggaagactgtattctaggtactccaggatacacacaaatatgtttactgacctccagtagcttacggtatgcaggagcttccaatgattatttaaacaactaaatagaaaaccttctgaaattcaaaatttcagaatatgatatgaggactttgagtggctattttattttttaagatgtagtcttgctctgtcacccaggctggagtgcaatggtgcgatcttggctcactgcaacctccgcctcccgggttcaagcgattctcccaccttggcctcctgagcagctggggttacaggcatgcaccatcacgcctggttaatttttctgcttttgttttgttttgttttgttttggttttggttttttttagagacagggtttcaccacgttggccaggctgatcttgaactcctgacctcaggtgatctaccgacctcggcctccaaaactgctgggattacaggtgagtctccacacctggtgaagtaaatattttaaataaactacaatgacaaaattatgaggataaagtcttaccatccattggtattaagagtctctgcttctagaactggttatttgcagcaaaatacatgttattcaattagatgaagtgccttatataaactcttcatggacaactcataaaccacacaaaaattcctttgcaatacacattttgagaacataaatttaaatttctatatttccacaatttatatttttaaatcagatacgatgttgcccaggctgttctcaaactcctgggttcaagcaatcttcctgcctcaaattcccaagtagcagggactacaggtgtacaccaccacactcagttatttttctacaatttttatttttttttgtctcactacagaaccaataatataagtagaaaaacaatctctcgtaaaaacaatatgataccaaaataataagtttccaagaacaaaagctatatgctatgtgctgaatattcttgccactaaaaatcaccaggaggatcccatgattactgcaaataatttgatccactgaagatttatacaggcataaatattaagaaagtcacactcgtatgatttaaaagtcaaagtattagtatttatccaaataaaccttaagcaaatttcatatttcctctattggagaaagcatttcctaatgtgattttcctgtcactactaattttccagttcattttttttcagctcccaccctgtcacagtacttatcaatctttgttagttaccaaagttaaacacattttttgaatcaactagccatatgtatgtttttctctgaccaactttccattaccaccataaaacaatgataggtaaaccactgctaaatttgaaaagtaaatactatgcaaaagtacattcagagtgagaaaattaattttacaagagaccactttaccttagtagcaacattcaagtctttgtcatccgatgcaggcaatgaatccacacgcagttcatggaaaatgcttgagagcaaaaacacacaacgaaaatgagcaagttgatttctttacaatttttttaactgccagtttatatccagcttccccctcaaaaaaggaaaccataatctagggaaaggtcagcaatctatatattaaatagtgattcttgatataattaaaatatgtcctcttctaaaaatagattttagttacctatttctgcctccacttgtctaaatctataaaatattcaatgaaaactaaccttgagctttataacaaatagtgacagtcaataaattggcagagcctgacaatgatttgccctcacaaattatctgtcctgaagctgaacttaaaattcaattaatggatgacataaattttgttacctaaactggaagaaaactaacaacctaaaacaaggtagaaagatccactgtctcttttccatgatctgtctctggataaaagactaatctgcatcacttcaatatggcagtcttgattcctcagcatggaacccacttaggaaggtcctattgctttcctttgccctaaatcagtacaggaaagcccctacaatatttgaaatgtatgaaagctaaatgtacagaagtcaaataacaaaggtgtatgttcttattgagaatacttttcccagaaagattgaaatattaacaattataaaatcccattattttcaccctataggtcctaccttattcaggtccacataaactagcaagcccttaaaacttttcataggcactcagacacccaaggagagagactgtcagaaaaaaacagagtcctggtaggtgtacctctatttccctaagtactctctaagtatctgtcttcctatgggctcccacttccagattccacttctgcagggctccacagaagtctccaatctttaaatcttcagtctatgaaagcacagattcctgaaaggatggcctcaaatgaccaggactaggagctctctatatccctgctcctgaaaaacaagctaactggagtctccatcacctgcccccagctagacacactaccaactacccaactgaactccatgactgatttgccagccaatcatgcccctgaaccagcccacatggacatgggaaggacatcagtgaatcgggaaaagaggcagaggtgaggagacacctgtactgggccacagatctatgtagttcagcaatctccagccccttagtactccaggggctctaagccacccctttctaagtcaggatggaagtagatgacaccacatttctatctgctgcagacgctcctcccagtgtctcaaaatgttttagcatctttcagtaaaaatcttcaagtttgtcagtccttgatttaaaaaaaagcagcaaactttttagagctcccttgaaccttctattttaatgtgccttcgtagataattcccaacatcttgtgtccttcatttttataatttatctttatcaaacttgtcataaaccccaatattttgatctcttatagaagagtctgtactcctatccaatccagtgttgtttatcttcaaacttggacttcccctgctcattccattcttatctacttccattgggttccccagctaattccattctcattctacccacagactcactcccgtttgtattattaaaacacacgccaataggatataaaaagaagcaagagtactgggctttaacatgagttcaaatctcatttctgccaattcctatgtctaaaaaaaagcatcctaaactctttgagcctcacattctctatctagagaatcatttgaccagaatgttcaacacaggtaaaaatactagaaggtattttaattcattccaagattccttaaaattctgtaattctatgtcctcttgattctgtctatagaaaaacttagaatacatagccagcagagtttgaaaaaataatagaacaaaagaaataccaagaaaagcagagaagaaagttttaaaaaatgaaggcaagattatagaaaagtcacggaaaaagcaacaagactaaaaaatgtattatggaagtaagcagaaatacttgcctaaatggaaaaccaaactgggaagtcaaataatttgtctctaagacttgcctaaacttgcttttgtaaaacttacacccctatggcaaagctaagtaagatctgccctagagcctttgatggtaaaaataagatactggttaccactgaaattgtcaaatttattaggacaaactcttggactaaccacattctaatgataaacttaaatgagagttcaaggtatttaaactctcattaatttagacattaatcaaattaatcaatctgactaatctgattcagacctataccttgatccaagggctgcacagatatctgtcaatctatgctgaggagcaagagacaggatttggaaggcaggcaggctgatggtcaaactgtaggccagctactttgttaactatgggatcatgaggcaattaatcagctctaatccatagttgtttatttaataaacagtaggttataggaacacagatgttgtgatggctttatgagatgataaacgcatagaacatattaggatgtctagcccagaatacaacactcaacagatattcgtttcttccatctatattttcttagttaacataattttttaaatctataaaatcctacctgactgcagattcatcagaacttccaacatctattaaagaaaaaggtaaaatgcattttaaatcaataacaaatgtacagaatattaaaagcataagaatgcacagtgatgcatccctctaatccaaactacttgggaggctgaggcaggaggatcacttgaggagcccagaagtttgagaccagcttgggaaacatagtaagactctaccttcataaaaaaattgtgcacacttgtatgtatgctttagatcctgttttttgttgttgttgtttttgttttgttttggtttggttttttaaagcataagactgatgctttgttacaaagcattcctttgagagcatgcctgggaccttattagaattaacattcgttatacatattggtaggtaattaatgcagtaagaactcttccctttgtatttattagatgcaaagaagaataaatttattaaaatttggtatctacaagtgaactgcagtatgcaagtcatcttagccaaaccctatgaggttgagtaaaaatggtattgttagcagaacaggtgtgatgagtcaccagtgtcaaagagcatgatttctggaccaaaatatgaggcgccattaaaacagagtacacagtagtaccccttatccactatacgtgcagaaagacatacttgacacatttttctctactgtcacaccacagcaacaatcatcaacaaagaaggcttctgtgaccaaatgtgtggagggtttttccccaccaacaagcaagcaatcattcctgctgatgacacaattcaattctcacaccttatctgctggtaacatcagattcaatttaatttataaattaaactttagcatagatatgtatgtatagggaaaaacagtttgtgattcagtactattcatggtttcatgcatccacttgggggtcttggaatgtatctcccacagttaagggggagctactgcacttattttgttataacacaacacagcctctctagctcttcagttcaaactgctcagtttagaataaaacaccctaacaccagatgtcagcaaaacataggaatccgaccagaaacaggaatccttgcaaagactttccagccgctagtggaaaagagctcaaaagagatcaatgtattactctggctactactctttggggaaggtgctgggtggtttacttagttgtagctatttgctctgccctacatatagcaaggcccaaattcacctgccattttacctcccacagaaaaaccactggaaagatcactcctttaagagcttatacgctaggaaccacacctcacattcagagagaagctgaagaaacaccagggaggtgtggcaggctgctggacagtactatatgatgtgaaaaatatatagaaagaaaaccatcaatgcccttttactaccagaatgttccagtgcttgcccttctccctagtaggggaaaaaaattctttttcacctcacagaaagcaaaactctcttgctatccctcatgacagaatctagttgtaggtgagtcacatcatcataatacaggctgttgtcaacctcatccctcaaaggaagaggatcagtgaggaacctatgtacttacctatagcattcactgtctggtcttatttccaaccgaaggtaagtatgaaagactttgtgattccagttttataaagtacaaccccttgcacttgtccccttccattgctagagaatctatctggacccacctcacagagcaagatgctccagtttgtgctgtgtggtacagcatggtgtccttttcctcaaccctttctattatgtgcacatatctatacaaatcatgttttctaagtatgtaaagcatatgtcatcagaatatatcattctttacaatgataaagaagcaaaagaaaaacaaaaggacaaagaacatcttaaatgactacattcaactgccatggagctttaattttttaactattcaaaaagatatccactgtattattccaactatgtgactcttctgaaaaaagtaaaactatgaagacagagtaaacatcaatggttgccacgagttactagggagaaagggaaagatgaacaggcatagcacagagaatttttagggctgtgaaactgttctgtcgataatattacagtaatagatacatgtcatgtcattatacacttgtccaaattcacagaacgtacagcatcaagagtgaagcctgatgtaaactatgaactttgaatgattataatgtgtcaatgtaagttcatcagttgtaacaaatgtaccactctctggtggaaaatagtaataatgggggaggctatgcatgtgtgggaggcatgggatatatgagaaatctctgtaccttcctctcaattttgctgtgaacctaaaactgctctaagaaataaggttattgatttaaaaaaagatattcagctgggctcagtggctcatgcctgtcatctcagcactttgggaggcaaagatgggtggatcacctgaggtcaggagttcaagaccggcctggccaacatggcaaaacctcgtctctaataaaaatacaaaaattagctgggcatggtggctggcacctgtaatttcagctactcaggaggctgaggcaggagaatcgcttgagcctagaaggtggaggttgcagttaactgagatcgcaccactgcactgcagcctgggagacagagtgagactccatctcaaaaaacaaaaagatattcactgtctatgcatcccaggatctccagaacaattacaataaataaataaataaataaataaataaataaatggctgggggcagtggctcatgcctgtaatcccagcactttgagaggccgaggtaggtggatcacctgaggtcaggagttcgagaccagcctgactaacatggtgaaaccccatctctactaaatacaaaaaattagccaggcatgattgtgcatgcctgtagttccaggtacctaggaggctgaggcaggagaatcatttgaaactgggaggtggaggttgcaatgagccaagattatgtcattgtactgcagcctgggcaacaagagcaaaactccgtctcaaaaaaataagtaaataaaataaaaaataaagatattcactgaacctgttactatgatatatttaagcaagacacggtgaccctaaaaattagagatcattgaagaccaaagtaacaacatgtggtcattacttctcaaattgaactatataaaatatataaaataaataaatttaattgcatgcttaggtaagaaaatattgataaaaataattgaatattttatcttatttcataattctaaacagggatttagcacaatatgaaaactagactattcatgtaatcaaaataaaagacaatttttattctaatgttaactcagaaattattttgcttatttaatttaacaattttactgaaaggttaatgagataaataggacagattataattacctaacattgctatggtaacttatatacaaatagctgttcatcaccaaaagtcaaaaaagtaacaagcactgcaacttaagatggattatacaacagaaattagtaccaagttaccttatcttataatattatgttattaaaatgaaattttaaaacaacaccaaaaattaagttggggttacaagtgttgtgcagaaaagatttcatatagcaggcaagaggctgccatccttagaaaggcctgcatgcaaggctggcccttggctggtgtttaggaaattggaaatgggagggtttccaccattccctgagaagagtggctcactgtgtctaaagtgcttatagaaacagtgtatttactctaaacagctgctttccttgtaagagtctggaatttgggtacatgtgagggagagtaacctccatagaaaaacttgggcacttagtctctaatgaaactctggtactggtagacatcactgcacatatgttgtcaaaatgtgagcctgggagaattaagcagatcccgggaactccacaggacagaactcctggaggcttgtgccttgtttcctccagaattgaccacatgcacctttttcctctactaattttgcttgtccccttccttgttatcaattaaagatctgagtatgactatttgttgagtcctgtgagtccttctaatgaaccaccaaacctggggtggtcttgggaaaccttgacacaaattcattgtgtaagatttgtattaagttgatatgatacgtgtaactgtaatcagatggttatttcacagaataactttacctaatctgtttttcttttctttttttgccttgatatttgacttggagattctcgtatttctatatctatccaattgaataaagccatagaaggaataaatgaaaaaataatgtcagaaaataatgtgaaatgagcagcaatcctcttttatctgaataaaaaatagagaatctgggtgattgacaatatgttctacaatatgaatgtttctagaaaaaaaatgaaaaagtggtcaattttctgcaactcaactgggcttcattcctttttataataattttgaaggccaggtgcagtggctcacacttgtaaatccgagcattttgggaggttgaggcaggaggatcacttgagcccggaagttccagaccggcctcggcaatatagtgagacctcatctattaaacaaacaaacaaacaaaaatcccttaaaaagaaaattagccaagtgtggtagtgcatgcctgtagtccaagctacttgggaggctaaggtgaaaggatcatttaaggccagcaagcagaagttgcagtgagccaagatgacaccactgcacaccagtactgacaacagagggagaccctgtattaaaaataaataaacaaataaataattgtgtatcaggccagatgtaaccacacaaaactgtagtcccagctactcaggaggatgaagtaggaggactgcttgagcccaggagttcaaggctacagtgagctatgattgcaccaatgaatagacactgtattctagcctaggcaacatagagagaccccatctcctatgataataataattgattaattgtgcatcattcaagtaaattgtgtaactggagaaaaacatatgactattgaatatactattatagtctactactgaccatagagttcctgtttacttgcttctaatctttttcttcatttctcataaaactgaaaacatgatttaaacccattaaaggcagttcatcacaaaacaagtcaaaaagtcaaaagaattgcatccaaacagtaggatgcgttatccaccgctctctgtgaacagttggatttggtcattaagaatcagcaggacttttaactttgtgtctgtgtgcacaggtgtgtgcacatgtgcacgtgtgtatgtgtatgtatgtaaactatgacagataaaatcattttgcttgtgtacgaatatgtaatataacttgtgcttctcacaaaggaattgcttttccgtctcctgtgctcagtagctgtcttcaaaaaataatctcctatttgtatgggtgcacactggttcagttctacagttcttattgccatttatttatggtaccagaaagggattgctgagttcctggttctaaagatagttactttcttagtgacacaaatcaatatgtaatacagttcacccttgaacagcaagggtttcaactgcagggattcacttatatgcagattttcttctgcctctgcaacagagagacagcaagatccacctctcctcttcctcctcagcctaatcaacctgaagatcatgaagacctttgtcaggactacttatgctttatgaaaagtcaatatgtttctcctgatgatttcctttctaacagcttcatttctctagcttattttattgtgcgaacacagtatataataatgcagcaaaaacaaaataggtgttcatcaactgtttatgttatcaggaaggcttccagtcaattgtgggctattagtagctaaggtgaaggaatcaaaagttatactcagattttcaactgcacagggatcagagtccctcacccccacattattcatgggtcaactgtagttatttgtttactaaatataaacaatttattataaaaatgaaatcgaagatccatttgtataacaagtccaatttgttataatgtgactatagaggaaacatacaacatactaacttaaaaatcttttttcttatttatgcaaaaatattatataggattttagggatcataattaaataaatgaatgttttcagacaataatgtttgagattgtaaattagctacaactaccttcttaaataaatctgaatttcaaactaaagaagttaaattttaaaaattaatttacatatgtatatacatatatacacattcaatttacacatatttttaaactggtcttttttgactgaaactaccttaatcttacatcttactttgtattttcttatcaagagtaggaccaccaagacaagtaagaaattcacaatcagaagtcttacctgatttctcctttttaagtatcttctttttatgttccaaaatttgttgttgaattctatgtatacaaaagtaataaataaaattgccatttttataatgaaataaaaaatattcaccaaacatattaaattccaaaacactttcaagcaatatcagacctaatatcagaattttaatgtcccatacacttcaaatttgtaaaccttacaagcttattaagcttataattaaagaagaaaagaaagtgaagtactcataaatggaggaagcacagctcagtaaatgaactctagttagctggatatcatgcaaagtgtcctgcactcagagtaagtccttgctctgtaaccaaaatacctcgctctgtaggtattttgtcttcagacaagttgcttctcttaggctccatggtttcttctaaaaaacaaggattctgctaccttacttcactaggttgtttggaagatgtaatgagattacatgtttatatgttcagagaaatagtaaagcaatggaataatttattcttgaactttattgctgaaaccattttggaatcccaaataatgctcggtgtgtgtttttctgtaagttctaatactcaaatgttgcagttttcagaaaatgttattaagtgctaattttggttattacttgtattcattgtggcttgtaattcagggcattttacctaattcataacttattactaaatttctatatatataaatttagtgagctcatcactgagctcatcaatcacaccaagggcagaaaactaataggtgtcaaaacctggcttggacaactaccactccttctctacctcctcaaactctgagccagcagatctgtgcttggctgctggatctccatggtcctctccaactaacagacaagacaaaaccctgctttgattgtttttcagttccatgaaggaaatacaagttgacattttctcatttccaagacatgtactaacaacatgtaacatccccttattactcagctctgttcccatttcagagatcaccatacatcaatagtttcatagcgataatcacaatttcaatattgcgtgtcacctgttttggttttgctcacactgcttccttggagctactcaacaaatagtcaaatggcctacctgggactaggcaaaatatggaatgttttctgaatttgtgtgccatccctaggcagtagccatgcttatctgctctgtattgatccaattttaaaatatgtgctgttgaaataagtacaaagccctgtttgatacatggatattcatgagtcatggatgaggcttagctctattaaatccaactcacttacttcagattcagagaattttattgaatggcttcctgtgaggtagaattttaaaatatattgaaaacttgaggaagagctgcaagtagcccaggagattttcatgattatagagacacattacttgaggggccaactgcaagctggttcccactactcagtggaaagataacatggaacattccgctatctaaccaaagctgctgcacaggatataaaaaagcctcaaggtacagatctgatagcaaaagagacagggaactctgatctcttcctgcaacattatttgaacatccctgactattgagaacaatcccaactaatattggttaaaggaaagacaaacatggctctcaaaggataacataccacgaaggcctaggcaaagtctagctaagacgtgggctccaaataaggtttttagtgtagggtgagcatcaacttgctcaatatttgtgtggataaagctaggaggcctagctgccagagcagggtgctgggaacaatgactgagcacaagtacataaactaataaacaccgtagctttgacctctatatatgaatcaccatgaaaactgaggggtctgaatcagtgaaggcatcctggtggcaaaggtcaatcattatcagattgcaggaccagttataatggcaataatacagcaagtgagtccatggaaacaacagaatgattagaatggccttttttccccttcttctgacttgtaaagaaagattgccttccttggacttaggaaaccccttagcttcttggaaaattcaaagaaggaagacacaggagagagccccaggggacaatacatgattttctgttaaactggacattacaagactcaataactaattagaaaagtcaggccaggcatggtggctagcactttcagaggccgaggcagggggattacttgacctcaaaagttcaagaccagccagggcaacagagtgagaccttgtctctacaaaaaaaaaaaaaaaaaaaaaaaaggaaaggaaaggaaaagaaatcaaagacatggctctttttatcccatgcatggggattatacttagaataaaatgaataacattgagatccctagggataaatgtctcaaaaatccagaaaaaatctcgcactctacttctaactaatctagacttctgcttgatttctggctaaaaggtagactaactcttcgctatttcaaactatctgaaccaaactatgaactctcacctaatgcataagatggagtagttgcaattattttaaacttcaatttagcattaactggccttttaacataaacacttactttgtcaaatgatgagaaatagcataatcttctgcatctcgtccacacatgtcttgagcgaagacatcaatattttgcttaagaaggatattgacaatacctggtgagtcatagtatacagcaagcatgagagctgacctaaaacaacaaagaaataactccactcaagaactttaataaagacttttttaaaaagctagtttgatacactttaccagtttaatatccgcctgtcagtatagatgtaataactatttgcatgtactagcttgggtctataagcatctagggtgctcaagtgttcatctttgtaaattgtcaccaaggctaaaagaaagggacaacagggaagcctcttgtcccactggggtaagacataatacaagttgctaacttatagtcctttgatggccaagaaactgtgctgaggtcacttatctaaagtaggcaaagatttagatgaagatttccccattgctttcctagtcaaatcagctaggggtcagataagagttatctgcaggctgaaaacaacaacaacaacaataataataatgacaatgctagtagtcataaactaaaagtccacactttgaaaatgaataaaacttgtcaggtgcagtgtctcatgcctgtaatcccagcactttgggaagccaaggagagcagatcacgaggtcaagagatcaagaccatcctggccaacatggtgaaatcccatctctactaaaaatacaaaaattagctgggcatggtggcgtgcacctgtagtcccagctacttgggaggtcgaggcaggagaatcgcttgaacctgggaggtggagaatgcagtgagctgagatcacaccactgcactccagcctggcaacagagcaagactccatctcaaaaaaaaaaaaaattaataaaactaatacaaaaccctttagctaataaaagattacagtacgaaaaacatctgattataaataccaaactctgtatattataagagaagatgaatcctactatatactattctttatgttactcagtccaaatatttgcttgtctacctgattattcatggtgatatttttcattatatgccaataattatgttaatcttcttattaatatttctgacttgagtgaccactctagaatactcaggttttatttttaaaaaaagaactactgtaccgtctcagcctatcaacggcatgtgaacttgctttccttttcaataaaaattccaccattttctctttcttgcaaattatagcaaataaaagtggggtattattgtcctataaaacagcagaaaaaattaataattcacaaaattacatatttctcaactgaactgaaaatcttctccaggatgctttgaacttcaacatacaatatagaaaggaagtaaatgaaaagcagtcccttcattctcactcctctgtgctttctgatgtgctgtgctttgccttgcaaacaaccctcctctgtctccctggattaactgtggtcattgccaaaactcactttaaacatttactagtcccaagaatccttgctttgatcacagcacttatcatggtacattgtagtcatttcattgtttcccactgaaaccaagagcttcttgaggcaagggcctaaaaccctaagacacagtagcaaatattttaagttttttacattaattaatgatctaaattactatctctaaagcagtgtctcttaaactatattccaaagaatatttgctttatcagaagtattataccgcaagagaaagactccatgaccatctgtatttgagaagtattacaaaactgtattttatgtccaataatcaagaaatctctttaatttcacctaatcccctttcacaatactatttgtggcaaacattaacatttgaggaattaagagtttcagagatacagttgccagagcttcccaatacaggtggcagttccctctgggtggtacaaacttgcttgattcacttttatcaatggtgtcaggatcccagatgccaatgtcaggcactcctgctccaaatgggtcaccatggaaatgagctttgaattaagagagattggcttcaaatgcatttattttccttattattaaatagtccatgggtttttcccctaatacaagagaagagatttttatctttactgttagaaagctcagtatattctgtgtaagagagataggtttaaaaaacttaagaacaaatattttaaaaaccaaaactcagtaagaaatactattctcaattataatggtaatcccgggaccctagtgcagctctactttttaaatccatttttactggcttccacttaaatggctacttaaaattattttttattttagacaaaatataaatcagaaataaaaacataatggcttatcaatagaagttctcatactgatccacatggattatttctggcataatacaagccaataagtcacttgcatccttaaggaagagcactgaggagaaggatgtactgtctgcaatattcataaattatccaactataaccaggaataacctaaaaaggcttctaggcattcttatgggcagagaattatttgtggtatatataaagaaaagagttaaaaacttctaaactctaaaattcaactccataactgagggatttatatactctatagactatatattataaacaaatacatgctgacttaaaaaccttgaaatttttatcaaaatatactataacataggagttgtaaactcagatacttacaaggacaaaggaaggttgcctgagtaagggaagtactaaggtgggcacagtagcaaactggagaatacctgccttctataaaggggcaacttctgcacagcagaccaaagaatgatagaaactcaggggacaccagatttgattttttaggatatgcctgaagtccacatttcttcacgagtcttctaaattttacatgttgattcaacttatagaggcaaacaaacaaatctgtgtaccacattagaatacagcccttgttttttttatattcgctattaatgtgttactaaatggttgtgtataatccaagtattttcatgtaaaatattttctttctctggtatcatatgttctaccaaaaaatcaggctctcatatataataaaaattgctaaaaagactcacaatacctgcttcaagaatttttccaacatgtattcatttaaaatatgtttgtatataattttcccagattgttaaccaaatagataattggttcacaagactgctaaaactaaattattaaaagaattcctatctatattcttattaacttcatggatttcagtgtttaaaactgacattttgggtatgctaaagttctataaacttaacaaacatactgagatagttcataacaaaacttcaactaaaaaaaatagtttaggatttgctactattctaattgagaaagccaaacttgtaatgaacatttgttgacacataatcacctgcgtggtgacaaagggacatgaaatcatgaaagggtcagcctctacctattgaaagattactcataagcaaatttctgaagactctctgaatggtagtgaatgattcatggtgggaagcaaaacatgttattctgtaagctgagagatattgccaatgatattacctttcacttcccagtcacagatgtagagaaagacagataagtcaggctaatataattgaaaaggagaactttgaaggaagtggcaactatcaaatgccaactcttctagagatttcttacatttttgagatacagaaatttatatattgcacttatctattctggggtttttaatcaagagtgtatcccaaccttgaaggttttttgtttttttgtggggtttttttttggctattattgttgttagagacaagagtctcactatgttgctcaagctggattcaaactcttaggctcaagctgggactacaggaatacaccactgtgcccagcttcaagaaaacatttttaaacacgttcaggccttaataggtctattacatcaaaatcttcaggggaaagcctacaattgtagatttttaacaaaatgtcctcaggtcactgtaatgcacaattctgagaatcagtgcagcagacaatcacttcagtctcacctctcacccacatggctaattcctttatcagttggagatgtggccaaaaagagaaaagagtaagagatagtgtcatttattaaaactccagttaagtttcctggctacgggtagaacagggacaagtaaactcaaaatcccacttgattttgctatttacaagctccttatctcccaccttcccactaagacattctagatttgagaggaggctttaggttcttatctaagtggctgtttctgccaggatgagcaataagtcagttaataatttgttccaccttctgctgaagtgtttctcacttcgtcaccacatattcactgccaatctggtttcctcagagtcctcctaaaattcatctctaggcaagttgcaattcattctttttcaaaccaaaaattattagacccaaagctaaacagcaccttgtctcaacacataaaacaaacttaaaaacaaaaaaaaacctcttcctggcattttccctcattatctaatatccaagtgacctgcatatttctgattgctctctttctcccctcccatttttccctcttaagccttgccactgaaagatgatacatcagtttttcagaaaattagcagcaacagcaacatgtccctttattgtaagttgctttagttttgtttgagttttaagataaagcctaattccggggaatattttctttcctgtgttgttttacactaattaagaaaaaaaaaaaaaaaagaataagcctgtgtagaaaaaaagttgaaaaggttttacctttaacaaattcacaaatattttccaaagtgcattttataaagctgtgccctttaatgcttctttaaaaatatcaatatttaaaataaaatcttagacaattaagttatttcaaaataacttaatttgtatttgcattcagggaatggttgagcttccaaatataaaaaattgacccttacctatgtcaatgttaaaacaaatattttggaaagaaagttgattgacctataccttgtccagtgcttcaatatgtgcaccatgggaaagcagtttttctgccagtgaggtgctctcactatacacggcataatggagagcagtgttgccgtagatatccttaaggtttggattggcgccatgttccagcagaataacggcacaagcctcttcctggcaatggacagcctgtccgtgttagaccaagaaacagattgtaaattccaagaattcaaaatacacattccacaggtttcaccaactagttatatgtaaatgagatcaatttattttaattctatatatgtaaatcaaatccatgtcatgctaaaagagttggctctaatatacctgtatcaaaggcgttctgttttctttgtcacagacatcaatctggcattttctgttaaccaggagagtgaccacttgcacatggccactggcacaggccaagtgtagagcagttctatgagagtaagaggattttttaagaaactgtagtacaatatctcaaaacatacaatcattcatgtaatgtaaaaactgaatagcatgtttttcctctgccttcaaaacaaataaattttttgaagaaagtacaatacttactagctcttattgctcactgccttaatgaaaacagcagcctatttgagtagaaagagctcagtctttggattcggttcaactagggcttgagtcctactttaagccttgacacttaccaactattgcttagcctttctgtacctcaacttcctcattaataaagatgacaatagtagctatctcataggacaccatcgtgatgcttaaatgagaagctatgtaaagtatgtagaacagttcctacgacaactcaataattgtaagatttttgttttttgagacaaagtctcactcttttgcccaggctggagtgcaatggtgtaactatacctggaactcctgggtcaaatgatcctccatccccagcctcctgagtagctgggactacagatgagcaccagcatgcccagctatttatttaaaaatttttgtagagtaagaatctcactttgttgcccaggctggtctcaaactcctggcatcaagcaatcctctcaccccagcctcccaaagttctgggattacaggtgtgagccactgcacccagccagatattataattattactattactactacttaacaaaaccattttaattaggtagaatgatacaattatacctactttgcaagatgacttaacgagtaggtcacattttaacacctctgacattggaatgccacttataattcatgatttgttataactataattggtagcattttaaaaattatcttattgatatataaaatatcggggcatcacgcaatccatgagaccttacattaagtagaatatggtatactcagcaggtctagggcagttctaggcatgtaactgaaacttaaatacattttagttcttaaaggtactatggggaaagagcactgaaataacaataatgcattttttaaacaaattaattctttgattttcaaacaacttgaaaccaaaggaaactcatgattcaaatgaatacatatggctcattgtattcaatatttatacttagaaaatatatgcaaatacgactttccaatgattaatattagtatttaagactgataaactttcgaaagagcagttaaaggttatcttctactattttctaacttcagaaatgcttttgtttgaaaggtgggagataaagtttcaaggagattaagtcccaatattcctattttaaatctctcagcttgtgcaggcggggcaggtaaacatgaagtgtttaaggatggacgggtcctgagagatgatagaatatgtctgctacatagcaggtactcaggttatgcttgatccataaatggaatgaaagaatggataaatacagttggggagttcattatttttaaataaactcctataaagcaatatttttgcaatagtaattatttatatgtgttgttttatttttaaagaacacaattaaaatgaaatgattatgtttgcataaatggaatgagtatataagcaaaacatatgtacataataaaatatatagataataaaatctggaaacagataaaaacattccttttttacttctgaagaggctaaaagctcaaagaagataacaacacacacaataatgataaaaaatagaaagtgagaaattattttcatcagcgcaagattcatattcctctcttcccaaggattagtccattaataataaacttttactagaagttttgtactcactgcagcaatcacagataagaaaaaggaaaaaaactttacttaaaatacaaatgctcagaaattacaaattttatattttgtacatatttttgctaaaacaagaccatagtatgtttgtgtatgtataatttaactaattttttctccttgctagctataacaaaatacatctttgcacatcaacgtacttctgtatctactgccaccttcagtggtcacatattattccatcctatggatgcaactgaaatttatttataggatccattctatgggttctctttaaagtaagtactgtgaaaaataaagtgcatgtatctttatttcctaagggtattttagtataatggaattggtgggtaaagggcatacacattttttaaatgtagtacttaccattttcaaatgagtactttgaaaagtaatcagcaacttcaagcagcagtataaaacatcctcacaaatattgtggatagaaaactgtttcattcctcttttagtttaaattcttataccagaaatgcgaaggattttttcctatgtatataagtaacttgtagatctggaaaaaggtactttgcccacttttagagtgtttgatgatttgatttgaaagaatttcctgtaaaatgaagaggtacttttcatctaatgtgtatatataactgatatatataacatattatatgtgttatatatgtatacatatcagtaatatatatatatcttatgatatataataaacaacataggccaggcgcggtggctcacacctgtaatcctagcgctttgggaggcggaggcgggcagatgacttgaggtcaggagttcgagaccagcctggccaacgtggtgaaactaaatatacaaaaattagccaggcatgctggcacctgcctgcaatcccagctacttgggaggctgaggtaggaaaattgcttgaacccggcaggcagaggttgcagtgagccaagattgtgccattggacaccagcctgggcaaagaagcgagactccgactcaaaaaaaaaaaaaaagaatataatgaattccctataaaatgaaaacatacttttcatctgaaaaaatatatatatataatatagtaaatatttttcaagtaagctctcttatctgagaacttttcgcccactgaaacaactcacggttatttttgataggggaacaagtactctcattaggcacctcctataatgtatataaaccatgttttaaacgtgtacgttaaaaataacaacgctgtatatgcttaactttgtgagttaaatcactcaaattctccaactgctccagccagggaattatgagggatggaaaacagatgagagtccgtttggctccgccgctccgagggtgcccggcgccctgcacggccccgtcccagggtctgcggggaagccgggcctgggggccccctcccacccccggctgagcccccgctacctgtgctgcttgtccagggcgtccaggtctccgctcctgcgcgccaggcagcgctccacctccgcggcgtcgcctttgacagctgccctgtggatcttctgcagttcggagtcccggattcggtatccggaacccgtgtagacgtggtctatggagccctgggccgtctggcccctgcggctcccgaagccgaataacttcatattggtgacttcttctcagacccccaaccaccggctcttgagcgagggcagctccctgtcaccttttcaccacccccctccccgaccccggccgacccagccccaaatcccc

SEQ ID NO: 648 - DNA, 3372 bp, Homo sapiens
tttattcaaaatatgaaattttattataattgatgtttaatgcaattcactttacgaaggtttttgtggttttccctaaaatttctgttttaatgaaggctcctgatcatcctggatgtcaacaagttttcttcttcatgtgacgtctctgatgcacaataaactgattagtttttctaaaactgattatattcatagggtttcatctcactctaacataaagtttaagctaaactacgtccatttaactaataagccaaatttgtaagagcttaacagactataaacttaactcttgctttaaagcaacaaaaacaaaaccctgatgaagacctggaagtgaattgttcgtttttcagactctagcttccttgaccttgtgctttatggttttgaacacacaggacccaagtttgctgcagaaataacctccaaatccatattatgaaccaggaagactgtgagggtttttcttttttttttttaagggccaagagtaaatgtaatatatatcattagcaccatatcccatggtcagccccacctgaataaacggcatattgggatttttccacaaactatgagcctaatgaaaaaggaaatggataagggaaacaagttcccagcctatgtcacatgagtttctgcactacgtgttatgtggtaaggtatgcattccctcaggacttcccaaatccattacatgctagggttttctctctggtatgcattctggtgtgatgtaccctaagagctgccttacggacaaaagttttcccacattcatcacattcatagggtttctcccctgtgtgaattctctggtgtactctgagagttgaattttgggcaaaagctttcccgcattcattacactcatagggtttctcccctgtgtgaattctctggtgtgcactaaggtgtgatttctgggagaacgttttcccacaatcattacattcataggatttctcccctgtgtgaattctttgatgtactctgagggttgaattatgggcaaatggcttcccacatacattacattcatagggtttctcccccgtatgaactctctgatgtgcactaacatatgacttctcagagaaggttttcccacattcactgcattcatagggcttctcccctgagcgagttctaagatgtgctctgagatgtgatgtcttggagaaagtcttcccacagtcattacattcatagggtttctcccctgtgtgaattctgtgatgtgccctgagggctgaattatcagcaaacgttttcccacattcattacactcatagggtttttccccagtatgaattctctgatgtgcacagaggtgtgttctttgggagaaagttttcccacattcgttacattcatagggtttctcccctgtgtgaattctttgatgcactatgagggctgccttatagacaaaagttttcccacatacgttacattcatacggtttttcccctgtgtgaattctctcatgtccactgaggtatgatttctgggagaaagttttcccacacttgctacattcatagggtttctcccctgtgtgaattctccgatgtgtactgaggcgtgtcttctggaaaaaagtttttccacattcactacattcatagagtttctcccctgtgtggatattctgatgtgctctaagggctgaattatgggcaaatgttttctcacattcattacatttatagggtttctcccccgtgtgaattctctgatgtattttgagggctgaattatgggcaaaagttttctcacagtcactacattcatagggttttctacctgtgtgaattctctgatgtgctctcagggctgaattgtaggtgaaagatctcccacattcattacattcatagggtttctcccttgtgtgaattctttgatgtgccttgagaacagaaatatgggcaaaagaccttccacattcattacattcataaggtttctcccccgtgtgaattctatgatgtgctctgagggctgaattatgggcaaaagttttctcacagtcactgcattcatagggcttctcacctgtgtgaattctttgatgtgctctcagggctgagttataggtaaaagatttcccacagtcattacattcatagggtttctcccctgtgtgaactctctgatgtacactgaggtgtgtcttgtgagagaaagttttctcacattcaacacattcatagggtttttcacctgtgtgaattctctgatgtgctctgagatgtgatgtcttggagaaagttttcccacattcaatacattcatagggtttctcccccatgagaattctctgatgtcctttgagatgtgatgtcttcccatattcactgccaccacagagttccatctctgcatctgttttctggtgtcctatgaggggtgacttgtaagatctcccacagccattgttatcacaaggtttctcttttgtgtgaattctcagatgtttactgaggtttgaattctgacagaaagctttcccacattcattacattcataaagtttgaatcccacataagttccaggatgctgaataggatgtgaacttgaacaaaaggattttgcacattcctcatattggtaagttttctctcctgagtggggcctctcatgctgaatgaggtgtgctttccagtaaaaggattttctgcatttcccatgttcatcagaaaggtagaatttctgatgtgctgtaaagtctgtgtgaattctctgatgtgctgtaaagtctaatttctggtagagggcatctgtacattcattatgttcaccaaatttatctccagcttgtgttttctgatgtactatatgggctgagctctggctaaaattttcttcacatttattgctttcaaaagcactccatcctgtaatagttctctgagattgagtgaggggtgacttcctactgaaattaatccccctttcattacactcatagtgtgtcatagccatgtgaactttattgtattcaacagcggtggttttgtcacaggatgtcccatattcattaagatcagagcatttcccccttttgtcagttctcatgtggttaaataaagtggttttatcaaagtttttttctaaattcatcatccttacaggacttttctcctgttagaaaactctgaggtgtaatacaaattgtcttatcatataaaccttgtccagatccatcacattcaaaagattcctccaaagtttgaaatttccaatgctgacctttcttataactgaaagctttagcattttcaccatgttcataagatttctcttcagcatgagctttctcatgcttaatatcaagctgcagtttctcacacacatt

SEQ ID NO: 649 - DNA, 6259 bp, Homo sapiens
cagttgcttgaaagcaacgcgcctattcacatggagaatcttccctttcctttaaaattacttagtgcctcatcgctaaacgcccccagttccacaccatgggtgttggatatcttcctcactttggtgtttgccctggggttcttcttcctattactcccctacttatcttacttccgttgtgatgacccaccctcaccatcgcctgggaagagaaaggtaaggaaccctcagtcccaacccacagagcttgattctctcctttctttttattattagttccacttttccaaatccagtggagagccttctatgatgggaagtctcagaagagaccagaacatcatccttccagggagaggcagggcagccaggggttggtaggggtagatagtgtactgggatttccatcccaagctctcagtccatctgtgggggagcacaggaggcatcaaggcaaaatcaaaccagtggactcagcaccagtaccagtcatgagactggggaggtctctgtccgagaccaggccctgagccctggctcatcagcccctttctggtgcaggtggctcagggcccagcctcccctgtgtggggtgatctggggcctgtgctgggcccctgagggcctcccaccagggcctggtgtctcctctggtctcctgggaagcagaatcctacctgatagctcagcagtgcctgcgggcctgaacttgggtgttcctggagcagaggaacagggactgaaggtgtccgtggtggacctcatattgaaaatccctctgtgtgtgtgtgtgtgtgtgtgtgtgtgtgtatttttattttatttgtgtgtgttattttcattttattttattttattttattttattttattttattttattttattttattttattttattttttgagatggagtctcgctctgtggtgcaggttgcagtgaaatggagtgatatcggctcactgcaacctctgcttcctgagttcaagcgattctcctgtcttagagtcctgaatagctggggattacaggcgcccaccaccatgcctgcctaatttttgtatttttagtagacacggggtttcaccatggccaggctggtctcaaactcctgacctcaggtgatcaacccaccttggcctcccaaagtgcttggattataggcgtgagccaccacgcccagccccctcttgctgtttttctaagaagaaaagcagtttatcatccatttaaacaagagtgggaggaagcacacagagctccctgagcaagacagagagagccatgcggttcctgagtgcagcatgctgcggctgggctggggcagagagggagagccggtcctagcttctcaccctttcttgtctcccattgtcatcttgtctctccgcgtcatcttgtctccgtacgtcatcgtgtctcccagtgtccagtagggcggaggcggaggcccagaggcaggatgaaaaaccacagtctgagaggtaaggctctgccagagcacactagagttaatttgatctcatctgtcccggagggaactgactctgaagaagtcagttgaagaagcctgaggtgggggctcctaggaaggaaatcagaaccccgggtccttctcagattccatgcgggaatgaagccatggtgggccagggactgggcgttacccagcagggggcagtgtgtgtgtcctggggagaccaatgcctgcctggatgcggaggggggtgagggggcctcccgctccctgggaacagcagtccaactctgctaaggctgattcctctttgagaccacctcagtcctttctccccacagggcagttgtgaggactgtgggggtggggggtccgtgtgtggaagccctttgtgaatgaaaaagccctgtcctccatgcattgctattaacgtcggggtcatgtggctttggacacagatgggtggggcccagggtctaattccccatggtcctccctaaagaaacagccactcagcctcctgtgagaacccaggcccctccctcactgccctaacccagtctcctgatttccagctggtagagagtgcccgagaggcctgcaggagacttcggacctgctttcacaactgcagaggtgaggcacttccccttccctgcatccttcctaccagggctgggacgtgaccccagggccacaggcagcctggagctgacctgggatggggagaccaggggtacagaggatgggagtaaaaccctggggcgaggggtagcaggagaactgggcaatcagggtgtggggtggtggaggggctgtggcccgagcacccactctgccctccggccccaccggctcctggctgcagctcgtgtctcctgtctcctgcagcctcctggggccacaccttgacaaaggtgactttggtcagctctccggtccagaccccccaggtgaagtgggcgaaagagcacctgatggagcctcccagtcctctcatgagcctatggaagatgctgctcccattctctccccgttagcttccccggatcctcaagccaagcatcctcaggatctggcctccaccccatcaccaggcccaatgaccacctcagtctcctccctaagtgcctcccagccaccagaaccttcccttcccctagaacacccctcacccgagccacctgcacttttccctcacccaccacacacccctgatcctctggcctgctctccgcctcctccaaaaggcttcactgctcctcccctgcgggactccacactgataactccatctcactgtgactcagtggcacttccactgggcaccgtccctcaaagcttgtctccacatgaggatttggtggcttctgtcccagccatctcaggccttggtggctcaaacagtcatgtttctgcctcctcccggtggcaggagactgccagaacctcgtgcgcctttaactcatcagtccagcaagatcatctttcccgccacccaccagagacctaccagatggaagctggtagcctgtttttgctcagctctgatggccagaatgccgtggggatacaagtcacagaaacagccaaggtcaacatttgggaagaaaaagaaaatgttggatcatttacagatcgaatgaccccagaaaagcacttaaattctttgcggaatttggctaaatcattggatgctgagcaggacaccacaaacccaaaacccttctggaacatgggagagaactcgaaacagctgcccggacctcagaagctctcagatcctaggctctggcaggaaagtttttggaagaattatagccagcttttctggggcctcccctctctgcacagcgagtccctggtggctaacgcctgggtaactgacaggtcttatactttacagtctcctcctttcttgttcaatgaaatgtccaatgtctgcccaattcaaagggagactacaatgtccccactgcttttccaggcccagcccccgtcccatctggggcccgagtgccaaccctttatttcatccacaccccaattccggcccacacctatggctcaggccgaggctcaggcccatcttcaatcttctttcccagtcctatctcctgcttttccatccctgattaagaacactggagtagcttgccctgcatcgcagaataaagtgcaagctctctccctacctgaaactcagcaccctgaatggcctttgttgaggagacaactagaaggtaggttggctttaccctctagggtccaaaaatctcaggacgtctttagtgtctccactcctaaccttccccaggaaagtttgacatccattctgcctgagaactttccagtcagtcctgaactccggagacaactggagcaacacataaaaaagtggatcatccaacactggggcaacctgggaaggatccaagagtctctggatctgatgcagcttcgggacgaatcaccagggacaagtcaggccaagggcaaacccagtccctggcagtcctccatgtccacaggtgaaagcagcaaggaggcacagaaggtgaagttccagctagagagggacccgtgcccacatctggggcaaattctgggtgagaccccacaaaatctatccagggacatgaaaagcttcccacggaaggttctgggggtgacttctgaggagtcggaaaggaacttgaggaagcccttgaggagtgactcgggaagtgatttattaagatgcacagagaggactcatatagaaaacatcctgaaagcccacatgggcaggaacttgggccagaccaacgagggcttgatccccgtgcgtgtgcgtcgatcctggcttgctgtcaaccaggctcttcccgtgtccaacacccatgtgaaaaccagcaatctagcagccccgaaaagtgggaaagcctgtgtgaacacagcccaggtgctttccttcctcgagccgtgtactcagcaggggttgggagcccatattgtgaggttttgggccaaacacaggtggggtctacccctcagggtcctcaagcccattcagtgctttaaactggaaaaggtttcatccttgtcccttacacagcttgctggtccctcctcagccacctgtgaatctggggctggctcagaagttgaggtggacatgttccttagaaagccaccaatggcaagtctgagaaagcaggtgctgaccaaagcatctgatcacatgccagagagtcttctggcctcctcacctgcatggaagcagttccagagggcaccgcgaggaatcccatcttggaatgatcatgggcccttgaagcctcctccagctggacaggagggcaggtggccatctaagcccctcacgtacagcctcacaggcagcacccagcagagcaggagcttaggagcccaatcttcaaaggctggagagacaagggaggcagtgccacaatgcagagtccccttggaaacctgtatgctggcaaacctccaagccacaagtgaggatatgcatggtttcgaggctccagggaccagcaaaagctctctacaccctagagtgtctgtctcccaagatccaagaaagctgtgtcttatggaggaggttgttaatgaatttgagcctggaatggccacaaagtcagagacccagcctcaagtttgtgccgctgttgtgctccttccagatgggcaagcatctgttgtgccccacgcttcagagaatttggtttctcaagtgccccagggccatctccagagcatgcctgctgggaacatgcgggcttcccaggagctacatgaccttatggcagccagaaggagcaaactggtgcacgaggagcccagaaacccaaactgtcaaggctcatgcaagaaccaaaggccaatgtttccccctattcacaagagtgagaagtctaggaagcccaacttagaaaaacatgaagaaaggcttgaaggattgaggactcctcaacttaccccagtcaggaaaacagaagacacccatcaggatgaaggcgtccagctactgccatcaaagaaacagcctccttcagtaagccactttggaggaaacatcaagcaattttttcagtggattttttcaaagaaaaaaagcaagccagcaccagtcactgctgagagccaaaaaacagtgaaaaacagatcatgtgtgtacagcagcagtgctgaagctcagggtctcatgacggcagttggacaaatgctggacgagaaaatgtcactttgccatgcgcgccatgcctcgaaggtaaatcagcacaaacagaagtttcaagccccagtctgtgggtttccctgcaaccacaggcacctcttctactcagaacacggcagaatactgagctatgcagccagcagtcaacaagccactctcaagagccagggttgtcccaacagagacaggcaaatcagaaatcaacagcccttgaaaagtgtgcggtgcaacaatgagcaatggggcctgcgacatccccaaatcttgcaccccaagaaagctgtatccccagtcagtccccttcagcactggccgaagacatccggtgcctctagccaccatcaccactgtccaaggcactgtcttctttgggaaggtatctgatttggtcagtcacaaattcttttttagccttccctggagaaaaagaagtccccaagaaaaaattcactctatgtagagaaaaaatattttctctcatgttagtacatgcagaacatttaatataccacaatatatatggttttttattca

SEQ ID NO: 650 - DNA, 6262 bp, Homo sapiens
cagttgcttgaaagcaacgcgcctattcacatggagaatcttccctttcctttaaaattacttagtgcctcatcgctaaacgcccccagttccacaccatgggtgttggatatcttcctcactttggtgtttgccctggggttcttcttcctattactcccctacttatcttacttccgttgtgatgacccaccctcaccatcgcctgggaagagaaaggtaaggaaccctcagtcccaacccacagagcttgattctctcctttctttttattattagttccacttttccaaatccagtggagagccttctatgatgggaagtctcagaagagaccagaacatcatccttccagggagaggcagggcagccaggggttggtaggggtagatagtgtactgggatttccatcccaagctctcagtccatctgtgggggagcacaggaggcatcaaggcaaaatcaaaccagtggactcagcaccagtaccagtcatgagactggggaggtctctgtccgagaccaggccctgagccctggctcatcagcccctttctggtgcaggtggctcagggcccagcctcccctgtgtggggtgatctggggcctgtgctgggcccctgagggcctcccaccagggcctggtgtctcctctggtctcctgggaagcagaatcctacctgatagctcagcagtgcctgcgggcctgaacttgggtgttcctggagcagaggaacagggactgaaggtgtccgtggtggacctcatattgaaaatccctctgtgtgtgtgtgtgtgtgtgtgtgtgtgtgtatttttattttatttgtgtgtgttattttcattttattttattttattttattttattttattttattttattttattttattttattttattttttgagatggagtctcgctctgtggtgcaggttgcagtgaaatggagtgatatcggctcactgcaacctctgcttcctgagttcaagcgattctcctgtcttagagtcctgaatagctggggattacaggcgcccaccaccatgcctgcctaatttttgtatttttagtagacacggggtttcaccatggccaggctggtctcaaactcctgacctcaggtgatcaacccaccttggcctcccaaagtgcttggattataggcgtgagccaccacgcccagccccctcttgctgtttttctaagaagaaaagcagtttatcatccatttaaacaagagtgggaggaagcacacagagctccctgagcaagacagagagagccatgcggttcctgagtgcagcatgctgcggctgggctggggcagagagggagagccggtcctagcttctcaccctttcttgtctcccattgtcatcttgtctctccgcgtcatcttgtctccgtacgtcatcgtgtctcccagtgtccagtagggcggaggcggaggcccagaggcaggatgaaaaaccacagtctgagaggtaaggctctgccagagcacactagagttaatttgatctcatctgtcccggagggaactgactctgaagaagtcagttgaagaagcctgaggtgggggctcctaggaaggaaatcagaaccccgggtccttctcagattccatgcgggaatgaagccatggtgggccagggactgggcgttacccagcagggggcagtgtgtgtgtcctggggagaccaatgcctgcctggatgcggaggggggtgagggggcctcccgctccctgggaacagcagtccaactctgctaaggctgattcctctttgagaccacctcagtcctttctccccacagggcagttgtgaggactgtgggggtggggggtccgtgtgtggaagccctttgtgaatgaaaaagccctgtcctccatgcattgctattaacgtcggggtcatgtggctttggacacagatgggtggggcccagggtctaattccccatggtcctccctaaagaaacagccactcagcctcctgtgagaacccaggcccctccctcactgccctaacccagtctcctgatttccagctggtagagagtgcccgagaggcctgcaggagacttcggacctgctttcacaactgcagaggtgaggcacttccccttccctgcatccttcctaccagggctgggacgtgaccccagggccacaggcagcctggagctgacctgggatggggagaccaggggtacagaggatgggagtaaaaccctggggcgaggggtagcaggagaactgggcaatcagggtgtggggtggtggaggggctgtggcccgagcacccactctgccctccggccccaccggctcctggctgcagctcgtgtctcctgtctcctgcagcctcctggggccacaccttgacaaaggtgactttggtcagctctccggtccagaccccccaggtgaagtgggcgaaagagcacctgatggagcctcccagtcctctcatgagcctatggaagatgctgctcccattctctccccgttagcttccccggatcctcaagccaagcatcctcaggatctggcctccaccccatcaccaggcccaatgaccacctcagtctcctccctaagtgcctcccagccaccagaaccttcccttcccctagaacacccctcacccgagccacctgcacttttccctcacccaccacacacccctgatcctctggcctgctctccgcctcctccaaaaggcttcactgctcctcccctgcgggactccacactgataactccatctcactgtgactcagtggcacttccactgggcaccgtccctcaaagcttgtctccacatgaggatttggtggcttctgtcccagccatctcaggccttggtggctcaaacagtcatgtttctgcctcctcccggtggcaggagactgccagaacctcgtgcgcctttaactcatcagtccagcaagatcatctttcccgccacccaccagagacctaccagatggaagctggtagcctgtttttgctcagctctgatggccagaatgccgtggggatacaagtcacagaaacagccaaggtcaacatttgggaagaaaaagaaaatgttggatcatttacagatcgaatgaccccagaaaagcacttaaattctttgcggaatttggctaaatcattggatgctgagcaggacaccacaaacccaaaacccttctggaacatgggagagaactcgaaacagctgcccggacctcagaagctctcagatcctaggctctggcaggaaagtttttggaagaattatagccagcttttctggggcctcccctctctgcacagcgagtccctggtggctaacgcctgggtaactgacaggtcttatactttacagtctcctcctttcttgttcaatgaaatgtccaatgtctgcccaattcaaagggagactacaatgtccccactgcttttccaggcccagcccccgtcccatctggggcccgagtgccaaccctttatttcatccacaccccaattccggcccacacctatggctcaggccgaggctcaggcccatcttcaatcttctttcccagtcctatctcctgcttttccatccctgattaagaacactggagtagcttgccctgcatcgcagaataaagtgcaagctctctccctacctgaaactcagcaccctgaatggcctttgttgaggagacaactagaaggtaggttggctttaccctctagggtccaaaaatctcaggacgtctttagtgtctccactcctaaccttccccaggaaagtttgacatccattctgcctgagaactttccagtcagtcctgaactccggagacaactggagcaacacataaaaaagtggatcatccaacactggggcaacctgggaaggatccaagagtctctggatctgatgcagcttcgggacgaatcaccagggacaagtcaggccaagggcaaacccagtccctggcagtcctccatgtccacaggtgaaagcagcaaggaggcacagaaggtgaagttccagctagagagggacccgtgcccacatctggggcaaattctgggtgagaccccacaaaatctatccagggacatgaaaagcttcccacggaaggttctgggggtgacttctgaggagtcggaaaggaacttgaggaagcccttgaggagtgactcgggaagtgatttattaagatgcacagagaggactcatatagaaaacatcctgaaagcccacatgggcaggaacttgggccagaccaacgagggcttgatccccgtgcgtgtgcgtcgatcctggcttgctgtcaaccaggctcttcccgtgtccaacacccatgtgaaaaccagcaatctagcagccccgaaaagtgggaaagcctgtgtgaacacagcccaggtgctttccttcctcgagccgtgtactcagcaggggttgggagcccatattgtgaggttttgggccaaacacaggtggggtctacccctcagggtcctcaagcccattcagtgctttaaactggaaaaggtttcatccttgtcccttacacagcttgctggtccctcctcagccacctgtgaatctggggctggctcagaagttgaggtggacatgttccttagaaagccaccaatggcaagtctgagaaagcaggtgctgaccaaagcatctgatcacatgccagagagtcttctggcctcctcacctgcatggaagcagttccagagggcaccgcgaggaatcccatcttggaatgatcatgggcccttgaagcctcctccagctggacaggagggcaggtggccatctaagcccctcacgtacagcctcacaggcagcacccagcagagcaggagcttaggagcccaatcttcaaaggctggagagacaagggaggcagtgccacaatgcagagtccccttggaaacctgtatgctggcaaacctccaagccacaagtgaggatatgcatggtttcgaggctccagggaccagcaaaagctctctacaccctagagtgtctgtctcccaagatccaagaaagctgtgtcttatggaggaggttgttaatgaatttgagcctggaatggccacaaagtcagagacccagcctcaagtttgtgccgctgttgtgctccttccagatgggcaagcatctgttgtgccccacgcttcagagaatttggtttctcaagtgccccagggccatctccagagcatgcctgctgggaacatgcgggcttcccaggagctacatgaccttatggcagccagaaggagcaaactggtgcacgaggagcccagaaacccaaactgtcaaggctcatgcaagaaccaaaggccaatgtttccccctattcacaagagtgagaagtctaggaagcccaacttagaaaaacatgaagaaaggcttgaaggattgaggactcctcaacttaccccagtcaggaaaacagaagacacccatcaggatgaaggcgtccagctactgccatcaaagaaacagcctccttcagtaagccactttggaggaaacatcaagcaattttttcagtggattttttcaaagaaaaaaagcaagccagcaccagtcactgctgagagccaaaaaacagtgaaaaacagatcatgtgtgtacagcagcagtgctgaagctcagggtctcatgacggcagttggacaaatgctggacgagaaaatgtcactttgccatgcgcgccatgcctcgaaggtaaatcagcacaaacagaagtttcaagccccagtctgtgggtttccctgcaaccacaggcacctcttctactcagaacacggcagaatactgagctatgcagccagcagtcaacaagccactctcaagagccagggttgtcccaacagagacaggcaaatcagaaatcaacagcccttgaaaagtgtgcggtgcaacaatgagcaatggggcctgcgacatccccaaatcttgcaccccaagaaagctgtatccccagtcagtccccttcagcactggccgaagacatccggtgcctctagccaccatcaccactgtccaaggcactgtcttctttgggaaggtatctgatttggtcagtcacaaattcttttttagccttccctggagaaaaagaagtccccaagaaaaaattcactctatgtagagaaaaaatattttctctcatgttagtacatgcagaacatttaatataccacaatatatatggttttttattcataa

SEQ ID NO: 651 - DNA, 7042 bp, Homo sapiens
agctgccattgcggattttgccagcttcagccagtttagtcctaagaaggaacttctgaccccagacatcctgttttctaaaactaagcagttaaagctgaatgggaatttagctctgtcacataggcatttgttgggcaacaaaagcagggtagggctccagctaagccacgtaggcactacgatgggcaacagaaaggttggtttctgggcaattcagagaaaccaaggacagctacccccagaactcagagtagccaactgggctgctcacaggagatgccttaactgaaaggtgatcagactccacaggagacccagagaagatgtggagggagctcagaggctgtcctggaggagacgtggagacagctcagaggctgtcccagagaagacgtggaaagagctcagaggctgtcccagagaagacgtggagagctcagaggatgtcccagagaagacgtggagagagttcagaggctgtcccggagaagacgtggaaagagctcagaaactcagagactgtcccggagaagacatggaaacagctcagacgctgtctgcaagaagatgtggagagagttcagaggctgtcgttactgctgcacttggctgtttttctttggataattattgcaatcaattttagtaattcaggtgttaaatcacagtcaagcacctatttacctagtggtgagttcctttatgttgtgagttcaatgtcatttgtggggactgtggtccagggaggtgttgggaggatgaagttttttctgagtgactttgcaaacataaaaagtcatctaataaagatgctagaaaagcaaatatcctaacttcctagtcagaaaaatgtccaacaccatgtttatttaagaatttttcacaaaaaaaaacagtggtgggagaaaattacacatctgggcccagcaagtaagactttcccttcacaattgtgctgtgggatcccaggcctcggggggctactgccgtcaccgtccccaggctgtgggcccctttgtcagctgctcttctgaaggcaggtctcctgtccatgccttcccctttgctgtccggatggagattggagacgcagcatcatatacagctgacaggtgttaaccttattagctaattctgtttcacgggacacgatttatacactccatggaaatgcttctcactgcctttttttaccacttcaaggtagaagtaggtaatagtgctaaagtcatcttactagaataacaaagtccatggtttgttgtccctaaaaatatttgtattagtttactagggctgccataacaaaataccacagactgagtggcttaagtaacataaatttctttctttctttctttctttctttctttatttattattattatactttaagttttagggtacatgtgcacaatgtgcaggttagttacatatgtatacctgtgccatgctggtatgctgcacccactaactcgtcatctagcattaggtatatctcccaatgctatccctcccccctccccccaccccacaacagtccccagagtgtgatgttccccttcctgtgtccatgtgttctcattgttcaattcccacctatgagtgagaatatgcggtgtttggttttttgttcttgcgatagtttactgagaatgatgatttccaatttcatccatgtccctacaaaggacatgaactcatcatttttaagaaaatgtggcacatatacaccatggaatactatgcagccataaaaaatttcttttctcacagttttggaggctggaagtccaaggtcaaggaatcagcacatttggtctcttctgaggcctctctctttcccttgccaatggccaccttcttactgtgtcctcacatgattgtcctgtggtctgtgtgtggtctctgtccacatctccttgtcttacaaggaaatcagtcttactgattagggcccacccatataacctaattttacctcaattacctctttataggtcctctttccaaatacagccccattctgaggtactagaggtgaggacttcaacataaatttgaggcaacacaattctgtccatgacaattgtccaccttagttttatggtgaaccaaggctgtgaaaaagacttgacttggggccgggcatggtggctcacgcctgtaatccctacactttaggaggccaaggtgggtgcataacccaaggtcaggagttcaagaccagcctggccaacatgatgaaaccccatctctactaaaaatacaaaaagaatgagctgggcttggtggcgggtgcctgtaatcccagctactcaggtggctgagacgggagaattgcttgaacccgggaagcgaaggttgcagtgagccgagactgcaccactgcactcaagcctggacaacaagagcgaaattctgtctaaaaaaaaaaaaaaaaaaaaaagacttgactgaaggcagtgacctaagagtgaagcgataacagctggcaactgttctgcaagaaggtgcaaagcccctgcaggcctgggaaggtgcagagcctgcacctcagatttgactcctctcatagaatcatggaatttaagtgaacctcttccagtattagggaatcttgaatggaaactctaatatcttaatccccagtgtaacaaacttttactacattgttctcatgatgacaaatgtctcatcagaaaatggcttaaaagtataatttttatgaaagcagactggcttatttaaaacaaacataatctgaaaactgtaatccaaaaagtagacatccatatatatatatatatatatatatatatatatatatatattcattcattctctttgctttgaaactttcactgaatgacctttgcccattttatcggtcaccatattttagtggtgctgtgcagtgacttttgtagagtaatatctctcaaagtgtgcaatgatcaatattgtgttgtcaaaagattctgtagtcaaagaagtttggaaaactttaattttttgattaagcaaagcaagaagtctgagtttcatttattggtttactatgaaaagtgttagaggctttatgatgtgcaagaaggacatgtgtcataatatttctcaaacctatttgacttccaatacttgcttttttgttttttcttcttttgtggagaaatttcaaaaactttggaaaatactttttaagtgagattcaggagtttgataagcaagatgacaaatactaaaaatatacactccaaatatagacacaatgaatactaaataaactcactgtttttagtcaacattattcaaggatatccaaagtttttcatggcataaaatgctctttttcttttcagtaatatgatacatgtgatattcctggaaacttaaaaaaaaaaatcatcatttatgtgctctcttgtcagtttcatgctgtatttttgatgtagaagaaagaatttggtatcttctcaggaatacattgtcacataaaaatatgtaaactccttcagataaattctcaccttctgcagaatgagtcaaacagcagggggagaagctgaatctagtgttcgcagtgagtgacctgtcttcctcaacactgtcatctcatccattgtcttggatgctcaagaaacggaactatataaatgtggcttctggccttcatatattacagtgccaaagcttcaaagaaccagtttttatttaatacttactttgtttctttgcattttttttcaaaaatacaatatgttgttattaactatagtgaccatgttgtgcggtagatctcttcttgaatatttcccctctcctaaatgaaattttgaatcctttgataaacatccccactccccaccccaagtccagctcctggtaaccaccagtctactctctacttctatgagtttagctttttcagattcgacataaaagtgaaatcatatggtctttctgtgcctggcttgtttcatttaacataatgtcctccaggttcatccacgttgtcacaaataataagatttcattattttttatggctgaatagtatttcattgtgtatatatactactttttaaaattcattcatccactgatggacacttacattgtttccacatcttgggctaatatataaataagatttaatgtatatggtgttgcagatatctcttcgacatacggatttcatttcctttggatatatacccagtagtgggattgctggttcatatggtagttcatttttaatttttgaaggaacctccatgctattttccatgatgcctttccttcaagtcttctccaacacttgttatattttgtcattttataataaccatcctaacacgtatggggtgatatctcaaagtgtttttaatttgcctttctctaatgattagtaatattgagcattttttatatgcctgttggcctgtatgtcttcttttgaaaaatgtctatttggatcatttgtccatttcttattgagttatttttggttgtctcttcactctgctagcacctattttgtataagacaataatgctcttacattttcaaaatatacagaagataaaaaacatatagtaagtatgatacttgaattgtagtgagacatttaaaattttccaggaaacaattactgtgttttatggttataaggaagaaacatgtacatcattttggggaagaaaaagagaaattatggagtgataagtttaaattgagaaaataccaacaaatacaatatacgagagaggctctaggcatttcatttacaaaaatattgtccagtttttgtatgtgtgatgtgtgcttgttccctctttccatatctatctctgtctgtctttctgctatggtttgaatgtatcctccaaaagttcgtagattggaaacttaatccctcttctctcatgaatagatttatgtcagtcctgccctcatgaatggattaatgtcactagcatagtagtgggttccttatcataagcccttttgctcttgctctctcactatgtgatgccccctgccatgttgttaggcagcaagaaggccttctccagaggccagcatcatgctcttggcattcctaggcctcagagctaaatacatttattttctttataaatcactcagtctgtggtattctgttatagcaacaaaaatattaagacactcttcctatttcccctactctccttcctccagcctctttcttacacacaaaatgttactgaaataccaggagttcaatctaggttctgttacttgcacacagaaagccaatcactgagacaatgaatattgccaaggaagaaggctttaattgcatgctacagctaaggatatgggatatcagtctcaattccatctcctcaaccagccgaaattaggggattatatagcaaggaagaaatgtaactatgagcaggaaaacaggaactagggagggctaaggaagcaatcatgacaaataaggaatctggcatctggcatctcattgtctcgacacagtggtctgatgaatttcacttctttgatactttttgagagagctgagagtccatttcctgaggaagaaactcagagaaaacaaatgtaagtttcaagcttcaagaccagaaggatttgtttctatgtttatatttttaaaatctgtctgtggatctattgggtgcatttcaaaaacacatacagaggaaatcccaggcgctgtgctagaattgggaatacaatggtgagttcaaagaggaataattttcctattctcatgaagctaatagtataggatagagaaagcaaacactaatcaaagaaccacacaagcataagattgcaactacaactaaaaaccataaccattcagttaagctaaggaggccaccattgtcacccttctcttaacctttaataatgtattttacaggtaaaatccttaagtaagtcatatttggttgggaagatcaaagaaatcacccagtctcccacatccgaaattgtgcagtccggactgtcaggaacaaaagtgaaagagagacgtcatcaaggccgggcgcggtggctcatgcctgtaatcccagcactttggaaggccaaggagggcggatcatgaggtcaggagttcaagaccagcctggccaatatggtgaaaccctgtctctactaaaaatacaaaaattagccaggcgtggtggcaggcgcctgtaatcccagctacttgggaggctgaggcagaagaatcacttgaacctgagaggcagaggttgcaataagccaagattgtgccattgcactccagcctgggagacaaagcgagactccatctcaaaaaaaaaaaaaaaaaaaaaagaatgactaaaattaagaagattgatgattccaaatattagtaaagatgtagaacaactagaactcccacatattgctgatgaaaatgaagaataatacattactttggaaaatactttggtactgatttaccatatgaccccaaaatctcacttgtagaaatttatacaggaaaaatgaaaacatatgctcacagaaagcttgtatacacatgcttatggcaataaatttatttatagttgcctaccaacaagtgatgaacaaatatattttagtatcttgatactactttctagctagaaaaggaatactactaagcaaaaatagaggatgaagtagtaatatacataacatagatgaatttaaaaacaccatgctgattgaaagaaaacaattatcaaatacacagtgtaatattctattcacagaaagtttgaaaacaaaaaactatagtctctgaaagaaaaccattggttgcaggaaggtggggattcattggccacaaaagggactgaggaaactttttatgggtaatggaaatattttatatcttgattgtggcaccaattatacaactatatgtacacatttgtcaaaattctaattgtattatacacaacatgagtgactttaactgtctataaattatatctcaataaaattggtcttaaaagat

SEQ ID NO: 652 - DNA, 6248 bp, Homo sapiens
cagttgcttgaaagcaacgcgcctattcacatggagaatcttccctttcctttaaaattacttagtgcctcatcgctaaacgcccccagttccacaccatgggtgttggatatcttcctcactttggtgtttgccctggggttcttcttcctattactcccctacttatcttacttccgttgtgatgacccaccctcaccatcgcctgggaagagaaaggtaaggaaccctcagtcccaacccacagagcttgattctctcctttctttttattattagttccacttttccaaatccagtggagagccttctatgatgggaagtctcagaagagaccagaacatcatccttccagggagaggcagggcagccaggggttggtaggggtagatagtgtactgggatttccatcccaagctctcagtccatctgtgggggagcacaggaggcatcaaggcaaaatcaaaccagtggactcagcaccagtaccagtcatgagactggggaggtctctgtccgagaccaggccctgagccctggctcatcagcccctttctggtgcaggtggctcagggcccagcctcccctgtgtggggtgatctggggcctgtgctgggcccctgagggcctcccaccagggcctggtgtctcctctggtctcctgggaagcagaatcctacctgatagctcagcagtgcctgcgggcctgaacttgggtgttcctggagcagaggaacagggactgaaggtgtccgtggtggacctcatattgaaaatccctctgtgtgtgtgtgtgtgtgtgtgtgtgtgtgtgtgtatttttattttatttgtgtgtgttatttttattttattttattttattttattttattttattttattttattttattttttgagatggagtctcgctctgtggtgcaggttgcagtgaaatggagtgatatcggctcactgcaacctctgcttcctgagttcaagcgattctcctgtcttagagtcctgaatagctggggattacaggcgcccaccaccatgcctgcctaatttttgtatttttagtagacacggggtttcaccatggccaggctggtctcaaactcctgacctcaggtgatcaacccaccttggcctcccaaagtgcttggattataggcgtgagccaccacgcccagccccctcttgctgtttttctaagaagaaaagcagtttatcatccatttaaacaagagtgggaggaagcacacagagctccctgagcaagacagagagagccatgcggttcctgagtgcagcatgctgcggctgggctggggcagagagggagagccggtcctagcttcttaccctttcttgtctcccattgtcatcttgtctctccgcgtcatcttgtctccgtacgtcatcgtgtctcccagtgtccagtagggcggaggcggaggcccagaggcaggatgaaaaaccacagtctgagaggtaaggctctgccagagcacactagggttaatttgatctcatctgtcccgaagggaactgactctgaagaagtcagttgaagaagcctgaggtgggggctcctaggaaggaaatcagaaccccgggtccttctcagattccatgcgggaatgaagccatggtgggccagggactgggcgttacccagcagggggcagtgtgtgtgtcctggggagaccaatgcctgcctggatgcggaggggggtgagggggcctcccgctccctgggaacagctgtccaactctgctaaggctgattcctctttgagaccacctcagtcctttctccccacagggcagttgtgaggactgtgggggtggggggtccgtgtgtggaagccctttgtgaatgaaaaagccctgtcctccatgccttgctattaacgtcggggtcatgtggctttggacacagatgggtggggtccagggtctaattccccatggtcctccctaaagaaacagccactcagcctcctgtgagaacccaggcccctccctcactgccctaacccagtctcctgatttccagctggtagagagtgccggagaggcctggaggagacttcggacctgctttcacaactgcagaggtgaggcacttccccttccctgcatccttcctaccagggctgggacgtgaccccagggccacaggcagcctggagctgacctgggatggggagaccaggggtacagaggatgggagtaaaaccctggggcgaggggtagcaggagaattgggcaatcagggtgtggggtggtggaggggctgtggcccgagcacccactctgccctccggccccaccggctcctggctgcagctcgtgcctcctgtctcctgcagcctcctggggccacaccttgacaaaggtgactttggtcagctctccggtccagaccccccaggtgaggtgggcgaaagagcacctgatggagcctcccagtcctctcatgagcctatggaagatgctgctcccattctctccctgttagcttccccggatcctcaagccaagcatcctcaggatctggcctccaccccatcaccaggcccaatgaccacctcagtctcctccctaagtgcctcccagccaccagaaccttcccttcccctagaacacccctcacccgagccacctgcacttttccctcacccaccacacacccctgatcctctggcctgctctctgcctcctccaaaaggcttcactgctcctcccctgcgggactccacactgataactccatctcactgtgactcagtggcacttccactgggcaccgtccctcaaagcttgtctccacatgaggatttggtggcttctgtcccagccatctcaggccttggtggctcaaacagtcatgtttctgcctcctcccggtggcaggagactgccagaacctcgtgcgcctttaactcatcagtccagcaagatcatctttcccgccacccaccagagacctgtcagatggaagctggtagcctgtttttgctcagctctgatggccagaatgtcgtggggatacaagtcacagaaacagccaaggtcaacatttgggaagaaaaagaaaatgttggatcatttacaaatcgaatgaccccagaaaagcacttaaattctttgcggaatttggctaaatcattggatgctgagcaggacaccacaaacccaaaacccttctggaacatgggagagaactcgaaacagctgcccggacctcagaagctctcagatcctaggctctggcaggaaagtttttggaagaattatagccagcttttctggggcctcccctctctgcacagcgagtccctggtggctaacgcctgggtaactgacaggtcttatactttacagtctcctcctttcttgttcaatgaaatgtccaatgtctgcccaattcaaagggagactacaatgtccccactgcttttccaggcccagcccctgtcccatctggggcccgagtgccaaccctttatttcatccacaccccaattccggcccacacctatggctcaggccgaggctcaggcccatcttcaatcttctttcccagtcctatctcctgcttttccatccctgattcagaacactggagtagcttgccctgcatcgcagaataaagtgcaagctctctccctacctgaaactcagcaccctgaatggcctttgttgaggagacaactagaaggtaggttggctttaccctctagggtccaaaaatctcaggacgtctttagtgtctccactcctaaccttccccaggaaagtttgacatccattctgcctgagaactttccagtcagtcctgaactccggagacaactggagcaacacataaaaaagtggatcatccaacactggggcaacctgggaaggatccaagagtctctggatctgatgcagcttcaggacgaatcaccagggacaagtcaggccaagggcaaacccagtccctggcagtcctccatgtccacaggtgaaagcagcaaggaggcacagaaggtgaagttccagctagagagggacccgtgcccacatctggggcaaattctgggtgagaccccacaaaatctatccagggatatgaaaagcttcccacggaaggttctgggggtgacttctgaggagttggaaaggaacttgaggaagcccttgaggagtgactcgggaagtgatttattaagatgcacagagaggactcatatagaaaacatcctgaaagcccacatgggcaggaacttgggccagaccaacgagggcttgatccccgtgcgtgtgcgtcgatcctggcttgctgtcaaccaggctcttcccgtgtccaacacccatgtgaaaaccagcaatctagcagccccgaaaagtgggaaagcctgtgtgaacacagcccaggtgctttccttcctcgagccgtgtactcagcaggggttgggagcccatattgtgaggttttgggccaaacacaggtggggtctacccctcagggtcctcaagcccattcagtgctttaaactggaaaaggtttcatccttgtcccttacacagcttgctggtccctcctcagccacctgtgaatctggggctggctcagaagttgaggtggacatgttccttagaaagccaccaatggcaagtctgagaaagcaggtgctgaccaaagcatctgatcacatgccagagagtcttctggcctcctcacctgcatggaagcagttccagagggcaccgcgaggaatcccatcttggaatgatcatgaacccttgaagcctcctccagctggacaggagggcaggtggccatctaagcccctcacgtacagcctcacaggcagcacccagcagagcaggagcttaggagcccaatcttcaaaggctggagagacaagggaggcagtgccacaatgcagagtccccttggaaacctgtatgctggcaaacctccaagccacaagtgaggatgtgcatggtttcgaggctccagggaccagcaaaagctctctacaccctagagtgtctgtctcccaagatccaagaaagctgtgtcttatggaggaggttgttagtgaatttgagcctggaatggccacaaagtcagagacccagcctcaagtttgtgccgctgttgtgctccttccagatgggcaagcatctgttgtgccccacgcttcagagaatttggtttctcaagtgccccagggccatctccagagcatgcctactgggaacatgcgggcttcccaggagctacatgacctcatggcagccagaaggagcaaactggtgcacgaggagcccagaaaaccaaactgtcaaggctcatgcaagagccaaaggccaatgtttccccctattcacaagagtgagaagtttaggaagcccaacttagaaaaacatgaagaaaggcttgaaggattgaggactcctcaacttaccccagtcaggaaaacagaagacacccatcaggatgaaggcgtccagctactgccatcaaagaaacagcctccttcagtaagcccctttggagaaaacatcaagcaaatttttcagtggattttttcaaagaaaaaaagcaagccagcaccagtcactgctgagagccaaaaaacagtaaaaaacagatcatgtgtgtacagcagcagtgctgaagctcagggtctcatgacggcagttggacaaatgctggacgagaaaatgtcactttgccatgcgcgccatgcctcgaaggtaaatcagcacaaacagaagtttcaagccccagtctgtgggtttccctgcaaccacaggcacctcttctactcagaacacggcagaatactgagctatgcagccagcagtcaacaagccactctcaagagccagggttgtcccaacagagacagacaaatcagaaatcaacagcccttgaaaagtgtgcggtgcaacaatgagcaatggggcctgcgacatccccaaatcttgcaccccaagaaagctgtatccccagtcagtccccctcagcactggccgaagacatccggtgcctctagccaccatcaccactgtccaaggcactgtcttctttgggaaggtatctgatttggtcagtcacaaattcttttttagccttccctggagaaaaacaagtccccaagaaaaaattcactctatgtagagaaaaaatattttctctcatgttagtacatgcagaacatttaatattccacaatatatatggttttttattca

SEQ ID NO: 653 - DNA, 7157 bp, Homo sapiens
agctgccattgcggattttgccagcttcagccagtttagtcctaagaaggaacttctgaccccagacatcctgttttctaaaactaagcagttaaagctgaatgggaatttagctctgtcacataggcattggttgggcaacaaaagcagggtagggctccagctaagccacgtaggcactacgatgggcaacagaaaggttggtttctgggcaattcagagaaaccaaggacagctacccccagaactcagagtagccaactgggctgctcacaggagatgccttaactgaaaggtgatcagactccacaggagacccagagaagatgtggagggagctcagaggttgtcctggaggagacgtggagacagctcagaggctgtcccggagaagacgtggaaagagctcagaggctgtcccagagaagacgtggagagctcagaggatgtcccaaacaagagagagctcagaggctgtcccagagaagacgtggagagagttcagaggctgtcccggagaagacgtggaaagagctcagaaactcagagactgtcccggagaagacatggaaacagctcagacgctgtctgcaagaagacgtgcagagagttcagaggctgtcccggagaagacatggagagagctcaaaggctgtccacaagaagatgtggagagagttcagaggctgtcgttactgctgcacttggctgtttttctttggataattattgccatcaattttagtaattcaggtgttaaatcacagtcaagcacctatttacctagtggtgagttcctttatgttgtgagttcaatgtcatttgtggggactgtggtccagggaggtgttgggaggatgaagttttttctgagtgactttgcaaacataaaaagtcacctaataaagatgctagaaaagcaaatatcctaacttcctagtcagaaaaatgtccaacaccatgtttatttaggggcaaaattatgtattcagaagaatttttcacaaaaaaacagtggtgggagaaaattacacatctgggcccaacaagtaagactttcccttcacaattgtgctgtgggatcccaggcctcggggggctactgccgtcaccatccccaggctgtgggcccctttgtcagctgctcttctgaaggcaggtctcctgtccatgccttcccctttgttgtccggatggagattggagacgcagcatcatatacagctgacaggtgttaaccttattagctaattctgtttcacgggacacgatttatacactccatggaaatgcttctcactgcctttttttaccacttcaaggtagaagtaggtaatagtgctaaagtcatcttactagaataacaaagtccatggtttgttgtccctaaaaatatttgtattagtttactagggctgccataacaaaataccacagactgagtggcttaagtaacataaatttctttttttctttctttctttctttgtttatttattattattatactttaagttttagggtacatgtgcacaatgtgcaggttagttacatatgtatacctgtgccatgctggtgtgctgcacccactaactcgtcatctagcattaggtatatctcccaatgctatccctccccccttcccccaccccacaacagtccccagagtgtgatgttccccttcctatgtccatgtgttctcactgttcgattcccacctatgagtgagaatatgtggtgtttggttttttgttcttgcgatagtttactgagaatgatgatttccaatttcatccatgtccctacaaaggacatgaactcatcatttttaagaaaatgtggcacatatacaccatggaatactatgcagccataaaaaatttcttttctcacagttttggaggctggaagtccaagatcaaggaatcagcacatttggtctcttctgaggcctctctccttcccttgccaatggccaccttcttactgtgtcctcacatgattgtcctgtggtctgtgtgtggtctctgtccacatctccttgtcttacaaggaaatcagtcttactgattagggcccacccatataacctaattttacctcaattacctctttataggtcctctttccaaatacagccccattctgaggtactagaggtgaggacttcaacataaatttgaggcaacacaattctgtccatgacaattgtccaccttagttttatggtgaaccaaggctgtgaaaaagacttgacttggggccgggcatggtggctcacgcctgtaatccctacactttaggaggccaaggtgggtgcataacccaaggtcaggagttcaagaccagcctggccaacatgatgaaaccccatctctactaaaaatacaaaaagaatgagctgggcttggtggcgggtgcctgtaatcccagctactcaggtggctgagacgggagaattgcttgaacccgggaagcgaaggttgcagtgagccgagactgcaccactgcactcaagcctggacaacaagagcgaaattctgtctaaaaaaaaaaaaaaaaaaaaaaagacttgactgaaggcagtgacctaagagtgaagcgataacagctggcaactgttccgcaagaaggtgcaaagcccctgcaggcctgggaaggtgcagagcctgcacctcagatttgactcctctcatagaatcatggaatttaagtgaacctcttccagtattagggaatcttgaatggaaactctaatatcttaatccccagtgtaacaaacttttactacattgttctcatgatgacaaatgtctcatcagaaaatggcttaaaagtataattattatgaaagcagactggcttatttaaaacaaacataatctgaaaactgtaatccaaaaagtagacatccatatatatatatatatatatatatatatatatatatatatatatattcattcattctctttgctttgaaactttcactgaatgacctttgtccgttttatcagtcaccatattttagtggtgctgtgcagtgacttttgtagagtaatatctctcaaagtgtgcagtgatcaatattgtgttgtcaaaagattctgtagtcaaagaagtttggaaaactttaattttttgattaagcaaagcaagaagtctgagtttcatttattggtttactatgaaaagtgttagaggctttatgatgtgcaagaaggacatgtgtcataatatttctcaaacctatttgacttccaatacttgcttttttgttttttcttcttttgtggagaaatttcaaaaactttggaaaatactttttaagtgagattcaggagtttgataagcaagatgacaaatactaaaaatatacactccaaatatagacacaatgaatactaaataaactcactgtttttagtcaacattattcaaggatatccaaagtttttcatggcataaaatgctctttttcttttcagtaatatgatacatgtgatattcctggaaacttaaaaaaaaatcatcatttatgtgctctcttgtcagtttcatgctgtatttttgatgtagaagaaagaatttggtatcttctcaggaatacattgtcacataaaaatatgtaaactccttcagataaattctcacctgcagaatgagtcaaacagcagggggagaagctgaatctagtgttcgcagtgagtgacctgtcttcctcaacactgtcatctcatctattgtcttggatgctcaagaaacggaactatataaatgtggcttctggccttcatatattacagtgccaaagcttcaaagaaccagtttttatttaatacttactttgtttctttgcattttttttcaaaaatacaatatgttgttattaactatagtgaccatgttgtgcagtagatctcttcttgaatatttcccctctcctaaatgaaattttgaatcctttgataaacatccccactccccaccccaagtccagcccctggtaaccaccagtctactctctacttctatgagtttagctttttcagattcgacataaaagtgaaatcatatggtctttctgtgcctggcttgtttcatttaacataatgtcctccaggttcatccatgttgtcacaaataacaagatttcattattttttatggctgaatagtatttcattgtgtatatatactactttttaaaattcatccatccattgatggacacttacattgtttccacatcttgggctaatatataaataagatttaatgtatatggtgttgcagatatctcttcgacatacggatttcatttcctttggatatatacccagtagtgggattgctggttcatatggtagttcatttttaatttttgaaggaacctccatgctattttccatgatgcctttccttcaaatcttctccaacacttgttatattttgtcattttataataaccatcctaacacgtatggggtgatatctcaaagtgtttttaatttgcctttctctaatgattagtaatattgagcattttttatatgcctgttggcctgtatgtcttcttttgaaaaatgtctatttggatcatttgtccatttcttattgagttatttttggttgtctcttcactctgctagcacctattttgtataagacaataatgctcttacattttcaaaatatacagaagataaaaaacatatagtaagtatgatacttgaattgtagtgagacgtttaaaattttccaggaaacaattactgtgttttatggttataaggaagaaacatgtacatcattttggggaagaaaaagagaaattatggagtgataagtttaaattgagaaaatatcaacaaatacaatatacgagagaggctctaggcatttcatttacaaaaatattgtccagtttttgtatgtgtgatgtgtgcttgttccctctttccatatctatctctgtctgtctttctgctatggtttgaatgtatcctccaaaagttcatagattggaaacttaatccctcttctctcatgaatagatttatgtcagtcctgccctcatgaatggattaatgtcactagcatagtagtgggttccttatcataagcccttttgctcttgctctctcactatgtgatgccccctgccatgttgttaggcagcaagaaggccttctccagaggccagcatcatgctcttggcattcctaggcctcagagctaaatacatttattttctttataaatcactcagtctgtggtattctgttatagcaacaaaaatattaagacactcttcctatttcccctactctccttcctccagcctctttcttacacacaaaatgttactgaaataccaggagttcaatctaggttctgttacttgcacacagaaagccaatcacttagacaatgaatattgccaaggaagaaggctttaattgcatgctacagctaaggatatgggatatcagtctcaattccatctcctcaaccagccgaaattaggggattatatagcaaggaagaaatgtaactatgagcaggaaaacaggaactagggagggctaaggaagcaatcatgacaaataaggaatctggcatctggcatctcattgtctcgacacagtggtctgatgaatttcacttctttgatactttttgagagagctgagagtccatttcctgaggaagaaactcagagaaaacaaatgtaagtttcaagcttcaagaccagaaggatttgtttctatgtttatatttttaaaatctgtctgtggatctattgggtgcatttcaaaaacacatacagaggaaatcccaggcgctgtgctagaattgggaatacaatggtgagttcaaagaggaataattttcctattctcatgaagctaatagtataggatagagaaagcaaacactaatcaaagaaccacacaagcataagattgcaactacaactaaaaaccataaccattcagttaagctaaggaggccaccattgtcacccttctcttaacctttaataatgtattttacaggtaaaatccttaagtaagtcatatttggttgggaagatcaaagaaatcacccagtctcccacatccgaaattgtgcagtctggactgtcaggaacaaaagtgaaagagagacgtcatcaaggccgggcgcggtggctcatgcctgtaatcccagcactttggaaggccaaggagggcggatcatgaggtcaggagttcaagaccagcctggccaatatggtgaaaccctgtctctactaaaaatacaaaaattagccaggcgtggtggcaggcgcctgtaatcccagctacttgggaggctgaggcagaagaatcacttgaacctgagaggcagaggttgcaataagccaagattgtgccattgcactccagcctgggagacaaagcgagactccatctcaaaaaaaaaaaaaaaaaaagaatgactaaaattaagaagattgatgattccaaatattagtaaagatgtagaacaactagaactcccacatattgctgatgaaaatgaagaataatacattactttggaaaatactttggtactgatttaccatatgaccccaaaatctcacttgtagaaatttatacaggaaaaatgaaaacatatgctcacagaaagcttgtatacacatgcttatggcaataaatttatttatagttgcctaccaacaagtgatgaacaaatatattttagtatcttgatactactttctagctagaaaaggaatactactaagcaaaaatagaggatgaagtagtaatatacataacatagatgaatttaaaaacaccatgctgattgaaagaaaacaattatcaaatacacagtgtaatattctattcacagaaagtttgaaaacaaaaaactatagtctctgaaagaaaaccattggttgcaggaaggtggggattcattggccacaaaagggactgaggaaactttttatgggtaatggaaatattttatatcttgattgtggcaccaattatacaactgtatgtacacatctgtcaaaattctaattgtattatacacaacatgagtgactttaactgtctataaattatatctcaataaaattggtcttaaaagat

SEQ ID NO: 654 - DNA, 6259 bp, Homo sapiens
cttatgaataaaaaaccatatatattgtggaatattaaatgttctgcatgtactaacatgagagaaaatattttttctctacatagagtgaattttttcttggggacttgtttttctccagggaaggctaaaaaagaatttgtgactgaccaaatcagataccttcccaaagaagacagtgccttggacagtggtgatggtggctagaggcaccggatgtcttcggccagtgctgagggggactgactggggatacagctttcttggggtgcaagatttggggatgtcgcaggccccattgctcattgttgcaccgcacacttttcaagggctgttgatttctgatttgtctgtctctgttgggacaaccctggctcttgagagtggcttgttgactgctggctgcatagctcagtattctgccgtgttctgagtagaagaggtgcctgtggttgcagggaaacccacagactggggcttgaaacttctgtttgtgctgatttaccttcgaggcatggcgcgcatggcaaagtgacattttcttgtccagcatttgtccaactgccgtcatgagaccctgagcttcagcactgctgctgtacacacgtgatctgttttttactgttttttggctctcagcagtgactggtgctggcttgctttttttctttgaaaaaatccactgaaaaatttgcttgatgttttctccaaaggggcttactgaaggaggctgtttctttgatggcagtagctggacgccttcatcctgatgggtgtcttctgttttcctgactggggtaagttgaggagtcctcaatccttcaagcctttcttcatgtttttctaagttgggtttcctagacttctcactcttgtgaatagggggaaacattggcctttggctcttgcatgagccttgacagtttgggtttctgggctcctcgtgcaccagtttgctccttctggctgccatgaggtcatgtagctcctgggaagcccgcatgttcccagtaggcatgctctggagatggccctggggcacttgagaaaccaaattctctgaagcgtggggcacaacagatgcttgcccatctggaaggagcacaacagcagcacaaacttgaggctgggtctctgactttgtggccattccaggctcaaattcattaacaacctcctccataagacacagctttcttggatcttgggagacagacactctagggtgtagagagcttttgctggtccctggagcctcgaaaccatgcacatcctcacttgtggcttggaggtttgccagcatacaggtttccaaggggactctgcattgtggcactgcctcccttgtctctccagcctttgaagattgggctcctaagctcctgctctgctggatgctgcctgtgaggctgtacgtgaggggcttagatggccacctgccctcctgtccagctggaggaggcttcaagggttcatgatcattccaagatgggattcctcgcggtgccctctggaactgcttccatgcaggtgaggaggccagaagactctctggcatgtgatcagatgctttggtcaacacctgctttctcagacttgccattggtggctttctaaggaacatgtccacctcaacttctgagccagccccagattcacaggtggctgaggagggaccagcaagctgtgtaagggacaaggatgaaaccttttccagtttaaagcactgaatgggcttgaggaccctgaggggtagaccccacctgtgtttggcccaaaacctcacaatatgggctcccaacccctgctgagtacacggctcgaggaaggaaagcacctgggctgtgttcacacaggctttcccacttttcggggctgctagattgctggttttcacatgggtgttggacacgggaagagcctggttgacagcaagccaggatcgacgcacacgcacggggatcaagccctcgttggtctggcccaagttcctgcccatgtgggctttcaggatgttttctatatgagtcctctctgtgcatcttaataaatcacttcccgagtcactcctcaagggcttcctcaagttcctttccaactcctcagaagtcacccccagaaccttccgtgggaagcttttcatatccctggatagattttgtggggtctcacccagaatttgccccagatgtgggcacgggtccctctctagctggaacttcaccttctgtgcctccttgctgctttcacctgtggacatggaggactgccagggactgggtttgcccttggcctgacttgtccctggtgattcgtcccgaagctgcatcagatccagagactcttggatccttcccaggttgccccagtgttggatgatccacttttttatgtgttgctccagttgtctccggagttcaggactgactggaaagttctcaggcagaatggatgtcaaactttcctggggaaggttaggagtggagacactaaagacgtcctgagatttttggaccctagagggtaaagccaacctaccttctagttgtctcctcaacaaaggccattcagggtgctgagtttcaggtagggagagagcttgcactttattctgcgatgcagggcaagctactccagtgttctgaatcagggatggaaaagcaggagataggactgggaaagaagattgaagatgggcctgagcctcggcctgagccataggtgtgggccggaattggggtgtggatgaaataaagggttggcactcgggccccagatgggacaggggctgggcctggaaaagcagtggggacattgtagtctccctttgaattgggcagacattggacatttcattgaacaagaaaggaggagactgtaaagtataagacctgtcagttacccaggcgttagccaccagggactcgctgtgcagagaggggaggccccagaaaagctggctataattcttccaaaaactttcctgccagagcctaggatctgagagcttctgaggtccgggcagctgtttcgagttctctcccatgttccagaagggttttgggtttgtggtgtcctgctcagcatccaatgatttagccaaattccgcaaagaatttaagtgcttttctggggtcattcgatttgtaaatgatccaacattttctttttcttcccaaatgttgaccttggctgtttctgtgacttgtatccccacgacattctggccatcagagctgagcaaaaacaggctaccagcttccatctgacaggtctctggtgggtggcgggaaagatgatcttgctggactgatgagttaaaggcgcacgaggttctggcagtctcctgccaccgggaggaggcagaaacatgactgtttgagccaccaaggcctgagatggctgggacagaagccaccaaatcctcatgtggagacaagctttgagggacggtgcccagtggaaatgccactgagtcacagtgagatggagttatcagtgtggagtcccgcaggggaggagcagtgaagccttttggaggaggcagagagcaggccagaggatcaggggtgtgtggtgggtgagggaaaagtgcaggtggctcgggtgaggggtgttctaggggaagggaaggttctggtggctgggaggcacttagggaggagactgaggtggtcattgggcctggtgatggggtggaggccagatcctgaggatgcttggcttgaggatccggggaagctaacggggagagaatgggagcagcatcttccataggctcatgagaggactgggaggctccatcaggtgctctttcacccacctcacctggggggtctggaccggagagctgaccaaagtcacctttgtcaaggtgtggccccaggaggctgcaggagacaggaggcacgagctgcagccaggagccggtggggccggagggcagagtgggtgctcgggccacagcccctccaccaccccacaccctgattgcccaattctcctgctacccctcgccccagggttttactcccatcctctgtccccctggtctccccatcccaggtcagctccaggctgcctgtggccctggggtcacgtcccagccctggtaggaaggatgcagggaaggggaagtgcctcacctctgcagttgtgaaagcaggtccgaagtctcctccaggcctctccggcactctctaccagctggaaatcaggagactgggttagggcagtgagggaggggcctgggttctcacaggaggctgagtggctgtttctttagggaggaccatggggaattagaccctggaccccacccatctgtgtccaaagccacatgaccccgacgttaatagcaaggcatggaggacaaggctttttcattcacaaagggcttccacacacggaccccccacccccacagtcctcacaactgccctgtggggagaaaggactgaggtggtctcaaagaggaatcagccttagcagagttggacagctgttcccagggagcgggaggccccctcacccccctccgcatccaggcaggcattggtctccccaggacacacacactgccccctgctgggtaacgcccagtccctggcccaccatggcttcattcccgcatggaatctgagaaggacccggggttctgatttccttcctaggagcccccacctcaggcttcttcaactgacttcttcagagtcagttcccttcgggacagatgagatcaaattaaccctagtgtgctctggcagagccttacctctcagactgtggtttttcatcctgcctctgggcctccgcctccgccctactggacactgggagacacgatgacgtacggagacaagatgacgcggagagacaagatgacaatgggagacaagaaagggtgagaagctaggaccggctctccctctctgccccagcccagccgcagcatgctgcactcaggaaccgcatggctctctctgtcttgctcagggagctctgtgtgcttcctcccactcttgtttaaatggatgataaactgcttttcttcttagaaaaacagcaagagggggctgggcgtggtagctcacgcctataatccaagcactttgggaggccaaggtgggttgatcacctgaggtcaggagtttgagaccagcctggccatggtgaaaccccgtgtctactaaaaatacaaaaattaggcaggcatggtggtgggcgcctgtaatccccagctattcaggactctaagacaggagaatcgcttgaactcaggaagcagaggttgcagtgagccgatatcactccatttcactgcaacctgcaccacagagcgagactccatctcaaaaaataaaataaaataaaataaaataaaataaaataaaataaaataaaataaaaataacacacacaaataaaataaaaatacacacacacacacacacacacacacacacacacacacacacagagggattttcaatatgaggtccaccacggacaccttcagtccctgttcctctgctccaggaacacccaagttcaggcccgcaggcactgctgagctatcaggtaggattctgcttcccagaagaccagaggagacaccaggccctggtgggaggccctcaggggcccagcacaggccccagatcaccccacacaggggaggctgggccctgagccacctgcaccagaaaggggctgatgagccagggctcagggcctggtctcggacagagacctccccagtctcatgactggtactggtgctgagtccactggtttgattttgccttgatgcctcctgtgctcccccacagatggactgagagcttgggatggaaatcccagtacactatctacccctaccaacccctggctgccctgcctctccctggaaggatgatgttctggtctcttctgagacttcccatcatagaaggctctccactggatttggaaaagtggaactaataataaaaagaaaggagagaatcaagctctgtgggttgggactgagggttccttacctttctcttcccaggcgatggtgagggtgggtcatcacaacggaagtaagataagtaggggagtaatacgaagaagaaccccagggcaaacaccaaagtgaggaagatatccaacacccatggtgtggaactgggggcgtttagcgatgaggcactaagtaattttaaaggaaagggaagattctccatgtgaataggcgcgttgctttcaagcaact

SEQ ID NO: 655 - DNA, 6256 bp, Homo sapiens
atgaataaaaaaccatatatattgtggaatattaaatgttctgcatgtactaacatgagagaaaatattttttctctacatagagtgaattttttcttggggacttgtttttctccagggaaggctaaaaaagaatttgtgactgaccaaatcagataccttcccaaagaagacagtgccttggacagtggtgatggtggctagaggcaccggatgtcttcggccagtgctgagggggactgactggggatacagctttcttggggtgcaagatttggggatgtcgcaggccccattgctcattgttgcaccgcacacttttcaagggctgttgatttctgatttgtctgtctctgttgggacaaccctggctcttgagagtggcttgttgactgctggctgcatagctcagtattctgccgtgttctgagtagaagaggtgcctgtggttgcagggaaacccacagactggggcttgaaacttctgtttgtgctgatttaccttcgaggcatggcgcgcatggcaaagtgacattttcttgtccagcatttgtccaactgccgtcatgagaccctgagcttcagcactgctgctgtacacacgtgatctgttttttactgttttttggctctcagcagtgactggtgctggcttgctttttttctttgaaaaaatccactgaaaaatttgcttgatgttttctccaaaggggcttactgaaggaggctgtttctttgatggcagtagctggacgccttcatcctgatgggtgtcttctgttttcctgactggggtaagttgaggagtcctcaatccttcaagcctttcttcatgtttttctaagttgggtttcctagacttctcactcttgtgaatagggggaaacattggcctttggctcttgcatgagccttgacagtttgggtttctgggctcctcgtgcaccagtttgctccttctggctgccatgaggtcatgtagctcctgggaagcccgcatgttcccagtaggcatgctctggagatggccctggggcacttgagaaaccaaattctctgaagcgtggggcacaacagatgcttgcccatctggaaggagcacaacagcagcacaaacttgaggctgggtctctgactttgtggccattccaggctcaaattcattaacaacctcctccataagacacagctttcttggatcttgggagacagacactctagggtgtagagagcttttgctggtccctggagcctcgaaaccatgcacatcctcacttgtggcttggaggtttgccagcatacaggtttccaaggggactctgcattgtggcactgcctcccttgtctctccagcctttgaagattgggctcctaagctcctgctctgctggatgctgcctgtgaggctgtacgtgaggggcttagatggccacctgccctcctgtccagctggaggaggcttcaagggttcatgatcattccaagatgggattcctcgcggtgccctctggaactgcttccatgcaggtgaggaggccagaagactctctggcatgtgatcagatgctttggtcaacacctgctttctcagacttgccattggtggctttctaaggaacatgtccacctcaacttctgagccagccccagattcacaggtggctgaggagggaccagcaagctgtgtaagggacaaggatgaaaccttttccagtttaaagcactgaatgggcttgaggaccctgaggggtagaccccacctgtgtttggcccaaaacctcacaatatgggctcccaacccctgctgagtacacggctcgaggaaggaaagcacctgggctgtgttcacacaggctttcccacttttcggggctgctagattgctggttttcacatgggtgttggacacgggaagagcctggttgacagcaagccaggatcgacgcacacgcacggggatcaagccctcgttggtctggcccaagttcctgcccatgtgggctttcaggatgttttctatatgagtcctctctgtgcatcttaataaatcacttcccgagtcactcctcaagggcttcctcaagttcctttccaactcctcagaagtcacccccagaaccttccgtgggaagcttttcatatccctggatagattttgtggggtctcacccagaatttgccccagatgtgggcacgggtccctctctagctggaacttcaccttctgtgcctccttgctgctttcacctgtggacatggaggactgccagggactgggtttgcccttggcctgacttgtccctggtgattcgtcccgaagctgcatcagatccagagactcttggatccttcccaggttgccccagtgttggatgatccacttttttatgtgttgctccagttgtctccggagttcaggactgactggaaagttctcaggcagaatggatgtcaaactttcctggggaaggttaggagtggagacactaaagacgtcctgagatttttggaccctagagggtaaagccaacctaccttctagttgtctcctcaacaaaggccattcagggtgctgagtttcaggtagggagagagcttgcactttattctgcgatgcagggcaagctactccagtgttctgaatcagggatggaaaagcaggagataggactgggaaagaagattgaagatgggcctgagcctcggcctgagccataggtgtgggccggaattggggtgtggatgaaataaagggttggcactcgggccccagatgggacaggggctgggcctggaaaagcagtggggacattgtagtctccctttgaattgggcagacattggacatttcattgaacaagaaaggaggagactgtaaagtataagacctgtcagttacccaggcgttagccaccagggactcgctgtgcagagaggggaggccccagaaaagctggctataattcttccaaaaactttcctgccagagcctaggatctgagagcttctgaggtccgggcagctgtttcgagttctctcccatgttccagaagggttttgggtttgtggtgtcctgctcagcatccaatgatttagccaaattccgcaaagaatttaagtgcttttctggggtcattcgatttgtaaatgatccaacattttctttttcttcccaaatgttgaccttggctgtttctgtgacttgtatccccacgacattctggccatcagagctgagcaaaaacaggctaccagcttccatctgacaggtctctggtgggtggcgggaaagatgatcttgctggactgatgagttaaaggcgcacgaggttctggcagtctcctgccaccgggaggaggcagaaacatgactgtttgagccaccaaggcctgagatggctgggacagaagccaccaaatcctcatgtggagacaagctttgagggacggtgcccagtggaaatgccactgagtcacagtgagatggagttatcagtgtggagtcccgcaggggaggagcagtgaagccttttggaggaggcagagagcaggccagaggatcaggggtgtgtggtgggtgagggaaaagtgcaggtggctcgggtgaggggtgttctaggggaagggaaggttctggtggctgggaggcacttagggaggagactgaggtggtcattgggcctggtgatggggtggaggccagatcctgaggatgcttggcttgaggatccggggaagctaacggggagagaatgggagcagcatcttccataggctcatgagaggactgggaggctccatcaggtgctctttcacccacctcacctggggggtctggaccggagagctgaccaaagtcacctttgtcaaggtgtggccccaggaggctgcaggagacaggaggcacgagctgcagccaggagccggtggggccggagggcagagtgggtgctcgggccacagcccctccaccaccccacaccctgattgcccaattctcctgctacccctcgccccagggttttactcccatcctctgtccccctggtctccccatcccaggtcagctccaggctgcctgtggccctggggtcacgtcccagccctggtaggaaggatgcagggaaggggaagtgcctcacctctgcagttgtgaaagcaggtccgaagtctcctccaggcctctccggcactctctaccagctggaaatcaggagactgggttagggcagtgagggaggggcctgggttctcacaggaggctgagtggctgtttctttagggaggaccatggggaattagaccctggaccccacccatctgtgtccaaagccacatgaccccgacgttaatagcaaggcatggaggacaaggctttttcattcacaaagggcttccacacacggaccccccacccccacagtcctcacaactgccctgtggggagaaaggactgaggtggtctcaaagaggaatcagccttagcagagttggacagctgttcccagggagcgggaggccccctcacccccctccgcatccaggcaggcattggtctccccaggacacacacactgccccctgctgggtaacgcccagtccctggcccaccatggcttcattcccgcatggaatctgagaaggacccggggttctgatttccttcctaggagcccccacctcaggcttcttcaactgacttcttcagagtcagttcccttcgggacagatgagatcaaattaaccctagtgtgctctggcagagccttacctctcagactgtggtttttcatcctgcctctgggcctccgcctccgccctactggacactgggagacacgatgacgtacggagacaagatgacgcggagagacaagatgacaatgggagacaagaaagggtgagaagctaggaccggctctccctctctgccccagcccagccgcagcatgctgcactcaggaaccgcatggctctctctgtcttgctcagggagctctgtgtgcttcctcccactcttgtttaaatggatgataaactgcttttcttcttagaaaaacagcaagagggggctgggcgtggtagctcacgcctataatccaagcactttgggaggccaaggtgggttgatcacctgaggtcaggagtttgagaccagcctggccatggtgaaaccccgtgtctactaaaaatacaaaaattaggcaggcatggtggtgggcgcctgtaatccccagctattcaggactctaagacaggagaatcgcttgaactcaggaagcagaggttgcagtgagccgatatcactccatttcactgcaacctgcaccacagagcgagactccatctcaaaaaataaaataaaataaaataaaataaaataaaataaaataaaataaaataaaaataacacacacaaataaaataaaaatacacacacacacacacacacacacacacacacacacacacacagagggattttcaatatgaggtccaccacggacaccttcagtccctgttcctctgctccaggaacacccaagttcaggcccgcaggcactgctgagctatcaggtaggattctgcttcccagaagaccagaggagacaccaggccctggtgggaggccctcaggggcccagcacaggccccagatcaccccacacaggggaggctgggccctgagccacctgcaccagaaaggggctgatgagccagggctcagggcctggtctcggacagagacctccccagtctcatgactggtactggtgctgagtccactggtttgattttgccttgatgcctcctgtgctcccccacagatggactgagagcttgggatggaaatcccagtacactatctacccctaccaacccctggctgccctgcctctccctggaaggatgatgttctggtctcttctgagacttcccatcatagaaggctctccactggatttggaaaagtggaactaataataaaaagaaaggagagaatcaagctctgtgggttgggactgagggttccttacctttctcttcccaggcgatggtgagggtgggtcatcacaacggaagtaagataagtaggggagtaatacgaagaagaaccccagggcaaacaccaaagtgaggaagatatccaacacccatggtgtggaactgggggcgtttagcgatgaggcactaagtaattttaaaggaaagggaagattctccatgtgaataggcgcgttgctttcaagcaact

SEQ ID NO: 656 - DNA, 6292 bp, Homo sapiens
cttatgaataaaaaaccatatatattgtggaatattaaatgttctgcatgtactaacatgagagaaaatattttttctctacatagagtgaattttttcttggggacttgtttttctccagggaaggctaaaaaagaatttgtgactgaccaaatcagataccttcccaaagaagacagtgccttggacagtggtgatggtggctagaggcaccggatgtcttcggccagtgctgagggggactgactggggatacagctttcttggggtgcaagatttggggatgtcgcaggccccattgctcattgttgcaccgcacacttttcaagggctgttgatttctgatttgtctgtctctgttgggacaaccctggctcttgagagtggcttgttgactgctggctgcatagctcagtattctgccgtgttctgagtagaagaggtgcctgtggttgcagggaaacccacagactggggcttgaaacttctgtttgtgctgatttaccttcgaggcatggcgcgcatggcaaagtgacattttcttgtccagcatttgtccaactgccgtcatgagaccctgagcttcagcactgctgctgtacacacgtgatctgttttttactgttttttggctctcagcagtgactggtgctggcttgctttttttctttgaaaaaatccactgaaaaatttgcttgatgttttctccaaaggggcttactgaaggaggctgtttctttgatggcagtagctggacgccttcatcctgatgggtgtcttctgttttcctgactggggtaagttgaggagtcctcaatccttcaagcctttcttcatgtttttctaagttgggtttcctagacttctcactcttgtgaatagggggaaacattggcctttggctcttgcatgagccttgacagtttgggtttctgggctcctcgtgcaccagtttgctccttctggctgccatgaggtcatgtagctcctgggaagcccgcatgttcccagtaggcatgctctggagatggccctggggcacttgagaaaccaaattctctgaagcgtggggcacaacagatgcttgcccatctggaaggagcacaacagcagcacaaacttgaggctgggtctctgactttgtggccattccaggctcaaattcattaacaacctcctccataagacacagctttcttggatcttgggagacagacactctagggtgtagagagcttttgctggtccctggagcctcgaaaccatgcacatcctcacttgtggcttggaggtttgccagcatacaggtttccaaggggactctgcattgtggcactgcctcccttgtctctccagcctttgaagattgggctcctaagctcctgctctgctggatgctgcctgtgaggctgtacgtgaggggcttagatggccacctgccctcctgtccagctggaggaggcttcaagggttcatgatcattccaagatgggattcctcgcggtgccctctggaactgcttccatgcaggtgaggaggccagaagactctctggcatgtgatcagatgctttggtcaacacctgctttctcagacttgccattggtggctttctaaggaacatgtccacctcaacttctgagccagccccagattcacaggtggctgaggagggaccagcaagctgtgtaagggacaaggatgaaaccttttccagtttaaagcactgaatgggcttgaggaccctgaggggtagaccccacctgtgtttggcccaaaacctcacaatatgggctcccaacccctgctgagtacacggctcgaggaaggaaagcacctgggctgtgttcacacaggctttcccacttttcggggctgctagattgctggttttcacatgggtgttggacacgggaagagcctggttgacagcaagccaggatcgacgcacacgcacggggatcaagccctcgttggtctggcccaagttcctgcccatgtgggctttcaggatgttttctatatgagtcctctctgtgcatcttaataaatcacttcccgagtcactcctcaagggcttcctcaagttcctttccaactcctcagaagtcacccccagaaccttccgtgggaagcttttcatatccctggatagattttgtggggtctcacccagaatttgccccagatgtgggcacgggtccctctctagctggaacttcaccttctgtgcctccttgctgctttcacctgtggacatggaggactgccagggactgggtttgcccttggcctgacttgtccctggtgattcgtcccgaagctgcatcagatccagagactcttggatccttcccaggttgccccagtgttggatgatccacttttttatgtgttgctccagttgtctccggagttcaggactgactggaaagttctcaggcagaatggatgtcaaactttcctggggaaggttaggagtggagacactaaagacgtcctgagatttttggaccctagagggtaaagccaacctaccttctagttgtctcctcaacaaaggccattcagggtgctgagtttcaggtagggagagagcttgcactttattctgcgatgcagggcaagctactccagtgttctgaatcagggatggaaaagcaggagataggactgggaaagaagattgaagatgggcctgagcctcggcctgagccataggtgtgggccggaattggggtgtggatgaaataaagggttggcactcgggccccagatgggacaggggctgggcctggaaaagcagtggggacattgtagtctccctttgaattgggcagacattggacatttcattgaacaagaaaggaggagactgtaaagtataagacctgtcagttacccaggcgttagccaccagggactcgctgtgcagagaggggaggccccagaaaagctggctataattcttccaaaaactttcctgccagagcctaggatctgagagcttctgaggtccgggcagctgtttcgagttctctcccatgttccagaagggttttgggtttgtggtgtcctgctcagcatccaatgatttagccaaattccgcaaagaatttaagtgcttttctggggtcattcgatttgtaaatgatccaacattttctttttcttcccaaatgttgaccttggctgtttctgtgacttgtatccccacgacattctggccatcagagctgagcaaaaacaggctaccagcttccatctgacaggtctctggtgggtggcgggaaagatgatcttgctggactgatgagttaaaggcgcacgaggttctggcagtctcctgccaccgggaggaggcagaaacatgactgtttgagccaccaaggcctgagatggctgggacagaagccaccaaatcctcatgtggagacaagctttgagggacggtgcccagtggaaatgccactgagtcacagtgagatggagttatcagtgtggagtcccgcaggggaggagcagtgaagccttttggaggaggcagagagcaggccagaggatcaggggtgtgtggtgggtgagggaaaagtgcaggtggctcgggtgaggggtgttctaggggaagggaaggttctggtggctgggaggcacttagggaggagactgaggtggtcattgggcctggtgatggggtggaggccagatcctgaggatgcttggcttgaggatccggggaagctaacggggagagaatgggagcagcatcttccataggctcatgagaggactgggaggctccatcaggtgctctttcacccacctcacctggggggtctggaccggagagctgaccaaagtcacctttgtcaaggtgtggccccaggaggctgcaggagacaggaggcacgagctgcagccaggagccggtggggccggagggcagagtgggtgctcgggccacagcccctccaccaccccacaccctgattgcccaattctcctgctacccctcgccccagggttttactcccatcctctgtccccctggtctccccatcccaggtcagctccaggctgcctgtggccctggggtcacgtcccagccctggtaggaaggatgcagggaaggggaagtgcctcacctctgcagttgtgaaagcaggtccgaagtctcctccaggcctctccggcactctctaccagctggaaatcaggagactgggttagggcagtgagggaggggcctgggttctcacaggaggctgagtggctgtttctttagggaggaccatggggaattagaccctggaccccacccatctgtgtccaaagccacatgaccccgacgttaatagcaaggcatggaggacaaggctttttcattcacaaagggcttccacacacggaccccccacccccacagtcctcacaactgccctgtggggagaaaggactgaggtggtctcaaagaggaatcagccttagcagagttggacagctgttcccagggagcgggaggccccctcacccccctccgcatccaggcaggcattggtctccccaggacacacacactgccccctgctgggtaacgcccagtccctggcccaccatggcttcattcccgcatggaatctgagaaggacccggggttctgatttccttcctaggagcccccacctcaggcttcttcaactgacttcttcagagtcagttcccttcgggacagatgagatcaaattaaccctagtgtgctctggcagagccttacctctcagactgtggtttttcatcctgcctctgggcctccgcctccgccctactggacactgggagacacgatgacgtacggagacaagatgacgcggagagacaagatgacaatgggagacaagaaagggtgagaagctaggaccggctctccctctctgccccagcccagccgcagcatgctgcactcaggaaccgcatggctctctctgtcttgctcagggagctctgtgtgcttcctcccactcttgtttaaatggatgataaactgcttttcttcttagaaaaacagcaagagggggctgggcgtggtagctcacgcctataatccaagcactttgggaggccaaggtgggttgatcacctgaggtcaggagtttgagaccagcctggccatggtgaaaccccgtgtctactaaaaatacaaaaattaggcaggcatggtggtgggcgcctgtaatccccagctattcaggactctaagacaggagaatcgcttgaactcaggaagcagaggttgcagtgagccgatatcactccatttcactgcaacctgcaccacagagcgagactccatctcaaaaaataaaataaaataaaataaaataaaataaaataaaataaaataaaataaaaataacacacacaaataaaataaaaatacacacacacacacacacacacacacacacacacacacacacagagggattttcaatatgaggtccaccacggacaccttcagtccctgttcctctgctccaggaacacccaagttcaggcccgcaggcactgctgagctatcaggtaggattctgcttcccagaagaccagaggagacaccaggccctggtgggaggccctcaggggcccagcacaggccccagatcaccccacacaggggaggctgggccctgagccacctgcaccagaaaggggctgatgagccagggctcagggcctggtctcggacagagacctccccagtctcatgactggtactggtgctgagtccactggtttgattttgccttgatgcctcctgtgctcccccacagatggactgagagcttgggatggaaatcccagtacactatctacccctaccaacccctggctgccctgcctctccctggaaggatgatgttctggtctcttctgagacttcccatcatagaaggctctccactggatttggaaaagtggaactaataataaaaagaaaggagagaatcaagctctgtgggttgggactgagggttccttacctttctcttcccaggcgatggtgagggtgggtcatcacaacggaagtaagataagtaggggagtaatacgaagaagaaccccagggcaaacaccaaagtgaggaagatatccaacacccatggtgtggaactgggggcgtttagcgatgaggcactaagtaattttaaaggaaagggaagattctccatgtgaataggcgcgttgctttcaagcaactgagctctgggcatccccgtggagactagggact

SEQ ID NO: 657 - DNA, 60784 bp, Homo sapiens
ctgaaatagttacacatgaagttttaatgagctatttcatattaagatacatattgagaattcaaaccagagagtccagttaattgatattttcccaactctgttttagggtgatcatagaaatgatatccacaagttagtcacagtggcctgcatccattttgatatatcagtgatgtattttgattggccagtgatcacccatactgactgttaaatatttttgttatcactcctatgcatggtgaatttgagttctggttttctttagccttgtgttatttatgtgtaaagttggattatggaaggcaaagaatctctcgtgtgtcattcacgctcaagtaaatggcagtggggtagggatgtaaatgaaactgcgtgataagccctgcaagtcattctgatgtatcaattttgcttactggtgtttaattgcagacattgtcatattaatgcaaccactaatacattatggagtaagatgcaaaaatcacatgagtcttaagagaaaagaaatgtgctttctatggtgggccccttttgtattattctctaacttcttattttatacctctactattagagaaatttcagtagaaaatcgtgaggggcaccgttttagagtttttgttgttataggtatgcttttactacagctaggtccccttgtacatctttatgttctttggcagtctagagaaccagaagagcaaactctatgagatagaaactctaagaatttatttacctccagcatcccttctcttctttcattaaattgaatttgtggccaactcaaagactgacaatttatactatggtttttatgtttttatattataatttatattacggcttatgtcaaaatgttttgttcactgctttgaaagtatcttttgtttacttttgttatttcatattttaattttttcctttctaattgttagaaactcatgtattttatctttcaaagaaaattttttaaaaggcttactctgcttatatgtatattttgcacaaagctttccattcataaacaaaaggtgaataggaatcagaattgaaaactacgtaatttcttttctccttttgagtcaaatcatcacagtatagattagtcattgtgtatgaagtgcattgccaatacatagtcacatttgtgtagaaatgtaaaggctatatctcaatacaaatcaaaaaccaaaaaatgcagaagaccattagctaataatactaataatctagtatagaaagcatgtgccaactgatctagactcttgtgacagttgtatatctacccagctgcatgacctgaggtgtatcaaaatcttgatttcctagactacaaatgagtaaaagggatggaggccccttacagttttaagattctagaattctaagtgtgtgtaactagagcaaattttattttctaaaatttgcataataaatttaaaaataggagaaaaacaaataattaaagtacatatttctagaaatcttttttaggtgacttatactaccaggaatggatttaccactaaatattggttttgcctaattcagcattgctatgtaatttgatggaagtataactccatagacaaagagatttggtcctaacatagcttgtattttatatgtatatacactatttctatttaaatttctgtgtagtcatgttttacccttttaaaatgaagattagttttattatgtattttcttttgtctataaacattcaatgaattcacactgaaaactgattatgaacagatagtctgctaggcactaaggaaacacatacgaaaaactaagtcctcctctgccctcaatatgctcacaagactacagttactgaagcctgacctcaaaacctagctagcaaagtccttgaatcaggtgatagttcagaataccattcgtgctctctcccaagagtatatctgaggaagggcagttctttctagttttctacatcctggtcgtataggtcaaccacaggaaaattaaatgaatctattgttttggtgacctagccttttcatataactctcatctataaatgtattaccaaatactatttatgtaaagggacttgtatgacaaatattttgaaattaaaaccacaatggttagcatagcttttaaattagatagatgttgacctcccattggtaaacatataaagtgctaccaagatctgccaatgacagactttggaagtggaaattcatctttgtaataatcctgttatctgtaggctgacctcaaaccttcataacattcagggccccttattcctaactgtatcttctattttgggcattgtgctcttgccatctaacaggaaaacaactttcagtgctgccaccttttgaacaggagagatttctagagattagaaaattactaaatttaaatatacatagttttaaaatatgatacttttctacccatgcattcaaatatattctaactttaaaatcctgtaaatacttatatttgtaatgattttacttatatgatccaattaattggcaagaatatgtggtgaaagattttttacatgtttgtattgttctgtgtgagacatctattgtaagcattgcttcaggccctcatttttgtctgccttccaggatttgctggcccaagtgctgtgtgctagcttagtgtcagtcacaaaggggagggaaacttgcagttgagccagacagttttgttattcctttaaaattaaaagcatatgaaacagatacagcttattaaggttttttttataaataacataaacttaaataacaaaacaataagttcaaaaacaacttaatatagagtttaatgcagtaaccataggaaaaaagcgtgattatttgtgggaagaacattattaaaagccatattcccaaatatgaattatacaaagatagattatgttacttgaaaaaaacttaaagatttctcaattttactttgaggaattataaaatgttatttagtggcaagtaagatgaagtacagtattatcatcaatcactgttgctatcttatatacaagatttttggaaacatccttttagcaataccctttccacttgagcagcattagaaattttgttcttgttaataggtataagcatgttctaatcctgtacttttgttaaattatctattttattgactttcataatagatttttttgagaatattctttttttctgattagagtttaagtagattataatttttcactagaaagcatttaaaatgctgctcattttccatagttagtgtggcttgattatctgacaaatcctgccagcagcctgtaggtctgatataccttatataacatcatctgcattattattattatagcagccattttataagcagataggaatatttaaataatcattatcagataatcaaatctaacatactcttaagggtaaattaatttaagaaaaaaattactattactaacatcatgattgtacaaccagttttacaattttgtacaacctttagttactaaatctgatttttgtgtatacttttcaaatgtctctttaatgcagtgtcttaaaacaaacataaatgcgcaagtccagcttgatcagtttttcagtagttttccagcctttcttgattactagaaaataaaaggaaagaaaattttgagaagaaagaaaacagtccacttaaagaaatctccctgctggaactggttctttatataccatatgcaattaagttattgccataggaagaaagtgggctgttttttgttctttctttgttttttttcctcttacaggaatccccttttgatttaaggccacaaacatttcccctccgttgtttgtccatttagctgctgcatatgtgttgtaatggttttccagaattagatctttgaagttacaatcttcattgcattccttctgttgaaacaaacaaacaaacaaacaaacaaacatgatccaaatgattttgagagaggctcaattaaacgaagagtaagcaggtaatatttggtagaattgaaacatacacaactttttttaaccctcagattgagcaggcctaatgtggtttattagctagacttatgtagtatatttgcattaaaaggtatcttaaatttgaaatagaaacaccacataatacacagctagttatgaaatatgtgtagctttttggaagttcatgtcaactattctttaaaattaggacctatttccccctaagtaacaggcctcatattactattcccacatcactcattctttaaccactggaaatttgctataattagcagaacctctgcctccctcaggtgagagacttgtttcacaacttttctttatttacttctacattgtcttcaatggtaatggaagataaaaggttaatttgtttgttcatccatgcaaccatttgttcattcagttaaacctgtatcattatacaattagcctgttccaggcattatgctgagctgtgggaatataaaggaaagccaattatattttattacagtgagatgaactgttacatattttgcattgtagtgaagtgggaacaatgtgaataattacagttcaaagcccatgattgtcagattgatattgatgaatgaactaaacatttcaagattttttcccaagaattctcatgtcagcaatgtgcaaattgagtgaactttaacaaaaagagctttaatactggcaaatggaaattttggattttaaatatctaaaatgcacatggaattttagagctggcaggatccttagaggtcagctaattcaactcattttacagatgaagaaaccaaaatccaaagaacaagccatttgtccaaagtcacacagaaaacattttttcttaatgtttgagtataaagtgttttaataaaatcattaaattatacagttggagataaattaagtccatttttacttttcagaatggtgagatatttcaacaaaagagttttaaaaattaagcctaagctatcaattatcaatacctttgcatagagttttccttcctcgttcgttgcaagatagaattcactttccacccctttgattgccacaatcccaactgctactgtcctgatttccatgatatctgcaaggaatcacagaaagacatgtcaagtattcgttcagctttgcaaatgatccacgaatggccgtttgttcttatttctgttttaatcggaagtttttaaaatttttaatgtgattatttactcagcccaagaccccgacccacaacagatacacacaaacaccagaatagtcattatataagggaagtgcaaactgacggttttttattttgtagaaaatatgtctgtatcaaataaatagttacatatttgagttcagctttttattctctagaattaaatttctaatttactataataataatagctaatgtttattgaactcataccacatgccaaggattattgcattgctcttatgtattaactcatttactcataaccacagattgaggcaggtagtcttgttatcccagttttacagatcaggaaactgaagcacagagaaactaagacatttgtccaaattcttatacctgataagtagcagaactggaatttgaacccagacattctggctcttaatcattatataattacttttctatttggataaactttatcttaaaaattattgccaacagaatagctcttgaatatactgaaagtgaagaaaattctaattaaagtaattgtaaatgatggtaaacagagcctactgccttaaaaaaaaaagattgttttaaactgatagtattttgatacatgaaaagaccatttaaaacaaaattatgaatcctgtttatataatacttcataactttatatctttgtaattaacttttaaatctttgttgaaatagtatttacaaaacatgtttacacaagaatgataacttactattttcctttattatatatatcttccttaaatcctgtgttttaatgacacaataaagtaaaatctcaagaaatttattaaaatgatgtaaaaattttagtgtacttttatgcaatttgctattaattacattttctacatgaaggtacagtcctgagacattcttttacctaagtctaacacagtgcaaagaaaagtcgaagtgtcaattatctgtgtgattgggccttcaaaagctatcttctaaaatattgacttaaagaaaaaactaattgttttgccccataccttcacttcattctcttatttatttttttgacttcatttttgctacctggataataaaatttctattcatgtcattgggatttaatgtagcctagctaatatttctcatttgcctcacatatatgttgcatacagaagcccttttcccaatatactatacttaacactagtcagagctcgtccagttgagtttcacagctactcatccagaaattgggttttattaagaaaatgtaaatgaatggatattaatctttttatatatttattaagcattatcacaaccctactgtgcatacaaccctactgtggttttaggacacaaattaagaaaaacagccctggtttctgacaccagaagttaaaacctaatagaaagagcagacacgtccatatattttgaagaattttgaagaacacaggcctgaataggccagataaaattttaataattgcttacaagcacatgaaggattatgatgttgatgcattcatgaaatgttcaacaggtcttcactgagagccaattttatgctaggctcaattcacagacaagccttgcccttttagagcactctatttggtaactacagcttcattgcattaaaggaagcacaaagggaaataacatgcagaagaatactattaggttaaatttgtacgaatacaatgaaaaatactgaagaagttcattgattcagcatatttgcaatacctccaaaatggaatgaatgtatcagttaggtcggtgcaagagtaattgtggcttttgccattacttatatgacaaaaactgtaattacctttgcaccaaactaatatttaaaagacatatggaatagttggtttctaaagatcttagcattgtaaaatatcattaaaaagtcaatattttcttttccttcaagtctctttactcctgccattcctccctttatttaatatattttcttttagataaaaagagaatgctgatgcacaagcttagagtgtctttcttgatcagttattagggactagaatctgtaatgtttgctggcttttcttttacagaacaattgtaaaacataaatgttgactgatagagttattattaattatgataggcagacatcttccctttttggtcctgtcatgacaataagttcatattgtcccactcccaaaacattttcctctatcccctgcctgtctattacccactgtttctatactgcactttacaagaggtgatggctggatgtggtagctcacacctgtaatcccagcactttaggaggccgagtcaggcagatcacttgaggtcaggagttcaatactaacctggccaacatggcgaaaccccgtttctactaaaaatacaaaaaattatccgggtgtggtggcgggtgcctgtaatcccagctactcaggaggctgaggcaggagaattgcttgaacccagaaggcagaggctgcagtgagccaaaacggtgccactgccctctagcctaggcaacagagtgagactctgtctcaccaaaaaaaaaaaaaaaaaattagttgggcatggtggtgaattcctataattctagctacttgagaggctgaggcaggagaatcacttgaacttgggaggcagaggttgcaatgagccgaggtcacaccacagcactccactctgggtggagtgaggctctgtctcaaaataatagttaaataaataaataaaaataaggtggtgaacatttttaatcttatccctccacatattagggttaaggataccaaaaattcttcgtaaagattctacatttggctgagatgagaacagacttatattcttaattgcttgacatatttaaaaaataccattcacactgggaaatcaacatatctaaaagacaattgcttggggagagcattaagcagtgttggcagaatcagtaccttatcgaccctattttctagtctattttgttccatgtcctacgaccctcttttattcaagaaaagctcaagaataaagaaattaacattatcactcttttgttcagttgcagtgtggggagtgatgttcctttcaatatgcacaaatatttatagaagtgttaaatatgggctgggcgcagtggctcacgcctgtaatcccagcacgttgggaggccaacgcgggcggatcacctgaggtcaggagttcaagaccagcctggcaaatatggtgaaaccccatctctactaaaaatacaaaaattagccaggcatgatggtgggtgtctgtaatcccagttactcaggaggctgagtcaggagaatcatttgaacctgggaggcggaggttgcagtgagccgagatttcaccattgcactccagcctggacaacaagagctagactctatctcaccaaaaaaaaaaaaaaaaaaaaattattaactatgaaatcctacccctccaaatcagaagccacgaagttgctcagaaaacataatagaaaaatatgtaatatgcagatattaagttagttaccaatataagttaattatacttggtttttttgtctacagtgtatccgttgcctcatataaaacaaatagaagaggctgtctttctttgtggatttccatttgtgcttaagagaagtttgttcacataaatagcactcagtaaatttattcccagagatttaaagcatattacatagatgcatccaattgttgacataatgtccatgataacataatgacagagttcaaaaatataaatgaaaaagagagagagaatcagctcatgcaatagaacatgaaaaaccaggcaatatgtcaagcacattgaccattttgccttgttagcaatattgtcaacaatagcataaatttattatttaggatgtcacccttacacactagagactatgccctaaatagcttccctattttttatcgtctggttcaataattcatgaatttatctaaactttttgtctgtttattatttaaacctgtgtcacacttggaatgaaaagtggggaactttgatctaaattgcaattactttttaaaaaaattctctaaagtctttcagaattttaggtgtccctctaatcttgtatttcagaagttgatactaattctttttttaattaccaatagctttgtgattttaaagtgctttaactttcctgtttgaaaaattactttttagtgtctcactacacagaatccatggccaccaatctcagcatcattaatatttctttttcctgaaactgttaaagccttatatttaaagttttgaaggggtatatattaatatggctgtgctagcatgatagctaaatattttcaagttgcaaaaaaaagtggaggcagcggtttgatagttagccagtcagaacatttaatcttgtccttgatcaaatataccctcttcggcatgttaaaactaagaactagtatcaacaaagaaaaaaacatttaaatttaaatacattttatgattttctgtcaagcctggattgttgagtgggaaatcttaaccattatatatttatattatgtttaaggctatagattccattcattttacatcactaaaatacaccgacatatacatatatgcaaaaaatatatcaatatatccaacatatacaaaaaacactgaaaacacaacaataggaaaaaaaaactagttaaaaagtgggcaaaatctggacacctcactaaagatacacgaagggcaaataagcagacgaaaagatgctcaatatcatagatcatcaaggaattgcaacatggatgcagccggaggccattatcctaagcaaattaacacaggaacagaaaaataactactgcatgttttcacttataactgggagctaaacactgggtacttagggacataaagatggcaacaactgacactggggactactggcggggagtagatgagggaagggttgaaaaaccattaggtactatgggcagtacctgggtgatgggagcaatcatacctcaaacctcagtatcacacaatatacccaggtaacagacctgcacatgaaccccctgaatctaaaataaaagttgaaattatttaaaaaggaattgcaaattaaaacaacaacaatgagatacctctatacaactattagcatgactaaactccaaaaaactgacagtgctgtatgctggcaaggatgcaaagcaaccaaaactctttcattactagtgggaacgcaaaatggtgcagtcacatgggaagacagtttggcagtttcttaaaaactaaacatgctatataatccagcagtcatgcccccaggtatttgcccaattgaattgaaaacttacgttcacacaaaaacctgaacatgactatttatagaagctttattcatatcatcaaaaaccagatgcaaccaacatatccaataggtaaatggataaacaaactatggtacacttatacattggaatattatttagcaataaaaaggtattgagctgtgaagccacaaaaagacaaggggaaccttaagtacatattgctaagtgaaagaaaccagtctgaaaaagccacatactgtatgattccagccatatgacattctggcaaaggcaaaactttagaggcggtaagatcagtggttgcaagggccttgaggagagcagaagaaggatgaaaagctgaatcacaggggatttttaaatcagtgaaactattctgcgtaatactgtaatagtggatagacgatatacatttgtcagaactcatagaactatacaaagcaaagcggggacgttagtataaattgatggtataaataaatattggctcatctattgtaataaatgtgccacattaatgcaagatatttataatggaggaactgtggggggaaatggagattgtttgtgggactctattatccgctcaatttttttttttttttttgagacggagtctcgctctgtcgcccaggctggagtgcagtggcgcgatctcggctcactaaaagctccgcctcccgggttcacgccattctcctgcctcagcctccccagcagctgggactacaggcgcccgcctccacgctcagctaattttttgtatttttagtagagacgaggtttcaccgtgttagccaggatggtctcgatcttctgacctcgtgatccgcccacctcagcctcccaaagtctgggattacaagcgtgagccaccgcgcccggccctttcttttattttaataaaataactacctaatttatgacagtaggaaagtaggatctggtgttctctgagcttctttgatttgtgggcaggtgtctgttgctgaattttaaaagttctcagccatcccttttttcttttcacattctgggtgaatgcagttttcatagaaggtgctagatttgtgcaaccctaaagataggtgactcctctgactcacagatccctgggagcctctcccgaacagagtttctttatccacacaccccacttcccacacccactcttccacataggtgttctggccaccagtaatctctgaaggatggaagatgaagagacatgacttttacctgagtctctactcctcccaagagaatgaatgttcctggaaacttaaccaacagaaaatcaggggatatcaatatatgtaagcactcattactcatgtaatggaggccttggcaaaatgtgacacgtaaatttctgctcagggagagtagaaaataggcacagagactagagagactggtaaagaatgaagcctcaaaggtgattgagttgtgttaaaggaacgtcttgatcaggctttgctttatttttctcttgtggagtatgaaactgggtgttacaattaaatatatttcttgatttcctaaaatgttataggctgtttccaatttttgttatttttggagtttcttaaatcgaaatttgattcaggataattaaaaaatataatgttaatgttaagatggaaggtaggtcaaaaggcaatcatgttaaacaagaggagaattggagataagaccttgaacacgaaagtattcttaaattcttgactattatgatacagtttgcataaacaactgagatttcttcagaaaactatagtgaaatgggacactacaaatcaaatataaatttaaaaatgaacacatttattcaatacatatccatagattattctggattaaatgtacacattttaagaataaagttttaaatttgaaaatgaaagactgtttcccatctaaacagaccgttggcttcaagatacttacaactgtgttaaatcatcttccattggttatagttgattatggcatgggcatccccaaatctggctgacccatactacgtttttcctaaatctcttttttcttctgtatcttgctaggctgctggttcatcctcccaatttcctgtatttaaaaccccagtgccatgtttgaccttgtcctttctcttctactgttcacatcttctgtctctcacattcattccaacctacacatcccagtggcctattcctatttaagcacccaaccccctctctcctgaatgaatgcagaaaactttctcatctctggactcatagcaccacagctatttttacacatgactgtcagatgtgtggagttcttgaaccatagttctgtggtgtcatcattcattttaaaaattttgattggctccctattacctagaaaataaactttagtatcctttgctcaacatgtgaggccctccacaatctaatttcacacactccaaaaccttatttctacctactctcttccaaggaccctgaaccccacattccaggcaaatccagtcattgaacacttacataggccatcagaagtcactgcaaaaccaatccggtctgactcctatgttgtttagtgctctatcccctttgtctgaaatggctttccctccacctctatttttatttactggcaccttccacagctttcaacattcagtttgtcatgaaggcagctgttatagactggactagaagactgtgaactgaattggtggtttccaaatcagtatcacacttgattcccacctccagaaattttgatagagggggcctggagtagagccaatgagtcttacacacacacacagacacacacacacacacacaccccaaaacaaacacacacttaccctaatgactatctaggtgccagccctagcctagaccaggctggtggaacatgctggattaaaaacaacaggacactgagaaagtatttgctacacagacatatgggatttgaccatgtgttatttacagataacctaactcattggagtaaaacctatcttaaattggcatatggtataggatatgttgtagcattttattagtgaacatttgtaaggttttatttgtgaaagctaataagactgcatttgtgaccatcacaaggaaaacagataaaactgtatttgtgaccatctcaaggaaggtgtgtcctatgccatgctcacctgccaagctggctgcagtcccttcctctcctgacttcactttgcccctaaaggtatctctgttattatactcatggctttccattttctaatactgtgtactgatcatttcaacacatgccttattctctaaacagactgaaagattcattaagtatctgaaaagcaaatgctgatgaacttgcctaaaataaaaagcatgaaccatgcaagtttctaacatagattgtagcagccaccccacatgactgcaatcgcctccccattgatctcccggctgacacattctatgtatttgtaactcagcaaccagagtgatcctttaaaaattatcagagagcaccactcctcttagtaaagcactaccccaccccagtcacgtagctttctgattcacaggagtaaaagccaaagtccttataatggcctaaaaatcgtacataatctgttccttttcagatttcattcactaccatcttcccccttctctctctgttccagttacaacagcttgccccctcaaacacaactagtatgttcctgccccagggcctttgcacctgctttttcctcttagagcaacaagtttgctccagatatctgaaaagctgactatctcgccaccttcagatgtgtgttctaatgtctctttatcaatgagagcttctttgtccaccctgggcatcttcttgcccttccttgctttattcttccccatggcacttactcacattggacactaaacacttgtttccttagctaggcattcttctcctaccctcacaacagtaggaatgtcctaaggttttgagaagactcccgtgctaggtttccagactcctgtcctctcacatttggtgctcatgcacctcttggtcattagtgcactccagaggttaggacctagagtacgtggctgtccttcagaggagggaaagggattgcttgggagcagagaagggagctttggcctcgcagtgcaggacccctgtgcccacaggcctctgtgtgttgacagcaatgctcttggtgtccacctgcactgccctctggtgttcagtcaaaatcaagcaaatggttacgaactgctataggggattgttaccaggtcctgagtctgtgttggaaacacaaacccagaagcaaacaaatctgcccaacacccctgacacgtgggtttcacagaaaatactgaggtcagagtagcatgttaaatgacaccacagtgacaacacaatcataaaaatctacactgtggactctgtcctagtttctttaatgaattgcatggaaaaaaaaagatggaaggggaagaataagaatgaagaatgctttagagactctgcaatccatcgtaatatccgtacaaggattctgcttttttaaaaaaagaaaaatggtgtgaaaaaatatgtaagactggccaggcagcgtggctcacacctgtaatcccaacactttgggaggccgaggtgggtgggtcacttgaggtcaggagatcaatcctggccaagcctgaccaacatgccaatatggtgaaaccccgtctctactaaaaatacaaaaagttaaccaggcatggtggtgggcacctgtaatcccagctaattggaagctgaggcagaagaatcgcttgagcccaggaggtgggggttgcagtgagccgagatcttgccactgcactccagcctgggtgacagggcgagactctatctcaaaaaaaaaaaaaaaagtaagacaatcagggaaattggaacagcgactggattttggttaaaagtaagtaattctggctaattttttagatgtattattttaaaaaggggatccttaccctttggaggtggatactaaaatattcatggatgaaatgataggatgccagaaatgctcttcaattaatctatgtcagggaagtgggatcagaggaatcaggactgtctaaaactgaagctgggtattaggtcaatgagttaattatactattcattcattatgctatttatttccttttgtatattctttaaatttttcataataatagtaataaagatatgttgaacatggtaaagatggaaaatgtacagagacagaagaaatattcttattttttatttcatacaattctatagtttcacattttgttttgttttactgtatttatgcattaattctataactgtaaaacatggtattaataattaaactgaccttatgaaaatttttggagagtgaaaactttgaaactcatgtgctaggtacatcattaaaatttatcattcaggtgacacctgatgactcacatctataatcccagtaatttgggagatgaagataggaggctcccttaagcccaggagtttgagaccagccctggctatatagtgagagcctgtttctacaaaaaaaaaaaattatttttaattagccaggcatggtggcactcacctgtagttccagctactcaggaggctaaggtcagaggatagcttgagcatgaaagttcaagactgtagtgagccatggtcatgccactgcactccagcctgggcaacagggtaaaaccatgtcttaataaacaaacaaataaatacataaatacataaataaataataaagtattccattcaacatttttaccttagtaatgctcaacatttggtttctacttatttccttttatgttgtattttctagaccaaattcacatatagtataaagcagaagaaactaatgattaaattcattgttcgtaattgtattcagtttcctattttcatcaacatttgtttacaaattttttttttcttttttgagacagagtctcgctctgtcacccaggctggagtgcactggcgggatagctcactgaaagctccgcctcccaggttcatgccattctcctgcctcagcctccggagtagctgggactacaggtgcccgccaccatgcctggataattttttgtatttttagtagagacggggtttcaccgtgttagccaggatggtctcaatctcctgacctcgtgatctgcccgcaccggcctcccaaagtgctgggattacaggtgtgagccactgccccggtctgtttagaaatatttttaaagaattattgcacttctgttcggatagaaaaacaaaaatacattttaagaatatatatttatatgtatgaaaatataaaattttgaaaagttgaatatttcaagccaattatgtagatgtccttgtccttccctgagctgctgactcacgttccacgaagcgggatgggtctcacagggcctgtcaggatgcaggctgtgatgtgaaggccactcgaatctcacaggattggacgggtttgtgaaggaatttggagcgagccttagttagctccttaacatttcctttgagcaacatcagtgcttttgacattttgcactgccgtataaaactgtaagtgtatgcagagatgtatgtttctgaataaatcacaaaattgacaagcaactgccatgcattgttttttgcatcatagctaactgataaagtacagactgcaacatttacttattcaaatacctttaaagatctggtatttttttgcttctacttcccaggaatttgacctcagggacattttctattatttccatatctattgaaatgaactcaaatcaaaaatgagaatgtttcattatacatttaaaatgtgagttttcccatttaaagtcacgcaaactgaggttactacgaaaaagatttaaaattgtgcagaatgaatcactgaaaaattagtttattctaaagatcatatattcagagtaaatatatttaaattttattcagtttcctctttgtcagcaaattagtgaataacattactgatatcttagatgtttgtggacacaaagagaatagaggtaaaaatcatgaccctcaaagagctcaaaatcctaagatttttatgggcagccccagaggtataaaattcaaaaggacattacttctccattcctgattaggtacgcaatgttctggattattcatggctcttggatacttgagagtaataatgacagtgacctctgaattaacatagttcaacttttataataattatgaccttcaaccatgtgaagtttgtggagcactgagatttcttggggcaattttgtaacagctaattcttaacagcaatgttatttcaggctttttggacattccctgttacaactgctgatcttttattcctataatggtacagaattctttgagaaaaataaattcatcttttcattcatttaagggaaaattgtcagcacgagcctatggctataatgttctccatcatttaaagaataaaaggaataatctggttgaaattgaattatctaaggttacatatggttttgattcaatggttaacgtgcatttttaacaagtgatatggtttggctgcaacatttacttattcaaatacctttaaagattttttttttttctgcctgtacttcccaggaatttgatgtcagatgcattttccattatttccatatctattgaaatgaactcaaataaaaaaatggggatgtttcattacacacttattaatgtgtaatttaagattaatgtgtaatcttgtaattcccataatcctcatgtgtcaagggcgggaccagatggacatgattgaatcatagaggtggttttctccatgctgttctcgtgatagtgagttctcacaagatctgatggttttataaggggcttcttccttcactcaaaactcattgtttctgctgccaccctgtgaagaggtgccttcggccatgattgtaagtttcctgaggcattccaagccatgtcaaactatgagttaattaaacttcttttctttataaattacccagtcttgagtagttcttcataacagcatgaaaacagactaatacagtaaattggtaccacagacatagggtgctgttataaggatacactaaaatgtggaagtgactttggaactgggcaacaggcagaggttggaatagtttggagggttcagaagaagacagtaaaggctgggtgtggtggctcatccctgtaatcccaggactttgggagaccgaggcaggtggatgacctgaggtcaggagtttgagaccagcctggccaacatggtgaaaccccatctctactaaaaatataaaattagctgggcatcgtggtgcatgcctgtaatcccagctacttgggaggctgaggaaggagaatggcttgaacatgggaggtggaggttgcagtgagcagagattgcaccactgcattccagcttgggcaacaagagcgaaactccatctcaaaaaaaaaaaaagaagacagaagaatgtgggaaagtgtggaacttcctagagacttggagggcttggaagacaagaagatgtgggaaagcttgggacttcctagagacttgaatggcttctaccaaaatgctgatagtgacatggaaaatgaagtccaggctgaggtggtctcagatggagatggggaacttgttgggaactcggataaagatgatttttgattctcctgcctcagccttctgagtagctgggactataggcacaggccaccacactcggctaatttttgtatttttaatagatacggagtttcaccatgttgtccaggatggtctcgatctcctgacctcgtgttccacctgcctcggcctaccaaagtgctgggattacaggcatgagccaccgcgcctggccaagtgaggcgttttaaacagcgcgtggttccaagtaatggctcagaaaagttagctattagaattgtaatggttgttagtgatgtttgccattttctttaagaatttcacacttgtatcaaaaaacagtattaaaaaaactatacaatcatttaatatataaaaaggataattctttgtagtttaagccataaaagttgcatccaaacatagatttaaataacctcttctccccacctttaatagtctttcaaaatatcgcatgtgctttttatattgtgaaaagaaataaattaaatagtcatacttacatgattaaaagttattttcatgtacttcgggaatttgttcatattagttacacttcaagttaatattacatgtaatattaaatgtacttaatattaaaagtgcatttaaaatacttgaatgaaaataaattttcataatcaaataaatcccagcactgattcaagaaaattataccaccatgctcatactaagaagacactgaatcaaagcagaaacacatgccttaatcgttgataagtgaagccttcagtgagtatcaaaaataaaagatagcaaaaacagaataattactacactaatcatagatgattggcaaaggtaaacataacaaatttctagtaaggagctgcttcaaagagtgatctttatgcgggaaaactccagcctggtgcctttgggatcactgatttcccttgctgggagtacttgcggtgaaactaataaaatcactgaggtgccacaagaaaaataacatgggaagaagctgaccaccgagttacagattcatgggaaagacatcaggaggtcatttccctcatttccttgccttgagattaatactcaagtcatcaacgctaaataaatatttcctgaaaataaagcatttctaggaaaaaaataactttgagaatcctcatgttggtataattgaatcaaggacagatgtgactaacttcagaagtctgttgttcttcctatattcagtccagcaaactctcagcaaagcccccagtgtatgaagaatatgaaaaaggagctctactagtagaatttgggactgagagtccagagttctgatcttttggcctgtgccttctaatgccctttcaccccacttcatctaaggcaaccctagaaattgtcaaagaaaaacagcagtgctggatacttgctaaaggcaatgagacctattgtattcagactatttcagcaggagggagagacttcagtataaactaagctcaactccaagtaagacaaaggaggctgatgtttttaaaaagagaacaaatgggaaataaaaagaaactatggaaaagtaaaaagaggggaattaaaaaagggactgaggactacgtgaaaatgcaaattataaaagggggtaagagcctggcacggtggctcacgcctgtagtcccagcactttgggaggcagaggcgggcagatcacgaggtcaggagatcgagaccatcctggctaacatggtgaaaccccgtttctactaaaaacacacaaaaagttggccgggcatggtggcgggcgcctgtagtcccggctactcaggaggctgaggcaggagaatggcgtgaacctgggagggggagcttgcagtgagctgagatcacaccactgcactccagcctgggggagagagggagactccttctcaaaaaaaaaaaaaaaaaaaaaaaagagcgggaggtaagtagagaattactgaaaatgatttgacatcatcggttacgacaatatacattatgtggtttggtagcattgtattttcttgagcaaagactcagcacagggcctggggttaactactccaagtggcagccaggctaatgtttggtcaagtctcttagcacagtgtttaggcaaatctttttggcttcagggaagttcacagtccctcctcttgttcaagagaaagaatgaatttctttctcatagaataaatatagttgttgcactccaaagtcctcaaaagaaaaaagttcagccattgtttatcaccgttgtgcaattcaggaagagtcaaggtggtaaatgcaagaatcgaggtttggcgtattatcaatggcggcacaattgtctcataagaatagagatgcacttggtgggtcatgcctgtaatcccaacactctgggaggctgaggagggcggatcacgaggtcaagagatcgagaccatcttggccaacatggtgaaaccttgtctgtactaaaaatacaaaaattagctgcgcatggtggcacgcgcctgtagtcccagctactcaggaggctgaggcaggagaatcgcttgaaccgggagggggaggttgcagtgagtagagatagtgccattgcactccagcctggtgacagagtgagactctatctgaaaaaaaaaaagaagaagaatagaggtgtacttaagagacaaagaatattgccattaaggatgtttttaagaagccaagtccaagatcaaaaaagacaaaggagagcattacataatggtgtaaagagttcaattcaacaagaagatctaactatcctaaatatatgtgcacccaatacaggagcacccagattcataaagcaagttcttagagacttacaaagagacatagagtctcacacaataacagtgggagatttcaacactccactaacagttattagatagatcaccaaggcagaaaattaaaaaacatattcaggacctgaactcagcattagatcaaatgtatctgattgacctctacagaactctccactcaaaaacaacagaatatacattcttctcatcaccacatggcacatactctaaaatcagccacataattggacataaaacaatgcttagcaaatgtaaaagaaccgaattcttaccaaacacactcttggacgacagtgcagtaaaaataaaagttgagactaagaaaatcactcaaaaccatacaattacatggaaattaaacaacatgtttctgaatgacttttgggtaaataatgaaattaaggcagatatcaagaagttctttgaaaataatgtgaacaaagatacaacataccagaatctctgggacacaggtaaggcaatgataagagggaaattcatagcactacctgcccacatcaaaaagttagaaaaatctcaaaaagttagaaagatctcaaattaacaacctaatatcaccactaaaagaattacagaagcaataacaaatcaaccccaaagctagcagaagacaagacataaccaaaattggagctgaatggaagaaaattaagacacaaaaataattcaaaagattgatgaatccaggattatttttttgaaaaaattagtaagataggccaacacctagactaataaagaaaaaaagagaaaaggtccaaataaacacaactaaaattttgagacccggtgtggtggctcatacctgtaatcccagtgctttgggagactgaagcgggtagatcacttgaggccaggagtttgagagcagcctgacaaacgtggtgaaaccctctctactaaaaatacaaaaattagctgggcatggtggcacacaactgtagttccaactactcaggaggccgaggcacaagaattgcttgaacccaggaggcagagcctgcagtgtgccaagatggtgccactgtacaccagcctggatgacaaagcaagactctgtctcaaaaaaaaaaaaaaagaaatgaaaggaatgctaacactgactgcacaaaaataaaaataatcaaataaccactaaaaactactctgaacacctctatgcacacaaactagaaaaccttgaaaacatggataaattcctggacacatatacccacccaagactaagccaggaagaaattgattgcctgaacagaccagtaacaagctccaaaattgaaccagtaacaaatagcctaccaaccaaaaaaagctcaggacctgatggattcatagctgaattctaccagatgtacaaagaactggtaccattcctagggaaagtacccccccaaaaattgagaaggagtgactcctctttagcacattctatgaggccaccatcatcctgatactaaaacctggcagagccacaatgaccaaaaagaaaacttcaggccaatatccttgatgaacatcatgcaaaaatcctcagcaaaatacttgcaaaccaaatccagcagcacatcaaaaagctaatccaccatgatcaaatagtcttcattcctgggatgcaaggttggttctacatatgcaaatcaataaatgtgattcatcacataaacagaactaaagacaaaaatcacatgattatctcaatcaatgcagaaaaaaagctctagataaaatttaacaccctttcatgttaaaaactctcaataaagtaggtgttgaaggaatatacctcaaaataataagagacatctatgacacatccacagccaatatcactttgaacgggcaaaagccggaagctttttgctcttgaaaactggcacaaaacaaggctgccctctctcaccactcctattcaaaatagttgtgaaagtcctagccagagcaatcatgaaagagaaagaagtaaagagcatctagataggaaaagaagtcaaactatctctgtttgcagatgacatgatgttatatccagaagcctcattccttcagcccaaaagctcctttagctgataaacaactttagcaaagtctcaggatacaaaatcaatgtacaaaaatcactagaattcctatacaccgacagcagccaaaacaagagccaaatcagaaaagcattcccactcacaatagccacaaaagggataaaatacctaggaatacagctaaccagggaggtgtagaattctctacaatgagaattacaaaacactgctcaaagacatcagagatgacacaaacaaatgaaaaaatatctcaggctcatggataggaagaatcaacataattaaaatggtcataatgcccaaagcaatttacagattcaatactattcatatcaaactaccaatgacattcttcacaaaactaggaaaactatattaaaattaatatagaaccaaaaaactaaggcctgaatagccaagacaatcctaagtaaagaggagaaaagctggaggcattatgttactcaacttcaaactatattacagggttacagtaacaaaaacaacatggtactggtacaaaaacaggcaaataaaccaacagaacagaatcaagagcccagaaataaggttgcacacctatgaccacctgatcttcaacaaagctgacaaaagcaagcaatggggaaacaattccctatttgataaatggtgctgggataactggctagccatatgcagaaaactgaagcatccactcttccttacaccacccttccttacaccagatacagaaatcaactcaaaaggattaaagacatagtgtaaaacccaaaactatgaaaacccatgaagacaaactaggcaatatcatcctggacataggaataggcaaagatctcatgacaaagatgctaaaagcaattgcaacgaaagcaaacaatgacaagggggatccaatttacttaagagcttctgcacaacaaaagaaaactatggacagagttaacagacaacctacagactgggagaaaatatttgcaaactatgcatccgacaaaggtgtgatattcagcatttataaggaacataaacaaatttcccagagaaaaacaaacaaccccattaacaagtgagcaaagaacatgaacagaaacttttcaaaggaagacacacatgcatccaacaagcatatgaaaaaaacttcaatatctatcactaatcattagagaaatgcacatcaaaaccatagtgacatactgtctcataccagtcagaaaggctattgttaaaaagtcaaaaaatagcagatgctggtgagaatgcagagaaaaaggaacacttagacacattggtgggatgtaaattagtttaaccattgtggaaagcaatatggtgattcctcaaagagctaaaagcagaactgctatttaactcagtaatcccagtactgggtatatacccagaggaatataaaccagtctaccataaagacacttgcacatgtaaatgttcatcgcagcaatattcacaatagcaaagacatggaatcagcctaaatgcccatcaatgacagattggataaagaaaatgtggtacatatacaccatggagtaccatgcagctgtaaaaaagaatgagattatgtcgtttgcaggaacatggctagagctggaggctattatcctcagcaactaacgcaggaacagaaaaccaaatactgcatgttcttacttgtaagtgaaggctaaatgatgagaacttattaacacaaagagggaaacagcagacactggggtctgcttgagcatgcagtgtgggaggtgggagaggagtggaaacagtaactgttgggtactgggcttaattcctgggtgattaaataacctgtacaacaagaccccatgacatgagtttacctttgtaacaaatcttcacatgtacccctgaccttacaataaaagttaaaagaaaaaaaaaaaagccaagtcccttaaaaagtctcctaagccatttggctggggaaaccattttctccttagagactaagcctgtctggaggggcgtgagctatgttggctgcttctcaggcacgtgctgccacgacttcttgattcatttctctttatcattcatgaatgaaaagcattgggaactcaccagtgcacaagcaccttcttgaaaactcagtatgtagtctaaggcgagctagttttgtaaagtcattttagaagctccaatacctcatggatttatgaaacaaaagcttatattaagtttgagatgaactctactaattattttttaaattattatttcaatagcttaaggggtacaaatagtttttggttatatgaataaattgtatagtggagaagtctgggcttttactgtatctgtcaccaaataatttacagtgtacccaagaggtgatttttttttatccctctcccttcctctctgagcctccaatgtccattatgcccctctgtataccttgtgtacccatagcttagctcccacttatatgtaagaacatgcagtatttggtttttccattcctgagttacttcacttatggtaatggcctccagttccaagttgctgcaaaagacatttgtgtgcgtgtgtggctaagtagtattcctttttgttgttgttgttgagatggagtctcgctctgttgcccagcctggagtgcagtggtgtgatctcagctcactgcgacctctacctcccgggttcaagcaattctctgcctcagcctcccgaggagctgggattacatgtgcccgccaccatgcccagctaatttttgtattttcagtagagatggggtttcaccatcttggccaggctggtcttgaactcctgacctcatgatccacctgcctcggcctccccaactgctgggattacaggcgtgagccacctggctgggcctgtagtattccattttttatatgtaccacattttccttatccactcctccgttgattggcactcagcttgattccgtatctctgctatcgtgaattgtgctgtgataaacatccatgtgcaagtgttctttatatataatgacttcttttccttgggtagataccagtagtgggattgctgattgaatagtagatctacatttagttccttgagaaatctccacatcgtttttcacagaggttgtactaattttcattcccaccaacagtgtatgagcattctctttcaccacatctgtgccaacatctgtttttgtttgtttgtttgtttgtgttttaaccttttggctagggtaagataattctgactagatggtatctcactgtgattttaatttgaatttccatgatgattagtgatgttgagcatttgttcatatatttgttggccgtttccatatcttcttttgagaaatatctgttcatgtcatttgcccactttttagtaggattatgtgttttttttcttgctaatttgttggagttccttttagattatggatactagtccttcgtcagatgtatcttacagcataggagttggctgacctggtgacaaagggtagaatatcaagaacagagcaccctgtaagtttggcctgagcaagtggctctccccggacctgtttaaggctgtttgtcatccagccattatccattcacaagtttcaggctcagcaattgtaggagcactcatgtttctaatttttccattgggaaatttttcatacatttccatttgagggacagcataagccacatcgcagcagccagcccaatgggctggaagtactttgtatggttttatgaccacatactaaataatgtcccttgagggcatactagtgttggttattgcctctagtggttgtaacagaggctagaggagctaacctggaatagactccaaagagacagttacaaacatcatcttctaaatggctgggtactttggtaccatttagccagcaattttttgcccagtctttcagttcaccaaaatattgatccggggtaaaataatttcctatgatactggtattgcgtgggtattgcagacaatgctgtccttaatgggagtttggctcttacaaagaatgtctgtttcttgaaaataggtttcatcttttcacaaggacacagagcatttactgtgttccacagggtgactatatttattagactgatttctagtaaaacaccacgtttcttaggttaaagaggccacatcatactcccagtcacaagggcttttaagaaataacccaatatctttctaaaagggagacctaaatggctgtatatttgtaatgttttctgccaaggccatctaaagcataagggagacaattattaagggaatacgagttttaggatagagtgggaatgggcatagacccggcaattactttggttaatttcattggctactttgtcagctaagagaccgagggaattacggtcatgagaggaaagcacgggatagggtaagataaggaggaaacagaggggaatcatgacagggctgctgaggctggagatggagtatatatgttgtaagtaggacacatcactaggataaagatgggacgttgtagaggacacaggagtagtagcagaatgcgtagacccaaaattgaagtcagagacaaagaaggggaatcggagtgaatcttgtttcaggatctttggcagaagcggactgcttcatcatatcatttacttgctccgtagttcttaggatggatgtctgtctccagctcttggctacttttagaggttcttttcttttctttcctttccttttctttttttttttttttttttttttgagaccgagtcttgctctgtcacccaggctgaagtgcagtggtgcaatctctgctcgctgcaaagtttggaggttcttttttttttttttcttttctttttgagattgagtcttgctctgttcccaaggctggagtgcagtggctcaatctcggctcactgcaagctctgcctcccgggttcacgccattctcctgcctcagcctcccgagtagctgggactacaggagcccgccaattagcgcccggctaatttttttgtatttttagtagagacggggtttcacctgatggtctctatctgctgacctcgtgatccgcccgcctcggcctccgaaagtgctgggattacaggcgtgagccaccgcgcctggcctggaggttgttcatagagtctcagcgtgagtctctggttagagtgccttccaattgaaatagattttgtattttttcaactaaaagacatgcacccaagttcaaacactctgtaatttgttagcagtgttagcaatgagtgaaacaataaaaggtcccctccctctgggttcaaggttagttttctgatgttggtgttttttcaaaatgccagatcacttacttatgaagcaagtaaggactgatcagggagtttaaagatacaagaagcctcaattgtggagtatagtggggctgtgtgtatttaattaatccctgacaatatctgaggttgttgaactgagttagtttggaatcttcggctagtttgcattagtaggttattctcatgggtatcccgtaatgattcaaagaggatcgtttgtgtgaaggtagggccaaggatctgagagtcagtgtgatgggtaatatctgtggccatggcaagttctttcttcagacagtttagccagttcagcttgaggatgctgttggctctttgtatagaactttatcactgaggatggtaagtccagtggaatatttggctggtgtgtgtaacctttcctatttcctgaataattttgccagtgaaatgtgatcctctgtcactagaggcagtagaggggataacccatgtggggaagattcactcttaataaaccttggcaaccgatgtccttgaggagtttcaacagggaaagcctcccattctattttccagtgaaggaagcctattttccagtgaaggaaggatgtagagggagccacttcccttttttgccccacctttatgctttttggaggattatgttgttggtagatgcagcaaatggcaacagcttggtccaaataaaatctaaagagtccaagccatattgttttgtttaatatatactacatgttatcctttctgtggtaaatctggatgagcaaattgtacacaatgacttgggagacagacttaggagttatcaaatggccatctgggtatttctgaagtccacttaagtgggtcaaacattcacctttttctcatccaattctttctgactctgaaattgttatctgggctgtgtgaattttacatttcctttagaggcattgtaaagacattgcttctgtcaatttatttaaagagggtaaataatcctagcaggactgtgggtatttgaaatgaagcccaggtatctagtcacaaggtttggagacttcctggatttcttaggcggccaaggaagaggatgctagcttagcacctttatcagccaatttatttccctgagcctcatctgagtattttatactatatccctcagctttaactgtaacaactagctggggcaatagcaatgactctagaagttctgctatttggggtttacttttgactggggacaagttgctgtcatgaatcctctctgttttcaaaacataccaaaatcatgcactacaccaaagacccagtgtctgtcactgtaggtgctaatcttaattccctctgccttatataagcctgaatgagaacagttaatttagccactttggctgatttaacgtgtggcaaagcttggcattcaagagttttgtgtagatgagtgatggcatatccaggctggaaggtcccaacctccttccagaagtaggagcgattgacatagagcatcaggtcgacttaggagagaagggtttctgacatatctaacctaaatgagacagtgatctggtttcagtagcaccattgtgtgtgtgtgctgaggggttcccttagtggacaaaatgtacagggtagcaagggatttttggcagcaaaggattgtgattgggtggggaggcatagtaatatttcatgagaagtaagtcgagaagcaaacgagtgctgtgtgttttcattaagtaatagggtcaacacagcatgggaacatacacatcaagtgggcggcctaacactaaatcagaagtagcctggatgagttggaagtcatggccactgtttgtaggccaggaggatatgcttcagcactggctggttttgtgggaaaacagagagaaagacatggctgagtctcatggtgctcagagaaggccacagccttggggtgccgtggtgaccacaaacacttcccccatcccataccaatctttaagagccttttccttcttaaagacctgtcacttagcaaagagctttcaatgaaccctcccctctgggccacttgttggattgcagccaatcagtgatggagggctggacacaactgtgggatgctgtgatttggtttagcccttgggtctagagtgctctggggtccactgtacttctgggataaaacgccaaggccacgactctcttgctcatttacaaacaaaaaattgagggctagctaaacaaggacagagtggaagcagctttctgtaagacacacccaccagtgtgccctgtcagtttaccattgccatggcaacactcaggcattaccacccctttcagcagcaatgacctgatgacccaaaagttaccacccttttcctagcaatttctgcacaaaccacccctgaatctacatgtaattaaaagtaggtatacatatgacagcaaaactgggctcagctgctactctcggcaccctgcctatggggcaaccctgggagcagtcactgagctgtgaccctgcaggagctgtaacagtgctgctttgataaaggtgttttcttccaccttaccactggctcgcccttgaatcctttcctgggtgaagccaagaacccttgcaggctaagcaccactttggggttcgcctaccttgcatcagcatcaggttttttttttaaacttgtaaaatagtttttgtgactctgtcatgtattttgcagtcatgaactaatattttttccctcaattgtcagttgcagtttcctcaaagatcattataaatactccttaacctacaaagtttggcagtcacagcctactctttgaggaacagcctgactcaccatcaagtggctcctcaggtggttttacttcccatgtttcccatgtgaggtactaagcctcagtgattcctggcaaaacttgtattctctgttagtattgcgctaactttggagtgagtttcttttggtgagtaataattttagtcaatgatactactgattattttatctttttttaggcttatgatgaatacctgatttatgattagtatgtttttcacttttacacatttcaaggaaggaaacaagaacagacagaaacacaacatacttcatgaaaccacattttagcatcctggccgagtattcatcactcagcaagatagagagacataaactatttctagcaagaatacttcataaatgatgaatagaagaaaaatagaagtcctaaaaatcttgcagaactgtcttaatttactaatatatttacactgtatcctaagtcactctctagcttcttgctctaagcatatgaaatgtaagagctaatgggaaccccagtgcctgtataaataacaagaaccagcatgtctttatttatggcagggaatactctacaacctgggacagatgccactctgcttcagtttggggaagctcctcactttaccatcctgacgttgaataaatgattcaaaggcaacctgatgcaacctgagccactggatggcttctgtaaataaagttatctcacctggcattcattacagagaaaacaagaaataaggcactacatgtcatatttgtctagatcctatacatatttaggttcacattaaaatgaagagaaaacaacataggctgagaatcagaaaacctgaactctgtcccagctcagctactgaccaaagagaattaatgaatcgctttaaatgtcagtttcttcattaagcatcgtagagaatgtcaaaaccaagtttacaaatactgtcattccaaaaccacacaactcaaatataaataatctttataaggtaacaaaaatgtacataatactttacataaacatttttagaataactttattataactcgataagcaaaataatccaaacctttatacatttctacaaggatagtcatgtatgtcaatttttgggtttcctctcgtgcctattttgtctcctgagccagcccctttccagctgacacatgtgctccgtgttctcccacaatagcctgatctggcctgagtccacgcccctgtgagcctcctttctttgcttacaacagcagcctgcctgatgtcagttatggactattctttttttcagcctcgtttcagggtcccctgcctcttagagctgctgctgtagcttagctagagacccgctgctgttgcatcatggaaaagtgccacatatgtgcacatgtgaaagaatacgcagaccttcatgttgtgttttagttttagaaaaagtcagaagtagcttcacttgatttcagcttgtaaagacataggagggaggcaactgggaatcaccgttgcaaaaagcaaacatcaaaaatcacattaaaatgctgaagtgttgtggagcacaaacctagctttattggatcaagcatttgtgagagttcttctacttgctttgttatgctttctatcagacagggctcattctctgtctttttttttaacatattcatttttttcctttggtctgtttagattattatcacatcttatgttttaaaactagcaaaatattatgtgtaagtcatgaagacagtgtaagaaataataaaatgaacactgatgtacacattacctgcctaagaataaaaaactacccgtatttttagagtccttaacactgtcctgttaatgagtcccatttcttatctttataattttgccaaaataaatgcattagtaaaggacattgagcattattgtttcacatatttttcagtttaaacaaatggaatcacactgaatatatttttctgaaattgctttttggttcaatatttaatttgtaaaattcattcttatgatatgtttgtctgtactttctgtgcattgatttagagtattccatcacaggataatactataatgagcattccattttattagattggggttatccatttttttctattacaaaactagatgtccttttcttgtatgagtctcctggacataaaaggtagattttctctaaggtaaaaacccaacattcaaataattgtgtcaaaagatttgtatactgttggttttactacgttaaaatgaactgttttccaatttatgctcccatgagaagttaaaggttctggtagatctatattctcaacaatacttaatagtatcaaacgttttaacgttagtcaacttggtttctcatttgaattgtaatctgcattttttagaagtactgaatcaaggtaagaatcaagtaatgaaaaactattattttagtaaataaaaatgctgtaaagacaataaagcaaatgaatgtaatcaaaagtggagacgggctacttcattctgatagtcaaagatggccttgctggtcatctgagttgagaggtggctagtaagacgagaagagatgttaagtagctgtggaaggggcctgctggcacagggcatgctccaaagccctgaaaagaggcaaacattctttccctctaaatacctgaactaagtaaaaacagtcctggctttgcacatttgaatatgcacaggtttaattaacatagtttagttaaatagcactagtctcccaacaacctggttacaatttcggttaccaccatatgctaactgtgagcaactgcataaaatccaaacttcattcccagctcttaattccacaaatgcctgtgtgagtaaataacagacaagcatcatgatcagggactgtattaatcttgtggggatgctgcaacaaagtacaaaaaaccgggttgcttaaaacaacagaaatgtattgactcgtagttgtggaggctagaagtcaaaaagcaatgtgttggtaggttcatgctctctgctggctctaggggagaatccttcttcccctctccttcctgtttgggtttgccagccatccttggtgttgtttgacctacagatatgtcactgcattttctcagtgtgtcttcacatcgtcttttgtgtgtgtgtgtctggagctgtatccaaattctccttcactataagacaccagttagtctattggattaggacccaccctaatgacctcattttaacttgagaacctctgtaaatgtgctatttccaaataagctgatattatttggagatattggggattaggatttcaaacatatcttttttggggaacacaattcacttccttcaaagcctgccagtgactgatcaatgtgcatcagctagttcgcacacagacagcaaagtctgcaatcgtgttgattccttgtctcccagtgagaaacccatgtgacatttataaatatgaataatcagaagaaaaaacttgtcaacaaccattgatgtgcagcaaagaaataaaaaatgtgataaccctggaagtggattcaaatacaatgtaaatggaatcatagaattggctcaccacaggaaacgcggcaagaggaactcggcgcaacgcagtgttctgacataaatgaggaacgcagctgtgattaaaaggatgaagaagccccagaggaagtgatgccggcaaagacagcaacaaacttcatattaaaggaactcttgtagatattgcatgacgttgacaatgttagatgctgttccaaaaacagcacgacagttcaccaaggcatagaaacactgctggctccttatcataagctatacgacaagagggaggcaagcacttttcaaactgggcttgatacacgtctataaataaataaagcactttaattggctgttgtttaatgttttaaattacagtgtataaactaagtactggccaggcgtgatggctcactcctgtaatcccagcactttgcaaggccaaggtggacagatcatgaggtcaggagatcaagacgatcctgggtaacacggtgaaaccccacctttactaaaaatacaaaaaatcagccaggcgtagtgtcacgtgcctatagtcccagccacttgggacgctgaggcaggagaatagcttgaacccaggaggtggaggttgcagtgagctgagatcacgccactgcattccagcctgggcgacagagcaagattccatctcaaaaaaaaaaaagtactaacttcactatgtttcatttccttatacatttataaccaacagtaagagatttttaatgttttggccaaaatttttaaatgacacagaacagtcgatgtttcacatggattgtttaggtcactttacagatcttcagcttgcatagtgatttgtatggccctgcactgctgtgcaaagagaggactgtttgtgttcttaaccagtaagaaggagggcaagaaagaggttctcagccagatattgcatatgtaataaaatgatgggagagggaataacactttagatatgaaatgtaccatgtggggaagctatttgaacaacaacaaaatagcttaatttaacccgatggagtacactcagccaccttctagatgtccctgcttattcttcaaatcttctcttttgtggccccaaagaatgattcactctctggagtgaaaaataaccgttgctttctttgcctggaactttaaactgacttgtgctgtatcatccaaacctactcaatcctctcttctccattaatcagtgaggtccaaaggagccaaagacaaatctctcctgtttttcttagaaatgtaaagatgttgcatctgtaaccacaggctgcttttaatcctaaaagtcagcgtgataatgaaatccagtgattaatttctgtcttctaatcaataagtagacatatcaatttatagtatgttagaaagcctcaacttcactgaaacaaaaagcaagaggctctgcaaatgttggagtgtgctaaaggaaaagcatggactgatgtttggggaaaggttggtcaatgtgatgaggccatctgtgtttgctaatagtgcttatcaaaattaggttcctacgcagagacagagaccaggagacaatcctgtatccttcttgatccttatagtccaaagggatggctcccaagtctttcagaaagacatttccatgttgtaggagatttaaaggggcagagaaagggtttataactgcaggttatctgtctttttttttttttttttccagacagaatctcactctgagcacaatctcggctcactgcaacctccgcctcccaggttcaagagattctcctgcctcagcttgctgagtagctgggattgcgtgtgtgtgccatgacgcccagctaatttttctctttttagtagagacagggtttcaccatgttggccaaaatgttctcgatctcttgacctcgtgatctgccctcctcggcctccaaaagtgctgggataacaggtgtgagccaccacgcctggccattgcaggttttctaaagttaaacctcttagaaatgggaggtcagggacctatagtcaagttttgggtgggacaaacagtaaattcttttggcagaattgaatgttcccaggcaggtgctttagaggggtatggggcatcgtagggacgtggctcggagctgatagacactgtgttggaatttggccaagtctcttagtgtatgtatgaggaggagggatgtgcagaagaagttgtctgtgccaagaatttatggttttcacaggttaagacagtggtgcctgggatcatctgcaaggcatgagtcaaatgttgacacaatgattgtttgcagactcatctgagggcttaggcagatctggacctgttgatactgaagtttctgaaggtagaggaagaaaacataatgtctcaataatatctgaagtaggggtaggaaaacagagatttaaggaggtgagatcccttaaggcctcagaaagaagcttcacttcttgcgcctcccttcagagtaaatgggtcattaaattagtttttgtaaccaacctgggaatgatggtgaagaagggaataatgagaggaaaaactttaaataagaatgcctgagagataatactaggtcagtgggagagaaagaaatttccaagaagttgtcatgggaaagggctcacgaataataaataaaaaattagttattaataatataaattaatatatgaaaaataaataagacatctgccaacagccacacttacagcactagatggattttaactgaattaaaacttgagtttttaatgaattttctacaatccaaaatttatttgtttaatttttgtaacaaaacaccatttctttactttttgcaaaagtaaaagtaaagtgctatttgtactttttaaataaaaactaattttaaagaaaaaaataattagctggacgtggtggcaggagcctgtaatcccagctactggggaggctgaggcaggagaattgcggaggttgcagtgagcccagatggccccacttcatccagcctgggtgacagagtgagactctgtctcaagcttcttcagtactcacatgtaaacttctactttccccttcagattacagcaaccatcatgccaaagctatacactctcagggaatccctgtggatttcactgatgaccacttgaccaactattataaaaatcaaggccaggggttctcaaactctcaacatttgtgtgctcatctccccttcacccagagactccccagggctgctgggccacgctttgtttggtttgactggaacatagctcaaaagggatggaaatttccaagaggtgttaagagacacataaatatttcaaagattaaaatgaaagaaataaagaaatgggcatttgtgagctttggtcatgagaatgcaggcctcgcagtacttagctacttccaaacccctgtccaaagagaggaccaaacgctagtgaggcttccggcagcacaagggtgtcccgcggatgaccccagccctcttaaaatgactgcctgaaaaagctcacttgcaaagaaaatttactgtttgtttcaggcaaaacctggtgatgggcaggtagagccccgaatcccctcttagaaccttagaaagcttgcaattataaatttttctccacctttgaagtgtaaatctacattccagaattgtctcctcaaagacctgagagttctctctttgaaatgcaaacattcaggaagctaactcttgctcttgttgccagttcctgagggaggggaaaggcctagctttggcgagcaccttgctccagcttgcacctctgactcttttattgccatgaaaatcaacatgtagacttttttcaaacccaatgacagcccattacaatggaggccatagcaatggaggtctctacatgcaaaaaaaatggtgggacagtttcctgataacaggtcaactttattccaaggataagcatgtcatgaaattattggatggcagattatgcttatctatggtcttcctttttctccttggtctcatcccaataacttacagatcctttaaaggcaaaggccaaatattcagctaagttaggcatactttagatgccaatatcaattttagctatatgggagatcctacttaagatattgaggacgatcatgtgtgtacagggcaaaaaagatgggacaaagagataagaaggggatgggaaatcacaccctccctccgcaccacagaccatgacctggggcaggtcctgtaacaccaagcccacccaggccccatctaacagtatgccgcattctacatgacctcagagttctttcggaattccagctgaaaagctgaaaagcaatactatatagttgtggtttccagctggcccatgttagtatgtatggcttttcttcctcgccatgaaagcactatgggagaacgaagcccgatgctgggcatgctttgccaggtgggtgctgctgaatcacagacctcagcaactgtgttccgcctccacagaggccggagatgtttgtttccccagtgtgttcgtatatttcagccagtttcatgcactttgccctctcagtttgcttcactttctggctcagtgaacctgacctgcaagtctccctgcagtttccctcagcaagtgctcactgggcagccccaacatgtgagaaacggctgtagggtgcacagaggtgaactaaattactaaaaactattactttactaaaatgcttcctggattccaaaactcaccaactgggagaaaggtcagacacacacggagacaactcatctacacaaatgatcatcagtgatttaaagaaggtacagcagagcgagactccgtctcaaaaaaaaaagaaaaagaacgtacaggagatcatggaataagaacaagaagagattactttccagggctctcagaaagtttctaaaaagaggtgccattgaccctgaccttagcattgtgatggagacattacagagctggtaggaaggagaagaagaaggaacggctggaacacacttggggtgaaatgagcggcatttcagtgtgggagctgcagactcagttttggtggaagagttaagagccaggatcttgtcaggaataattctgtgtccaagtgcagaatcgtggtttgctccactactgccagtaactccatttctcaatcatgatggtgatgcttttttttttttttggctcccaatcccggagagtggccatactgaagtcatattacaacaattaacttttcaactattagatgattaatttttaccaagtagcaagaacagctgtttggcacgtagcagtgtggcatgagtatcttgtaaatgaattaaacaaaatatctctccaacacacacacagtcattcttgctgcatgtcagcctccacttctccctccattatttgatgctgtgaagctgaggcagccagcttgagcgaaagctttcagatctcactccaacaaagagctttgattgattcatttagtataaggtgttttatctggctagagaaatccaagctgagttttattaattactaagaaaagtatgcaatagattaatctttgatcaaaactatgtgtgaagtagaaacatattacacatatggagagcagttttatggaataaaaacaatctatgtgtggcataactgacattgtctttatatttttgggggggtgtgtgaggacggagtctcactctgtcgccaggctggagtgcagtggcacaatcttggctcactgcaatctccacctccttggttcaagcaattctcctgctgcagcctcctgagtagctgggattacaggtgcctgctgccatgcccagctaatttttgtatttttagtagagacggagtttcaccatgttgtcgaggatggtttcaatctcctgaattcatgatcctcctgcctcggcctctcaaactgctgggattacaggcgtgaaccaccttgcctggcctataaataatttttaaaacagatacagaatatatagatagcttaacaattataaaattgtatttatcaagtaggtcacgaggtaaacattttacgctatgcaaaagggagcaaacctctgaatttgtcatgcagggtcactagtggaactcacagcaacaggtctgataaagcagaggagggaaccgggcttccgtgtgctttagagagagtgaaacatgaggagtcacaggcagagaaaactgtttttcagaaagaaaagaaaggggacatgacagcccagcagtagggtgaagagggcctctccgtgggtgccgctggcttgagctgctgtaagtggctgtgccgggaacagaggatctgtataggagaatggggaagggagtgctggaaccgggggtgggcaggagcagcagtctggagaccagaatgacctagggtttcctctcatgctcccattcccagtgtttcacgtgtgtaaagtagcaagcatgcatatactgcttagaggcatctacacttaacatactacactcatatacaacacttgcatcgtacaaagtacacatagtaggtgtggcatgtaataagttaccctcctatattttcttctaaaagatttttaaatatttgcatctcaaatttaagtcctttgtccatttagatctggcctttgtgtgatagcgatccatttttgggatagagatccattctgatattttcccatatggataccaactgctcataccatggattatatagaccctttctgactgttctgtaatgttagccagggcatacatcaagatttcacacaagcatacactttcacaatagcaattcctgctgtggtaattataacttcacagtaaatctggtacgtgatagactcacataagctccacctcccaccttcacacactttagtcttctatgggattgtcttagttatactgggcccttttatcttccgtataagctttggaagcagtttagtgacaatggtactcttgtctttttcttgattttaaaaggagtgatttcgatatttttaatcacaaaacatgataggtgctgtaggttatttgttgactccttttatcaggttaaggaaattaccctttattcataggtggaaatatcatgaattatttaatttttgtaaaataattttataggccttttgagacaatcatataacttttgtctttaattcattgataaggagatgatttcagtagattttctaacattgaactaaatttgtattactaaccgagcttgttcatggtttttatactttgctaggtatacttcctagtattttgtttacaatatttgtctctgtgtgcatggatgaggtacacaatagcaaggttaccctagtctcaaatgaattgaagaatggcctcttttttctcccctcgcaaataattagtgtaacattggaactacttgtgacatcatctgggcatcctgttttctttgtagaattattaattatcaactcaattactttaatggtatgatttccatccagattttctaattatttgagtcaactttaataagttaaatgtatccaaaaatttgttaatctcacttatttacaaatgcatatatttaattgtcttattacttaatgaaatagatcataaatataaaagtgtgtgtgtacagcttaagaagaatataaaatgagcatatgtgtccttccttcaggttatgaaatagaatatttccagtatcttagaaactcccattgcccttctacaatgccactcactccttccacaagaggtaaccactatccctaacttcctgttaatcattccattgcttgtcattacagacttgtatattgtttagttttgcacatttgactttttaaataagtgaaactatgtattgtttcttatgatcagatatgcatacacacaaacatgtatatgtatgtatatatacacacatacacacattatttttaagagcagttcaaagttcacagcaaaactgagcagcaggtatagatttcccatatactccctgtcccccacacatgcatagcctcccccataataaacatcccccaccagagtggtgcatttgttacaattaaagaacctacatgatacatcttatagtttgcattaaggttcacacttgggcttggacaaatttacaatgacaagtattcactattaaaatatcatacacgtactttcactgccttaagcatcctctgtgctctggttattcatccctctcttcctcctaactcctgggaaccactgatttttttttctatttctatagtattaccttttccagaaggtcataaagttggaagtgacatacgtagcctttttagattggcttctttcattctgcaatatgcatgtaagcttccactgtgtcttttcatggcttgacagccatttattttatcattgaatggtattcagttgtctggatgtaatacagtttgtttaattattcacctactgaaggtaatcttgcttgtctccaaatttttgcaattataaataaaacgtccataaacatctgtgtgcaggtttctgtgtggacataagttttcaactcctttgggtatataccaagaaacaagattgcggggtcgtataataagagtagatttagttttctaagatgccacaaaactattctccattttgtatttccatcagcactgaatgagagttcctgttgcttcacatcctcatcagcatttggtgttgtcagagttctggatttttgccattctaatatgcatgcagtagtatctcattgcagtgctgtgtttgagaatgtgagtagctgcagttcattcactcttagtgctgcgaggtactctattattggaatatatgatcatttagttacctattccacaatctacccatattgagagataactggattgtttccaggtttttaaaattgtgaacattctcatatatccctaggtaaacaaatgcaagaatttttctggggcctgtaacaggctgactagattgcactaggttgtagtgaagccactgggtcatagggtacatgcatgatcagctgtatgagctaacatccgttttccaaatggctgtccttctacttgcatgggatgaatgcttccacggttctttatccttgccaatactacacctttcagaacttccaaaaaattttgtcaatatgtgtgaaagggtatctaattgttaattttcattttcatgattattattaggttgagcactttttcacatgcttatgggctatttatgctaacttcttgaggtgttatttttcacttattaatttataggagagctttatatattctggatactaaacctgtctaggtaacatgtgttgcaaatatctctgccaagttttgcatatttttttctcattgcggtatccaataaacagaagtcttaaatttttatgtgatcaagttagtttttactcttgccgtttgttcttcttccctatgtaaagataaaagagatgctccacagtttttttctaagaatgttgagaaggtatctttatccattaaaatatatttttaggtttggtctatgggattaagtttcaatttccttttttcccccttatggagaccagtggtcccagtgttgcttattgtaaaatttactatcttcacttaaccacaagaaaagctgtgttacaaaatatgtttccaagtatgtgtgaaaaatatatttatctttatgattctactcagattaattagctctcaggactgctgtgtccagagttgattccttctggtgggttcgtggtgttgctgacttgaagaatgaagccgccgaccttcacggtgagtgttaccgctcttaaagatggcaaggacccgaagagtgagcagtagcaaggtttattgggaagagctaaagaacaaagcttccacaacggggaagagcacccacgcaggttgctgctgctggggtgggggtgggggggtggccaggttttattcccttatttgtcacgtttctatcctatcagagtgcccttttttcaatcctccctgtgattgactacttttagaatcctgccgattgatgcgtttttacagagcttgctgattggtgtgttttacagagcgctgattggtgtgttttacagagcatggattggtgcgttttacagagcgctgattggtacatttcacagaactcgtgagacaggtaagttcctgattggtgcattttactatcctctggtaagacaggaaatttccccaagtccccactcgacccaggaagtctggctggcctcagctcttgctaccagaggctaatttccaccctggtatttctcaggcccatagatagtgtgaattcaaacccaaaccaatatggctattgttttgtatttagaaattatcatacgttttttatttttcatttttttgtctaccctattgggaccaagacaagcacatattttcactttcttatgggggtgggattttcctagcccaggcacttaacgtgcttctttttagaaatcctagatttatgcaggaggcattttagcctatattccttcctgcatgggcatcagtctctgtttcctgaattaggtgctcatgggtctgggccagtaggtcctgggagacaccgcagggcaaatgccagatgagacactcacacctctggattcagactttttttgctcttctagatatctgaaaatttgccttactttgactcagcccatgcattaaagcagatgcttttaaatattttatgatgcatgttttaggaaagggtctgtctgggtatttcttctttcgatttgcatttttcattcagttcttctttcacactatcctaagcattaatcaactcgccatttatgtcagtacaaaacttcactatcctgttcattatcaccatttcattttgttctgcataggccagactatttatctaaaaatgtttaaagaaatctaaggccttaaaggattctttctcaaggactctactgtttgtatttagagaaatgctcatttgttccactgttttactttcttcttgggtcacgctctttgatgactgcgatcttacagaggatgacaaaagagggcccaccctgagacagtaatacctgcttgcccctttggattttattagtgttatcaaaatattaataaaatgtcaaaaacaaattactatcattagaatgtgtgcctcacttaaaaatttctctctctaataagaagtttttgtttcctagttcctttggtaccctaatgtttaggtaaatattctctgaggaaaggatgtggaagtcatagcaaaatatatgctggacttgaatgaaaatatctgtttcataaaagttaagcaggcaaccaaaatttaccttttttaacctaaattatctaaacatgtatttacatttctgtttcattgaaagatatttgacattaaatgtccctgagacagattttggaatgccctctccttctaaaatatattttttatcttttgtggactaaacagttagttaaaaatgaacttaatgattgctaattactaagttatctaaacagttatttaaaaatgaacttaatgattgctacttagttatttataatgcatttcaaaattaactttatcatctaaaccttttaacacaaatgtattaaattatgaaacagggaattggctatttttgttcaaatgtttattctcatcaaacttaaaatatcactcagctatatgattaaaaatgaaggcttcagtcattaaattatttcccagttatttgcgatatttctccgtattaaaggaacaaacagtgcccttcgaatctgttgatagttctattgatagtggccatcacaagttacacattatcaataaggtcaaggcacaaataaaatttctcccttgcttttcactcaaaaactacaagtatagttctttgataagatgtcccaatcatgatttgtgatgccaatcatagaaggaaagaggatgttgagaaacaataaaatagctactttaaaatgttctgtgcctgaacattttgatggcaatattggtcatattataaatttgaaaatataaattttaatctagattgactttattctactagtgattttaagagctttatccaagagaaacacttacatttttattcctaatgtttctttaaaaatgtgaaactcttttttttttttataattttaagaattcctagataagcagaacatagagccaactgttatgttctggttgtttttaataggtatatttatgttatcccccaaattataatttattaatgtctaacttcagttagatgagttgattacttttcatacaccattgactaaaggaaacctaattttacacgtaattcaaggggatctgtgagtaagaacatttttaaattaaagcaacacatgtgcatggaaaatcattcaaacagtttgatggcaaaaaaatcagtggaaaccagaaactttttttttccttccacagaccttggtcctgtttttcagagttaggcaggttttatcatactcttttttttactatatgctattctcttgaactgtaaataatattatataatcacctaatttgttttatcagttttaagtaatatcccttgactttttatgaacgatagagaatatagctcatttaccctactttcttttcttttttcttttttcttttttttttttttttgagacggagtctcactccctcacccaggctggagtgcagtggcgctatctcggctcactgcaagctccacctcccgggttcacgccattctcctccgtcagcctcctgagtagctgggactacaggcgccagccaccacgcccggctaattttttgtatttttagtagagacagggtttcaccgtgttagccaggatggtcttggtctcctgacctcgtgatccgcccgccttggcctcccaaagtgctgggattacaggcgtgagccactgcacctagcccatttaccccactttcttcttctaaaactatatttccaatttagtctttaatatataattttaagggatttttaaaaatttgcttcctctaaataatatacttacagtgcttaattctttgcttaaataatatattgtttaaatatacagtccatccaatttgaacaccactgattggctcagtaggatgtggagattagtgtacaacttccctcctctccaacagtccctgtcatagctttcgacttgtatcaaatatggttctatacttatattttcacattctatgtaaattacatcctattttgtaattataataaagtctgtgctttgttcataggttaattttgatcatggaatctcaagtgaattgacagcatcattattatgttttctttttttttcaaaccacagtcgcaggtggcatgatttgatttgtgtgaaggcaatgaaatgatacacagatacaccgaagcctcccaaaagaatcctggttccaagattcaagaagatggattaatgtttttccattaattgttggaatttatgccatttttttactatgtgccatcaattttaaagcacttctgaaaagagataacaatctacaatagctggcattttaaattcataaaaatatagtattttcttctatttttatacatttatgatgcattatttcttatttcccaggaattttactacctttgttttgaatgattaaaaaggaaacatagcaccttttttcaacacatcaccaagatagcctagttaatattcttctctttctgaagtagttgaattgggatagacagcttgccaggcctgctgccacttgtcagcatcgcatccctacattcaaccacacttgcatctaacgaccgtctctttcattaaatttcttttgcaccttttcttcctgaatgagtgcatgatagttaattttcctgtgcacttgcatgtctcaagaaggttttaattctttttgtattgcattaatatttaagttaagtttataattgcaaaatgatttatactcacaacattgaagactcctttgttttgttacatcctgtcaaaatgatgagaagacagatcatcctttagggaaaaattggttttgattggcgtcagcctttccaacagcaatgctggagacaagaataaaatgaagtaatatttttcaaggattaaaaggaaacaatttttaatccttgaattatttgcagccaaaatcttttaaatatgaaagcacagaaaaagacattataaagtaaggcctcaaaagttttatttcaaataaatccctttgaaaatgcctagaggacatactccactaagaagagaaatacaccgtggtgttagaattgagggttccagaatcaatggtagtggtgtttatcataccctaaaaaatacatgaaaacataacatattgaaaacaactccgagtaaacttcagaaagtaccaccttagacaaagtgctgtcgtaacagagaaagcaaaccagaggtggcaagaggaggctagagtacttatttggtttgctgagatgatattaattttgacacatggaggaaattgagaaaattaacataagtaatgacataaccaccattactatgttaaaaatttccagatttcaaacaaatgaaaaatttttgatctatagagtgagaggtacaaataggaaaaaagacacagtaaagtatgaaaaatcataaatgagatgacagaaagaagtcataatggaacaataattacataaatcaaaggttaagattgtcaggtaaaatttttaagtgtcaaaaaacacaatataacctatcgaaaataaattagtggaaaaaatgtagcaggaaaatatgaataaaaagagctaggtccaatttttgataaaaatttgaattcaagttgataatatcctaaagaaggaaaagtctgtaggccaatagaagaaatagcagatgcagaggtgtgctcacaaacatgagtgctcatgacactagtcatacaaactcaaattcccattacagttgtatacaaacatgatggccgacaagaaggaagttcctttaagcccacttggagcattaagacaaatttaccatgtgaatccctaattgaactctgagttacttctgtgaaggaatgaagaatgatatcataaatgaatttcatatagcactcaaagctcctcctctatatggttcaggatagacttgagtatccacggttctggagtgcaagggaggagaaaggaaaggtgcattcagacaaaaaaaaaagtgtacagaacacaccacggatatcagaagaggctgctcatggcaaggcgtggtggctcgtacctgtaatcccagcactatgggaggccgaggtgggtggatcacctgagctcaggagttcaggaccagcctgggcagcaagggaaaccccatctctgccaaaaatacaacaaaattagctaggcatagtggcacatggctgtggttcccattacttgggaggctgaggtgagaggattgcttgagcctgggaggcagaggttgcagtgagcccagatcgtgcctctgcactccagcctgggcaacaaagtgagaccccgtctcaaaacagaacaaaacaaaacaaaaaaagaggctgatcaagaccagactcagctcctaggccttgaactccagtcccaccttacaccctaaggttcctaaagaatcagtaacttagttcaccctaccccactcctggcttctagatgtagcacaagtttctaaacatgcaaacaatgagaactatctattttgacaaaataagaagaaatggagtcaaggcaacatataacatatttttgccagttctattgattaacagaaaaattgtatatagttaaggtgtgcagtgtgttattttgatatacatatacattgtgaagtgatgattaccacaatcaagctaacatattcatcacctcacctggttacctttttatttgtgtttgtgtggtggagaacacttgagatctactctttcagcaaatttcaagtatacattattattgactttagtcactatgctgtacattagatctccagaacttattcatcttataactgaaagtttgtactttctgacaaacattttttcttttcccccaactcccaggccctggtaagcactattttactctgttaccatgagtttgacattttcttagtatgcatataagtgaaatcatgcaggatatttgtgtgtgtgtgttcctggcttattttacttaccataataaactccaggtttgtccattttgttacaaatggcagtatttcctcatttttaaaggctaaatgatattccttgtgtgtgtgtgtgtgtgtgtgtgtgtgtgtgtgtaatacatttaaaacatccatctgtcaatggacacaggtagtttccatatcttggctgtgtacataacactgcaatgaacatgtaagtatacatatctctttgagatagtgattttctttactttggatatatacctagatggggattgctggattatatgggagttccatttttaattttttgaggaaagtccatactgttgtctctaatggctgtaccaatttacattcccatcaactatcaactaagcacaagggtttctttttctcaatatcctcagcaacatttgttacctttttactgttacaatagccatcctaatagatgtgaggtgatatctcattgtgcattttcctgatgattagtaatggcaaacatctttttcttagtatatacctattgtcaatcgtatgtcttttagaaatgtatctcttcaggtctgatacgctttggctgtgtccccacccaaatctcatgttgaattgtagctcccataattcccacgtgttatcagagggacccagtaggagacaattgaatcatgggagcagttttccccatactgtttttgtggtagtaaataagcctcacaagatccgattgttttataagcgatttcctttttcacttggctttcattctgtcttgcctgctgctgtgtaatatgtgcctttagcctcccaccataagtaaggcctccccagccttatggaactgtgagtccattaaacctctttttctttataaattacacagtctttggtatgcctttatgagcagcatgaaaacagatgaatacagtaaattggtactggtaaagtggggtgctgctgtaaagttatccaaaaatgtggaaccaacttcggaactgggtaataggaagaggttggaacagtttggagggctcacagaaagacagaaaaacatgagaaaatttggaactccctagagacttgttgagtagctttgaacaaaatgctaataatgatatggacaatgaaattcaggctgaggttgtctgagatggagacgaggaacttgttgggaactggagtaaaggtaaatcttgctatgttttagcaaagagactggcagcattttgcccctgccctagagatttgtggaactttgaacttgagggagatgatttagggtagctggcagaagaaatttctaagcagcaaagcattcaagaggtgacttgggtgctgttaaaagcatgcagttttaaaaggaaacggcataaaactttggaaaatttgcagccaaacgacatgatagacaagaaaaaccaattttctgaggagaaattcaagccagctgcagaaatttgcataagcaacaaggagccaaatgttcatccccaagacaatggggaaaatatctccaggacatgtcagagatctttgtggcagtccctcccatcagaggccaggaggcctaaaaggaaaaaatcctgggttggattcaggggctccctgctgtgtgccactttgagacttgatgccctgcatcccagccactttagccatggctaaaaggggccaaggtacagcttggactttggcttcagagggcacaagccccaaaccttggcagtttcacatggtgttgagtctgtgggtgcacagaagtcaagaactgaggtttgggaacctctgcctagatttcagaggatgtatggaaacacctggatgtccaggcagaattttgttgtggggcgggtgggggggggtccctcatggaaaacctctgctaggacagtgcagaacggaaatgtggggttgaagcccctacacagtccccacttgggtactgcctgctggatctgtgagaagtaggccaccgtcctctggaccccagaatggtagatccaccaacagcttgaccatgcacacgggaaggccacagacaatgccagctcatgaaagcaaccaggaggggggatatgtcctgcaaagccacaggggtggagctgcccaaggccatgggagcccacctcttgcataagtgtgacctggatgcgagacgtggagtcaagggagtgcattttggcactttaagatttgactggcctgctggattttggatttggggcctgtagcctctttgttttggccaatttcaaccatttggaacaggtatatttacaccctccctgtacctccattgtatctggaaaataactgacttgcttttgactttatgttctcatagctggaagggacttgccttgtctcagataagactttggagagtggacttttgagttaatgctcaaatgagttaagatgttgggggactgttgggaaggcataatttgctttcaaatatgaagacatgagatttgggaggagccagggcagaatgatatgatttggctgtgtccctacccaaatctcatcttgaattgtagttcccataattcccacatgttgtgggagggacctggtggaagacaattgaatcatgggggcagtttctcccatactgttctcatggtagtaaataaatctcacaagatctgattgctttataaggggtttccccttttgcttggctttcatcctgccttgccggctgtcatgtaagacatgcctttcaccttccaactgtgatcatgaggcctccccacctgtgttgaactgtgagtccattaaacctcttttttctttataaatcacccagtctcaggtatgtctttatcagcagcatgaaaacagactaatacaaggtcctttggaatcgtctaagttcctaatttatttggatattaacttcttatcagatatatagcatgtaaatattttctcccattctttaggttgtcttttcattgtattgattgtctcctttgttgtgctgaatcttttactttgatttagtcccatttgtctagttttgcttttgttgtctatacttttggtgtcaaatctgaaaatttattaccaataccagtgtcaaggagcttttctcctatatttatgtctaagagttttacaatattgctcctaggttgaggtcttttatccattttgagtcaatttttgtatgtggggtgagataagggttcagtttcattcttctgcatgtggatatccagttttcccaacaccatttattaaagagactaaacttttatcattgtgttttcttggcaccaatgctgaagatcaattgattgtaaaggcatggatttgtttctgtgctctctattcttttcccttggcctacatgtctgtttttatgccagtaccatactattttaattactatagctttataatttagtttggaataaggtaatgtgaagcttccacttttgttttttctgttcaagaatgttttgactgtttggggtctgttgcacacagattttagaattgcttttttccattgctttgaaaaatgccactgaaattttgataggggttgcattatatctgtagatcacactgagtaatagagattcttttatcttcaaattctttcatcagtgttctatagtttttggtatatagaaattttactttcttatttaaatttattcctaagttaattttttgatgctattgtaaatgagattgtgttctttcagatggactctcgctctgtcacccaggctggagtgcagtggtgtgatctcagctcactgcaagctctgcctcccgggttcacaccattctcctgcctcagcctcccgagtacaggcggccaccaccacgcccggctaattttttgtatttttagtagagatggggtttcaccatgttagccaggatggtctcgatctcctaacctcattatccacctgcctcagcctcccaaattgctgggattacaggcgtgagccaccgcgcacagcccgagattgttttcttaatttctttctgggatagttcactgttagtatatagaaatgcaataggtttttttttttttaatgttaattatgtgttctgtaaatttgctgaatttgtttcttaattttaacagtttttttttggagcctttagaattttctctatataagatcatgtcatcttgaaatagacacactttcacttcttttccaatttggatgccttttatttctttttcttacctaattgctctggctaggacttacagactttttcagaaaccccccacagtaatctaggggagtccactgtcactagatctgctttataagaaaccctaaagggagttcctcaaactgaaatgcaataagactaattagtatcatgaaaccatatgcagttataaaaagtcactggtaactatacagtcaaattcaaaatactcctaatactgtaatgatgcagtataatcactttaacttttaaaaggttaaaagacaaaaaatactacaaataaatataattacaaaatatacaaagaaagaaactctgacatcaaaaaacataagtggaggggagtaaagtgtagggtttttgtatatgattgaagttaagttgttatcaacttaaaatagaccattataactacaatcatgcatttcttaatgcggatatgttctgaataatgcaattttgtcatggtgtgaatatcatagagtatacttacacaaaattagataataccacctaacacacacccaggctatatggtataacctattgtttccaggctacaaatctgtacagcattgtactatactgaatgctataggcaactgtaatacaatcataagcatttgtgtatctaatgtatgtaaacatatgaaaggtacaataaaaatgttataaccttatgggaccaccgttgtatatgtggcccatcattgaccaaaacatccttgtgtggcacacgatagcatacaatgttttatgtaagcctcatgataatcacaaagacaaacatgtaacagatacacaaatgagaattttaccacgtttaaaaaagaattaatacaaaggcacaggaaagaatcaaagtataccactacagaaaataatcaaagtaatcaaatcatgcacagcaagagagaaataaaagaacaagaaaactacaaaatgcctatcaatagttactttaaatatcagtggaccaaatcagtgaaacaaaagacacagagtggctgaatggatagtaaaacaagaaccaaatatatgccacctataagagactcacttcacctttagagacacacatagactgaaagagagggaacaaaagaagagaaagagtagctattcttacaacaaacaaaatagactttaagtcaaaaactgtaacaagagacaaagaaagtcattatagaatgatacaaggctcaattcatcaagaggatataactactgcaaatatatattctcccaacattggagcacctaattatataaagcaaatattaacaaatctgaagagagaagtagacaacaataatacaataacagtaagggacttccatatcccactttcaacaatggattgatcattcagacagataatcaataaggaaacagctgacttgaactacactatagatcaaatggaccagacatatacatgacattcctttccaaaacagcaaaatacacattcttctcgagcatacacagtacattctccaacataggtcatatattaggccagaaaacaagtcttagcaaatttaagaagattgagatctcaccaagtattctttttgactacagtggcatgaaactgaaattaaaaacaggagaaaacttagaaaagtgacaaatatgtggaaatcaaccaacacactcctgaataaccagtagatcaaagaaaacatcaaaaaagaaataaaatatcttgagacaaactaaaatgaaagcacgacatactaaaactgatgagatgaagcaaaagccgttctaagagagggaagtttatacagataagtgctaaataaagaaaaaagatcccaaataaacctcaaaaaatagaaaaaaataatcaagcccaaaattagaaggaaataacaaagatcatagcagaaataaatgaaatagactagaaaaacaatagaaaagatgaatgaaacgaagagttgattttttgaaaagataataaaaattgaccaacctctcactaggccaagaaaaaagaaatctcaagtaaataaaattagaacaaaaaaggagatattaaaattggtaccatagaaatacaaaggataataatagtctactctaaacaactatgtgtcaacaaattgtttaacttagaatagagaaatttctagaaacatacatccactagactgaaacatgaagaaatagaaaataaaaacagataaataatgattaaaaatattgagtcagtagtcaaaaagctcctgaaaaaggaaaatccaagaccagatagcttagtggagaattctaccaaatgtttgaagaagaattaatacgatttcttcacaaactcttccaaaagttgaagaggagggaacacttccaaacattttttatgaggccagcattaccctgataacaaagacagaaaaggacactacaaggatgacagagatttttaaggtacaaatgatgtattgttggaattgaaaatacaggctttgttagtacaaagatttgtgtgtggataggtggatgtgtactggtgtgtgcatgcatacatatacaagcttaacttgttttattgcacttcactttattatgcttctcggatattgcagtttgtacaggttgaaggtttgtggcaaccctgcaccaagcaagtctaccagtgccacttttctggtagcatgtgcttattttgcacctctgtgttacatctttgtaattcttgcaatatttcaaatgttttgttattattatatctgttatggtgatctgttatcagtgatcattgatattactattgtcattgttttggggcatcacaagccatgctccaaaagacaatgagcttaattgatacatatgtgtattcgaatggttccatcgatctgcccttcctccatctcaccctctcctcaggtctgttttctgagacacagcaatattgaaattaggccaattaataactctataaaggcctctatgtgttcaagtgaaagtaagagtcacacatctcttattataaatctaaagtgagaaatgattaagctgagtgaggaaggtatgttaaaagccgagacaggccaaaaggcccaggctggtctcgaacgcctgacctcaagcaatccacctgccgcagccttccaggtagctgagattaaaggcatgagccaccatgtccagcttctatgcattattttaaatggagtattgaagactctgttactgtagaactatttctaacttcaattctgtcaatattttggtcacaggccttaatgtgattacacgctggtctgatgttcatggccaggacattttgttttcctgttggacataaacaatctcacagaatatcaacttcagaaggttaatctgagaccgtgataagtgcaaacaaaaacaagggcactttataatgttgtctaagtgcagataaaaaacaaggtcttgatgccacccacaaaatacttaataatcatattgctcctgctttctgacagcatccaatctaaagtcttcactttctgagatcctgtccgaaatcaaccaattaaagtccaaatcgtataatagtttctctctaactcctcccactgagatgacccatagtaccccattccttgctgcaatgtaattatatttacttacaagtgtgctcctggtggtctttaactgaagggcactgactgggtcactggtgaagttccccgcaggaactgagtcagaccccatctcagggccctgcacaagataggtgcctgctctaaggcgtggaccctcgccacagccctggcccgtcttgacgggcgagggttactgtacttgtcccaaccgtacagatgagaaagctgagactcagggcgagcaacccgggtcccagcggagcgcccggcacacgccgacacttcagcaccagtcgcggtggccaccactgtgcgcggagatggctgcgacgcgtgcgcaggtaaagtccatccgtgccttgcctcccaccggcgccttccccggcctctggtttttgtacccgccagcggctccgactccatcgcgtcctcttccagtctagtgcttttttccagatctcgatcccaaactccctcctgccagaatctggacccgaatccacccattgcccgttttctgctgccgctggagagaatctctgaggtccccaggagagcctgcctgcacggaagagatgcctcctcagtatggccgcccccggagaggagcgattaagtgcagacctccatgttgctcttgagcctgagcggcttcagggagccatgtttgttactggcgggc

SEQ ID NO: 658 - DNA, 4029 bp, Homo sapiens
agattaattagctctcaggactgctgtgtccagagttgattccttctggtgggttcgtggtgttgctgacttgaagaatgaagccgccgaccttcacggtgagtgttaccgctcttaaagatggcaaggacccgaagagtgagcagtagcaaggtttattgggaagagctaaagaacaaagcttccacaacggggaagagcacccacgcaggttgctgctgctggggtgggggtgggggggtggccaggttttattcccttatttgtcacgtttctatcctatcagagtgcccttttttcaatcctccctgtgattgactacttttagaatcctgccgattgatgcgtttttacagagcttgctgattggtgtgttttacagagcgctgattggtgtgttttacagagcatggattggtgcgttttacagagcgctgattggtacatttcacagaactcgtgagacaggtaagttcctgattggtgcattttactatcctctggtaagacaggaaatttccccaagtccccactcgacccaggaagtctggctggcctcagctcttgctaccagaggctaatttccaccctggtatttctcaggcccatagatagtgtgaattcaaacccaaaccaatatggctattgttttgtatttagaaattatcatacgttttttatttttcatttttttgtctaccctattgggaccaagacaagcacatattttcactttcttatgggggtgggattttcctagcccaggcacttaacgtgcttctttttagaaatcctagatttatgcaggaggcattttagcctatattccttcctgcatgggcatcagtctctgtttcctgaattaggtgctcatgggtctgggccagtaggtcctgggagacaccgcagggcaaatgccagatgagacactcacacctctggattcagactttttttgctcttctagatatctgaaaatttgccttactttgactcagcccatgcattaaagcagatgcttttaaatattttatgatgcatgttttaggaaagggtctgtctgggtatttcttctttcgatttgcatttttcattcagttcttctttcacactatcctaagcattaatcaactcgccatttatgtcagtacaaaacttcactatcctgttcattatcaccatttcattttgttctgcataggccagactatttatctaaaaatgtttaaagaaatctaaggccttaaaggattctttctcaaggactctactgtttgtatttagagaaatgctcatttgttccactgttttactttcttcttgggtcacgctctttgatgactgcgatcttacagaggatgacaaaagagggcccaccctgagacagtaatacctgcttgcccctttggattttattagtgttatcaaaatattaataaaatgtcaaaaacaaattactatcattagaatgtgtgcctcacttaaaaatttctctctctaataagaagtttttgtttcctagttcctttggtaccctaatgtttaggtaaatattctctgaggaaaggatgtggaagtcatagcaaaatatatgctggacttgaatgaaaatatctgtttcataaaagttaagcaggcaaccaaaatttaccttttttaacctaaattatctaaacatgtatttacatttctgtttcattgaaagatatttgacattaaatgtccctgagacagattttggaatgccctctccttctaaaatatattttttatcttttgtggactaaacagttagttaaaaatgaacttaatgattgctaattactaagttatctaaacagttatttaaaaatgaacttaatgattgctacttagttatttataatgcatttcaaaattaactttatcatctaaaccttttaacacaaatgtattaaattatgaaacagggaattggctatttttgttcaaatgtttattctcatcaaacttaaaatatcactcagctatatgattaaaaatgaaggcttcagtcattaaattatttcccagttatttgcgatatttctccgtattaaaggaacaaacagtgcccttcgaatctgttgatagttctattgatagtggccatcacaagttacacattatcaataaggtcaaggcacaaataaaatttctcccttgcttttcactcaaaaactacaagtatagttctttgataagatgtcccaatcatgatttgtgatgccaatcatagaaggaaagaggatgttgagaaacaataaaatagctactttaaaatgttctgtgcctgaacattttgatggcaatattggtcatattataaatttgaaaatataaattttaatctagattgactttattctactagtgattttaagagctttatccaagagaaacacttacatttttattcctaatgtttctttaaaaatgtgaaactcttttttttttttataattttaagaattcctagataagcagaacatagagccaactgttatgttctggttgtttttaataggtatatttatgttatcccccaaattataatttattaatgtctaacttcagttagatgagttgattacttttcatacaccattgactaaaggaaacctaattttacacgtaattcaaggggatctgtgagtaagaacatttttaaattaaagcaacacatgtgcatggaaaatcattcaaacagtttgatggcaaaaaaatcagtggaaaccagaaactttttttttccttccacagaccttggtcctgtttttcagagttaggcaggttttatcatactcttttttttactatatgctattctcttgaactgtaaataatattatataatcacctaatttgttttatcagttttaagtaatatcccttgactttttatgaacgatagagaatatagctcatttaccctactttcttttcttttttcttttttcttttttttttttttttgagacggagtctcactccctcacccaggctggagtgcagtggcgctatctcggctcactgcaagctccacctcccgggttcacgccattctcctccgtcagcctcctgagtagctgggactacaggcgccagccaccacgcccggctaattttttgtatttttagtagagacagggtttcaccgtgttagccaggatggtcttggtctcctgacctcgtgatccgcccgccttggcctcccaaagtgctgggattacaggcgtgagccactgcacctagcccatttaccccactttcttcttctaaaactatatttccaatttagtctttaatatataattttaagggatttttaaaaatttgcttcctctaaataatatacttacagtgcttaattctttgcttaaataatatattgtttaaatatacagtccatccaatttgaacaccactgattggctcagtaggatgtggagattagtgtacaacttccctcctctccaacagtccctgtcatagctttcgacttgtatcaaatatggttctatacttatattttcacattctatgtaaattacatcctattttgtaattataataaagtctgtgctttgttcataggttaattttgatcatggaatctcaagtgaattgacagcatcattattatgttttctttttttttcaaaccacagtcgcaggtggcatgatttgatttgtgtgaaggcaatgaaatgatacacagatacaccgaagcctcccaaaagaatcctggttccaagattcaagaagatggattaatgtttttccattaattgttggaatttatgccatttttttactatgtgccatcaattttaaagcacttctgaaaagagataacaatctacaatagctggcattttaaattcataaaaatatagtattttcttctatttttatacatttatgatgcattatttcttatttcccaggaattttactacctttgttttgaatgattaaaaaggaaacatagcaccttttttcaacaca

SEQ ID NO: 659 - DNA, 5651 bp, Homo sapiens
cagcaggatgggctggtcagtgggatagcctctgtgcacattttgtggcaagtaggagtgacacatcattcctgggaggccccgtggttcctgccaaacccaaccccagaattctccctgaggtggttttaccaaacccataacccagaactgctattgtggtttgggggtcagcacccaccagtgccagggcactactgggaggctgggacctgaccaaagcccatggtgtctgtggcctgaggacagggtgtcttggggccatgaggacaggccaccaatggccgttgggtcatagggcctgagccccagtgtttgtccttccctggctccttctggttcagtcccatcagggctctggatcccaagacgcagcatccaaggttccctccaggaatcctggtggctcggcttactttgtcatgtttcatctgatagcaaaaatatcagatcggctgcacagaaaaatggctcaaagtgcttaatgaccagaagaaatctgggagtagcaagaaggtaatgtggagaggggaggacctccatgactggtgtctgcagagccaggggtacagggacccagtgcagtgacctggcaccacctgcctctcagagggtgggtagcacactgtccttacctgggggacagcaggcctggtcaccggcttttctccctgtccctgcaagcatcacattgctggaagagaatctcatgccagagcttggaccatccctagcttgggggttaggggttgtctcttggtgacctaaatgaaaaaataggtccagatcagagttcgtgatgcatagcactcacccactctttgaatcatgggaggggaggcctagtcctaggtaaacctaaactctttgaggaaccacagagcccaaggctggaaacctccagaatcctccagcccctgatcccccccccccccggggacctctgtggcctgtctcaccagagcactcttctgtctgtagaggtctcaggtgctctacaagggagtcccatttcaggtgtggggctgggtatggtcactcctgctggatgtctagaaggtgaaaaccaaggacctaggaaaataccagatacagcctttccaccgtcatccagagcaggacaaacacgccaggtggtgtcaggagcccaggtctccagctggagggaatgtcaaccctgcagtgggagcccatcatgcatcctaggcacagatgctaacgtaggcaccgcaggtaagctgggtttggtaccccttcctggcttcagaaagaagccaaacaaggagctttctgcagaatgaaacctcttttccatccagaagcactgctgactgtttggtggttgctgttagggcagtgagccttttgtccattctgagattaggctggtttctcctcttggccctggcctacagaccataaaggaaaacagcaagaggtccccagcaaacatctacagatggccctggacatcagccacattcagagaaacgtgtcatgttctgggagggctaaggcatcgagtaaggcctatggggctggaggatcacagggcaggtggggcaatccagagctgtgggggcttccatgggaattgggaggtcccaaggcagaggtaggggttccacaggaggagtcacagagccaccaagggctctcctggcccagggagcagtcaacaccatggactgaacacccactgggctaagccctgggccaggctggggcatgtggggccaggaggcagctcagagtgggagacagagagacaagtgtgctcagagggcacccatatctgcatataacgtggtcctgaatttctggctgggaagtgcttccagggtttcatatgtgttatggagatgcttcctctctccaacctcaccgtgcaggaatcccagtgaatatattgccaccatcttggagctcagtgccctcatagtgtaacagcaccagcagatctgcctgtgcacagacttcctgtactacctcactcctgaggggagatgcttctgcagggcctgcgacctggtgcacaactttagacaccatcatcctggagcggcactgcaccctcactagccagggtgttgatgacttcctcaatgccaaggccacgttcaagattttcgacttcagtgatgcgtttgtgctgagcaaggtgggcttctccgggatcttaattcaggaggtagaatgcagcttgagatctagtgtctgatcaaagaacttgaacttgacctggagggctctggggagccatggaaggtgctggataaaggaagggacagtcatatatattttagagatgactgtggaaggctgcctggaaggagtgaacaagagccaggagaccagggagggagtttgtggggcaggtctggagatggcaagggagggatcctgcttggatgaaaggtcttcagggactgtctcaggttacactcaggtgccctcagagctactgtgttcagggttcttgtctccaggatgaaaataaggaggagttgtcagacaaggacatatacatggaggctggcatcttcatgagtgccaatcgtggtcctggtgtggactactgtgggagcaggggtctctccatccagggacatggtggatggaccctacatcactccattctgcccttcctttccctcccattctcctgagggactcaatgcatgggcactgtccaacctctggtgctgaagcagccaagagacccaagcctgccttgctgccacttaggatatgacagcacagccagtggcctctactggatcctggtacccctcagaagacacccagacactgggagtgctgccacctcgtggtgcaagagttctgagggacggcaattctgaagacattgaatggtgggtgctgggcctcatggctgttccccagcccctctcattggctctgctccaggtggagaagggggatgatgtctctgtcagttctgctgttttagcctagaaggaaaagaagcagagcccagaagcagggcctggtacccagcctgcctaacaagggagaatttgtaggctttgtggacagaaagatctgggactccatgtcacccactaacttgctgagacattagtaaaatcagttttcttttctgaactatgtttctgtcatctgtacattgagaggaatttcttttactccacgaggctgcttggagaattagtgacagtgtgtgtagagcatgtgccacccagcaggcatttggtgtcgagaccacacctcctcccccttcattttcagcctaaatttgcattttgttcttaagactttcactcgccttaattttactctttcctctgattcccaccttatcgtctatcccatggagtcactaggatctaagtgggtaacagtcatgtatgcatgtatgtgtatgtacgtatatactttgttggtgttggagtgtggtgtgtgaatgtgtgtgtgtgtgtgtgttggagttactgggtgactgaaactgtacacatcaggctgtggttctgcccattgctggaagcgctgtcaggggtcctgccctcaaccccaggtctgacccttgcagcgcaggcaggacattctggaggaatcatgcccttgggaggatccctgaggagtgactggtgggtattggtggataaatacccctggtcccttgctctgggtatgatgactctgaagcacatgttctgtgctgtctctcagaggtacctggcagggctgagtcctggctgccacagtggaaactttcttgatgaaggtccctttaactgctgcattcctttcctgtctcagttccccactcctccactgatgtttcctgggattagcaccctaaggaagaactggcagtcgaattaatatcctagcgttatctccaaacaaaatttttgtatttgaatctttgcctcaggatctacttccaggaaattcagactaagacacacatttttcttttggctccttgaatccccataggcctgacattttgctgtttttatcaaaaaggaacatgaggatcagagagggaaagtcacttgcccaaagtcacccagctgaacagtggtagagttcaactttgatcatgagatgtctggcccccaggtggaggcttgctcctctcccatgagactccttccttatcagggtcaaatgaatgaatggaggatgttaaaagtggggtctctgatgcctttgccagataaaccccaggctcatggctggcgcctgttttctcattcttacctcattaagagtagtaatgaaaaacatgctcagtgctgaccgtgtgcctgggggtgttgtaggcactccacttactttaattcatttaattttcacaataaccttgtttttacttctagttgttatatgaaaaaactgaggcaaagagcaatacagagagttgcaaaaattcataccgctggtccaggtttgaaccaaacagtctgcacctggagtccttgtttgtaaccatggcaccctgtcttcacacatatctcatcgtggagttccatcttgtgttaggcatggcactgagcagcttcttttaagaacataatttgtagccaggcgcagtggcttatgcctgtaatcccagcactttgggaggccgaggcgggcagatcacgaggtcaggagatccagaccatcctggctaacttggtgaaaccccgtctctaataaaaacacaaaaaattagctgggcatgatgattggcgcctatagtcccagctacttgggaggctgaggcaggagactggcatgaacccgggaggtggaacttgcagtgagccgagatggcgcgactgcactccagcctgggcgagagagcaagactccatctaaaaaaaaagaaaaaaacatgatttgtaattatgtaaattactaattctacttcaaagtgccacacagccttcatgtgataaaatgaagcaattggtaagtctaagcattgagaaaaaacattatttttcccagctccattgcaacagttgggacagtgttttctctgtgcctatagaaacctcagctagtgtgccgaggagtctggtccctttggggaatgtggcagtcaggttctggcagggacctcgaagtggctggtaatgtctttcattaccaccaccacgtgacctggtcttacgacctgttagcttccttcatcaggcatgagcaccaggatggcaggggcctcatctgtcctgttcctcctgtggcctgggtcctagcaccatgtctggtacagtgtaggtgctcaagggaagtttactttatagaactgtctacctgggagatgttgctgttagtctaacctgtaccattttgtaaacctgcagccgttttgcacaccctggtcagaatgaaacattccttgggaactcgggccgtgagaagcatccttcctgatcacctgactgtagaaacatccttatcgcaccctcccgggcaaaggcccaacagcctgactgcaggaacatccttgccatatcctgccgggcagcaagctctaccgcccacacccctccttcccagtcccatgatcaccccagcctgtgagaggcagttggtgctggcagtaagctggtttcctcctctgcagggttttgctagtaataaaggtgttgctgttgaagccgtca

SEQ ID NO: 660 - DNA, 3110 bp, Homo sapiens
gctctcctgccttccctgaataaacttacacaatttagtgctgggacatttggaccttttctgaaaatttgagtcagggagagcatcttggggaggtgggaaggaaggtagaaggagcaaagcaacacccccctgaagcctgggaatattgtcagaaccttaaatataattcagctcaccattctgggtaaggacagactctaccaatgaaaatgggtgattaccagctgtgaaacacaaaaacatacttttacggttacacattcctttacaaacaaccgtgtacatttcagcctcctgccccaccatttcttttctccaggagggaaggctgcatgtcgaggtggtcatagaatgttgagtatcatactttcctacctcgcttttatttgcgcgggtttaaatgcgccttaacagaacccgtgcaaaggcttgccaactgtctggctgcaccggatgagtagagcatcttccttggtggcaggtgggtgcgaggaggaggggcctgggcttttctccggacagtgtttgcccagaagaccatcatccctggactacgttaggaggaagtggcaccgctccgaggtaggggaagaagggttataaaggggggagtccaccacacatggtcttgaagaagcttttataaaaggcaaaggcatctttgccggacgttgttgcaaaggagtagaaacaagcagacgaaaacatcccaaagggtaaccactagcgttcctgcttcttgcaacattcatcccaggcttccagctcagcccgccccaggccaggtgatcggccgccacatcccctgcgactgaagcacctgctcctccatgaacctgccaagagctgagcgccctcgctccacaccgcagcgcagcctccgggactccgatggggaagacggtaaaatcgatgtcctgggagaggaggaagatgaagacgaggtggaagacgaggaggaggaggcgagacagcagttcctagagcagtcgctccagccggggctgcaggtggcccggtggggcggggttgcgcttccccgagagcacatcgagggcggcggcggcccgagtgacccttcagagtttggcaccaagttcagggcaccgccaaggtctgcggcggcctctgaagatgcccggcagccggcaaagcccccctactcgtacatcgcgctcatcaccatggccatcctgcaaaacccgcacaagcgcctcacgctcagcggcatctgcgccttcattagtggccgcttcccatactaccgccgcaagttccccgcctggcagaacagcatccgccacaacctctcgctgaacgactgcttcgttaagatcccccgcgagccgggccacccaggcaagggcaactactggagcctggaccccgcctcccaggacatgttcgacaatggcagctttctccggcgtaggaagcgtttcaagcgccaccaactgaccccgggagcccacctgccccaccccttccctctacctgctgcacacgccgccctgcacaacccccacccaggccctctgcttggggcccctgccccgccgcagccagtcccgggggcctaccccaacaccgcccccgggagacgcccttacgctctgctgcacccgcatcctcttcgctacctactgctctcggcccgcgtctatgccggggcaccgaagaaagcagaaggcgcggacctggcgaccccggcacccttcccgtgctgcagccctcacttggtcctcagccttgggaggagggcaagggtctggcgtcgccaccgggaggcggatgcttctctttcagcattgagagtattatgcaaggggtcaggggagcgggtacaggggctgcgcagagtttgtccccgaccgcgtggagctactgccacctgctccagcgaccatcaagcctgttgcatccccaaaccgctgcccctttgctgcaagtgtccgccgccgctgctgctcggacaattttgcagcaatagcagcagcatcaggaggactgcgccaacggctgcgctcccaccaagggcgcggtgctgggcgggcacctgtcggcctcgtcggcgctgctgaggtatcaggcagtggcggagggctctaggctgacatcgctggctgcccctttgggcggagaggggacctcaccagtttttttagtatcgcccacgcccagttccctggccaactccgcagggccctcctagagccaggtgggagtggggagcgacccgcagctgctcactccaccttgcgcggcccatactgggcgtgtgcatctgaatcccgctggagagcaaacacgaacttctgttcgttcgctgcaaaatggttagaaagattacattcctctaagctggattacgttcctctaaaaaccacctgaacgtaaccttcgcagggcgtcaagtcatcttttcttgccttcggttgtggcttctatggctgtcccgatttgcacattgtcatctttgaagattagtgacatagcattcatcttctgttgtcaccttttccgtcattccctgtatgcctgatggacaggtttcactgaagttcagagaacagcatgcaaaattagctaccaattaatctttatgaagtgagctgcatttctagccacactgagcttatgttttagcaggaagcatttttgggaaatgtttatgttagagtttgcccttcttgacaaggtgagacataaatgtctactttagagacatgaattaagatgggaagatatttgggggaatcatttactcaaacgctaagtaataaaggtacacaaagggcaaattatactagatttctttcccacttgttttctatgtctcttgcaattcaccttgattcccttcagtttctgtttaatgtagaaagtggcattttcattattttaagcttctagcacaatgaaagaatttctctttttcatgaacaggatcataaatgaaagggaggaagagtgtcctatatcatatttattgttcaacaaaacactgctccacggcttcaattcagtttaaaaaagagaatttattgaacatttaacacatacataaaaggcagtaaagacaaatgagaagagggggggatattgaa

SEQ ID NO: 661 - DNA, 3110 bp, Homo sapiens; identical to SEQ ID NO: 660

SEQ ID NO: 662 - DNA, 14717 bp, Homo sapiens
tgagtctatatatatatatatattagcagttgtatgaaagtatatgagtcaatattccatcaatacctagaaaaatagtagatcaatatgctgattttaggggtggacacaaaagtgttataagtgtcttttaacttttcttttttccctccttgactctgaagagaaacaccattttttctacgtatgcaaagagtaaaaattcagaactaacatgcagggattaatagcagtgaattgcaaactcaactcagtggtatagtacctggcaacattattactcagcatatttccctggctgaggctgacttcatttaaagtagttttatacttgtgctaaaaataagtgtacatcccattaagggagaaaagatcttctacacaatggattggacctacataaccttatgtaccagagaagaaaacatcattctcatgagtcgcaaagctttcttcttcttgtcaatatgataaacagtttccgtaaattgagaatgacgctggttactttccttcctcctgaacatgccacactgaagagacagggatgactccttccctatgggacagacacacatgtagctttccctgggttgtggaggaaggcatggccacaacaccattggcagtctgctgcagggacctcacgatgagaggaagcaatggatgcctgggccagggaaatgcatatttgggagaaagcaggaaattctgatgtagagatagggaagaaccctggggaaaaggacccaagctgggcggggaggaggaaaccaccaggatcccaggatcagagacaaaggacccagggacacaaacaaagtgaggccagatggagagggcaggctcacggggagagcaagctcacagggagagcatgagccaaacctggcttatttcacactcatcagagagactgcacagatggggccaaaccagggcccaggagcatcggagagaggagggccatttcaaagacttttgtaaaataagctcaaagtttctttgtttatttgtgggtgtgggagtggaaacgtagggaaagtgaagaaagtgggggaaaagggatgggtgattttgtaggcaagatgctccctgaggaggtcctggtggacctgctgtggggcgtggcattctgcacactctcatatcatggggagcgcatgactacattactgcttacacatctccaagtgcagcttggggggtgaatgtttaattgtctcactgtaactgtctaaatctctggaaaatgtgaagggtcatgcatttgatttaaacctatgaggtctgaatgaattctcctccatgcctaaccgagtgaagcaagtatataaccaaccatgcatccctaagcagggccggtatgaaagggaggaaacgcctccccactgagctcgcaaagaacttcatcactgacctgaatcagatccagcaggaaatgaaacactgagtacatacttttacagtagagggagggggacggaaaacaaagtgagctgaactgaaacgtgagaaagaacagaatggcagtgagtccacggggcagggccgcagctttcttttttcatggccctcagtccagtaaccccacccggcattcgtagcggatgacatcattgatgcccaaacatgctccagcaatttcctgctttccagagtccagccgagccatgatgtcagtggtgcacctgggtaaagatatggcagggccgggtcacagggagtggggacaaaggccaacccagttaaataaactgctggtcttctagggcctggtccctaggcaggcttccaccatgagataggtatagcccaggccaatcccaacaagaggaaaaaaagcatgtacttggccgggggcggtggctcacacctgtaatcccagcacgttgggaggttgaggcgggtgaatcacgaggtcaggagtttgagaccagcctgaacaatgtggtgaaaccccgtctctactaaaattggaaaaaattagctgggcgtagtggtggccacctgtaatcccagctactcgggaagctgaggcaggagaatcgcttgaacctgggagatggaggttgcagtgagccgagatcacaccactgcactccagcccaggcaacagagtaagactctgtctcaaaaaaaaaaaaaaaaaaaaaagaatgcacccatgcagtgcctcctgtcaccctctgcccagaaagggcacaggggccagggtgaaagagttacaggaagacagagggaaggaaaccatgcagacataaccacatgggggcaggccctaagctgctgggacctccacagtgtatccctttcctccaactgggagacggaagcaccgatggtctttctctacagtgccaggagccaccctgcccccagagatgccctacaatcaatgactaccatctaaatgcttctggatagtttcattccttgtagatgatattccaaatattataatttgtacttctccacaattacaattccagttttggggtttctttttactcattaaatttgaaaagccaattccagttttaaagcttgacccttttcttaaaagtttaacttctctttttattcaggcttcccactaaaccctcaaactgactctgagggtggcctgactaatttacaaaaccggccaggctgcctaacccctagattccagcccagagtgttgccataaattgctgtcaagacatgcctctatgtcccatgtttgccagtgagaaaagggttcatattctaagttcttcaagtctctctcactgcctcaatgtgaagtcaatggaaaacagtcaaatacaccaaaaattaacttcaaatggatatctgctatgaattccaacttggttggacacctctccaggccaactgttgtgaaaatgcattgttgttttaaaaaacactgtgagagatggctgggcgtggtggcttacttgaggtcaggagtttgagaacagcccggccaatatggtgagaccccagtctctatgaaaaatataaaaattgagccagatgtggtggcatgcacttgtagtccacgctacttgggaggctgaggtaggagtatcacttgaacctggaaggcggaggttgcagtgagccgagatcatgctactgcactccagcctgggtgacagagcaatactctgtctcaaaaaaaaaaaaaaaaaaaaaaaaaaaaaaaagagagagcgagagaaaacactgtgagaagaaagaagtcaatcaccccctctccaatgcccaacacagtaagcaagaagggcccaggaaaaaattaacagggaaaaacaatcttgcatttgcttagtggaatctggggtttgcacacattagtcagagctagacaaatcatactgaatacacttcttatagaaacattctagctcttatggcctttccttgctgtcccaacttttgaggtgcgaaaacacagcaacacagccaggaccggccaggtgatggcacggagcccgctcccacaggctgcgtgtgtgttctcactctcttgcaactggcctgagttaagccttctccccaagcacttgcagtttatcatcgccctatttactgtattttcatgttataaaagtgatatacacccaacgtagtaatttgatctatacaaaaaagagaagaaaaaaagctactcataatatcactgtctaatttaaggttttggtgtagtctttctagtctttttctatatggaatgtaatttacttctcaaaaatatcatttcatattctttgcttacatattagcatttttgtcatgaaatttatgccaactgattaaacagcccttgtaaattacagaaacttaaagacaatatcaaaacaatgtgaccacaagacaaagaccacctactactaaattatttttggcatgagattattttttgagaagttttataaactattaggtttattgaacactataaactgtaatccttgaaagaattttggaagcatacgataacagggtaatttgtagtagaatatagggttggaaaaccttaaaaaacacttgctcatttcttcctatatcaaagatttgtattagaaaatctatttcttacaaaaagatgtactaagtggtattatgtcagtcaagcatcttgtattattttctagctttcaataatatgtataatgtcataaaaaagagggaagaatacacaaaatacatatgaagcttactaggaatgaagaaagttattttaggaaggaaaaattggttaccatcaaggaatatggaaaacactagcaatgcatgtaagaatgacctcaaaggtcttagacgtccacgagctgggaatgcttgtgctgggtgcttcagttacaacagcatggggaagttaaatagactagtgaagctgttacatcagttaatagtatttattattatttgtggtcaccaatgccaattaaaacaataattaaatagaacatgatgaaataattcaatggtaggaaaaaaaaatctggcctacaagtgaacatggaaagtaaaagtaaatatttagaaagtgaaatcaggagtggaaaaaagctccagcatctcaccatggggtcttccaaagccagcagtactggagatgtttattgttcaaagatggacttgcttgggttgggattctccaactagagccagaggggagattctctgcttcccttgaggacacaaaaagagaggctttcttataaagcctgccacattctgtgcctgtattgttttatttactggagtctatcataaggcctgtgaggaaaggactgaatctctttctcatagccgttgggctgatggccctgcgtgctgtaggcatttaataattcactgagtaaatgaatgaaccctgcaggagattgggagcctttctgatcttgaggtctcagtttggactatctttctggaatggatagacgaatatgtttttcagcagcactctaataagcgcacattgggtgactaagcagaagagtgattcgttttgctagaattttccaacctgcaggagccagtccccctggtgtccccattccctgtcccctcagtcatctcagcaggaaattactatcctttctcccacatgggtgatgaatgttcaaggcatttcagcacactgtggtaaggcccagaatgggttcaagtaaaagtaaataccagtccttattaggagatcctggcccctctgctgcatgtgtcccagtacacatgcagcttcctgctctgtcatagaaagcagccctctagggccactgcctccagtgagagtttcctgacctccaggaacttctgtagtcaggcaccactcccttccctcacacccaacaccctgttgttccagattttatcactgtgcactgatgctcactgcgaccccacatgtggccacaggaggaactcggctgagggctgagaagaccagataatgacacagagggctcacttcaggaaacccagagagctgcagcggctcctccagggccattccacgcattcattttctaacaagtcataagtcaaagagtgacatcaggagcggacagcctggtgtccaggcatgagccatggcaacagattctgatttcccagaacggctttggtctttacctggtgttggatatggtagtgttagctggagtgggaggagattcacattgtatatttgtttagtgactccaaagattttaaattatattgtgttttttattattttattccatttttttagagacagaggtctcactctatctcccaggctggagtgcaatgatatgatcataggtcagtgtagcctcaaactcctgggctcaagtaatcctcccatttcagcctcctgagtagctgggactccaggtgtgtaccatgactcctggctaattttggtttaagtagagatacagtctggctatgttgcccaggctggtcttgaactcctggcctgaagcaatccttctaccttggcttccaaaagtgcttggattgtaagtgtgaaccactgtgtgggccctggtttttgtttaatggctattaaatgctcagaagtgaattaaggttgcagttaaatgcacaatttttatatcaaactattttctttgctaattcacttctatctgcgtctaccagctgtaaactacctgaagcagagaaagtttctttaggttggggcttcctgtagccccgagctgagtgtcttatgcagcattggccgagtgaatgaatttgttgggtgaactgctgcggggtttagagtccgcagagggtaggacaggacagatcgtgatagaggctaaccttctcatctactctaccatttcatgctctgtttgggcacctccatcacccctcacttcccctgatggtccagtctctctgggcctgcactgtccagccaccctcttatccctaagccaaggcctttgccaactaaagctcaggagtaaagtggccatcactgaggccattctatgtatgtatgtatgtatgtatttagagatggagtcttgctctgtcacccgggctgaagcacaatggtgcagtcttggcttactgcaacctctgcctcccaggttcaagcaattctcctgcctcagcctcccaagtagctgggattataggtgtccgccaccatgcccagcaaatttttgtatttttagtagagatggggtttcacccttttggccaggcaggtctcaaactcctgaccttgtgatccccccaccttggcctcccaaagtgctgggattacaggcatgagccactgcacccggctgactgaggccattctaaggaatatacagcaagctcttcagtacccatttttgttaactgaggtataactaaatgatacacaggcccagcacagtggcacaaacctatagtcacagcaacttgggaagctgaggtgggaggattgcttgagatcaggagtttgagtccagcctgggcaacacacgtgtataggtctatgagtctggaagaatgtatatagccatggaatcactaccatgtcaaaacataggatatttccattatcccaaaaagttccctcctgcccctctgcagtcaaacacttccctcccccaactcctggcaactgctgatctgaactgtagacctgaaaatgtcattcagaacccatttcatctggacccttctctctgtgtcaacattgctgtgagcggtgtctgtgggatttttctggacgttctctgccatgcccctgctccttccttcctgccttctggaaggcacccctgccaggagtcggctgcattaaagtgggtgtttcaggggtgtcttcctttactctcttctcactgatttccagctatccctgtgtctcttgtttaatgagtgccttcacccatatccttaaacccaccagggcgaccttcctgcccctttctttggagagctgtatctgtatttccagtggagacacagactgttccttagatcctattaaccctctgagctctctctcttcaagccaggctcatttctggcttggccaatctgcctcctcccgtgtcctttccatgacacggtgatggcatcaccagccagtcaccaagctagaacagtcccttcacccggcccctactgtaggaggatacttttagagtatgtctgcaattcacccccactctctgtatctacttctgtggccaaagtgcggaccttgatttcctctggccccagctgaattaacccacctctctgggcctggttctcttttcactaaacattctccacattgctgccagagctatttttctaaaatacacatcagaccacattcttctcctccttctttaaaaacaaaaaatcaaaaaaataaaaaaccaagaaacaaacaaaaaacccaccctaccgtggctcctcagtgtgtagagatcagattcaagttccgtgagatggtcttcaagatccttggccatgtgaccccgtcctgctatcccaatcccattcccattcccatccccagcctccccacctcatccaactccagccacattggatcaccccaggagaggatgtcatgtattagtactctggtgcctttgagtcaaaactcactgttttgccagttcagaggttgagccctttttgaagaatcccctcttcttccacagcccaggtaagttctaccccaggcataatgagctgttatccccctgggatctgagggcattcagaataccaacacaatgctctccagatacctctatgctattcaaatccatgcatctcacacctgctcatcttaaaatctctgtgcctcacatgcaggaagaattcaaatgatgctgattgaaaaaacattgtgtccaatattagatgaagcatgtaaatatcaaggcaagaatctgcactttttgtctgtctattgcttgtttgcacaatagagccacatggtttattataaaaaattattataatgtatgctgtttaagctcagatcactttgcactaatgatgatgataatgatgggttagaattttttttcttttcttgccatgggatctgccaggttttaagaattcttttttattctaaaccaaattcaggagcactcccaaagacaagaaatcaaatttaggccactgatggtaccaacggaaggctatcactgtgtagctataccaaatgaagccaatcttcatggattttaagcactttgataagcttttatatctctgctcatctcgtttacctccatagataacacaaaataacagaataatcaaccaatagcaacgtaatcccatcacaacaacatcaaaaatgagaattcatatgattcagtaatttcctaagccagaacttcccacctgatgtgctggggaagtgagagggtgaggactgctttccccagcccttagggtgactgggcagatcctgtctggtgtgagcattcaaccctactgattacatcattttgggtgctatgtgtgataaaggttgacaaccactgtcctaagccattctaccatttaaatagactgaattctcccaagttatgttcttacttgccttaggaaggaaattagtattatgactctaaggatcctgaacacatgatctaaaaaaagaaaaacccaaagcacaatggcaaaggtaggtgagacagagtgtttagaaaaatagcgaatactgtactattaattactcccaattctccctaatccatgatttttaaagagcgggtggagcataacgatttgaggcactgcgacaatgcagaatggggagggattttggaaaatgtgactcactcaccgttccgaccaaagggtaaatgaacccagcacctatgctggcccggacatcactgataggtaagatgaagtcccttggcacaccttttttgtcaggttggtgagacagagaaagatcggtctttgccatgcagatgggcaaatttccaaaaccctgtaagaaaggaaagaaaatgtgttcactgatatagacgtgagtctcctgtgtttttcaatttgcactttatacagtctcggcagcaatggtatgccagctcagatcgaggcacacgcaggagctgcttgttactacttgttcactgaagaagcaagaaggtgaggataaaaactcatctccatgtgatgactgtttagtaggtcaggggtgactattgtttattttggaggttctcgttaagagaaggcagtgttatgtgcatgtttgggaaaagcattgctatttgcaggcaaagcagcagctgtagaaaccgctttccaagactattaatatccgggacccagcaaggtagtctggagaaaggctctgcgactaggctcttagtcatgttgttcactcattctggagtcagtcaagaagcaaagggttcctttgtgttggtttatgaatcatggttatttgatctgcaactacattacaagagctaagatgaggtcactatttaagcttcttgtttttaaggacaaaagtctatgtctgacccagagttccaaaggtgaaagagcaggaagtcacatgtggtgtctcacaaaaagcacagtgtcctataagcctgtttctgattaaatggcacacagtgttccttcagaggctttgctaattcattgcaaccacatacttggcactaactttaaaaaaaataaaaatagagatggaggttttgctatgttgctcagagtggtctcaactcctggcttcaactgatcctctgccttgcccccacaaagtgctgggattacaggtgtgagcaccgtgcctggttgacacgacttttaaggagtatttccttgatagagataaagggaatgaaatctttagtcaaattttcataagacttagcctaaaactatttggaagatcttagagtcttatcaacttagggaggacttgggcttggggccattttctttttgaaatctccactcttctatactgataagaattttgctgagtgagaatcacaactgcctttcagaatggtgccagaattttgaatttcagacatggttaaatattaaagtaatttctataggtttgctaatgtaaaaattttgttagtaggcatattaaaaagaaacagaaaccaaccagtatgctatatactgtcaccagattacttcataaaagaaataacattttaacactgaaaggagaaaagacttaatattacaataaatgatagtcttaaatatcattattaaaaactcggggaataaaaaacaaagcaacctcatgagaatgaccttattttacttggttcattgcacatgaatgaaaacttcaccacaatgcctaggcacagagcagtgcttgggaatcctttttgtaaagggtaagccaagaacatcagggaaaattctaagaatttagaactttctgagttcctattttaccaaacctaggagaacaaataccctggctggcaatggtagcatttaacaaaatttcaaatgggtttacaaaaaagaataaggagttggagattgtttttaaagataaggtcaacactaccaatcatgaagctctttagccaacaggctcttaaaatgttctgacttctatctatctgattacaccaaagtaggagggacactggaggcacatgatccttttggtaaaaggtggctgagcctcctataatggagttgattcatcatgactgtcactggactaggtgatgacacatgctgtcagatcgtagccactttcccagctgtttgcctacttgcctttctcagtggctagaggtagaagatgatggagccttcaacctcagtggaccagctcagtaaaaagccaatgaaccgcttgcataagaacagcaaacattcccatctttataggctgcactcctatctgcctaccctggcaccttgctagcatttttaaggtagtaagaggcctgtaaggaagaggaagcattgcaattcatgcaaatctgactccgcagctctactccaaaggatagtttcaacgttctgggctgagtgggagggatgaaagatcacacatcacctacaaacagggataccacccatatcagacacatttatagtcacagaagtaaatgatgcatggatcagaggatacatgcctcaccataaagttctaaatatagtttacactctacccgaggatattgctttcatctttgttaaccagaaaatagattaagcaaaggttagctggtgagacatgtacaaatcctcaagtcaagctgagtattctgagagcctaaggtgaattttttcttttcccctaaaagtacaacttttacctgctgagtgtaacgatctattttgacttgtgcctcaggacagagttcgatatctttggctccatagacagcctgggcaatggtccttatcttgtccacaattggaagctgcagaaacacaaattataaaaaaattgtgtaagtttaatctggttaaagatttttttaaaagtttagtgacacttactgtaattgcttaaaattcccttatcagggtaccccctcagcaactgcaggattccttgcaaaccctcttttttccttttagcaccctaaagcactgaaattttcagtgtcagaatagatcggatgtcaactagcaaataagccttaggtgttcaggcaatttagaggctgcctagagcccatgtagaatctgcagagggaggccgggcacagtggctcacacctataatcccagtactttgggaggccgaggcgggtggattacctgaggtcaggagttcgaaaccagcctgatcaatatggtgacaccccgtctttactaaaaatccaaaaaaactagctgggcttggtggtgcatgcctgtaatccgagctacttgggaggctgaggcaggagaatcacttgaactgggaggcagagactgtggtgagacaagattgtgccactgcactccagcctgggtggagtaggactccgtctcaaaaaaaaaaaaaaaaaaaatctgcagagggaagagggaagttagtgccttacagagggcttctgactaggaagccccagaactgcggccgaccccttcctctccctgcctcacccctgcagaaagatctgcagaaaaagctggaaggggtgggatggtgtgtgtgggggtggggactggggctatgcagtttccagacctggtctttggcaccctctacaggacagttccattcccacacctgagctttggacaactgaatcctatgccccttcccacccagggaacctggtgccagaaattcccaggacttacccaccatccaccacgccacatagcaagtgtcctcagtgtctgcagaccagaaacaactcccttgtgtctcagcactgggccacctgctgaaaccccaaactgcctgccccattgtttgagacccagtcaggccttggctccaaaagtcctcttggactgccactggcccccagggtctctcctgactgcacctcggtcccggagctcccacaccgctgggccccgagccccatgccccgatccagctgtggctcctttacgggggccttgctggcctttcctaagggaggtgttttcccgagggcaggtggactgctcctcagactaggggccctcggagggccaggcctgggcttctacctcctctcgcaggctggtgtttctctgcaaatatggctcgtgtgtcctccttcctctcagactgggggcccctgaggactgggcctgagtttccctctcccccttcagaatgggggttccctgaggactgacccagggcctccccccgtcccctccatctggctgttaatctccaacacttccacctccagtcctattctgcacagcgctccccagcgctgggagctcagaggcctcttcagccttccccagggctggggctcagggagggcttcctcaggcgctggccccagagtcaggctgcacattggcttggaggacaggcctttcctctgggactgtgaggcccagagtgcccacccagaactccacctctgacctcacaaaggcctgcttcagaactcagtctccactgcactgctggccagacgagggaagttattttgggcagtgcatctggacttggttcaagtggcaccagccaaatccctgccttactgacctctcccctggaggagcaggagcagcgctcaaggccgccttgggagggctgagaggcaggctctggactggggacacagggatagctgagccccagctgggggtggaagctgagccagagacagtcacagaggaacaagatcaagatgcgctttaactgagaagcccccaaggcagaggctgagaatcagaagacatttcagcagagtgagtggggctccaggcagggtggggatggggcagcctcctcagtgcccagatctggaagggtcattccctgggtaccatacagcgaggaggtgactgagggattgtttggggaaggagccccggctgggagtggaagtcccggctttcttgttatggtgcagtcctgtgttgctgtgtgacacaggcacatacaccttctctctgggcctcagtttccttacctgtaagttggttgttgggaggaccagcggtagagcagagatggcagggatgcactgggctgggctgtcagcagaccatgggggtgggacgaggagagagctgaagaccaccggcagtggaccacagggggaggcatgcaggccagagacgggtcagctgccggcttgctggagtcattcctcccacgcagtcccctcctgaggggctggagctggggctggagggtttcagcagtcagggctggagataagagtctgtgctggagctagagggaactgggctagagaatcaggaggacagacagggtgaggggacttcgggctaccttcatgctgtctgttagagataaagataggagtacaaaggggaatttttgggtgaggtacacgggtgaaatgagttttcagggcctcatcctgtgtgttcaccttctgtgtgtgtgtgtgtgtgtgtgtgtgtgtgcatgcgtgcatgtatgtgtgtgtgccggtcctggacagtcacagcttaagttagcagcaagagaacttgaggttaaaggtatagcacgcaaatatgaggctggagccactgagtagaggctgagggcatctccacagtccaaagctgggctgcagacagggaaggtcagcaggagcact

SEQ ID NO: 663 - DNA, 4949 bp, Homo sapiens
gttagaggtgtttaaccataactactattcacgaaaaaggtctactcattacaactgaaaatcataaaattgtaagttctacaaaaataagtcaaccttatctactgcccagtcctaccaaactacagaatgtgagaacagaaggtctgaccgtggactcgagagctgacattaggaatgtcaccaccatcctgctctccaaggactcctcatcttcaacaaactcctcatcttcaatgggcagagtggaaactgcaacttgtgccatgatccttgcacaagaaaagtagtaagaaagtgagtggtagaaatccagtgtcctaaactcacatccagagctgtgagagcttttccaccggctggataattcacagttttcttgaatcaggggaaaaataagactcagaaactaggaattcgttttgcccaaaactctcatcagatagagaatccatccactaactttctgtctagtattatttccataagttagatcagtatcactcccaaaacaaatgcacatggcacccagaatctgcgcatttctcccaagtaaaagaggaggtggatgggcgcagtgtctcatgcctgtaaccccagcactttcggaggccaaggtgggtggatcacttgaggtcaggagttcaacaccagcctggccaacatggtgataccgtctctactaaaaataaaaaaaattagccaggtgtggtggcacgtgcctatagtcccagcttcttgggaggctgaggcaggagaatcgcttgaacccaggaggctgaggttgcagtgagcagagatctcagcactgcacctgagcctgggtgacagagtgagactctgtctcaaaaaaaaaaaggggggggaggaggcaatgcactttacaacccagtgatgggctaccacaactcaacacagcaaagaggtgccaagctccctttctcccctgcacaacccgacacagaagagttggtgcagtggaatgaggttgaatggagagaagttcctcttctttccatttttttttttttttttttttgagatggagtctcactctatcacacaggctgggtgcagtggcgcaatctcggtcactgcaacctccgcctcccaggttcaaccaattctctgcctcagccttccgagtagctgggattagaggtgcccgccaccacacccagctaatttttgtttgtttgtttgtttagtagagactgggtttcactatgttggccaggctggtcttgaactcctgaccttgtgatccacctgcctcggcctcccaaagtgctgggattacaggcatgagctgctgcgcccagccaagaagttcctcttcttactgagaaaatggatcacagggcatcaagtaacacataaaattctttataataagcagtattatttttggaaaacctttcctaatattttggtatcagcaaaaaccctcagattaatttcaaacactataaaaatacaatacataaacagaaaatattaactgtcagcaatgctatagagaaattggaagctgtatgcattgccttttggaatgtaaaatggtacagcccactgtggaaaatggtttagcagctccttaaaaatattaagcacagaattatatgatccaccaacaccctttaagtgtatatacccaaaataactgagagcagggactcaaacaggtatttgtacacccgtttaacagcagcattattcacagtggccaaaaggtagaaccaaccctaatgcccatcagtaggtgaatggataaagaaaatgtaatatatacatacacagagtattattcagccataaaaagaaaaatatctggccagattcaggggcttacacctgtaatcccagtattttgggaggccaaggtgggcaggtctcttgagccccgaattttgagaccaggctggacaacatggcacatttggtcagaagtgtttgaccataattactattcaagaaaaagatctactcattagaactataaatcataaaattataaattctacaaaaacaaatcaaccttatctaccacccagtactacccaattacagaatgttagaacagaaggtctcaccatggactcaagagctgatatgagcaatgtcaccaccatcctgttctctgcggactcatcttcaacagactcatcttcaacggactcctcatcttccacggactcctcatcttcaatgggcagggtggaaactgcagcttgtgccatgatccctgtgcaagaaaagtagtaagaaattgaatggtagaaatccagtatcctaaactcacatccagagctgtgagagtttttcactggctggcaaattgtttctttgcatcagagaaaaaaacaaaacttggtaacttggtattcgatttgcccaaaactctcatcagatagagaattcatccgctaactttctatctagtattatttccatgaagttagatgaatatcactcccaaaataaatccacgtggcaaccagaatcaatgcatttctcccaagaggaggtggccaagcgcccacatctgtaatcccagcatgttgggaggccgaggtgggtggatcaggaggtcaaaagattgagaccatcctggccaacatggtgaaaccctggtctctaccaaaaatacaaaaaatagctggatgtggtggtctgtgcctataatcccagctacttaggaggctgaggcaggagaatcacttgaaccagggaatcagaggttgcagtgagccgagatcgtgccactgcactctagcctggtgacagagcaagacttcgtctaaaaaaaaaaaaagaaaaaaacagtaaaatacaaaatgtctttttctcctaaccttcttagccttctgctggtacttcaatttctgctggtactgtttggtcattgccctctaaagaatgatggcttcctaaaaagaaaacaaacaacatataaaccaataaaaactcacattgaaagataaaaaataatctaggtgacgatgcaagcacttttaagacataataggccaggtgcagtggctcacacctgtaaacccagcagtttgggaggctgaggagggcggatcacctgagttcaggagttcgagaccagcctgggccaacatggtgaaacctcatatctactaaaatacaagaaatcagccaggtgtggtggcaggggcctgtaatcccacctactcgggaggctgaggcaggagaatcacttgaacccaggagacggaggttgcagtgagctgagatcgcgccgctgcactccagcctgggtgacgagagtgaaactccatctcaggaaaaaaaaaaaaagacataataaacataaaatatgattctattaactctattaatccaaataacgttttctaattcagaagaaatatataacatgtctatttggtagcttaaaaacattcttttaaaatacaaatacagtagacccaagtaggcttggggacttaatattagttactctagctacatgataaaattactggatattggaatctgaagcagcacaattatgctacaagtaccatgctcatctgtcactgacacacacacacaagtgtgaatgcctgctttgctcaattaactctgtaaataagttcaggatttgctgtggaatgttccctgctttccattttcactatggtgaaagttatggaaactcgatccccataatttaagcaaagttgtacttaaagtaactcatatgtaaaaatttaagatactacctttagtgtcaaaaacattttaatccaagtaacgtaatctgcctgcttctaaaaactggcatataaagcaacagatctgttaggcagtcacaaggtaaacaggctcatcctactggagcagaagttttactcacaaatatgaaagaaataatctaaaatatcagagtgccacttaggattaagaccacaaactgcccccagtacacatcctctgtccttaaagatctgagctactaacatggaaaagattgaaaaacactgtcttcaagtataaataaaaatatattacatttcggtaagaatacattgtttagggggaagggaagcagatgctcatctattttgtcctatctgttgataactaaattcagaagctgtactaaaagtcaaacaaaagttataaatacatctcaatttttaaagagcaatgattacagtcagaaaaactcatttggtggctagtattcttgaattaaaagtgccataccaaagtgaaatctttttggttttcaacatctagctttttcatgtcacaattattttgggattcttttccacttactgcatattgtgaaaactcacctgaactcaaaactctaggtaaatctataaacctgtatctcagaatccacctttaattcatttgtaaaatacactttctctgcacacatttcctctctcttcttttaaccgtaatatttggatttagggagcatcaagttccttgactgtaaagtcaacgaaaaaagagatatgaagtcaaaagaatgggagataatgaacaagaggccagtagttaaaaagtaaaatttcaataaagaataacagttaagatggtcgttcatgttattacccaaacactaggggtttcgtccaggtcctcctgctcatcggagaaaaagccagtcactgaggtgacaagtactgccaaggaagaaagctttaacctggtgctgcggcccaggagctggaagctcagtctcaaatccatgggcttgactaataggggcaggaaaaaaatttaacaatgtataagagaacagaaattagggaggggcaggaggcatgtggtgctgtgatctggtatgtttcagttatctgatacttcctgaaggtctttttttgaggagagaactcagatacaacagatccaagtttcaagctttaacagcagggtcaattttgacgttcatc

SEQ ID NO: 664 - DNA, 6230 bp, Homo sapiens
cttataaataaaaaaccatatatattgtggaatattaaatgttctgcatttactaacatgagagaaaatattttttctctacatagagtgaattttttcttggggacttgtttttctccagggaaggctaaaaaagaatttgtgactgaccaaatcagataccttcccaaagaagacagtgccttggacagtggtgatggtggctagaggcaccggatgtcttcggccagtgctgagggggactgactggggatacagctttcttggggtgcaagatttggggatgtcgcaggccccattgctcattgttgcaccgcacacttttcaagggctgttgatttctgatttgcctgtctctgttgggacaaccctggctcttgagagtggcttgttgactgctggctgcatagctcagtattctgccatgttctgagtagaagaggtgcctgtggttgcagggaaacccacagactggggcttgaaacttctgtttgtgctgatttaccttcgaggcatggtgcgcatggcaaagtgacattttcttgtccagcatttgtccaactgccgtcatgagaccctgagcttcagcactgctgctgtacacacatgatctgttttttactgttttttggctctcagcagtgactggtgctggcttgctttttttctttgaaaaaatccactgaaaaaattgcttgatgttttctccaaagtggcttactgaaggaggctgtttctttgatggcagtagctggacgccttcatcctgatgggtgtcttctgttttcctgactggggtaagttgaggagtcctcaatccttcaagcctttcttcatgtttttctaagttgggcttcctagacttctcactcttgtgaatagggggaaacattggcctttggctcttgcatgagccttgacagtttgggtttctgggctcctcttgcaccagtttgctccttctggctgccatgaggtcatgtagctcctgggaagcccgcatgttcccagtaggcatgctctggagatggccctggggcacttgagaaaccaaattctctgaagcgtggggcacaacagatgcttgcccatctggaaggagcacaacagcggcacaaacttgaggctgggtctctgactttgtggccattccaggctcaaattcactaacaacctcctccataagacacagctttcttggatcttgggagacagacactctagggtgtagagagcttttgctggtccctggagcctcgaaaccatgcacatcctcacttgtggcttggaggtttgccagcatacaggtttccaaggggactctgcattgtggcactgcctcccttgtctctccagcctttgaagattgggctcctaagctcctgctctgctgggtgctgcctgtgaggctgtacgtgaggggcttagatggccacctgccctcctgtccagctggaggaggcttcaagggcccatgatcattccaagatgggattcctcgcggtgccctctggaactgcttccatgcaggtgaggaggccagaagactctctggcatgtgatcagatgctttggtcagcacctgctttctcagacttgccattggtggctttctaaggaacatgtccacctcaacttctgagccagccccagattcacaggtggctgaggagggaccagcaagctgcgtaagggacaaggatgaaaccttttccagtttaaagcactgaatgggcttgaggaccctgaggggtagaccccacctgtgtttggcccaaaacctcacaatatgggctcccaacccctgctgagtacacggctcgaggaaggaaagcacctgggctgtgttcacacaggctttcccacttttcggggctgctagattgctggttttcacatgggtgttggacacgggaagagcctggttgacagcaagccaggatcgacgcacacgcacggggatcaagccctcgttggtctggcccaagttcctgcccatgtgggctttcaggatgttttctatatgagtcctctctgtgcatcttaataaatcacttcccgagtcactcctcaagggcttcctcaagttcctttccgactcctcagaagtcacccccagaaccttccgtgggaagcttttcatgtccctggatagattttgtggggtctcacccagaatttgccccagatgtgggcacaggtccctctctagctggaacttcaccttctgtgcctccttgctgctttcacctgtggacgtggaggactgccagggactgggtttgcccttggcctgacttgtccctggtgattcgtcccgaagctgcatcagatccagagactcttggatccttcccaggttgccccagtgttggatgatccacttttttatgtgttgctccagttgtctccggagttcaggactgactggaaagttctcaggcagaatggatgtcaaactttcctggggaaggttaggagtggagacactaaagacgtcctgagatttttggaccctagagggtaaagccaacctaccttctagttgtttcctcaacaaaggccattcagggtgctgagtttcaggtagggagagagcttgcactttattctgcgatgcagggcaagctactccagtgttcttaatcagggatggaaaagcaggagataggactgggaaagaagactgaagatgggcctgagcctcggcctgagccataggtgtgggcaggaattggggtgtggatgaaataaagggttggcggtgggacaggggctgggcctggaaaagcagtggggacattgtagtctccctttgaattgggcagacattggacatttcattgaacaagaaaggaggagactgtaaagtataagacctgtcagttacccaggcgttagccaccagggactcgctgtgcagagaggggaggccccagaaaagctggctataattcttccaaaaactttcctgcaagagcctaggatctgagcacttctgaggtccgggcagctgtttcgagttctctcccatgttccagaagggttttgggtttgtggtgtcctgctcagcatccaatgatttagccaaattccccaaagaatttaagtgcttttctggggtcatttgatttgtaaatgatccaacattttctttttcttcccaaatgttgaccttggctgtttctgtgacttgtatccccacgacattctggccatcagagctgagcaaaaacaggctaccagcttccatctgacaggtctctggtgggtggcgggaaagaggatcttgctggactgatgagttaaaggcgcacgaggttctggcagtctcctgccaccgggaggaggcagaaacatgactgtttgagccaccaaggcctgagatggctgggacagaagccaccaaatcctcatgtggagacaagctttgagggacggtgcccagtggaagtgccactgagtcacagtgagatggagttatcagtgtggagtcccgcaggggaggagcagtgaagccttttggaggaggcggagagcaggccagaggatcaggggtgtgtggtgggtgagggaaaagtgcaggtggctcgggtgaggggtgttctaggggaagggaaggttctggtggctgggaggcacttagggaggagactgaggtggtcattgggcctggtgatggggtggaggccagatcctgaggatgcttggcttgaggatccggggaagctaacggggagagaatgggagcagcatcttccataggctcatgagaggactgggaggctccatcaggtgctctttcgcccacctcacctggggggtctggaccggagagctgaccaaagtcacctttgtcaaggtgtggccccaggaggctgcaggagacaggaggcacgagctgcagccaggagccggtggggccggagggcagagtgggtgctcgggccacagcccctccaccatcccacaccctgattgcccaattctcctgctacccctcgccccagggttttactcccatcctctgtccccctggtctccccatcccaggtcagctccaggctgcctgtggcccttgggtcatgtcccagccctggtaggaaggatgcagggaaggggaagtgcctcacctctgcagttgtgaaagaaggtccgaagtctcctccaggcctctcgggcactctctaccagctggaaatcaggagactgggttagggcagtgagggaggggcctgggatctcacaggaggctgagtggctgtttctttagggaggaccatggggaattagaccctggaccccacccatctgtgtccaaagccacatgaccccgacgttaatagcaaggcatggaggacagggctttttcattcacaacaggcttccacacacggaccccccacccccacagtcctcacaactgccctgtggggagaaaggactgaggtggtctcaaagaggaatcagccttagcagagttggacagctgttcccagggagcgggaggccccctcacccccctccgcatccaggcaggcattggtctccccaggacacacacactgccccctgctgggtaacgcccagtccctggcccaccatggcttcattcccgcatggaatctgagaaggacccggggttctgatttccttcctaggagcccccacctcaggcttcttcaactgacttcttcagagtcagttccctccgggacagatgagatcaaattaactctagtgtgctctggcagagccttacctctcagactgtggtttttcatcctgcctctgggcctccgcctccgccctactggacactgggagacatgatgacgtacggagacaagatgacgcggagagacaagatgacaatgggagacaagaaagggcgagaagctaggactggctctccctctctgctccagcccagccgcagcatgctgcactcaggaaccgcatgactctctctgtcttgctcagggagctctgtgtgcttcctcccactcatgtttaactggatgataaactgcttttcttcttagaaaaacagcaagagggggctgggcgtggtggctcacgcctataatccaagcactttgggaggccaaggtgggttgatcacctgaggtcaggagtttgagaccagcctggccatggtgaaaccccgtctctactaaaaatacaaaaattaggcaggcatggtggtgggcgcctgtaatccccagctattcaggacgctaagacaggagaatcgcttgaactcgggaagcagaggttgcagtgagcctatatcactccatttcactgcaacctgcgtcacagagcgagactccatctcaaaaaataaaataaaataaaataaaataaaataaaataaaataacacacaaataaaataaaaataacacacacacacacacacacacacacacacacacacacacacagagggattttcaatatgaggtccaccacggacaccttcagtccctgttcctctgctccaggaacacccaagttcaggcccgcaggcactgctgagctatcaggtaggattctgcttcccagaagaccagaggagacaccaggccctggtgggaggccctcgggggcccagcacaggccccagatcaccccacacaggggaggctgggccctgagccacctgccccagaaaggggctgatgagccagggctcagggcctggtctcggacagagacctccccagtctcatgactggtactggtgctgagtccactggtttgattttgccttgatgcctcctgtgctcccccacagatggactgagatcttgggatggaaatcccagtacactatctacccctaccaacccctggctgccctgcctctccctggaaggatgatgttctggtctcttctgagacttcccatcatagaaggctctccactggatttggaaaagtggaactaataataaaaagaaaggagagaatcaagctctgtgggtcgggactgagggttccttacctttctcttcccaggcgatggtgagggtgggtcatcacaatggaagtaagataagtaggggagtaataggaagaagaaccccagggcaaacaccaaggtgaggaagatatccaacacccatggtgtggagctgggggcgtttagcgatgaggcactaagtaattttaaaggaaagggaagattctccatgtgaataggcacgttgctttcaagcaact

SEQ ID NO: 665 - DNA, 237590 bp, Homo sapiens
gagagggacggaggaagctgccggtataacgggaggagagcgccaggcggagctggggcgtccctcccgctcgcttcttgactcgcgttggtgccggccgcctcccgcgcctagtgtccgggacgcgcctgaacctgccgcctccgtgcctggggcggcgccgcgcggcccccaggctcccgcggggccgacctcggagacgcagctggggccgggcgcggcttggcgggagggtctgcagcgccgagggaggctgccagtgcgtgaggaagagagctagagactggacaggggagacagagcagcgtcggagccgcgcaggggacgggagtgagagcgggagtgagagcaggaacgacgcagagcggccgtcgccgtgcccgggtctcagggcgcctggctgaagtgagcatggcttcagtggcctgggccgtcctcaaggtgctgctgcttctccccactcagacttggagccccgtaggagcaggaaatccacgtaagtacagcaaatggtttaaaacttgcgctaggctgtctggaaaactttgtatttttttattatcggtaatatttggaagtggaattgcagaacatgctcctgaacatgaagaaccttaaaaaaatatttggaattgcaacccgaaaaagacgattttgtttacaatagactttcctcttgtgggggagtctaagatataccatgcatgttttgactttttaatcgatgttcttgaatattcattgagaaagtggccgtttctgtaaaacctgaaaagagcatcttaataagagattagcctgcaaatgctgtcatttattcctttttaggattgtaatattttgtaggaattaagtctaacagggaaaaaactggcagacattacatcatactgcatcaacttagatgttagcagcttacagttttgccgaccttggcagcttcagagttaaaatgctaattaacttccacgcagtatagggacagagtgcctgtaggcgaaactaaattaataacctgccctaactactaagggaataacacttgaacacccctgtcaggggcttcgtttctcagtagaaagttcttggttaaagacaaaactcagccagtcatttaggtgatcttgaaaatgattcctctctggatgctaatattttacattatttaatttgccatcgggttccctgttttttattttacttaatttggtaaacacctaggaagcttttatttctagaatgggctatgattctaatataatgatgatattccagacagatgagcaaaacataatgtacccatattttatcacacataaaaatgtttacacaacattgcacatttttttttcggcttggagtaaatctctatcagagagtcgtctttctttcttgattaatgaaaccatgagattagaatttttaaaatgtcttcctcctccttctcaaatcacttttatttttctttcagtggcatctccctgctgtcagcctcagccctctcctaccaaaatctctttcgaaataagttccaataaatgctagtggccatgtttggaaatttagattattgcaggataaccaagggtagctttcagcagttttcctaagctgtcatgaaaagtttgccgtagctcagtgctgttctgcctgtgggctcaagggtgggttgtttcttcacacacagggcacgcacatgggttcatgcactcactgtgcatcatgattcagttgtgcctcagttaatcctacacttggtgtgcccttcgaaaaaacaagctccggattgctttggtcagatgctgtaccgtgtttcagattcaactttaatctgcttttgtgagagggctttgtgaataaaacgttgttacttaaattaaaatccttgggtcttgtaatggaaactgccgtttggcttaaataaacacataaatgagttacttatagaaaggcatgctagagtaattgaccaatcaactggcaaaatacaacaaaataagtcactagaggtcactcttactattgaataaacagggcttcaaaaagaccttcctggagaaaaatgaaatctgagatcctgccaccacctttcctgtttttgttgcatagttgtgattactttttattctcaggattagttgtattgatagttattttgcttggaatccagtggaaggattacaaagcccatagaaattaagctcttctcatttacagtgaacattctttttggaggaggggagggcagggacagatattccaaacggactcagcaccagacgggactctcgcgagttgctgagtgacacgtaaaatttcaatactactactgtgggtgttttcagtcttctttcgttgatgaaacttagtatcctcatatctaataaattttactaattttaaattaccttttagatcaagtaattcttccagataaaactatgtaactataataattataccaccttcaataccaagaagaaagtcaataaggacatctaaaagtttccttctcatgaagacaccatgagttgctcacgttattcacagctggttttccagaagcacattggccacccacgaaggcagcctgttgatgatggcatgaaatggctcttcatgggaagagctctctaggccgggcacagtggctcgtgtctgtaatcccagcactttgggaggccgaggtgggtggatcacctgaggtcaggagttcgagaccagcttggccaccatggtgaaaccctgtctctactaaaaatacaaaaattagccgggcgtggtggcaggcatctgtaattccagctactcgggaggctgaggcaggagaatcgcttgaacctgggaggtggaggttgcagtgagccgagatcccaccatagcactccagcctgggcaacaagagcaaaacgcaaaactccgtctcaaaaaaaaaaaagctctctaaacatttggcattttggggattatgtgcagtttatctgaatgttatttgacctgacaaatacatgggaaagctttgttaggaagattctgcatgaagggaaatattttcgtaacttcagtgcccatagacttgcactgagtgaaaggtcacttactgctctcattgagtccctgaaaacaacaggaagcatcaagagaaagattgaactctgggcactgatcccagggatacacaaacaaatggctgggcagattttgcagaaattcctgtaattggtaaaatgctgagtaatagcctttgatgtaacttttcagtgggttaatttattcattacttagcctaaaacacttttaattttaattgcctcaattttttcccctaaatggttatgttttgcaagttcgccagccagcctggggaaagaagggtaagcctactatagagtgtgtgtgggttagttaggaaactcacttagatgtgaaatgtgtcaggaaagagatctcacagagtgtaggaataattatttttacagatgtttcattttggaccttttagtaataccattttaagagagattctgcagatgagtaacagactcttaattttagtgtcaaatggtactctataaaaaatggagttcaggctgggcacggtggctcacagctgtaatctcagcactttgggaggctgaggcgggtggatcacttgaggtcgggagttcgaaaccagcctggacaacacggtgaaaccctgcctctactaaaaatatgaaaaaatttcagggcatggtggcaggtgcctgtgaggaggcagtgagctgagatcgtgccactgcactccagcctgggtgacggagtgagactctgtctcaaaaaaaaacaaaaaaaaaaaaacaaaaaatgtagttcacatgcctttattcattttcaccaaactctatacaaacagtacggagctgaagtagcccatggaaatgataatcaattccaagacattggtttgatcatgaaaaaagaaaaatcaaattacttggcattcttcttcctcttcctttccccttctctttttgaacaattcagtccaaggtcattcagttcagcttaggcatccatgctgggtagtggggaggcccaggaccatggcagagcattcagaaaccagcagggtaaggaaagcatccacagtatagcaagggtggggacctggagagacaggagacagcactggtggtgacctatagcaagttgtcagaggttgagtggagtgaggaaggaggcattccagattgacagaggctaagaaaacaaggcaactaaatactattctgcattaaatgcttatgttataaaggacatgattgggaattggtgaaacttgaacaagattggggattaaatattggaactttatccatgatgactgtgatgatcatattatggttatataggagaacatctttgttgtaggaaatgtacattgaagtattcaggggtgatacagcatattagcatagttcttccatgttttctgtaaattggtttcaaaatcaaatggttactttaaaaaaccattcaaaattgtgtttaaaggaaacatggaccaatagaaaaactcagaataagtaagtgtagttaaattgatgcattttacctaagagatgtagattaaaaataaagaggctgaaaaaaaaacaattatgagaaataacagttcatttatatatgtctctaaatcaaattagcctggatttctgaatgacaaagatgtaattggcactgggattgttctccattctttttgggaagtttattgcctaggacatctgtatcagtcttcgaagtactttttaaagcttgaatatctgaatgaacccgtcagactgactgttatctggtcttctgtaatgggcttccgcacctttgacgagactcttagctgaaaggttgcttgtccctaggcccggttgctccacgttgtaagagcatttgcaaacgcttggttgtacatgactgtgcacatgtcaagtctgctctgtcactgtagaaaaaatattccttttccacttgacatataaggcatggaattgtttgttttaaatgtattttgtcaaggaattcatatatctgcttgatgtgttgtggtactgtataaaagacaagtgtgaaattcattgcttactatgatagccttaacaggactacagtaaatctagttttctaaaaaatggagtatatgcttagcttggttaaaattttataatgaaatgactactctggtaataaaaattaaaaaatatcataaagtgggggctaaaaaatgatactgcatgtgttccagttaatgaacatttttgttgtaataatacgaagagtgattgaaatctaaaaacatttgagattttaaaatagttttaaccttataactacaggattgtgatttaagtagcatgcctacttaattaggcagcaattaaaattattgctaagaattaaattaccaagaagacgtggtctagtatgtattgcctgggctgtggtttgaattacttttgattaagtataatcacattttttgagagtataaaaacagaggatattacttgcttctaattcacagatgtgtttatgaaccattggcaattaaagcatttgcaattgaggccctaagaaaattttaggttaaaataacatgttgagttatgccttataactcagtatatgcttatactttatatgctttacggagttttgaatatataatatatatgtataatagtatatttttccaggaaatatataacttgtagttccttaacttattttgtaactaaatcccgtggaaaaaagtttattgaatgtcattgcttctcaggcaaatgtagagttaggaaaatgatatatatacatattgggaatcttttagaaggcttggacttggtagctcaaatcttctgcaaccttgagcttcaactttctggccggttcaagagatctcttcactgtccttttcatgtaaagtcaatgtttatggaacactagaccaaaatggaaggattcctttggaaactgaacaaacagttgaattagtctttgacttgatggagtgatttgatctaaaatattacctatcagttttagatatctgttcaatcagagctgcctccatatatgcaaatgataatttgtcttggatttttagatatcttagccctcagacaagctaatagagtttaaattgaacctggtgttttagggacagttgaattgttgggttgcccaggaaaacagtcacatttttctataagtatgtgtttatttggctggaatgtgggtgaggaagaagttatatgtgaattaaaagaaacattgtctcaatgtcacatgttaaattaaattaaattacaggcagaactaagcgagtttacgattgctgccgctgggagcagagattattttcagcttacatttataacagaaggagggatttaaaatatagtattatgcctaccctgatacagctaacctcctccacccgcccctccacacacatacagctacatgcttaccctcgaactatgaaagaagggtgtctctcagacatcctatatttaacccagctttggacaggtccctggagtctagtctttttgaacacagcagtgaagataaggaatggggagggggctttgatttcaagaccactagatatagtagattcctaatttaatttcaaagacaaatcaattattaacacaaatacaaagagaacagtattttaagcaaagcttctgttgtggcagataaccttttaaggtgtctcccagttgggtttctattttagatgactttttgaagaatatatctctgtaatagaaatatgtttgatgattctcatctttaagaactgcacatttgccataattaagatatttatgaatttattgtaagaagattggtagaaaaagtaatgcaacatcaaatgggaaaataaatatataatattatatagctgttcaaatatagggtttatgattcttgtgctaatttgaactgctgtacaacaccaggataaaagtccacagctgtgttaagaaagctctcataagcttatgaaattttatagcacaggctgtcacagaacctacaatttacaaacatttgtaaaagttaggaaagttttgggttcctcaatagaaaatgatgttgcttagctttaagaaagtaactaatttatctcttttcattcttgtccactaacaaaggaacccaaatggtcttttaaaattataataaaactaagctagtaaaatatcacatagattttgagatactgtgaataaccatagaaaataacaatttgttattcttcatatataaaaataagcttaacacgcttatcaatacatcttgaactataagagatttatttcagcagtgttgccaaagggcaagcaaagcctgctgcccatagaaaactttgaattccctaagctcagggctcctcacttgtcatgtaacccactgcgtgtgcacacatccatctgtgcccatccatattcccccagaggacttggaggcaaggaaattgatgcaaatatgctgatgctcatactgtttgctatgctgtaagtaatacagtcctttgctttgacccaggagtcttctgccgcaaccatgaaacaaactggcagactcatttgttagcttgcaagtaggttaaaatctctcctcacggttcttcacagtgtacttgtctgtgcaatggtcatcttcttcatgaatataattataacatgatataagaaatagtgagctcttacctatagataagcaaacattgcaatataaaaatagcatatgtcatttcataaatcacagttgacacattctagagaagagattgggcagctttccttttttggatgtcacagttgattctactgtcctcatttcttcttttttctgggatatgaggaagaattgctgtgacaaagctcatctcctgggtggccggggttgattgtcaatttgttttgttttggcaggctaggcagatgtcctctacctccttctttatgccatgtgacattcatccctttgattttcctattgcattttatttagtattttagaatactgcccacattccattctggaaagtccactgtcccagccagagttttcttagaaagctgagcctgtgatgggcgtttgtgcaggtagcctcttttagaaagtgagctcataaaagagggaagaatggaatagagaagaaaaatccaccaaaagggggtgtcattgagctggtcacttctgtgagcaactggggcgtgaactccctgggaagctctcaggaagccggtagaatgtgtttcacagctgtgcctctgagagacagcagggggaatgcatttatcctgagtcctgtccagggattcagcactgcccttggggtgctaactcctggctctaaggagaggaatatgaacgaatgggttgcgactgggtttctgcaggcatcgcagaggccaagagacaaagagagaactcgaacactgaactttttaattttttattattttattattattatactttaagttacagggtacatgtgcacaacgtgcaggtttgttgcatatgtatacatgtgccatgttggtgtgctgcacccattaacttgtcatttacattaggtatatctcctaatgctatccctcccccctccccccaccccgcgacagtccccgttgtgtagtgttccccttcctgtgtccatgtgttctcgctgttcagttcccacctatgagtgagaacatgcggtgtttggttttttgtccttgcaatagtttgctgagaatgatggtttccagcttcacccatgtccctacaaaggacatgaactcatcattttttatggctgcatagtattccatggtgtatatgtgccacattttcttaatccagtctatcattgattgacatttgggttggttccaagtcttgctattgtgaatagtcccgcaataaacatacgtgtgcatgtgtctttatagcagcatgatttataatcctttgggtatatacccagtaatgggatggctgggtcaaatggtatttctagttctagatccctgaggaattgccacactgacttccacaatggttgaactagtttacagtcccaccaacagtgtaaaagtgttcctatttctccacatcctctccagcacctgttgtttcctgactttttaatgatcgtcattctaactggggtgagatggtatctcattgtggtttttgatttgcatttgattgccagtggtgatgagcattttttcgtgtgttttttggctgcataaatgtcttctttagagaagtgtctgttcatatcctttgctcactttttgatgggattgttgttttttctcttgtaaatttgtttgagttcattgtagattctggatattagccctttgtcagatgagtaggttgcaaaaatttccttccattctgtaggttgcctgttcactctgatggtagtttcttttgctctgtagaagctctttagtttaattagatcccatttgtcaattttggcttttgttgccattgcttttggtgttttagacatgaagtccttgcccatgactgtgtcctgaatggtattgcctaggttttcttctagggtttttatggttttaggtctaacatttaagtctttaatccatcttgaattaatttttgtataaggtgtaaggaagggatccagtttcagctttctacttatggctagccagttttcccagcaccatttattaaatagggaatcctttccccattgcttatttttgtcaggtttctcaaagatcagatagttgtagatatgtggcattatttctgagggctctgttctgtttttctatatctctgttttggtaccagtgccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctataaattaccttgggcagtatggccattttcatgatactgattcttcctacccatgagcatggaatgttcttccatttgtttgtatcctcttttatttcattgagcagtggtttgtagttctccttgaagagttccttcacatcccttgtaagttggattcctaggtattttatcctctttgaagcaattgtgaatgggagttcactcatgatttggctctctgtttgtctgttattggtgtataagaatgcttgtgatttttgcacattgattttgtatcaaatcaagatacaaaatcttgattttgtatcaaatcaagatacaaaatcttgattttgtatcaaatcaagatacaaaatcttgattttgtatcaaatcaagatacaaaatcttgattttgtatcaaatcaagatacaaaatcttgattttgtatcaaatcaagatacaaaatcttgattttgtatcaaatcaagatacaaaatcttgattttgtatcaaatcaagatacaaaatcttgattttgtatcaaatcaagatacaaaatcttgattttgtatcaaatcaagatacaaaatcttgattttgagactttgctgaagttgcttatcagcttaaggagattttgggctgagacgatggggttttctaaatacacaatcatgtcatctgcaaacagggacaatttgacttcctcttttcctaattgaatgccctttatttccttctcctgcctgattgccctgaccagaacttccaacactatgttgaataggagtggtgagagagggcatcctgtcttgtgccagttttcaaagggaatgcttccagtttttgtccattcagtatgatattggctgtgggtttgtcatagatagctcttattattttgagataggtgccatcaatacctaatttgttgagagtttttagcatgaagcgtctttgaattttgtcaaaggccttttctgcatctattgagataatcatgaggtttttgtcattggttctgtttatatgctggattacatttattgattttcgtatgttgaaccagccttgcgtcccagggctgaagcccgcttgatcatggtggataagctttttgatgtgttgctgtattcagtttgccagtattttattgaggatttttgcatcaatgttcatcaaggatattggtctaaaattctcttttttgtttgtgtctctgccaggctttggtatcaggatgatgctggcctcataaaatgagttaggaaggattccctctttttctgttgattggaatagtttcagaaggaatggtaccagttcctccttgtacctctggtagaattgggctgtgaatccatctggtcctggactttttttggttgttaagctattacttattgcctcaatttcagagcctgttattggtctattcagagattcaactttttcctggtttagtcttgggaggatgtatgtgtcgaggaatttatccatttcttctagattttctagtttatttgtgtagaggtgttatagtattctctgatggtagtttgtatttctgtgggatcggtggtgatatcccctttgtcattttttattgtttctatttgattcttctctcttttcttctttattagtcttgctagtggtctatcaattttgttgatctttccaaaaaaccagctcttggattcattgattttttgaagggtttttttgtgtctctatttccttcagttctgctctgatcttagttatttcttgccttctgctagcttttgaatgtgtttgctcttgcttctctggttcttttaattgtgatgttagggtgtcaattttagatctttcctgctttcttttgtgggcatttagtgctataaatttccctctccacactgctttaaatgtgtcccagagattctggtatgttgtgtgtttgttctcattggtttcaaagaacatctttatttctgccttcattttgttatgtacccagtagtcattcaggagcaggttgttcagtttccatgtagtcgagcagttttgagtgagtttcttaatcctgagttctagtttgattgcactgtggtctgagagacagtttgttataatttctgttcttttacgtttgccgaggagtgctttacttccaactatgtggtcaattttggagtaagtgtgatgtggtgctgagaagaatatatattctattgatttggggtggagagttctgtagatgtctattaggtctgcttggtgcagagctgagttcaattcctggatatcctttttaactttctgtcttgttgatctgtctaatgttgacagtggtgtgttaaaatctcccattattattgtgtggaagtctaagtctgtttgtacacctctaaggacttgctttatgagtctgggtgctcctgtactgggtgcatatatatttaggatatttaactcttcttgttgaattgatccctttacaattatgtaatggccttctttgtctcttttgatctttgttggtttaaagtctgttttatcagagactaggattccaacccctgctttttttttgttttccctttgcttggcagaccttcctccatacctttattttgagcctatgtgtgtctctgcacgtgagcagggtctgctgaatacagcacactgatgggtcttgactctttatccaatttgccactctgtgtcttttaattggaggatttagcctatttacatttaaggttaatattgttatgtgtgaatttgatcctgtcattatgatgttaactggttattttgctcattagttgatgcagtttcttcctagccttgatggtctttacaatttggcatgtttttgcagtggctggtactggttgttcctttccatgtttagtgcttccttcaggagctcttgtaaggcaggcctggtggtgacagaatctctcagcatttgcttgtctgtaaaggattttatttctccttcagttatgaagcttagtttggctggatatgaaattctgggttgaaaattcttttctttaagaatgttgaatattggcccccactctcttctggcttgtagagtttctgccgagagatccgctgttagtctgatgggcttccctttgtgagtaacccgacctttctctctggctgcccttaatattttttccttcatttcaagtttggtgaatcttttcacagtcacatatttcttggaggctttgttcatttctttttactcttttttctctaaacttcttttctcgcttcatttcattcatttgatcctcaatcactgataccctttcttccagttgatcggattggctactgaagcttgtgcatgcgtcatgtagttctagtgccatggttttcagctccatctggtcatttaaggtcttctctacgctgtttattctagttagccattcgtctaatcctttttcaaggtttttagcttctttgcgacgggttcgaacatcctcctttagctcggagaagtttgttattaccgatcatctgaaaccttcttctctcaactcgtcaaagtcattctccatccagctttgttccgttgctggcgaggcgttgtgttcctttggaggagaagaggtgctctgatttttagaattttcagcttttctgctctggtttctccccatctttgtggttttatgtacctttggtctttgatggtggtgacgtacagatggggttttgtgtggttgtcctttctgtttgttagttttccttctaagagtcaggaccctcagctgcaggtctgttggagtttgctggaggtccagtccagaccctgtttgcctgggtatcaccagcagaggctgcagaacagcaaatattgcagaatggcaaatgttgctgtctgatccttcctctggaagcttcgtctcagaggggcacctggctgtatgcggtgtcagtcagcccctactgggagttgtctcccagttaggctacgcaggggtcagggacccacttaaggaggcagtctttccattctcagatctcaaactccatgctgggagaaccactactgtcaccaaagctcagtcggaaattcagaaatcacctgtcttctgcgtcgttcatgctgggagctgtagactggagctgttcctattcgaccatcttggatccggacctgtctattttcttagccttatgagctttgtcaaaagagtgcagcttcttctgttttttcttatgagtatacaaaaaatctctttgattgcatttagcaatgtttgaaagtcttaatgtgttctgggctttaactcactttgctttatattgcctccttttaatgttccttttcattgtaagtatttcttttttttttccgatatggagtcttgctctgtcacctaggctggagagcagtggcacaatcttggctcactgcaacctccacctcccgggttccagtgattctcctgcctcagcctcccgagtagctgggattgcaagttcccgctaccatgcccagctaatttttgtatttttactaaagatggagtttcaccatgttggccaggctcgtctcaaactcctgaccttgtgatccacccatcttgaccactgcgcccagtctcactgtaaatattctttccttggttactttgcccatttctctcttcttcagtggaacatgttttttctgggtttcatttgggtagcttttcacatttgatgaacgatgttgtcctcaatcataacaacagtgtctctttgtatagtggttgctcggaggtctacaaggtagtattatgtaacatttcccattgtgttctaaatactcttatctttttaagttaaaaaattgaagtcaaagctgcctctaaagtcacacacatagcttgaaataatagagttgaaatttggacataaaacatattgccatgggataatgcctgttgttttcctaaagttttaaaattatctttttgacatctcaaataaacatttgtctattgacagggctccttccttgggcacaataaattctaagatgttctggttattattttctcaaggattctgacactgccatcttactaatcatattagagccaagtacggagtagtgaacaagttctgataatttgcaggtttattactttgggctgaaaaaaatctagctgatgtcattggtcttgttgggatctgtcttcagaatgcaattggagtgcatctcttaacccttacttaagtatcactgaagttctctttcttcagctcccagatgctccatagcctgctctggcctgtgaggtcatgaggtccctttaagatgttataagttgaacacagtcttctttccatccctctgtaacatgtcttgggaagaagccatatccttctcataccttatattctcattcagaccctaattctgtcaactctcagaggtgcatagaaagaattattattatttttaatttttttagtttttaattttgtggttgcatagtaggtgtatatatcgatggtctacatgagatgttttgatacaggcatgcaatgtgaaataagtgcatcaagaaaaatggagtatccatcccctcaagcaattatccttcgagttgcaaacaatccaattacactctttaagttatttaaaaatgtacaattaagtaattattgactatagtcacctcttgtgttatcaaatactaggtgttattcattttttctatttttttgtacccgtggaaagatcatttattgccctttattaacagttcatctttatcacttatattcccacagctgtggatacatttgtaataacaattattagtgatgacatcgccacatgattttctttttaaattatatgcacctgtgttgttgtatttttttctgtgtcgtgtctgatgtctttctgcacgacttaattttgttatttggtttcctctctttctacttagcagtaagtctcaaaaaaataggttcgtcttattctcgtattatatactttagccaaaaatctatagtttaaaaataggtattgaatttatcacagaagtataatttaactacatagcaagaaatttagaaataaaaggaaagagaacaagatcatctatccagcttcctcagggaaaaggagctgatctatgttgaatcccttctgtgtttctagagctgtgtttgttggatttaacacccattatctcatctcaatccagcagatctctttgtccattatcttctcatatgcagattttcccatcccatctccttcatctctccacatgtttaaatagttcttatatttattgttgtaatgactgtagagtagatcgtcaaactaagatgcttaaatttatgtaaacttgaccgggcatggtggctcacgcctgtaatcccagcactttgggaggttgaggcaggtggatcacgagatcaggagatcgatactatcttggctaacatggtgaaaccccgtgtctactaaaaatacaaaaaaaatttagcctgggcgacagggcgaggctccgtctcaaaaaaaaaaaaaaaaaaactctgtaaactttcctctaggtcttcatttgtgttgtgtcttttgtagttctcatagaataaagtccttggtcctggtatgttaaaattggtatactgttgttataactttatatttgtagtgctgtaagtcatttgaaaacaccaatgtcaggaggtattcaatgttcctatgctaggttttctttaacaagtcaaaatgtcatctggaaggagagacaacgtgtaacccctatctcctaccccctgtaaattctaatttatagaatttaaacctgtttctatgtgtcttcttccaagcctcatctgttcccacaggtagactctaggaattgtctgtcatgtcccgggaaccagacactcatcagctggtcatgccagtctctcttcctcaccccagaatcatcagtcagcaggcaaggctcctttctcaggagtgaggttctcctgttccctctcatccccatctgccgccgcacatggctgctgtgtggctccctgtgagtgaggtgctgctccttctccagaggtgtaattcattttccatgagacagacctcagtatttcagaagagtaagccttactggggccttcacacatgtgagaagacttcagagcagagacaaaacttgagttgagccctgaagataataagtgatgggaactcgcagacagcaggggctgcaatgtcatcgggtgagcggtcaaggagcattggtgcatgcatcccacattcaggaaacagtgagaagaccactccaattaaaggaggaagcgcatctgagaaatgtgtaggggattcggctgtagtgcagagagtaacggggaacaggtgatggaaggaattgaatgccaggacctgaaatttgaatttcaggacaggtgcagtggggatccattggagctcgttgatatggctgtttgtgtgacttgcactcagcaatagtttaaaaccgtttctgctctggtgatatgtaaggtgtgtgtgtggctggggacagtcaataaggaaacattggctgtaaggattagttaggtcgttaacatgaggacctacagtgagatgatgatcatgataatggaaaagctgccatatacacacaaaaagtacataatccttggcaatttattggctgtagagggaagataagggtgggggctcaggacagtgtacttattgagtatttttcagtttcaggtgaccaaaatctaagatcaaataggcttgaacaataaagggaaccaaagtgtcttgattgaagccaggctgaatttaggcaatcagattctttcatcagcagtctgcctctttccttcttgcagttttattttcatctacaactggcctcattcttgggcagctctgtctatgccttagcttcaggcataccgtttaccagcttaggagcgtgactattttcctttatttctgttcttagcaatgttgagttctacagatactatgcctttatttgtttattctactcagtaggataagcttcacaggagcagagactttttctgttgtttatggttatatccccagaacataggggcacacctggcacagtatagattttcaacaaatatttgttgaatgaatgaatgggtatttctcccaagagttcaagccgaaagtcccaagttctgctgttattcattcgaaagtcccaggttctgttcccattcattcagcgtgggcttcctgaccatcctggaaccagtcctttccagtaggacaggcatgacattcagttgccaggcctgaggcttgtccctgtgctggccccaggtggtagggtgagcccccttcagaccccatggagtgagatgtagggaagacagtgactgaagataatcgaatggagatcaagaccatgtaaaacagaagtttttatatggaaaacagtagatttttacattgaccatcactgcttatgttcactgtgagtaaaatgtactttttccgaagcattccctctagatagcaatgcacagatcaattcagattcataataagatgaacttttggtaccttctaaataaaagcattatttaacctctcattaagataatgttaaggtacattaagaactgaaaagacaggtgatgaaatgggaagaatggaatagcgccgtatccagatgaacatccagacgtggcctgaagaaggtatgggcacccccttccctgtttgtgattcgattcccgaggccgtgctccctgctgactcaatatgtggaaccagagagaagcctgctgtggagttagtgaatttgacctaatcgagacagtctgagaaaggacaggaatctttttttttcttttttttttttttagaacaaagaggttttctgtacatctgtgataacacagtaaccatctgttgaactctttaataataggctttgtgtttttctgataattcgaagctggttaaggtgccgtcccctcatattagcagttcggtggccccttcccctctccttccatccttaggttccgccgacacagtgcttagctcctttcacagtgaggagcaagtgcagccgcaagcatggggagagccacagcctggcagagtggcttagcatcacgaagcccttctcagaaggaattgagtatctgtgcgattcaaagggatgttaaacgtattttcagtggaactctcctgcatttgccctaaaatatccaatatgtaattccatataaagtgtgttcatttcctatggcccttgtgagaaatgaccataaactggcagacttaaagcaaaagaatttattctgtcatagtctggagaccagaagttccgcatcagtatccctagtccaaaatcaagatgggccacactccctacgaaggctctagggggacatgcattcttcgtttcttccggcttcctgtggttgcccgtgtgcctcaccttgtgggtgcctcactccattttcacaccctcttctcttttgtatggggctctgttcatcatcacctttatctctcttacaagggcagttctgatggtatttaagacccagccagataattcaagataatttcctcgtctcagggtctttgatcacatctggagaaccttaccttctgaagtaaccttcacagggtcccgggattggggcatagacatatctttgggagccactgtcagcctgtcctaacacatgtaagattcatctctgataaaggcattcagccacaagtgcagtgtggtttggtcttttaataaaatcctttaagtaatactgtaatgaattcggagctccatctggagatgccaggaggtgtcctcatttgaatgtaaagctcctccccaaaggatcagttgtcgcccctccttttggcttttcccatttcctctgcagatacggacaaaatctgtccatgtattatccatgcattctttttttttttcattcttattatcagatcccagaataatgaattgctgtttgaaaatgcatggtttatgtttatcttttccagaagcacttttatacgcatctctccctagtagtgtttgctctttcagaggctggttttgttcctaagcaattaagatgcttccctgtgttttggaataaatagtagtatctaaatattttgctcttctgtttatttcctataacagatatttacacatctccctcccatgttagattctggacttcttgaacctagaaccatgtctctctttatgccccataatgctttgaacatggtaggtgctcaatacacttttattaaataagtgcaagaattaacatactcaaatgaaatgctgttttgaaaagtatatcatctctgtcttaggtaagggcaattcctcaaattgattttttaatcatttcatattcatgtggtaaaaattgtcataaactagcacatctgtgaatgcaatgttgatttgtatacaggaagcccttaggctaattttaatcttctgctgtctttcatgaacataatactaagaaatggtttctgtcccaaaccgttcataggcaccatgctgggaatcacaaagcatgctgggaatacttgtcaaggagaagtgggaagctaagagtgatgccaggcaggggtcaggggacaaatcaagaccatagagtggggagagaggaacctaggcagagctaatcaccgagactaaatcaacaagcctaaggaagtgcagcaagccaaaaaccctctggtctagcgtgcatcttcaaagttgtcacttgaggtggctgcatggaaggtggcaggtgggatcctctatgggtttatctctacttctctctcaaccgttgttgagccttcagctaagtcaccaacccatactgtgtttattctctgcattttccaaatgcttctcttcttcaaacctgcaagttttaatatgaatccagctgttacccagttcagcacaggtgatttttaaggaagtccaccatttttgaacagatataaaacaaccctgaataaaacattttatatcattttcaaccatgatcttctaggagaacaataatataaaatatacctatgtagcaatgaatctctgcctttagatggtgagaataaatgtgaaataatcaatacttgtaacattaagaccctagaaccctctatattgagccaagcacatggaaatatagtgaatcttaaccagatttccaaataagctgaggaagagggagatccagcccctgtaacacttgtggggtgcccactgtgttttcccctctgactcagtagtgtacaattctttctagaaagaaagtgttcacagaattcaaaatgatagggaaaaaacaataaacttaggtaccagatatgttcttatgttcttttattttataaaatttagtgcctttctttctttcttttttttttttttaagacggagtctttctctgtcgcccagcctagagtgtactggcaccatctgggctcactgcaacctcctcctcccaggttcaagcgattctcctgcttcagcctcctgggaagctgggactatgggcacgtgccaccatgcccagctaattttttgtatttttagtagagacggggtttcaccgtattagccaggatggtctcgatctcctgaccttgtgatccacccgccttggtctcccaaagtgttgggattacaggtgtgagccaccgcgcccgaatttattgcctttctgaagggcaagatttattcaagcctgtgccagaaattttcttcattacaaggtgactctttggcagacagatgctattgactcttgaattttccaaaggcgaaatggaaaatttcagcaattttgtttccagctgtctttacagatttatatttggaccttaatcctattggaaatcatctgaaactcgtgaaacacacaattggaaagttaattagggagaaaccaagggaaagaataactattatctattacacctatttagaaccttctcttgagatctggttattatttttattagagatgtgaatctgatacctgtaggcctcttgtgtttgaactttaataaattgtactctgctaacttaggaagactaagtttaattaagtgtattggttaatgataattctcttttacgtatttagtaaatattcagttgaagtttattgagcatgtgctatctttcagattctgcgctaggtatagagcacatgaagttgggaaagacttttattgtgccttcaagagctcatgattccacagagagagttagacatgtcagccaggaatcccagggacacgtgaaatgcccagtgctgtttcatgtatcgcatgatactgcaggaatccagggacacgtgaaacgcccagtgctgttttatgtgttgcatgatactgcaggacagaggcatcatgagaacagctatcatgcttttctaatgtaggaagagattttatccaaaaaatgtcaatgctactttagatgttcttggatttgttttattctttcccagaaaatagagagaaaataacatcaggcagacaggcttaggaggcactattccctggatgatgtccttccttcttggatcctgctgtgaccactcgtgggccatgtgggacttgtctatagatggagcagagccttagttgccttcttgtactttagcttcttcacagttttaaaatgcctttttagaaaatgtaagtaaagttcgtagccagttggattcgtatttatctatttttcttagcccactctgtagcatatttgctgacatctgggaatcccgactgcacagtgttatccagagagcatgtgtgctggggaaatcaagaaagcctctcttgtggcataaacattgagggggacatttaaggaaagtgtagagaaagcaaacctttcttaacagctctgcacatttcaatggcttcttgctgtgtaaaaatattgggtgctcttcatgctaaagatgttaaatgcaatttcttagctagattatgctgctctttgtatgtaaaaaaatcacaaattccagtgtctgactcacctgtataaatgtgacattgtcacttatggggaatatatagaaaaatgttcctatatcaaatactctgaatgttttaccaagcaatgagatactgttctccctattgtagaatagatgcttcacaatgagttactgagtttttcttttgtcatgtcttaaagacatgtcactgtcttaatggtaatgcatgcttttagaaaagcagatataattccagtatttctttatgaaatgatattcactcaggcaaattatgtgcactgaattttctttctgttgttgcagtatcatgtactcaaccaaacaaatcaggagagaccctgaattacctcttatctatctcactgaacatagttgacattttgctaagtcgtagcaatctaattaattctggttgccttctttctgtgacttaacaagttgctcacaaagaaaaaaagtgtatccaaaatatgcagttcagaatcatctaatgatatattcaaggtataacattcctctttcacagacatatcttaatgtgtgacagaaaacttatgtgtaacattattagatcaataaccatgctggaagaggtaccctttttatgacaaaatatatgacatgcctgaaagtacagtgattacaggattggactgcgggactcagaggtaacctctgggttgcttctgttacccatggctacgcataggaaaagagctacccaaggtgggaatggtcccaggggctcctcaagtttgatggtggggaacaccaggggcaagaaggctctgagggtccttatggtcttaggacaaataagatgatctgggtcaaacactacttaacccccagcaattcttttagaccagagctgaagcaatagagagtcaccctgaggtgaggatgacatggtgacatgcaggggtccttgggttggaaaggcagagcaagttcctgcaatgctcaagttatcaggcaaaaaggaggagcctccatctcctgtaggcaagtagcccgcagtaattccctctggaggggtctacagagtgggctttttccagttcatcactacaggtgttgcctctcatgggtcctggcttcacgcaggtaactctgacctgaacacctggtgcatttcacttttcccatcccccacaggttctgtgctggggcactgtgagaatttctagccgctattgaggtttgggcacagaattcacactacctctgtatgtgtgtacctaaagaacctaagcatcaaattgagtttaaagtagtgttggatgggtgatgtacccagacatcttgcagaattgagaaaatgtgggacattagggaactttgagggctaatggacctgttttatgtcttcattatggtggaggttacaaggcagaatgcatttgccaaaatgaatagagctgtacactttaaaaacatcaaataaattctctggaattttactctctgtaaattatgctgcaatgtaaattttaaaaattgtaaagaattaaaaaaggagtgatgattgccatacatcctagaatatattcatatatatttttggactattatttctcccaagctgcaatctgagtgttaaccatatcacggtatttttcctggcagctgactgtgattccccactggcctctgccttgcctaggtcatccttcagcagctcctcagagctgtccagcagccacggcccggggttttcaaggcttaatcgaagagatggtgagtctgcctttttccttgtattgctccttggtgactctcattggattttcttttaacaaaataattataattgattaatactttgcagaaggaagtaaaattcagaataagcatatttgttcacatttgaaactccaagaatgtatttgacaggaataagttgatcacttcggctttcttgtcctgctgggtttcccttggtatgatctttgtgtgccttgaacaagtcacacctgactttgacagtgtttgaactctttgtataccccttgcaatatctgagtattatttatcaaagaccttagattctgccatgtcctttttttttttaccttggattcttttgttctgccacagtatacattttgttgtcccagattatttaattatccctatttggatgagaaaattggcaaagtaaagaaacgtttaagaagatttttattatgttttaactacaactcttagtttatttcttattatggtggacttgattctctctttagcatccactgtagagaaataaccatgtaatggtttattcatgctccactgtgactattccatttatatttgtaaacatatctcatgaggagtgtgtttcttttacatatgcttaagcagaagtgtagaaaattgaatgttgtcttgctgtgtaaattagagggaactttaaacaccaaatacattgtgacaaggaatcatcctggcattttctgagcacaaactcagatagaacttctttgaataaattctcagaggaaattaaatttacactattaataaaatgtatttgtaggcatatattaaaaagattcaaaagtgtctactgtattttatataattgtgctttcctattttcttattgcccttgttcttttttttttttttgagacggagtctcgctctgtcacccaggctggagtgcggtggtgcaatctcagctcactgcaagctctgcctcctgggttcacacaattctcctgcctcagcctcccaagtggctaggactacaggcacccgccaccaggcctgactaattttttgtatttttttttttttttttagcagggacggggtttcaccatgttagccaaggtggtctggatctcctcacctcctgatccacccacctcagcctcctgaagtgataggattataggcgtgagcctgtaaccgcgcccagcctttttttttttttttttttaactccctgttgcatttcttggtgttttctgtatttgagcacatttaatgcattgcacattggaccaaataaatatgttctggcatttgttataggcagtatggctatgaaacatgaacaatttaacttttcatttttctgtttatttttcttaagtctgtgatttcatttgttgcagagatatgggctctgtttcgttactttagattctattgctgcagagcctcagtggatggtcattatcactgaaacagtgactaagcctgggcacagggggtaaaggaaaacaagagcaatctcaagccatagctcttcttgatgtcaaatcatattttgtactaaagtacatgattatgaggattctttatcttagggatcatttttattcttagttcatgttcctgtaactcatcgtgcaaaaaagcatgatatcaatcttaataaaatttattttcatgttaatgaagttagaaaaacaggcttactttagttagctatcaactaagtttattacaaattcattgttgttgcttttttaaattggttttgacttttttcttctccctcgtggtagcctggagtattcatcaaaggagttccaaattgggagtgatttattgagggctatagattatctctagtgttttcatatcctttattagattcagaatggtctatggaagagtgactgaacaaatgttctgatcataaataattaaactaacaaataatgaccccctgtctcagacattaaagcctttctccagtggagtgtaaagatctcagagctaaaaattaacaggcagaaaacaagtagtttccctgttgtgcagcccagtgccttcttcccatgtgatgggaagacgccatggaaacagctgcaatagttactcaagccttagcctgaggggtgagaggggaacaaggtagctatgcatcccgtctgtcccagtgtaaagagtcaaaatggactttttggaggtgtctttcttcatgcctcttggataccacaagtaaactagttcttccatgccactaaatgatgaacccatgggccaaacaagttaatgcacttttataagcaacttatttaattccctttaatggggaagactcaatttttccaccaaaggtttcataagttatgaagcataatccagaattactttcaacttgtaaaaatgtattatcatgaatattgcacagattggattataactaattaaatatgtttttgctttctacatcttcatagttagaatttcagtataacctctaacatggtattggctaatttgaggataaagtgacttgttgtaaatttatttatttatttatttatttatttatttatttatttatcgagatggagtcttgctgtgttgccaggctggagtgcagtggtgcaatctcggctcactgcaagctccgcctcctgagctcaagtgattcaccttcctcagcctcccgagtagctggaactgcaggtgcccgccaccacaccaggctaatttttgtatttttagtagagaaggggtttcaccatgctggcccggatggtctcaatgtcctgacctcgtggtatgcccacctcggcctcccaaaggtgtgagccaccacacctggccgacctgttgtaaatttaagaggctaagggtcagtgtgcatttctacacctttcacattgcatcacttgaagctaagaagaactctgtggtatattacatgtaaaaataagactgaaataagctgacaaagacttagggcaaaaaaataaggttttgagtagaattgaagaaaacattttgataataatatcaaagaaattcagagatgccattgaaaccatttaattatttaaacatgtttgttattcctttttctgtaacttcttctgacactaattgaaaatttcagaaaattaacctatagtttaaaatgtttaaaatatgagaattcaaatgatacactggcacatagtaaattcttaacatttcaaaataaataatgaatgatctatattaggaaatgaaatctttatatgatacacacatacagttgtaaaacttggttttctccataatcaataattggctttcagaggcaatttaattatgcaatggttgtccttagttttattatactttataataaatggattgatgctttgtttagttgacaaatacagacataggtgaattaattttacctttttccttaggcctgtcttctcatgtgcttatagctgtgtctgtgtcagatgaatttgtgaaaatatattctcttgttttagacaatttcaacaattaataaacactgtgaagttgttattccatgactgtttgagatggaaaaccagccgttttgggtatcattcacatactggctaaagacatacatttatttgtgcatttgctgccctgtgtctcctctgcatttattatattagcagtttcagtttaaagtttatttttctgtaattcagattccttgcttcttatgctggttgtcatatgaatatgcctttctaagattaggataaaacactcttcttggtgttttctttcagtcctgtcttgagttatttttaatcaaaatgctaggctgaggtcaactgattgtaatttgtttataaggaaaaaatggaaggtgacctgaagaattttctctcctccctttacccaaaagtatttattcttattttgaaatgagaaattccttcagaattccccaagatcaaagagggctatctcactgacagctaagacactgttgtcttcatctgtaacttgactagtcttgtccaaaagaggcctcttctgggttggaattgcatttagttttaaataaacaattatgcagaaagtgcttcttccatcttattaaaatttcagagttagaagaaaaggcatctgaagtttccaagtagaactataacagacctagtgtttttagtatccccataagtaagcattctagcataagggagggtttgctggttgctcattgaatgttgtcttggccactcacagaccaacacatgatgagtgtaagataaactctttggtctaaagagagaaaacataagagtctgtagctgtaacatgtctgctgacccaagctggaatgttttagtgtattgtgtcacctagtgagttttaggatttccctccccacttgagttttccacctcaggttaaaggaatgtgggatattaaggagaattattaagagagaaagggcaagtatttggaaatgcaaaacctagacaaggtggagatgatgtactggagtcagagaggaattaatagcatattaatatcaacatcattatggcccacacacatctatcatgctctctagtattgtgtccaaggtccatagatggtcactgtcttattatatccctgatcatactagcttcaccagactttcaggtcacccaggggctacatctcttagacagcagaatattaagataatggaaaacaataataagttatgacagtgtgtgaaaaacatgaaaaagattttatattctctcatgatagatgtgattcaagatgctactgcaataaattaaaaaatatatatgcttttttgcaaggataacccgtgtgttttcatggtctaacgaagttagacagcattgttatttgtggcttgacacctctgcaattgctcctttttaaagttgcaaaatgaatgtacaataactaaccatgcattagaccgaaggagagtttgagaattttttcaaggggccttcactaatgaagcaagctgtcttatttggggatctgtaagcagcaaagataaacattgcctaagacatttctgttgaaatggcgtaaaacacatggattacttacttcttcagggattttaaatacttggaaacaatgcagtgaacacagatattactgtgaagaacatttcagcaaatgagtttacaaaatggatgaaaccgaagaagtgtcttatgtttatagcttctcacctgaagagattaactatatgggtggacctcatcaacattcgaaactttctttccaagaggtttttcctgtagaattttaggactttctgggaagatgcatgacagatgcatgccattgttgatgatgtgggtcactgtggaaactgccctaatgaggccattatgctgcctatttgtgatatttggttatgagttgatgacaatattgtaaagaaaataaacactcaagctgttgaaaaattttacaggttgacatcaattatcacttagaacttttttctcaattttctgagtgaatgagcattgtgtttaaaaagatactttctgcctcatttcttctccagttattttgaaaaagctcaggtactgatttcttaggaaaagagtaaagcagggaaactagaggtgggaatttgtgctgcacacaacctagccacgactctgggtgcaccagcccttcggatgtgggcaggtaagcatttgcccaggtatcaggctgcctgtgtggctccacagaacaaagatggggaagcagaggcatcagcttctcttatagcacagcacacagccttccaggagtggatacacactttctttctattattagcacaaataattatctcaactcaatagaaaaaatagccatctgtgcctgattgtcctgaaaatgtttcattaatttacttgtattcagtgaatatgaaaccatagttggtggtttttcagtaagtacagaaaacatatttggtgggttgttttccatgcagagttaaatattgtagggccaaagtcttagttatctgtttttttttgctgttggttttttttttttttttgagacagagtctcgctctgtcacccaggctggagtgcagtggcatgatctctgctcactgcaagctccacctcccaggttcatgccattctcctgcctcagcctcccaagtagctgggactacaggcacccaccaccatgcccggctaattttttttttttttttgtatttttagtagagaaggggtttcaccatgttagccaggatggtctcaatctcctgacctagtgatccacctttctcggcctcccagagtgctgggattacaggcgtgagccaccacgcccagcctagttatctttttcatggaataaaactacagaggatacattccagtgtcagtaagacaaagagtttctgcttctctgaggaagtaagtttgctatgtagacacacacacagagaaaatggtcaaaagttgcttttataaactccaataatcaacttttttacattagcaccttactccatgaagatcacagtatatgaatacaaaataatatgtatgaatgtttatttgtggaaaaaaatcttagagatatcactccctcgtttttccaaattctgtgtattgtctgttgaaacagttcatgcttatgattctaatacatcatttccatggatctccccctcagcttagtctcttcatgtctcacttggattattttgaaagtcccatgattggacttcaacttttgaagctttccctaattaaataaatgcttagcaaagtcctcagttaatgttctttaaagtgctattctcttcttattccatgctcagttgatgaatctcagacactaaccccatagagcagttctcaaattcacaagccacctaatgcccactgccatacgtaagaaggtggtctagtaaattttggagtaaaggcaatatatatttcacaaaatcaaaatgtaagatcaattacaattcagctaatatttaattaggatataaggcatctcagtgaatgcatttttagtttttgaagtacgtaattatttttttagatttgtacttagctattcttactaaattttggaaagttcctgctttatggaaatgaatcagtgactctaaatggttctttgaggtataaaaacaaagatagtaacaaatacaaatttcacaatctggactagaaaacattactagtgaccacaactcaaatacaaatataaaaagcatctttattaacctggggtaaaagcttctctgcgtggggcagttttacccaggcaactgaacaggcggtgcgggaggaatgtttgaaaattggaactaacttggacgcactcatccccattttccatgcctgctgtgcactcctgccagatgggaacatgatgtcatattttccgtcagttttcaaacaaaacggggataatctaatattttctggaataaccatagaataatgttttccaatgtgaacttggtgaattttatgagtgaaagagaagcagatattggatccacacagccatcattgaaggtggcacacctaacatcaaaaacttctgtgcgggaccgggcacagtggttcacgcctgtaatcccagcactttgggaggctgaggcggttggatcaccttgagcccaggagttggagaccagcctgggcaacatcaaaaccctgtctctattaaaaaaaaaaaaagtttcatgccactgttacggactaggaatgtctaaaatccatcacaaagttagtattttgcttggaggggcaagtagaatgagcttttggaaagtttctttaacaattctttgatctagtaattcctgaaaacctttgaggctggtgaaaatactttttcatgtagggatgaatcattctgtgagtcctggcgtaagtcagccagaaactcataatgggagcttttgatggggggatatgaggtttaaaaatggaaataaaaactttcttcacgacactgataattcctataaaggccatttctgtgtgggatgacatgtacaattaacataaatgaccctgcttccaagctcactgaaatttttcgccagtgccctcagacctccgtctttgctcctaactcagattgtcttgagtcctctgtgtagagaaaaggggatcattgcagagactgtgaaccaagacattaatcttcacttctgaagtccaaaagcatcttttggtctgaggtagaaaaagtttgaaagggaattgagcaggctaaaggtgttttaatttttctgctatctcgcagactaggaaccctcagcaggactgcacgatagtatgcatagagaggtggggactgccctgaagctctgctctcaagcagagccttgccggtggtggcttaatggaagtcttcactgaagctcagggatctgagtgggcactctcaagtgtgtagtggaaaggagaacgccagtctccaagagcagcctgcacagcatcctcattgtgctgcggcacattcagtgacaggactggacgccctgcggcagctctggtggccggtgaggacagccccagttatccaaggacaccctgaggtaccaaaggcaggtgagcaagaccatgttcctgcctgaggtctggcagagggaggagaaagggtcaccaaaacgttgtggagagcactgtcccagcctgggatgggaggacttggctccgtcggcagcaggtcgccatccctgaggacagtgcagtgctgacctctacttggggcttgaacacactcccctccccgctttaccaaggcaattagcaaagccagaagagaccagagttaactctggggatgaaggggaagtaaaagaacccctgaaggaattttcaagggtctgcgaccaatacagacacgaactgacaggcttatcccttaactggacggagacacctgttgtgactacttccagtctctgtatcagccagaattccagctcctactagaaagctttctgggttatggagaaatgaagttacattttccctcatgagtttgtgatttaaaaatttatacctgcagaatgattctgacggatttgctcaagtggcttttgtcagggttatagtcagtatcttctctagcctcaaattaatgtgatgttgttgaggatgacttaaaattttctttgaaagtctgaaacatgatgcagaatgcttgcaccaaaagagttttacattttccccacgcttgtacttactagagccaagtacatcaaaggtgtgggttaaaacccgtgatgcagggaactctgacacttgtgataacatggatgaacctggaggacattatgttaagtgaaataaaccaggcacagagagacaaataccatatagtctcacttacatgtggaatttaaagacagtgctcacagaagtagagagtagaatggtggttaccagacgctagaggagaaggtggatagggaagggggagatgttggtcagtaggtacatagttttgggtagataggaataataatttctgttgttcttttgcacagcatagtgaatagagttaataagtgttgtctgttttgaaatatatgagagaattttaactattctcaccgctaaaagaatgatacatatttgaggtgactgatatgctgattagcctgattcgatcattttacagtgtatgcatgtatccaaacatcacattgcacctcataaaaatgtacaattattattcatcaattaaaaataaaagttaaacatgggagttagcaaacttctgctgtaaagagacagatggaaaatgattttggtattgtggaccatgtaaggtctctgttacatttcttttttttcttttttctttctctgtcttccctccctccctccctcccttcctcctccttctccttccttccttccttgcttttttccttccctctttttttcttttcccctcttctctctttctctttctttttctgaaacacagtcttgctctgttgcccaggtttggagtacagtggcaagatcacagcttagtgtagcctcaacctccgtgggctcaggtgatcctcccacctcagcctcccgagtagctgggaccacagtcacatgtcataacacccagcgaacatttatattttttgtaaagatgggatctcattatgttgctcaggctggtcttgaattcctgggctcaagcagtccagccacctcagcttcccaaaatgttgggattacaggcctgagccaccatacccagcccccgccctctttgttttttttttttaaatgcaacgctttacaaatgtaaaaccattcttagttctctggctatataaacaggtcataacctagattttggctgccagacctaatctagatttttactaagcctgcatgctaaatatgtctggcactttcccttaaaaagctctcagcatttatcatatgccagtgtgcttactaggtgtttgtatgcttttcttacgctttgtgcaattctaacttccttgaaggaagggtgctatcttatccttagtgattagggataagcttggaatcatccaggctctaccccttactagctgtgtgactttggacaaattcctttatctccctgagtttttgtttcctcagttataaaatgggattagtaaagtacctatcatgaaacagttaacttgagtaaaataggttgtgaagattaaatgaattaatacacataaaataattaggttatgttacatcaatgttcagagcaggtgtatccacaagagccaaaagagaaacaacccaaatttccattgatggacaaacggagaagcctagtgcagtgtaggaagaaaattctggcccgtactgtaacacagttgaactttcaagacattatgctaaggaaaataagctagacacaaaaggacaactactacgttattcatttatatgaggtacctagagtagtgaaattcatagagacaagaaatagaatagtggttgccaggggctggtaatggaggttattgttagtgggttcagagttttcatttgggaaggtgaaacagctctagagatggatggtagtgatggttgcacaatgtgaatgtacttaatgctactgaactttacatataaaacagttcaaatggtaaatttcctgtgatgtgtattaccataattaaaaaattagtatatgatctgatccaaagtagctaaaatctactgagtgctgctgaagcaaaaattataattagtagtttttttttaatttgttttgttttggtttggtttttgagatggagcctcaccctgtcacccaggctggagtgcagtgacgtgatctcggctgactgcaacctccgcttcctgggttcaagctattctcctgcctcagccttctgagtaactgggattacagggtcgcgccaccacgcctggctaattttttgtatttttagtagagacggggtttcaccatgttggccaggctcaactcctgacctcgtgatccgcctcggccaccttggcctcccaaagtgctgggattacaggtgtgagccaccgcgcccggcaattagtagtatcaacagtgggagtaaaagtggcagttaagcacattgtttcacaacatctagctcagagccatgacaaagcaaacattaaataatatgtatagatggaattaaacttaagcttctgtagtagaataattcagaataaaacatgaaataatgccaggtaatgtcagttgttaccaaagaaatgtccaaactctgaaagagcttgttaaattaggttatggcagcccacggtgcaggggaggggaccgtcaggtgatgtttaagtagtttacatggactgaatgaatcccctatggttccatttaaattggccaccacactgccaggcatatgacattggcaacttaaactcgacagagaaacctctaagaataagattaatgcatttctcattctctgtgtcacaattattcaatttaaaaaaacaggaaaatatcaaaaatctttttatgaaatggctgtaccagttttaccttctatagtataaatgcaatatggcttttggtgcatttaaattaattttataaggagtcccaatcagctgatgagtagttttagaattgttcctataattgtcaacctggagagctcttcactattttattcatacttcactgaaaattaaagttcagttttatgcctaattttatacataacgtgttgtaaaacatcaccatttgggtgatgtgtgtatatgtgtattttccttccaataggatatatatgtgtattttctatttataactagctgacacaggaccattctcataatcccatttgatttttgtatttgtcagtagatataacaatctccctttggttcagattgaaaaaacggaaaatgatgatgatgatgatgatgattgttgactgtgctgataattctttgtataccattattttagctttaaactattttaagtgtggtccagtacaaaagctgcttaagtcagataccccagtctctatgatgtgattattatgtattacatgcctgtatcaaaatatctcatgtaccctataaatacatacaactactacatacccacaaaaattaaaaattaaaaaggaaaataaaccagaaaaaagtcagattttttaaaaattttacatttcattatatttagaaaacttagctttatggggttttagagaacatggtttttcttccatgtatcttcctatttattttttatgatgctcaaagttgctaagtttccacatattttagtaagaattagcaatgccctgaattccatagctttcataaaggattacctgtgtaccatctcatcgccacctctttcctattacaggaaagcaataagaagatattctgtagttaatttagattgcttgccaaaatagttttaaactgatttgtaatttttcctaaaccagaatgaggaattgtatagtttaaagtattaatatatatgaaattgtcacactacgtttcagatgcttaggaaatgtagagaaattattgtaaaatacattttagaaaagatgttgcaacaagacgaggacagaagtctgtgaagtgttgtgaggagggcccagggaagcaggaggaaggtggggagaccacaggatgacctggagccaaagaagaagggcccaggtcccagggtctctacagcactgccggccttccagccacagtttttctcaatcttcctgtcatatccctcaaggaagtaagtggacattgtaaagagcgagtaattatagcacaacaaaaatcaaaagtcatgattctggaaagcattatcaataaaaaatggagaaatagttgacatctcttcatgtttcctctggaaatttctgattatgtatgtatactcttccactctaatatccaaacaactctcttacttcttcatgcaaagaaacatgaaagaatgaaaaggttcatcacaagtgtatgattaattttgtatatataattttgcaaattaatagattttaatgtgttcaataaatgtacataaatacacatgtatgtatatatctgtgtgtgtgtatgtactatgtactaaatatatactatatgtgtgtgtgtgtgtgtgtgtgtgtgtgtatatatatatatttagagagagtcagtgtgtacttaatagtcaaatccaaatttcaagaactttatattttatgtaatggcaccagttttcctgaagctgaatgtatgtgtgtgtgtgtgtgtgtgtgtgtgtattcagttgcaggaatatatacatatatacggtcagtgtgagtgtgtgtatatatatgtcagtacatacatggtcagtgtgtgtgcatataaacacacatatgtcagtacatatacacatatacatatatgttagtgtatactaactgtatactgactatatatagtcatagtcatatatactgactatagtcatagtcatatactgactatatatgtcagtatatacatacatatatatttcagtatatatatgtatgtatactgacatataggtatagtcagattgtgtatattcagctgcaggaaaattggtgccattatataaaatatgaaattcttgaaatttggatttgactattaaacctgactttgttgtcattaagtttacattgatatttcctggaattgcacattgctaaatttttctgcaaaaccaagatttctaaaatatgatggggcatttgatacaagaaaaggcaaataaagaaaaagtagagctccatttgtcattcttcttaagtgtctccttaagaaaactatgtgatccaaagttatttagacaaaagcttaagaaataaaacacttagtaactcatgctagtacttgattattcttttgcttatcaagttttcttctttttatgattattatacctttaattgcgaacattcattggattggctcagtagcattttatgtgagacaactttccattttaataagtacatattctccttcgttaatatgaaatagaagtgcaggagtagggatgaaatggataattttgctagaagcaaattgaaactggctaggcaaaagcgtatatgtattttgccctctttttctgtttttagaaagtgcttgcgttaactctcattctcagccagaagcgttaatgattcaaacgggctttatatattgaaaaccatgaactctcacgtgcagagtacaatcagggagcaagcccgtgggtttgaatggaaattaacgttggtgtatgggaatgaatttcatagacaaggataatttagaaacctgtgtgataaactgcaaacacagagcaaatggaaacatattggatcttttccctccactcctcatatttctccactattcagatgtccttccatgtgatcatgctttcttggcacactgactaggttcagtgattaagaggcagagaaaataattactgaatatttttaatacaaaatgaatagctcaggatatttgtaagggcttttcaatatcaagatatttatttcccacattagaaagtataactcctaatgaaaacttggcaccatagtttaaaatcatattaataaataaaagcaaaattcttacattggggaaatgacccacaaatggtttgttatagtatgcgatctttaactacttagaatttccactattctgcacagtgcaatatcccaaaacagaataggatgtgagatttcattgttttgtatgaggaatctagaggatagaaattgataaaaatgtatgcaataatttaaaaatataaagagtatcaatctctgatagaataatgtaaatgtagcaaatatttaagataactaatctaataagaattaaattcccctacatttttcttctcccctcccctcccctcccttttccccttctttccccttctttctcctttccccctttcaccctttttccctttccctttccctgaacagctgggattacccttgtcccaagtaactgagattacaagcacccaccaccaggcccggctgatttttatatcttctggtacaaatggggtttcaccatgtttaccaggctggtctccaactcctggcctcaggggattcgcccaccttggccttccaaagtgctgggattacaggtgtgagccaccacgcctggtcctcatttttcataaaatcaaaattcttgcatattcccctccttagtttataggtcagaagctacactaagcttcccaatgtgcctaggtgttagatgtgccaatttacatatgcaacaaaggacctgaaaagtagaacattaatacaacagaaaatattttgcctgaggatattgtttactaaattttttatctgtgccttttaatagttcttagaattagtaagtccaatggcattctatttttatgcttttttttcctcagatttgtagcatatgacaatgtgaatatgttacaaatgttgaatgattcagctgactacaggccaaacaaaatagcatcaagttatctatagcaaaatgtgtttcgattgaagaaatatgtagattttaaagaaattaatcttacttacttacgcaaagagtatgcttcagcagcatatgtaactttaaaattcatctaaaataggttgttagtactatgacaggaagtggcattcaaacaaacaaaatattcataaggatgttaatatagattagacatgagaacaagaaatatttggctggtctgattctcttgggtcactttaaaaattatttttaaaatttttgaaattgaggcataacttaaaatacaattaaatgcataaagtgtgccatttggttaatatttacagatgtatacgcctgtattaccagagcccagatcaagttacagatcagttcatcacccccttaccatttgttaatactttttattgattatctaggcacctcccacctatcactgttctactttctgtcatattatttaggttggcttgtgcttttgaacttacaaaaagtcatacagtaccagaatcatacagaagcttttgtatccagctccctttagggagcataaggtttctgagatccatccatgttgttgcgtggatttgtggcacatttccttctattgctgagtagatttcaattgtgctgtttgtttatccattctttttaaaatggacacttgtggcttgtttccagtatggatctattatgaataaatttctacaaacattattttacatcgcttttgggagtggaatttcagtatgtgaaactctaaagaaactgtcaaactattttcaaaagcccttgaacatgttatactcccattgccaatgtgtgtcaattctagttgcttcttatcctggtcaacatttggtattaaaatcattaaccattagagaaatataagttaatatcatagagagataatatgttctctaggatggctaaaattaaagaatggcaacacctgtgaactatattactcatggcaccacaaacaacaacatgagtttcagcatatttgtatctgtctcctttgcccctgaggcccacaggggcaatgcaatagggcacgtatgaatattacactcatagcagacttgtattgcagctgagaaataatgagcttggggaacctactgcagttatagcaagtagtaagtgagaaggctctttgtgtggaagaaaatgtaacctcacctctcaaggttaccagctgcataaacaaccatgaaaaaagggtccataaaagagcttttaggcctttgtagtcttagcagacccaacaaaacatgtaggagtgcaagctgcttaaagtggactgtctctccatacattattgtgtatggataacatgttcctatatggagatcttctaagaaatctagaaatctaaaagacaccaactaataagtgaattttaacaagttaacaggatacaaggttaatatacaaaaatcaattcttttttatgtagtagtaacaatctgattatcaaattaagaaaagaatttcattcacaatagcattaaaaaataaaatacttaaatgtagatcttacgaaaggtgtgcaggacctgttcatggaacactataaaacatagctattagaaaataaagaagactcaaataaattgagagacacactatgtttatagattggaagaaactggaattgtcctaattgtaataatcctaattgtcatactttgttggtgggaatgtaaatagtgccaccaccttggagaatagtttggcagtttcttaaaaagtaaaagcatgtacttaccatataacctagcaattccactccaaaaaatgtatgtccactctaagacttaaatgttcatagaggctgggcacagtggctcacacctgtaatgccgccagtttgagagggcgaggtgggtggattacttgaggtcaggagtttgagaccagcctggccaacatggcgaaacccagtgtccactaaaaatacaaaaattagctggacgtggtggtgcacaccaggaatcctagctactcgggtagctgaggcaggagaatcgcttgaacctgggaggtggaggttgcagtgagctgagattgcattgaatcttggcctgggcaacagagcgagactccgcctgttgtaaaatgtaaaaaaaaatgtaaaaaaaaaaagtaaatgcaaaaatgtaaaaaatgtaaaaaaaatttatatatatatatatattcatagcaacattattcatagtagatgatatggtttggctgtgtccccactcagatctcatcttgaattgtagctctcataattcctaggtgttgtgggagggacccagtgggagataactgaatcatgggggcggtttcccccatactgttctcgtagttgagaatcaatctcacaaggtctgatggttttataagggggacccccttttgcttgataatcattctctcttgtttgctgccacgtaaaatatgcttttcgccttctgccatgattgtgaggcctcctcagccacatggaaatgtgaatccattaaaccttttttctttatgaattacccagtctcagatatgtcttcatcagcagtgtgaagatggactaatacagtagacaaaaactggaaacaactcaaatgtccatcagccactgaatggataaccacaatgtggcatattcattgaactggttgctatttagtaataaaattaaagctactgataggccatgatttctttatgtacttaattgttgcttaatgttaccaattactcttaatgaagaatgccgtcccactcctctctaggattttcgcatcactctcttacagtttgcgttcttccttctaaaaatgttgtcctttcacttttttcctgttcaaaaaaatccagtgatacatgtgacagctcaactgtcatgcagttcttggcaagaaaggtgaggttgaataggaaacttcctgtttaccagaggcaactggaatcactcaagaataaagggacactgtattcaccatcatattgccagcttctgctccggagagatgaagtacatgtctttaatatattcttcctgataagtacattttaaaaggaactttatatataaaataaacataagaatgaaaaaatgtagggaagacagaccatctaggaacctgaggaattgaggaaattatagagatagaaaacaaattagtggttgctatgtataactgtaaagggtaccaatgaggaggattgtcgtggtagtgaagtcattctctttcttgattgtggtgggggttacggaccctaaacgtgtcatacaactggatagatacatcgtttcctggttttgatattgtactgtaattttataagatgtaaccattggtagaaactaggtgaagagtacacatcacttctctgtactgtctttgccaattcatgtgaagctgtatttcaaaataatttttttcttaaataacatttaaattctgactggcagtttaatttgtgcttcaaaactgattcaaaaggactatgaccaatgatgaaaatggtaaattacaacaattggtcctataaccaactctcctacattagttattaaagtcagtgttaagggaggcattccagaacttctataggacatggtgcagattcacctattttctttcacattaatttttgccaactggatttttttaggttgtcatattttttccaaagaattcagtgggacaaacgttagcagaattctgatgccccacattgtccctgttgtgtgcttgcctctaaaaaaattcctctgttaatagcaacttaaaataaacattattgtaatgtttagaggacattccttttgcatcatattttgatagtgtcctgttacatgcaataataaatgcatgtctctcttcatatgaggctttaacagcaatttcataaactataattagtttaactacataatatccttaggaaaaatgtaaatattaccatctctttttttttagggggtggactaggggattttggttgactgagcaatcaatcacatacagatggataatttgatattcactaaaatattcacttctcagcatttcactctcgtgtttccttgcatgacatcaattgtcatttaataagaaagacaaatacacgtgtttaatcactccctgaagaaagtaaacacactatctgtgggaaatggaacacaatgagaggcgtgccatcagcctcagggtgccctgactccattccagccctctccgcatatgccccatttgcacatcacccatcacttttgcctaattgtttctactcaccaagtgaagataatggcttctttgcctgctcaagtgataatttgagattatatgtctcatcagatactttattggatgaatgaaaaaatgcacaatgatggttttattaaattatgcagttagttaccaagatgaatggaactacacctatgcaaaaatcaagatgtggagataagggaggttataggctgagtcatttaacctttagggctctttctgatattttctgtgagggccaaatagagttctcagtggactgcatgtgagtttctgccaatggcctgtggagcaagtgcctgcaagagggaacactcccccaacttctggggtgataaaggatttctcactgtcccaccagcctgcacagtaggtttcaccattttgttaactattccagctgaacttttcttactgacctctggtttcatctatctaaggtgagctcctgctcacatctctccctgcgaggttcatatctctttagattttaggccaggtggtggttctgcaagctcaactctccaatgcatttgtaaaagatcatgaacttgaagtttgttgtaagggtggaaatgaggctccttatagctttctacttcctggggcagaagccagaagttccagcccatagattttgataagttgtattttcattttcattcagcttgaaatacttgctaatttcccttttagtttcttctttgattcattgagtatgaagtatgtgttattagtttcctaatattcctggatttttcagagaagttgctattgctgatttcttattttaatctattgtatatcacaaagatatactttacatgacttaaatgattttaactttgttgaaacttgtttaatgactcgtttaatggtctattttggtaaaagttccaaatgaactcgaaaaagaatacatgttcttctgttaggtgaaacattccataaatatcaatgaatcatataggttgatagtgataattaatacttctgaatccctattttctgtcttcttgtgcaatcagttactgagacggggtgctagaatctcctactgtcattgtggatttatctatttcattcagttttactagatttcatttcgtgtattttgaagctctgttattaagtgtttgcatgtttaggattatgttctctgatgaaagaacatcttaatcattacaaaataattttctttaccttttataataatttttgcactgaaatctactttgtttaatatagccaatccagcttttttaaaaactattattagcataatatatatttttccatgtgtttacacttaggctatttgagccttttttatttaaagtgtgtttcttgtaggcaacatatagttggatcttgctttctcatctaatctgaccatcattgccatttaataggagtgtttgcactacttacctttaatatgattgtttatatgattaattttaagtctaacatctactatttgttttttgtttattctttgtccattttcaaagctgctagggagtgtagatgcattttgtaagagaatacattttataaattgttatatacactctgagattttaaccataattgcagttctttttttatgaacacatttttagtaggctgaatattctttctgcttcaacctgctaagattgaaggaaatactgctgaaatagaacatgtacacaaagacagattctgagggagggtttctgtatttttttactttaaagcagcctagttgaaaaagactgtggtacctgattctatatctgtgtagttagcccttttttttctaaatgaaattagatctcaggtaaatgtttaaattcccctcagcaaaaaggcagatctactgacaaaaagcatggctgtttaaagcctataaatctcagaagtggaatgagggagtttatttaaagccagcttcactcctcttccctataaattacatataatcacactggagtgtaggagctgtgacagtccctacctcacgtctcacttcccacctcctgctcaccccaggtaatacctgaaatttttaatgtgaattaaaatgcaattagatgaggaaagaaacaaacaaatatatctggataaaatcacatttgaaacaatttgttatcttagtgggaagtgtctcatggggacaaggttgacttaactgtgtgtttgcttgatatatagaagcccctaatagtggctggctttgaacatttactttgtttacttatattttgtgccctcaatatcaaatttagttaaggaaggtataagattatggtgatatgatgataatcgtaatgatgatgatgatgatttacctgtgcattatttcccctgtaaacaaagtcaatacatactctgtaacagtgctgccacttaatgactagatgctatagtcatgggaagttttattgttgttagtcagaaacaattcaggctccagctgtagggtttctacttttcttttgcagagccccctgccccagatagtgaaatgtaactttgacctgatgtaaatgcagaattataacacagatataactgtacaaaatagagacataatcctgccagattatttataaccaaaaagtactaagtgattgacaaatcatgtgaatatattcatggacaaggataaaaatgaaacatagctgattttaaaaataatatctttccatgtgttttaattagtgattttattttctcatctgtaaggtagatacgataaagacaacccactgaatgcttttagaaataaaaaatgataatatgcttgaaaatatctggtcgaattctcagcatacaatatatgcttcacagtttctcacttccctcttttcccttgttttccattacaaaataagtggcaaaactttaataatttcctcagaacttgaaaacttaaaagtggataaaacggtacataagataaatcctatgttgtgtgaacatttagggacaaaacagcgcagctcagcatcttcactgtggtaccaatatcagcctttataaaaacgaattaccctttaaaaaataacatctgctgttcctcaagccatataaagtgtaagagaaagtttcagttgctcagcatattttaatctcattccagtaatggaacatgtgtgtcagaacatatattatgaatggaggggatgagttttcgtgattcataggatctgtggggtagaattgtgacactttatttaactcaggtgcaatgtcttgtcagaggcagggggaggagggtgaagtggagaagaaacatttgttatgggggagaggctgagcttagaggacctaactgcttcccctgttttgtgtacaaagttttgttgaccatagactagaagggactatgaaaagacacttccaggttgaaaattagtcagcacatgtataatcttgacttaacaaatagaagactttcatttgttttaatttaaagacaacaaaaattgagtataacatcacatttgaataataatttagttacaaagtgctgtagtttcagttatcccattgtcttccttacagtcttgtgaggtgatttatatgactgttaatcccctcactcccaactttatgcttttcttttttaaacaaagacaacatttttgtctcagagaggctgagtgactggacaattaccacactctagttgggggtggagtcagccaatctcctttctctttctgttacccatagtggccttctataccaaccatcaaagctgcctttaacaaaggcacacagattagtgctatccagcagtgcacaggtcagtcacgctgtgtttcccaccatttccactcagcgtttaattaaattgtgtgcacagcagcttacccttaaaatgcatctgggattgcagattgtaaccatgagtctacaacatcctgatgaaattctttggtaatgccagaatttcattactttatcagtaatggctgaaaatatagcttatttgcatttaagtactacttcatcaaaggtaaaatgaagtcactgaaatgtgtcatctgttagcaggagtgcaaccatgaacaccaacaaactaacaaactgtgagggatgccgagaagagggatggctagtggctccctcttcatctaatgaaaacacaccatcccagggtagcacaccagaaccgtgtcaactcattttcctccttgtgcttctccacatgtgttctcatagtaattacttttctaaacctggaatgagagggagtgaaaacaccaaagaaaggttatgaaatacaagctgaagaggatgcccttcatgctgactaaccaagatgaggggaagaaccaaaaatattgaatagttcctcagaagtttcagctctgtgtataaaattcccaatgtacaacatccagcctaagatgatgggttggctgttagcatctccttcaccttctcccaactcttttaaaacaaccataaaataggctgggcccagtgcctcatgcctgtaatcccagcactttgggaggctgaggtgggcaaatcactaggtcaggagaccaagaccatcctggccaacgtggtgaaaccccgtctctactaaaaatacaaaaattagctgggcgtggtggcatgtacctgtaatcccggctacttgggtggctgaggcaggagaattgcttgaaccagggagttggaggttgcagtgagcagagatctcgccactgcactccaggctggtgacagagtgagactccatctcaaaacaaaaacaaaaacaaaacaaaacaaaacaaaaccccttaaaatagtaataagaaaaacagaaaaggatacacagtttcagtagtgttgtacctaggaccattggttgctagttagaccaaccccaaaaggatctcccaccaattaaagtttacataggcttaggagagaagagtagatctggtggagtcaacaggaagggccagtagagaaaaccccattggcactgcaccctcagctttccgaaacccagaccttgcctgaccaggagtaggagaggttgccctgctgcatgggggctgctcccttaggtagccagacctgctcactcccaaatgtctttacatctttgttacatttatttgagaaacaccacatcccatgattatcatcaaaataatataataaaaatatttaattgcacaggttctggatccaaagcttgtgggccccttgctagatgcgtaaacataggtgagctgcccaccatccatatggagggtagtaatgaggccttgtcttttaaaggtatgttaggaattaaatgcaaaatttacttaaagggaactctttgcctgacctagagttctcaaatgctcgataagtgttcattgttaaattgagtgattatggaagtgggtacgtggaattctgttacatcctgaaaagttaagttggaaggaggaatgagcagagagaagaaactgtggaagtagttcctactgagggctaaagaaatctgtgcactgtctctggcaggggctcacataaatattgctgtaaatcatccaagaataaatcttgcccgatctaggaaaccatgttgcatgagtggaggatgcccctgatctatagcagaacatttaactttgaacaagagctgtgtccacctcctagctgtctggattaagaaaatatatggagtattttagtgtcaatcagatgcacagtgttggttatcagtaattttccatcttgtctactagatcaaattcctgactcttcaattcagaacatagaacaataaaaagcaaaacaaacaaaaattatatttatatatatgtctgtgtacatactatatatataatataaactttagaggtgcttatcgtacattcagaggaaaaaatatttttgaacaaagattcactacaaaaatatcttagaatctgacttctaagaatctgtaaacttgggaatcataaggaaacagtagttaagtgtggtcatcaattcaaataggtgcctaatatttatatttcttaacacttccccataataacttatattaaagtataatgtcctcacttattcgtttttacacctagctatattctaataatatcaaacttttttggacatgtagtgaagtactaaagactttacaaatgaggacataatgataaactcctaataataaaatacacagtataagtcaatgaataataatgaactgtctagaacttcagaatttctgtcagagccttcaggtaagtggcagcaccagggaataataaaagtgttctgactcctcagcttgggaatagtttatagagcactctctttttctagacattgattattaaagaagctgtggttttcgagtgtcccctaattctattagactagaaaaataataaacatcaataaaacatcagcggacatgcctatgtttttgtttcagatgtggcattggtcagagcaaaaagagcaaattttctgctctgcatgcatcttcttcaatacccaacagtctccttttccttgtccaaggtggatgagcgctgtgtgaggcttgccccagtttccctgcagtactgccagagagagcagagtgcaccagaacctgcttaggactcaccttgaccatttgctactccatacctttttgtattttttaaccaatatctcctccacaccccagttcctcgtaaccatcactctcctctgtacttttgtgaaatcaactttttagaattccacatgtaagtgggattgcctcacaaagcactctatgttttaactcttcttttacatccatttctcctatgagactgtaagcactttgagtgcaaggtcaatatattaactgtctttcttttatcagtgcttaatactgtacttcctactactggaatttagtctcttatgttggcaaagggcaaatcttgcacaagggctatgaaataacactagttccaaaagttgacaggaatgctctagtggccacctgcattaaacaaacattttctgcagtcagtgggacacctgccttctagaatatcaggggtcatctagctaaatgtgaacacaatttagggttcatccagtcacatgtaattattctattttttctattgtaaatcgatgattttcttaatatatattcataattttatagttttctaatctagtaacagctatgttaaataacttcctcctctaccatttttatactttttctgtttcaaaaaaggagctggtggctggaccccacttgtgtcaaataaataccaatggctgcaaattgaccttggagagagaatggaggtcactgctgtcgccacccaaggaggatatgggagctctgactgggtgaccagctacctcctgatgttcagtgatggtgggagaaactggaagcagtatcgccgagaagaaagcatctgggtatgtttctaataacaataattgctacctattgctgcaaacctattagaaaaacagaattttaagaattactttgaaaaaaatgttctaagtgaaagtaagatacctatttcattgaaagcattgaaagagaatcttataccattaaatagtgtggaagttaaaaaataatacaaatcatatataatttattttttcttggtttgcttaataaagtaatttaacattgcctctgcagtattttagagtggtagattgaattcatttattttctctgatttgatctgatatttttgaaagacactgaaatttcaaaatgtaataaatgagcagtttctgtgtgtatgacaagtacaggaacacagactttgaacttgaagaattgtgtgtcctttattaagcagccagatttagtttttcttgttttttttttttttttttagagacagagtttcgctgttatcacccagactagagtgcagtggcacaatcttggctcactgcagcctctgcctcccaggttcaaacaattcttctgcatcagcctccttagtagctgggactacaggcatgtgccaccacacttggctaattttttttttttttttgtatttttagtagagacagggtttcgccattttggccaggctggtctcgaactcctcacctcaggtcatccacccatcttgacctcccaaagtgctgggattacaggagtgagccaccgcacctggccagatttagtttttcatagactacagatctctgtgacattctctgaatctgtaaatatcctcataacagtgacattatttctgtttctgattatatgtcagtgcctctttgccggggtaatcactttttgtttgacttttgcagctacttgggaggctgaggtaggagaatcacttgaacccgggaggcagagattgcagtgagcagagatcgcaccattgcactccagcctgggcaaaaaagagagaaactctgtctcaataataataataataataataataataataataataagtatttattacatagtgtttgaaagtaacctgtatctgtttaaaatcttgctctgcattgattaataatgtttaaaatgttgtggacagtttccctataaaagagatgctgtaagagaagactcatatagagtctgcatcgtatttgtaatttggctctttcttcctcctaaaaaaaaatacgtcaatgacagaggtaccgtcagcatttttgttaccaagttaagcagttcagagggaaaccatagccaaggcaatgtcatttgccaattttgcttactctgaaaggttactagcctgcggggaaagagcgtaaaggttaaggttcttactaatccagaacacttaaaatgacagatgtcaactctcatgatcttacctcgtgtaggagcgtgttgagcttcactggaacaagtgatttactttcctggtgcccgctcacagtgtgagcttcctttcaaagtcactgtgcctgcctttcatccctgcatctctatcctggattgacttgtggtttcccaaagacatatgttggaatcctaactcccagtacctcagaatgtgaccttaattggatataaggtttttacagaggtaatcaagttaaaatgtagtcaggagggttgaccctaatctaatatgactggtgtcctcatcaagaaggacctttggacccagagacagatgtacacacagggaacacagtgcaaggacacatagggaagcagccctgtgaggagggaggattggaataatgcatggacaagccacagaacaccggaggcaccagcagctaggagatgggcatagaacagatccctccctagagcctccggaggcagcacggccggcagacaccttgatcttggacgtatggcctccatcactttagctacctagtttgtggcactttgttacagcagttctggaaaactaactcagcctctaaagcctaactgtgcctaacaggactaggacatcaggaaatgtttcctgaatgaatgagggaaattcatcctctcccaggatgccttttttgaacaaccacactgaaaatgatccttcctggctctgcacatctcttggacttgttttggactaaagcaatgaaatgtagtgctatgagggttcaggactcagccttccatcgttttgagctaaaaggtttttggggatagggctttatctttgcatctccttcatcctccatcactgtgactggcaaattataaccatttaatagcttcatttcctactctatgaccaactatacagaatttgcatggtgaaaaaaatgttaatgctactgaagagagaacccacaaaacaaaccagagatggttcttgtgagtgttcagttataagacacagacccgaagacacttgagaatgacaggccttggagaaagcgttacctcatgagttgttggaaaataattcaggaggatatttcagaaagcaaaagtaatgcaaacaaaaacatggataatggatgagatacacaaaaaacagtgagctgtaagatgtgaaatggctgttcagactgagatggagagaatatggggaatttgctgaaagttgtaaaattgcaaagagagaggctgtcaagtttggattataaaatacctatgtagatatttgagtttctttttttaaaaaaaacttttactttttgtgggtgcatagcaggtgtacacatttatgggattcatgagatactttgatacaggcatgcagtgcataataatcacatcatataaaatgggatatccatcccaagtatttatcctttgtgttacagacaatccaattatacacttttagttattttaaagtgtacaattaaattattattgactatagtcaccttgttgtgctatcaaatcctaggtcttattcattcttactatttttttgtgcccataactatccccacctcctccccagccccccacgccccttccctgccactgataaccatcttgattcgcgtttcttgaactgctacatcaacatctcagggacatattctccatttgtttattcattaatccattcttttagtaaataagcaaataattatggtagaggttagtaatatactcttgggaaatgtgagctgagtcatagttatcatattcttcactaggcatgtcccttgtgtctagtatttttcctatcaaagctacttctgtagaaataaagttcactgactgtatcctatttattattttcttaaaaagatgggctgatattggctgtcctccagtcttatcattgctgccttaacaataaattacatctcttattagagtttctgccctttaccaaggcattaattttagatatgaatggatgatattaaaataacttaagatttatttttgatacctaaaatattaacactcttgattaatgaaaattatgtttttataggcttactatctttcccagcacattattatctttattattattatcttttcctgaccacagctacatcccctgccctcagggtcatcgtattaaccttcctgtaccaggagaacagaatgcatttccagctctctcctagggatcctgctgcctctacttttatgttaaggacacattaaaaatgcattctccagtcttatatatttcttgtatgctctccctctgtcgttttatggctttgttttttttggtctggttttacccattacctatgctaatgttttctattattaaagatccacagttgcttatctgcaatttttaattctaaaagcaaaattattaaaatggtgaaccctaagcagacccaaatttatttagcagcaaaatctgaatgtactgactttggggctatttgcattttttagttactctgcttaatgtgaatattcatatgttttattgcaaaaatagtaacatatgtgattaccacctagtcactcatatttggtgtatacacagtatgacctttctaatatatgaaatgaatctgaatctaaagcaaatctgataccaaggctttagataagagattgtatagctgtcatatcaatcactgacatttgattatctgaatggattaatatatcaatccacattcttactaattacatgcttcacattgacgcttcaagggctagactgagtttgtgttgagaaatacccaagaaaactagatgtaactcccagatttatggaatcttcagagtagtaaaagctctgttcaaaagagagaatccctgttacttacaacaggaatacatgaatattttctgagtaacagaacaagcttcattatgtattatactttcagttaacaaaatgtgtttcaggacacagactcacttgaggtgaataatctcctcatctgctacatcattttaaaaggtgtcattactcaaacaaggtcaaaagaataaacaacagaagagggaagataaaagataattttctgggagaaccatatgtgtgtgtgtgtatgtatatatatatatagtagtagtagtaataggaatggccttaaaaaaccacctggcctaataagaacaaatgttctgaatcagaaagagagaaaagatatttagaaatccacctaaccatgtcctggaatcatgctgagagattataccataacattctattaaccatagtcccagattagcaatcactgacaagccattttccctcatgtctatttttcacttatttctgaaagaataaagaattaaatctgctaggaaatatagaactttttaattcattgtgaaattttcttctggttgggattagatatattcaggttattatccatccctgacatatgtttcaagttcccctctgagcaccagactccatttcctttcggatgtcaaatagtcacatccaaaactaagtttattatctccatatccttcccatcaccaaacctattacccctgggcttccacctctcagtaaatatcacagcatttaccaattgttggcttgagccaatatgcgtggagttaccaatgacttccattccttcacactccacgatcaatccataggcatatcctgtcaactcagttgttagacagatcatgtcagtcacagcttcagagtatatgtggagtctgacaactttccctcacctctgttattaccatgacagcccagttgcccaccatctcttacctggaccattgccacagcttcacatcccatcttgcttctgcctttgcaactggcttccaatttaaatctatagaattttattttctttaattcttgctgtaaattgccacatattttatgcaccatatgaatgtagtcattttcaataaagaactgaccttatttagataaaaagaaataagcaactttgaccgtattctctgcttatctgtggcttcaaatattttgtgctatgttgttcttctagctgctctttaaaaatgtcaagcaagatccatcctttgtactagctattcagtatttctgaaattttcccctatagcatagatagcttcctcaattcatttcttgggtaaattatctcttcctgatagaattcttctagataacctaacccctaatgtgcatagaacacacacacgcagacacgcacgtacacagctcccactgccctccccaccccacccgcctccagcctgtgtcttccctggttttgtgtttccttatggaagtcattatttcttgttcccatgtatggaattttgtttttttcctgtctgtctcttctcactaggaagattttatgcaaagaaagaaaatgttctctgaataatattattggactttgttttttaaaactttctgacaaagagcatacaatttgctataactgaattcttgtttcactggtctttatcagtgttgagaatttttgagatccaaaatgtagaaccgttctaactgggaaatctaaaaaagtgtccactagctgtcatgggacgtttttggggcagtggacaaagtgcattagtagatctcccatggcctgtgtgtatttgttcctaattgttatctttattttccgggcctgactggagcaaatgtgagtggaactaacggagggggcagaaggaaggtcagaggttggagatctgccgatcagcactgagcccagaggcagcagctgtctggactgactcggtacctgctatgagagagcaggaaaggatggcagacactgcagttagcacagagacagaaacattctcagtctgagtgtgtgttacatgccagacacacagttggttgacagtagggaaaagagaggctgagggtgtggctgggtagctaccaagctgtgagccagtgatgggcagcgacacagtgagtcagaggaagagcaggtctgcaggacacgtcagccctgctgccaggtgtggtgtcagcccaaacagctgcacctgtgggtccagaggtggtcagcggatatctagtttcggtcggccttcattcagcctctggctgtcatggccactgggttactgaaatcatggcttgtttccttctgtatctctccatcttcgtgtacagcttccctttatccaacacgaagtcaggcagattgtccttgtaaggcaaactaaacattagcagaggcaagtacacacacacaacactcaggaagttagagaacattctttagtcgcttgaagcaaaagggcttttcctggctaggaagcaaaaagaaaacattgtttctaaacttgaagctaatgccatctaccatttatgaagagctctttgtgcataaggctgtgtgctctgggtttccagcactcccacatttaattcttgcacaattcctgtaagggttacagtttccaagaaggtaaagaaacagtctctggctgtgaaagggctctttttcaccttgtttcctaactccatttctacaatagcaaaggagtgagagacttagtggtgtatttgtccttatgaaacattctcacttaattctaattttttatatatatatatttatatacacacacacatacacatacacacacataaatgatcctcctgcaaagcaaaatatatgtatatatgtatacacataatatagataaagatgtatagatataaaatccatctgaaacgcaaagtgtagagaaaaaagaagaacacaaaatcctgctaggatgtggtgccaattgaataggagacatttcttcatgtggatttagagttgagcagagtagcccaagctttagaagtttgtttgagatggatctgtgctagcaaggaatgtcacatcaagtgacacctctacaaatggatctttctaatacttgtgggccttcttcacaaattaagggtcagcatggtgtgttgccaacttcacaaattattcagaagatttgagtttcagctgtaggatgaaatgagttcaggggctggatgcaggtggtggttgaacaacaatgtgaatatatttaatgccactgaactgtacacttaaaatggttaaaatggtagattttatgggatatatattttaccacaataaaaattattttaaaaggcatcctatgagttaaatagtcaatgggctatattagtagtgcatgagttacacagccttgtgttactttttttctctctgattttaattgggtctgattattggtaatattggtaatatttggtaatatttgagcaacttgcttttaactgtaggcttttgaaaaaaaccatttttttgtggattcttaaatattgtagtaaatggaaatgccctttttatgggagcctgtgctggggcttcacagtcacacagagttgcctttgagaacaagaatcagttataaactatgtaaagttgggtaatctaacttctcaaagttctagctttctcatttgtaaaattttaattgggtctgagttttaataataaaacctttattctgaaggttttattatatttttcagaataataagactcctaaggttaatgtttttagtctgatgttattgattcagtcccattagtgtgagggagaagccttctgtggtatgatgccactaggaacacagaggtaccacctgtcaagaaggatttaagccattgttgcggtgactgagtgagatgccagtactctaagttccatgggcaaacacgtgaccttgagaaatagcagaaaagattttaacacatatttatgttagattaaatgggtaactgcctgggaattttatagagtatccaaaatagcaactgtgggtgagtgttatcaaatgattaagcatggaagtgaagtacaataaccatactctttaaggagaagcccttccagctctcttccccactttgtgccctaatctggtgacaacatcttagaaagcacttgtgatgatatgaagaataatggggctgatccagaatctaactgatttattccacagtaatggttctgttttgtcagggattctgttgttttgtcaaatttaaaatcaatatagcacttcagtatcattttgttgttgtaatagtgaaaatcctcagtgatttctttaagctgctctgtcttttaagagaacctctaccacagccccaaaggggaccctgtcagtgaaagtctggtttaccagccaaatcctcagatatctctctagttccccattggctgtgagttatttgaccttctgaaacagctgccctagaattgtacagatatcttaaaaggtattaactttcatttttaaatcagtgacattgacaaatcagagaagtgtgctggtctaagcagttttgtttcaagcagtatcctctgttttactgctatcccagatactgatgagcaggggtgtttttctacactgaaactttggctatagtgataaattatctcaataggaagtataatcctctatataattagtgaaagttttacttaaacaaaagtgaatattctagtttctgatgaacattcactagataatggttttcttgtttagagagtgtatctttgtgtgcctctgtagaaaattcctgtgagctgcttttttttcctctttcattgcgatcaattttttaaactgattattctattttaggtaatatttgagcaactttctttcaactgtaggcttttgaaaaatcagtttttgtggatttttaaatattacagtaaatggaaatgccttttttatgggagcctgtgctggggcttcacagtcacacagagttgcctttgagaacaagaatcagttataaactatgtataaagttgggtgatttaactcctcaaagttctagctttctcatttataaaatgagcataattgtgtgaggaaaaataagattatccacttaatgagcttaactctgcgcttggcagataataagctcccataagacctttgttgttatattttttcttcttatctctgttgcagcacttttctattatttaaaactttttctatcaagcagtattgtctgttattctttcatatagttttgttcacttatagcatactacgtcaattttcataaacaagattgtatctatatggatacatgtaatagaacatgaatatgtatcaaacactataaaatttaaatttatatataaggatgcttataaaatgactcatattgactatattcaaattgatgagtttctagaaggaaaaataaaaatagtagggaaagcaaatagaaaattttgtttggctccatcttaggagttcaaggagagaggcctgactaaagtttctattcagagatacaaaaatgttttaatacttatacatcacagtatattatcaatgcaaaaccgcataatctcctttcctctttccctcttaatggtgctatgatattctcaaattctatgtatgacttttttttataatttggtctcagagaggctgagtttggagtttcctttattttgtggcaataaagatttatttattccttcattcctgtaaccctgaaaaagaattttaggcccttctcactagggtctatccttattttcctatgatacaaagagtatttcaattagagaagagactaaacaagaggcataaaaaataggaaccaagtaaaaattattattatttgatccttgaaaacacacataagaaaatcacctgggccagcgtggtggctcatgcctgtaatcccagcactttgggaggttgatcacctgatgtcaggagtttgagaccagcctggccaacatgctgaaaccccatctctactaaaaatacaaaaaaattagccagatgtggtggcaggcgcctgtaatcccagctactcggaaggctgagtcaggagaatcacttgaacccgggaggcagaggttgtggtgagccgagatcatgccactgctctctaacctgggcaacaagagtgaaactctgtctcaaaaaaaaaaaaaaaaaaaagattcaacagctcacattttttaatacttttttttggaaattaatttaataatcagaaatacctccctttgtataagttatcagttaaaatgaaaagaagcaaatactgtttataatagatttagaaggcataaaataccactggcaggcaggagaggggtaagaaatgtacaagctacatgggaaaagaaaggttaaaacattactatgaggtatataaggagatctgtgtaaattctcatttatggatatgaagactcagtaatgtaaagatgttaatcctctctaatttaacccataataaaatgatgtaattcaaaattttactttgaagaatgttcattcaagaataaacaaggcaagtgtacagatgccagcaagatggtgaaataggacattcgtctgcagaatcatctatttgaaccactgttgacatctgaaaataccaccgaaagagctaagtgaacttaaaagaaaatagaaaaataattcaaaatagccaaagcaatccaaagcaaaaagaacaaagccagaggtatcacattacccaacttcaaactaaaaggttacagtaacctcaacagtctggtactggtattaaaacagacacatagaacaatggaacagaatagagaacccaggaataaagctgcatacctacagccatctaatctttgacaaagtcaacaaacataagcaatggggaaaggactatctattcaataaatagtgttaagatcactggtgagccatatgcagaagaatgaagctagaaccctacattttaccatatatgaaactgaactcaaggtggatcaaatatttaaatgtaagacctcaaactgtaagaatcctagaagaaaacctatggaacaccgttctggacattggccttgggaaaggatttataagtcctaaaagcaattgcagcaaaaacaaaaattgacaagtgggatccggctagactaaagagcttctgcacagcaaaagaaactatcaacaaagtaaacagacaacgtacagaaagggagaaaatatttgcaaactatgcatccaacaaaggtttaatattcaaaatttatgaggaacttaagcaattaggcaagcaaaaagcaaacaaccccacttaaaaatgtacaaaatatatgaacaaacatttctcaaaagaaggcgtaaacatggccaataaacatatgagaaagtgttccacatcacttatcatcagatcagtgcaaattaaacccacaataagataccatctcataccagtcagaatggctattactaaaaagtcaaaaaacaacaaatgctggtgaggctgtggagaaaagggaacacttacatactgttggtgggaatgtaaattagttcagcaactgtggaaaaaaatttggagatttctcaaagaacttaaaagagaactaccattcaacctagcaatcccattactgggtagatatccaaaagaaatctaatcattctaccaaaaagacacatgcacttgtgtgttcatcatggcagtattcacaatagcaaagacatggaatcaaccttggtgcttatcagtagtggattgaataaagaaaatatggtgtatatatatacaccatggaatactatgcagccataaaaaataatgaaatcatgtcctttgtagcaccatgatgcagttgggggccattatcccaagtgaattaacataggaacagaaaatcaaatactgcatgtttgcacttgtaagtagaagccaaacattgataactcatggatataaggatggcaacaatagacactagagactactggaagggaaaaggagggagtgggacagtggttgaaaaagtaactgtttagttagtatctgggtgaagggatcattcataccccaacctcagcattacacaatataccaaggtaacaaacctgcatatgtacctcctgaatctaaaataaatgttggaaaaaactagagatccggaactgggactgctctggtttgaatgtgtccctcaaaatttatgttatgagggagtaggtttcttataaaaggaccctacttttgtctctctctcacccatgtgatgccttctgccttgttatgacacagcaagaaggccttcacagatgccaccaccttgatcttgagcatcccagtctccagaactgttacaaataaatttctgtttatctaaaaaaggaaaaattcaaaaattagtaagtcattaaatgaataaaatgagaaaattaaagattgaaattatacaaaaaactaacaaattctggagctgagaaatgcatgaattaaatgaaaattgcaatagagaatgtcaacagcagaatcaatgaagcagaagaaaggctctgaactcaaagacagtttagtgaaattatacaattggagaaaaaagaatataaagtaatgaagaatgcttatggaacttacaggaaagcatcaaaagaacaaaacttaaaagtatggacactgaaaaaggagaatagagggacaaaggtctagaaagtttagtaaagaaacaataggctgggtgtcatggctcatacctataatgtcagcgctttgggaggccgaggtgggagagtcgcttgagcccaggagtttgaggttgcagtgagccatgatcatgctattgcactccagcctggctaatagatccagtttttattgtaaagaaagagatatagagagagaggaaacagtagcagaaacaaggaaggagggagggagcaaagaagaaaggaagacaggaaggaaggaaaaaaggcaggcaggaaggcaggcagaaaaagttttatcaatctgggggaaaatttacattttcatacacaggaaggtcaaaggtctctaatcagattcaatccaagcaagactacaccaagacatattattatcaaactttgaaaattcaaggacaaaaagagtattctgcagcaaaagagcatcaagacaaaagaagcatgtcacatataagggaattccattaatactagaagcagacatcacagcagaaaccttacaggccagggaagagcaggatgatatattcaagtgctgaaaggaaaaaaacaaaacataacaaaaactgtcaaccaagaatacacagcaaagctcttctacagaaggaaaagagaaaaggacttttgcagagacacacacacacaaagtcaagagttcattactctcagaagtgtcttacaagaaatgctaaaggaagttcttcgggctgaaagaaaaggatgttaattagtaacacagaaacataagaaagtttgaaactcactagtaaaagtaagtacaaaaagtttaagtcaaaagtaagtacaaaagtaagtcaaattttaaaactgtggtggtagtttttaagtaacatttattacagtggttaaaacaaactattaaaaatagttaaagctgcaataattcattaagggttacacaatataaaaagcatcaaaaacataaagtgtgggtgggtaaaaatgttgaatttttgtgtgtgatcacggttaagttgtattcaagttaaaaaaaacttgctgcaactataagatattttatgtcagcctcctggtaaccacaaagcaaaaacctgtactagatatacagaagatacaaagtaaggaatcaaaccatgccactatagaaaattgcctaatcacaaaggaagatggaaagagaaggaaggaacaaaggaaaacaaagctagaaagaatgaactaaatggctgtagtcaggaaacaaagccagaaaagaatgaactaaatgactgtagtcagttcttacctggcaacaattaccttaaatgtaaataaattaaactattcaatcagaagacatagtgtgacttaatggattataaaaaccagacccagctctgtgctacacacagggagctcgcttcacttataaggacacacatagactgaaagcaaagggatggaaaaaagatactctatgcaaaggaaaccaataaaaagcagaagtagctgtacttataccagataaaatagattttaagtccagaactgccacaagggacaaagtcagtatgtaatgctaaagggggctgggcgcagtggctcacacctgtaatcccagcactttgagaggccgaggtgggtggatcatgaggtcaggagttcaagaccagcctgaccaacatggtgaaaccccatctctactaaaaaaatacaaaaaaattagttgggcatggtggcacgcccctgtaatcccagctactcaggaggctgagtcaagagaatcacttgaacccaggaggtggaggttgcagtgagctgagattgcaccactgcactccagcctgggccacagagcaagactccgtctcaaaaaaaaaagaaggataaaggggtcagttaaccaagagaatgtaacagttgtaaatatgtgtgcaccaaatgatggaatatctgaatatataaggcaaatactaacagatctgaagggaggggaggacttaataggagggaaattctatatcctattttcagcaatagacagctcatccagacagaaaatcagtaaggaaaaattagacttaaactatatgttagaccaaatggacctaccagacataaactgaacattgcatccaacagcagcagaagacacctttttcaaaaacacacagagaacattctccaggatagatgatatgttaggccacaaaacaagtcttaataaatttaaggagattgaaatcgtatcagttatactttctgaccacaatggtatgattctagaaatcagtaactgaaggaattttcagaaaatttggctgggtgtggtggctcacgcctgtaatcccagcactttgggaggccaaggtgggcagatcacaagatcaggagatcgagaccattctggacaacatgatgaaaccccatctcttctaaaatacaaaaattagctgggcatggtgctcgcctgctgtcccagctactcgggaggctgaggtaggggaattgcttgagcccaggaggtagagattgcagtgagccaagctcgtgccactgcactgcagcctggtgacagagcgagactgtctcaaaaaaaaaaaaaaaaaaaaagaaaaagaaaattcagaaatacatggaaatgaaacaacatgctcctgaacaaccagtgggtcaaagaagaaatttaaagggaaattttaaaatgtctttagacaaacaaaaattgacccatgccatatcaagacacatgggatacagcaaaagcaattctaggtttatagcaataatggcctacatcagcaaggaagaatgatatcaaataaacaaccaaacattacaccccaaggaactagaataacaagaacaaactaagctcaaagttaaagaaggaaagaaataataaagatcagagcagaaacaaataaaatacagactagaaaaacaataaaaaaaatccataaaagtcaggttttaaaaaatatataaatatatataaaaatataacatataaacaaaatagacaaatctttaagaaaaaagtctcaaaatcagaaatgaaagaggcaacattacaaccaatattacagaaatacaaaggatcttaacagactactatgaataagtatacctcaacaaattggacaacctagaagtggataaatttctggacatatacaacctgccaaaactgaaccataaaaaaagaaaatctgagcaaaccaataatgagcaataaaattgaatcagtagtaaaaagctctaattaaataaagacctaggccctgatggcttcactgctgaattttaccaggcatttaaagaactaatactaattattctcaaacactgccaaaaaatggaagagaagggaatactttcaaactcattttataaaaccagcattaccctgataccaaactcagaaagtacactacaaaaaaagacaattataggccaatatcctcatgagcataaatgcaaaaactctatgaaattttagcaaaccaaattcaacagcatattagaaagatcattcatgataatcaagtgagatttatctgtgggatgaattgatggtccaatataggcaaatctataaatgtaacgtatcatgttaatagaacaaaggacaaaaaacatatgattatctcaatggacacagcagaagcatttgacaaaatgtctaacaaccttttattctaaaatctctcaacatattggttgtaaagaggacaatatagctcgacaaaataagggtcacatatgacaaaccctcagctaacatcctattcagtggtgaaaagttgaaaactcttcctctgagatccaaacaagacaaggatgcccactatcaccacttctttcaacacagtactgaaagttctatccagaacaattagacaagaaaaagaagaaaaaaaatccaaatttgaagaaaacagaatttaaattgtccctctttgcagatgacatgatcttatatatagaaagccctaaagacttcaacaaaaaattattagaactaatgcataaatttcaggccaggcatgatggcttatgcttgtaatctcagcactttgggaggccaaagtaggaagatcacttgactccagtggtttgagacctgggcaacatggcaagacccccatttctacaaaaaaataaacaatgagctgggcatggtggcatgtgcctgtggtcccagatactcaggaggctgaggtgggaggatcacttgagcctaggaggttcaggcggcagtgagctgtgatagtgccactgcactccagcctggatgacagaacaagactctcaaaagaaaataaccccaaataactaataaataaattcaataaagttacagtacaacatcaacagaaaaatcagttatgtggtctatatactaataatgaagtgtctgaaaaagaaatcaagaaaataatccaataagatacttacgaataaatttaaccaaggtagtgaaagagttgtacactgaggtttacagaattttatagtagactataaaatattgatgaaagaacttaaagatgacaggaatcgaaagatatccccatgttcatggattggaagaattaatattaaaatattcataatacctaaggtgatctacagattcagtgcattacctatgaaaattctaatgacattttccacataaatagagaaaatgatcctaaaatttgtgtgtaaccacaaaggacctccaataaccaaagcaatcttgagcgtaaagaacaaagctggaggtatcacactatctgacatcaaaatgtactacaaagctgtagcaatcaaaatagcatggtactgacataaaaaacagacacatacatagaccaatggaacacaatagagagcccagaactaaatccaggcatttattgtctgttgatttttgacagaggtgctaagaatacacaatgaagaaagtttagtttcttcagtaaatggtattgggtaagtgggatatacatgcacaacagaatgaaattagacccttatctcacactatatgcaaaaatcaacacaaaatggattaaagagttaaacttatgacccataactgtgaaactactaagagaaaacacaggggaaaagctccatgatattggtctaggaaatcattttctggatacaaccccaaaagcattggcaataaaagcaaaattagacagatgaggttatttcaaactaattttctgcaccacataggaaacaatcagcagagtaaaaagacaacctatgggatcggaggaaatattttcaaacaatacatctgataaagggttaatatttaaaatacataggcaactcaaacatctcaatagcaagaaaacaaataactgtgctttttaaaaatgggcaaaagacctgaaaagacatttctcaagaaagatatatgcctggccaacaggtatatgaaaaaatgctcaatatcacaaatcatcggggaaatgcaagttagaaccacaatgagatatcacctcgtacttgttagaatggttattatcaaaaagacaaaagataacaagtgtcgatgaagatgtgaagaaaagaggatccctgtatactgttggtggcaatgtaaatttgtatatccattatggaaagcagtggggagtttcctcaaaaaatcaaaaatagaattaccaaatgattcagcaatcccactattgtgtatgtatccaaaggaaattaaatcagtatgtcttttagatatctgtacaaccatgttcattgcagtattattcataatagccaagatttggaatcaactgaagtgtccatctgtggatgaatggataaagaaaatgtggtgtacatacacaatggaatgctatttggccataaaataaaagaaatcctatttatttgtgagaacatagatgaacctggaggacattatgttcggtgtaataagtcaggcacagaaagaccaatactacaggatccagcttatatgtggagtctaaaaatgttgagcccatagaagcagaaggtggaatagttgttaccagggactagcgagtttgggagttggggagatgttggtcaaaggatacaaaatttcagttatgtaggaagaataagttcaagaaatctatcgcacaaaatggtgactatagttaataacaaagtactgtgttcttgaaaattgctgagaatagatttttagttttctcaccacaaaaataagtatgtgaggtaatgcatatttaattagcttgatgtactcattcaattatgtatgcatgtttcaaaacatcaagttgtacatagtgcatacatattttattcatcaaatttaaaaaaattaattttcataaaaggataagcagtacaactggcaacaagaaattgaaaaaggagttagtcttaccaattagaaaaatacctagaggctggatgcggtggctcaggcctgtaattccagcactttgagaggctgagttgggcagatcacctgaggtcaggagtttgagagcagactagctaacgtggtgaaaccctgtctctactaaaaatacagaaattagctgggtgtggtggcgtgctcctgtaattccagctacttggtacgctgaggcaggagaatctcttgaaccctggaggtggaggttgcagtgagacaagattgcgccactgcactccagcctgagtgacagagtgagtgagagtctgtctcaaaaaaaaaaaaaagtacataataaaggttgattctagattttagtatgcttgatattaatagcagtggaaaaaatagtattcactaacaaattcaaatatatatgctgataaaagatgtggcattttaaattagtaagaaaaaaattaataaatggtactggggaagctaggtatccctcaggaaaaaattaataaaactggaccattaccctattccttgcgtcaaagtagattgtagatgaattaaagattttaaagtagccacagaaacagttctagaagattctgggagaggtttgcatatataatgtgggagcgggcatgtatttctatgcaagatgtaaaaccaagaccacattaaagagactaataaatgaaattatttgaaacttaccagaagatatcaatttataaatgggaaataatattttaatatacatgacacagtttttttgtaaagtgctcttacacatcaatggataaagattaagaaaagcaatgtaaaattgagaaggattgataagcattccacatgaagaaaaaatagtatataaatttatgagataatgcttggcgcggtggctcacacccgtaatcccagcactttggaaggccgaggtgggcagatcacgaggtcaggagatcaagaccatcctggctaacccggtgaaaccccacctctactaaaaatacaaaaaattagccaggtgtggtggcgggcgcctgtagtcccagctactcaggaggctgaggaaggagaatgctgtgaacccgggaggtggagcttgcagtgagccaagattgcgccactgcactccagcctgggcgacagagcaagactccgtctcaaataataataataataataataataataataataataataaaattcatgagataatattcaaccttgtttataagttaaagaaatgcaaattaaaacagcagtgaggtactactcagtttattagaacaactaaaacatttactgaggctgtgttgcttaggacattactttcaactatactttcatagttaatgcattaaatttaaagtctcttaaaattaaatagtatggaaacatgcaatattatggatattattgctcagcataatgctcaggttaaaaataatcagttttaagaacaaatttaagtatgaagacattatgtatcttgagtgcttactgtgcaccaaacatgattctttgtgctttgtatatattaaaatcctcgcagaactctatgagctagatactaatattcttcccagatgaaaacaaggaaagcaaaaagacaggctttatttatttgccccaattatagagctagttagtggtagcacaataatttgaacccaagtggcctggctgcagaatctttactcacaacccctcaccacatctgggaatgttttaggtctgtttcaagtgtgcacatgaaaaggtaaaactcagatgattcaatttcaggaactggtgcctttttatgaatatgatttcttgaagaaccatttggcactatctataaaattaaagttccaaaaaatgatcaactttcagtgtagtgaatggaggtaatgcaaaaagagtgatgctttcagtttctctcaatgtatagtttacgttaagcagcaatgctacttctaggaatttatcccacagtcatagtgtaatatatgcatatgtgcatgaagagattaactaacattttatgaatataatggtaaatatgttagtacagttctctttcagtggtcatggtacatttatactctggaatagcatgcagccttgagaaataatgaggtaaacatacttgctgtgaatgaacttcaagatatttttctaaaatcaaagaataaggtaagatattctcccatttgaaattcccacaatgaatatatgtatatatatatatatactcatgtaaatatgaaatatttctagaaggacatataagaaaaatcatagcattttttccctctgggtaatgggaatgggataaaaatataaaatggatgtagatatggtttgaactatgtgaatcgtatggcttttcaattaaaaacaaactgaaataaatgtaaaaaataataataagtagtgattttaatgcagttctttttcccattgaaatttctccaggatgaaagccaatcgctaaagctcagtatactgatataaaacctgaaagtgaacatcaagaccttatcttgatgtgagagtgaagggcagtggctgggatgtgtgggcatcagtgtactggtaagaagaaagactttcatgggctttcaaatgcgaaggaacagcctggatgtcaggaggagtcccagctagggaggtcatttggtatagcacagaaggagcttattagattaaaaaacaacaacagcggctacaaaactgtatctcaagttaaatgtcatcctaactttgtaacatttattagtggatgtaacccgacagaaataaatagccttcaaattctagttgtaatatttattttagtggtgttttttaaattaatgagtctttttttcccatgtttaatgttgaatgaatgatacttattcatgtcctgggtcatcagtccttgaccatcacgtgatgtggtgcagacagcacctggctaagagtaactaactgagtgctgtttctaaaatagcccctaacaaacacctggccaagtacaaggtgctcaacacctgtgagcttcctcaccttcgattacaaaatgcagggtggatgtggaatccagtcacgcactataaggctgaacctcgtgaatgtgctgatatctaagtatcttgacctacaaaaacagcaatttcatatgatcaagctaataaatatactttgactttcaggtttaaaatcacccatttctgcagcaaaactaaagggagggcaacaccagttttccacaggggcagctgcagttcaggctaacaagttcctatctaagttctcctcatttttaaattcacatggtgtaactatttctcatgctaagattttatgagtgtgtgcaaacacacacacacacgcacagaagtgctgcaacaagctacaatgaagaaatcccaaagtagactgaacaatgggtaatctacaataaggaagcagaatgatgtaaagcttaatattttattgtgctctaaagtagtattgaagttcaaagtaagttagctttgctcagtcctccactttctcatcaaacctttgtgttgatatactcccagagttctcacaggggatccatttggaaggggaaaatgcatcaatacaagtctgccatggtttgggtgggtgtgctgggtaaaccttgtgaagaaaggcagcgcatcgctgtctcaaaatatatggctttgctgttggagcagcctgctctgtctgcgactttaatccggctttcttctaggatggcttcctttttgcatttcagctgctgactcggtttctaagttgctgctactagtcagtcactagagttttgcatctttactctcatgaccatttctccagttcttgctttcctttggtgtcaggtatcacccccaaacgtttgtcatctcatcacctctgaattaggtcctttgaccaagagtaaagccatgtgtttgccaactggtctccacctcagaaatatttactaatttctcttctgtcatgtgaatgacttctgagatggctccatatccagatgcctttctgaattaccatgagatacaatggcttgtctactctttgcctgccagtatttgaaactcagttattttccattctatcttacaattattctatgctggcctttcccccaaattatacatatgacatcaattcatgacaaatctaattttatatgccactggctaaaacatgtcatttaggctatctttacattcagaatattattgctcatttcagattgtgaattcctactatatgagtccctttatcagaagcatttgaaccatcttgcgtaggggctgggaacactgaggctgagacctgttgggctccattcctaggaggttaaggtattcttagtcacaggatgagacaggaggtcggcgcaagatacaggtcacaaataccttgctgataaaacaggatacggtaaagaagctggccaaatcccaccaaaaccaagaaggctatgagagtgacctctggtcatccttattgctcagtataagttaattataattcattagcatgctaaaagacacttccaccagcgccatgacagtttacaaatgccatggcaacgtccagaagttacgctatgtggtctaaagtggggaggaaccctcagttctgggaattgcctgcccctttcttggaacactcatgaataatccaccccttgtttagcatataataaagaaataactatatttatctgagcagcccatgctgctgctctgcctctggagtagccattctttcattcctttactttcttaataaacttgctttcactttctggacttgtcccaatttgtttcttgcacaaggtccaagaacccttttttggggtctggatcgggacccctttcgggtaacactttgttttatttcctcatatggatagattcttaaatcatctccacaatgaatattttcctaatactttaaaatataatatggataagaataaatattaataatgctatattcttaatgactctctttttgattaaaacgtaatatcatatctcgttccatcactgctggattaccttacagaggtttctgcttataaagagacatgcatttctcaaggaaaactctccctcataaatagcaggacctgaacaacatggcttctctctcatccgcgtttccatttcctgtctaaataggctttgcataaaatcctttgtttattgcgttagaaatatattcttcctttcgcagatgtccttgtggaataacctttggtgctgtggaaaagattcacgtgtcaagacactagttctgaagtagccgattggtgtcaagcatgagaataaaagatgggcattaaaaacattagcacttaacctcagtcaggattttgtctgtgaaacaggaaaaatagaagagaagtcagatttgatctgcattctgaaaatgagaatttttttatatttaaactcctcttattttgtattccttaatgttcttattaatcattcatatcaaatggcttgtctttctttcagagccttgaacattttaaagacaccatgtcattctttttacaagagagagaaaaaattacgcagttgaaagagttcccaagggagctattgtgctacactctggcaaaagttttattagctaaacttctgactgaaaggaaaaataaattcaggtttaggaacggcttctatttattgtaaggaagtttgcaaaaattactgaaaaatatcccaagaacacaatgtaaatttactctggtggtattttttccatccttgcttctccaaaataataaaaaaagttaaacggccaataaatttacattaacagtcaattgtctacccttgaatcagaatgaattcattacttcagtaattaattaagcaagctcaaatgaaaactaggttctcctgaagagcttgcatgtcagtattgtcaagtcacagttaaaacatctctaaacagagaaattagccctatcacatctcattaatttgtactatgggtttcttttattgttctatttagaatcttaatactaagattttttttcttcatctgagctaaattccttaagctatgacacaaaatcttttgcaaaaattatttctgaaaggaaactgcatttgtgtgctgtgactgggcagagtaagctgtagctacctctgagttcaggttcaggaatatgcatttcttatccttcccaaatcttttttcatgttacctgctttgggcattgtttggagcttctggttgccagaggtcctgtaggatcacatcttagatcaaggcaggcctaccttccagagctgcagaacactgggtactgagctggtcatcctcaccctttctctcttctcttctcttctcttctttcctctccttcctctcatctcctctatcccttcccctctgtggatccttaccctccagctccttgggttgtggcaccaaaaacgtggctggatctggtacccaagctaatgtggtagaggaaaataattagtgaaaaccatcagcacactccctctgttctggcttctttgtgcattttaacagtggagtctggaaataatagtcccacttcagctatttaacccaagactgactggaatgctaggaatgtcaaatcaggtagggcagaattttgtcatcagagcaagcaaatgtcaggtgaactggaagacaaagcaggacgtaggtaagaatgcagattctgagtcaaatcagttgggttcaaatactggcttcatttgctagctgtatgaacttggactagctgattaaccactttgtaccttgtttcttcatctatatagtaggtgttattatagaacatacattataggattattgtgaaaatgaaaacaaaataatctataaattagtgatagatcggaggtcatcagtaaattgatgaatggataagagtagatgcctgattgcagaggactgaggagaggaaatgagttaatgaaaaggagagagcaaatgatgaatactttctgtagaagtcgggatgcttagaaaaagagagtgggacagcagtagcaagagggacatcgggcaggagacagtgtgaagtggaagctagagcgactagagcctggtcactgccagggatgctggtggaactcccatgcccatcaacagcttggagacagaagaaactcacagagtagctgaggggcaacgtcccagagggatggcagggaaaaggatccagaacacagaagacactgaaaaacagtgatgttttctgaaacaggaggaaaatagctaattatatacgctttattttaaatttctgaaagggagtttatagctgtttcttatctacttgatgttcagaagattcaagctctgtgatatgagtgatgaaggatcaggtgctgtggttcatacctgtaatcccaacactttggtaggctgaggcaggcagatcccttgagtgcaggagtctgagaccagcctgggcaacacagtgagacccctgtctctacaaaaaaatacaaaaattacctagttgtagtggtgtgtgcctgtagtcccaactactcggaaaactaaggaagattgcttgagtctggaagatcgaggctgcaatgagctgtgatcgagccagtgcactccagcctgggtgacaaagcaagagcctgtctcaaaaacaaacaaacaaacaaaaaagtgataagggaaaagtggaattaaggtaggaaatgtttatgtgtgtgtagtagaggatgtggaatggaaaaagattttgacagggaacaacaagagtccctagtaatagtacatttctacactggaaacacctgcccagaccacttaaatccgaacctcaagagagtaggaactaagcagtatgttaaagaatccacctgatgattcccatattcattcaaggctaaggaccattgtcctcgtagcatacagaccccaggatggagaccatgaatagggaccccacccgcacagctggggggttttccccagcaatagtcagctgtttgcagaacctgtgaaggcaactgagaagactgacctagaattagcatctgcaggtatgccgacattgaggatttggctacataaatgctaacaaattggcaaaagagtctggaaaaaaaggtaccatgctgtttgggcaatgtggagaggacagttagatcaagagaggctgataatgaaaatcagaaagagtcagcatgtcaaagaagctatagtgtgggagtgagagatctgggaatatctagaggtgtacagtcaacacagagtttaaataagatttcaaagatggtgcccccatcccaggtggtgatgaggttggccatgggaatgaggctgaagtgaagcagctggagctcatttgcatcagggaacttgaagtcaaaggatcttattggtattcctcaaggatgttcatattgtggctttgggatagaggagatggtgataagtgtaagggaatgactcggagtttagaaaatgaattacaatggccaggaagggtagagggagctatagtcaaatgatatttaagagaagagataactttctcattgtgttagttcagttacttttgtgaggaggtgcaatgttatgaaatcaaaggagattggtgaaaatgtatccagaccccaccacaaataagatgaggggaaatgaggaaactgcattcctgagtgttacaagggcaggggtgtccaaaaggaagacctgagttttaatcaaggtgtagatcagtgtctgacacccaatataactgagtatttattgtgtaccaggtgagatttttagaattttagctgcattctattatttactttttcatcattaacttgggatgaagaaatacaactttagagaggctcagtaatgagctcatgtcacacaagcagagcctgtaccagaaaccttgggctgcccacctggggagccagtctcaatttctaggctacaccagaatattctcagataagattaaagtagtcttttttcttccttctttcctcccctcaacctcatcccccttccctctctcctttctttttcctttccctcccttcccttcccctcccctccttttcccttcccttctttatgagggtcaaagagtgcacagaaaaaaaactgtggggaaggaagaagagtagtggggagtgcatgggcggatgggagtgtagagagcccagaaaaggacagattgatctgaggatcaacggcatacgatttgaagacatgtccggggatgatagggatgagaggcctgggggaatggctgctctcgggtctctgattggaattctggagtgatgtggttttgctgccatcccagcccagaacgtgtctctcttcagggttccacacagaaacattaatccctaactgtttggcacgctgtggattctatggattctgtctccctggtgggagtgagggcgatgatcaggcacagctgttccccctcaggtttggaatttatcagtgaggacgaatttagtgctgggcaaaatgcatttcctgccttttaaaggaatatggatttgctcagctgaggactccagggcactttcatgcagaaggggcaggagacttagttccaggcccaagttcttttccctctgagtcataggaaccccctcctcctttctagtccctctggcattttgtcctctaaagaaatctgaacccaagtggttggtcctaaaacactatcacaaacagagaaccaaccaagagagggagaaaggatgaaaaggagatgcaggtgagaggggcgaggggcagggtgctggtgcagttcacaccagaaggaaggaaggaaggaaggaaggaagggaggaaggggcagaaggggggaggggggaagggggagggtgaagggaggagtgggagagggtagtgggggagggagggagggagggagggaaggaagggaaggaaggaagtctgaatgttttcatctcaccccacccttctccaggctggaggctgcagaactcgactagactcatttctttctatttataatttgctatgtcattttaaaatttaatttttaatttatcttcccatttaaacttaatttgggattgaatttgctttggttttgctttctgcttttttcctcctgattttagctttagtaaccacttacttcttattattgacattttactttgtatgctgaaggctaattttctaccttcattcaaagtctgaaccctgcagcgatgccaaataatacggagaagtctgattgtcctttataaaaacagcaaaactttttaagttaaatcacattcaccttgaaagaaatcatgtgctcaataaaccctgagaactgcggccccagggactcaccgtgcccacattttagttgtattttcacatgcagattaatgaatgtgactaacatctcataactcgtattttaaaatgtaatacagtatttaatatacattgcataggaagactgaaccgtggcttacgttgatgagtactgtgagaaacaaattctacattggggtgaaaatgaataaaattagaagttgggactgagaaggactgcaagctgctgtgagcaagtgaacaggaaactgaccctctgcagacttgagtaggaccagacacaactcttctagaaagacagagtaggaaaacatcttcctttttcaaagtgtacgtagttagagccccccacccaatgcattttcttccattattacctattttttaatattctatttttcaatctaatttcccttttccagagtggaaaaacaacatttaactctgggagaattttagtgtaattttgaaatctgttaagcttgctgaaagttaaaaagaagggaacatattttaaaatttacattttgctgcgtggtttctgtggtatgtgtaggcctgttggctatgaaacacccagctgctatcacctttcaaactcctttgtgaatttattagagcaagacccaagaaacaaaaacaaaaccttgtcttccttattttctttcaaccttgcttcatcccaaagtgtacttgaaatggaaatcatttgaattttccacagtgcattatgtttactgatatctatacatcttccctcagataagatcctaggagtaatcaccattacctccattttgcaaatgaagatgggaaattcaagggggatgagtgatttacatcatacttggaattgtgacaggtcttgaactctggtttatttagatcttcaagttaaaaacccttccccccaaccctgcctcaccacagaatccagcactgcctccctcagtttataagtaggtgacatgtggacagaaagattctggaaactcctggtttctcagggtggcaggattttctactggaagtttctcacaggccggtccttgtgtggtttgcaaagtgagcccacagcactgactgtggggaggaagacggggacaacagctctgtgggaaatgaaagaagcagagaattctgactgtcctccatctaccccatggctgtcctgcagctgcaggactctgttggacagttccagtggcccctgttgttctcccagttgctccaacttggaagacggaatcccagaggacaggttgctattgggcctctaagctcctcacagcactgaggacctacagaaagttcagtgacaggaaagtctgagccccaccgagatgatattaaagatgcagattgctattctgtgtttaactgaatcttcaaggtgtgaatgtcaagctgaaaatgacatgccaatattaagacattagaccaactcagtttgtgattttaaaaattataccatattttgtttatccattccactcatcagtggacatttgggttatttccacatcttggctattgtggataatgctgcagtgaacataggagggccaatatttctttaacatcttcattttatattgggggggtgtatatacccgaaagtaagattgctggatcatatgatagttctatttttaatcttttgagtatttgccataatgttttccattgcagctgcaccatttacattcccatcaatggtgcaaaaggggttcctttttttcacatccttgccaacacttgctatctctttcgaaataaatttcagttaaacaagttctagcgatctgctgtacaaaactgtgcctatagttaatgatactgtattgtttaagatgatagatttcatgttgagtttcttacaataaaaataattatgccataaaatatgcataagactttttcaatgaatgtaatactcaaaatctgcaatggaaatgcttcttagcaacaagggaccaataggaggattatatcctttcattcttcagctatacttaaagtgggtatttagagttgaaaaataatcagtgtattttcactgtttttatttggagtcactacacaaacagctataaaattttgaagaaaaataggcttatgcagaagtatagagaggaaagattacatacatccacagacctgactcctagcaagcgcaacttgtaaagtatgaaacagcttatatgttacgagtgtaattataaattggcaaaatgtcctttttatcacagtccagtacatttttattgctttcagcttgctcaaggttttatattgctcaggatttttctctgaaatgtacttggaggagagagctatacattgtaaagccatacactatcttagaaacccttacctcctgaaccacttcttctggcacaggctttatccttttccttttcttgttaagtccacagaaccatctcagggcaaaatggtgaagtgggccaacgtagtcttttctagttctctgtgtggttcacccattcaccgatctgaatttcttcggaccccgtctgagtcggttgtcctcaggagtcgtgtaaactctctgggccccagcctgtgcgctccttgtttcctagcccagggagtgccggtgttctggtttaataaacatcctggacaaatgaatgaaaaaggcactaactgataagaatccccataaaaggctatttaaactttaataatgaactttaaaaggcttgtaggcccaaaacaatgagtattttgatggtgacaactcagatgtgagaaatggaggtgataccttgagagaaagtgactgcagtagtccccaaatccctggtggatgccagaaactgcaaacagtgctgaaccctatatgtactatgtttttttcttatacatacacacctgtgatgaagttgcttttataaatgaggcacagagattaacaacaagaaccactaataaaatagaaaattgtagcaatatgccagcatcactacttgtgcactttggagccgttgttgattgaaataagagtgatttgaacacaagcactgtgataccatgacaacccacctgataacccagagggctacttaagtgactgataggtgggttgcttatagggcatggatatgctggacaaagggatgattcacgtcccatgcaggacagagcagggtgacacgtgttttcatcacattactcaggatagtgagcaatttaaaacttatgaattgcttatttctgaaattttctatttaatattttcaggctgtgattaaccacaggtaattgaaactatggaaagcgagcgaaactgcagataaggggagacgactgtatttctgatgtacttcgaattatactttaaaatttgtctatagaaaattgtttgtgtttattcttacagacctgtggaaccaatttttaaatctcctaggcaggctaaaataattgcttttgctatctcattttttataaacatttatttgtgagataaatctttacttttatcttacaaataaaaaagataaagagataaagaatataataaaatatatttgcacttctaaaatttgtattattaagctttaaataaaatacaggaaaatagttctactatactaaactaaggaattttcttctaagcctcaaatctaaaaatctataaactaatctgaaagaaaagtaatgaaaatcagggccaggtacagtggctcatgcctgtaatcgcagcactttgggaggccaaggcaggtggatcatctgaacttagtagttccagaccagcctggccaacatggtgaaacccagtctctactaaaaatacaaaaattagctgggcttggtggcaggcatctataatcccagctactcgggaggctaaggcaggagaatctcttgaacccaggaggcggaggttgcagtgagctgagatcccaccactgcactccaacctgggcaaagagtgagactgtctcaaaaaaaaaaaaaaaagaataaaagaaaatatcaatatttctatataaacttgggaatcatgcatttcagacaaatttgggtgaagttgattatggttgtcatgacaatgaaatactgaccatctctgagcaaagggcttaaggaagtatgtgggaagtgctcaaaaacataagctatgatgatgatgatgatgatgatgatttgaatttgagaatataatcccattttctttgggctattcaaaaactagcaaaaagtcaattagttaaaaaaatttcatttcagaaattagtttctgtggcctagaggaaaaatacactgtgtattctcatcaatcactgatttgaatggacacttaaaatacacctccatgtgcaggtaaaaagaagttactcaatggtgagcaaccttgtggactagaaatacagtcatccctggatatctgcgggagattcattccaggagccccccacccccaaatataccaacgttcatggatgcccaagtcccttatataaaatggtgtagttttgtatgtaacctttgtacagcctcctgtatacttaaatcatctccagattactaataatacgatgcaaatgctgtaaaaatagtcgttatactatattgtttaaagaataatggcaagaaaaaaatggttgtgcatgttcaacaaagtcacagccatccattttttccccactattcttaatcacagttggattcatgagtgcagaacccatggatatggagggctgctgagtgtactatatccctagaaagttattctgaaatagagataagtaagcgtaaatcttactcatatttacagggttgcagcattgtttataagagcgaaaattgacaactctctaatatctagaggtttatctatctagaacaggaagatcattttaaatatataccatccaaaactatgcagatcttttttttatatatacttcaagttctagggtacatgtgtacaacgtagcaggtttgttacatatgtatacatgtgccatgttggtgtgctgcacccattaactcctcatttacatcaggtatatctcctaatgctatccctcctcccaccaccccacgacaggccccagtgtgtgatgttccccatcctgtgtccaagtgttctcattgttcaattcccacctatgagtgagaacatgtggtgtttgcttttctgtccttgctatagtttgctcagaatgatggtttccagcttcatccatgtccctacaaaggacatgaactcatcattttttatggctgcattgtattccatggtgtatatgtgccacattttcttaatccattctgtcattgatggacatttgggttggttccaagtctttgctattgcagatagtgtcgcaataaacacacgtgcatgtgtctttatagcagcatgatttataatcctctgggtatatacccagtaatgggatgactgggtcaaatggtatttctggttctagatccttgaggaattgccacactgtcttccacaatggttgaactagtttacagtcccaccaacagtgcaaaagtggtcctatttctccacatcctctccagcacctgttgtttcctgactttttaatgatcaccattctaactggcgtgagatggtatctcattgtggttttgatttgcatttctctgatggccagtgatgatgggcattttttcatgtgtctgttggctgcataaatgtcttcttttgagaagtgtctgttcatatcctttgcccactttctgatggggttgtttgattctttcttgtaaatttgtttaaattctttgtagattctggatattagccctttgtcagatgggtagattgcaaaaattttctcccatgttgtaggttgcctgttcactctgatggtagtttcttttactatgcagaagctctttagtttaattagatcccatttgtcaattttggctttagttgccattgcttttggtgttttagacatgaagtccttgcccacgcgtatgtcctgagtggtattgcctaggttttcttctaaggtttttatggttttaggtctaacatttaagtctttaatccatcttgcattaatttttatataagatgtaaggaagggatccagtttcagctttctacatatggctagccagttttcccagcaccatttattaaatagggaatcctttccccatttcttgtttttgtcaggtatgtcaaagatcagatggttgtagatatgcggcattattcctgagggctctgttctgttccattggtctatatctctgttttggtaccagtaccatgctgttttggttactgtagccttgtagtatagtttgaagtcaggtagcgtgatgcctccagctttgttcttttggcttagtattgtcttatcaatgagggctcttctttggttccagatgaactttaaagtagttttttccaattctgtgaagaaagtcattggtagcttgatggggatggcattgaatctataaattaccttgggcagtatggccattttcacaatattgattcttcttatccatgagcatggaatgttcttccatttgtttgtgtcctcttttatttggttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgtttatcagcttaaggagattttgggctgagacaatggggttttctaaatatacaatcatgtcatctgcaaacagggacaatttgacttcctcttttcctaactgaatactctttatttctttctcctgcctgattgccctggccagaacttccaacactatgttgaataggagtggtgagagagggcatccctgtcttatgccagttttcaaagggaatgcttccagtttttgcccatccagtatgatattggctgtgtgtttgtcataaatagctcttattattttgagataggtcccatcaatacgtaatttattgagcgttttagcatgaaggttgttgaattttgtcaaaggccttttctgcatctattgagagaatcatgaggtttttgtcattggttctgtttatatgctggattatgtttattgatttgtgtatgttgaatcagccttgcatcccagggatgaggcccacttgatcatgatgtataagctttttgatgtgttgctggatttggtttgccagtattttattgaggatatttgcagcgatgttcatcacggttattggtctaaaattctctttttttgttgtgtctctgccaggcattggtatcagaatgatgctggcctcatgaaatgagttagggaggattccctctttttctgttgattggaatagtttcagaaggaatggtatcagctcctccttatacctctggaagaatttggctgtgaatctgtctggtcctggacttgttttggttggtaggctattaattattgcctcaattttagagcctgttattagtctattcagggattcaacttcttcctggtttagtcttgggaggatgtatgtgttgaggaatttatccatttcttctagattttctagtttattggcatagaggtgtttatagtattctctgatggtagtttgtatctctgtgggattggcggtgataccccctttatcatttttattgcatctatttgattcttctctcttttcttctttattagttttgctaccggtctgtcaattttgttgatcttttccaaaaaccagttcttggattcattgattttttgaaggatttttttgtgtctccatctccttcagttctgctctgatcttagttatttcttgccttctgctagcttttgaatgtgtttgctcttgcttctctggttgtttcaattgtgatgttagggtgtcaattttagatctttcctgctttcttttgtgggcatttagtgctataaatttccctctacacactgctttaaatgtgtcccagagattctggtattttgtgtctttgttctcattggtgtcaaagaacatctttattccttcatttctcaatgtacccagtagtcattcaggagcagattgttcagtttccatgcagttgagcggttttcagtgagtttcttaatcctgagttctagtttgattgcacttttacatttgctgaggagtactttacttcaaactatctggtcagttttggaataagtgcgatgtggtgctgagaacaatatattctattgatttggggtggagagttctgtagatgtctattaggtctgcttggtgcagagctgagttcaattcctggatatcctttttaactttctgtcttgttgatctgtctaatgttgacagtggtgtgttaaagtctcccattattattgtgtgggagtctaagtctctgtaagtctctaaggacttgctttatgaatctgggtgctcctgtattgggtgcatatatgtttaggatagttagctgttcttgttgaattggtccctttaccgttatgtaatggccttctttgtctcttttgatctttgttggtttaaagtctgttttatctgagactaggattgcaacccctgctttttttttattttccattgcttggcagatcttcctccatccctttattttgagcctatgtgtgtctctgcaggtgagatgggtttcctgaatacagcacactgatgagtcttgactctttatccaatttgccagtctgtgtcttttaattggagcatttagcccatttacatttatggttaatattgttatgtgtgaatttgatcctatcattatgatgttagctggttattttgctcgttagttgatgcagtttcttcctggcatcaatggtcttaaaaatttggcatatttttgcagtggctggtaccagttgttcctttccatgtttagtgcttccttcaggagctcttgtaaggcaggtctggtggtgacaaaatctctcagcatttgcttgtctgtaaaggattttatttctccctcacttatgaagcttagtttggctggttatgaaattctgggttgaaaattcttttctttcagaatgttgaatattggcccccacctcttctggcttgtagagtttctgccaagagatccgctgttagtctgatgggcttccctttgtgggtaacccgacctttctctctgactgcccttaatattttttccttcatttcaaatttggtgaatctgacaattatgtgtcttggatttggtcttctcgaggagtatctttgtggcattctctgtatttcttgaatttgaatgttggtctgccttgctaggttggggaagttctcctggataatatcctgcagagtgttttccaccttggttcctttctccctgtcactttcaggtacaccaatcagacgtagatttggtcttttcacatagtcccatatttcttggaggctttgttcatttctttttactcttttttctctaaacttctcttcttgcttcatttcattcatttggtcttcagtcactgataccctttcttccagttgatcaaatcagctactgaagctcgtacatgcgtcatgtggttcttttgccatggtttctgctccatcaggtcatttaaggacttctctacactgtttattctagttagccattcgtgtaatcttttttgaaggtttttagcttctttgcagtgggttcgaacatcctcctttagctcagagaagtttgttattatcgatcatctgaagccttcttttttcttttttctttttttttttaattatactttaagttttagggtacatgtgcacagatcatctgaaaccttcttctctcaactcatcaaagtcattctccgtcccgctttgttccattgctgatgaggagctgcattcctttgaaggagaagaggtgctctgatttttagaattttcagcttttctgttctggtttctccccttctttgtggttttatctacctttggcctttgatgatggtgacgtacagatggggttttggtgtggatgtcctttctgtttgttagtttttcttctaacagtcaggaccctcagctgcaggtctgttggagtttgctggaggtccagtccagaccctgtttgcctgggtatcaccagcagaggctgcacaaccgcaaatattgcagaacagcaaatgttgctgcctggtcgttcctatggaagcttcgtctcagagggacaccctgccgtatgaggtgtcagtctgcccctacttggaggtgcctcccagttaggctactcgggggtcagggacccacttgtggaggcagtctgtacattctcagatctcaaattccgtgctgggagaaccactactctcttcaaagctgtcagacagggacgtttaagtctgtagaagtttctgctgccttttattcagctatgccctgcccccagaggtggagtctacagaggcaggcaggcctccttgagctgtggtgggctctacccagtttgagcttcctggctgctttgtttacctactcaagcctcagcaatggcgggcgctcctcccctagtctcgctgctgccttgcagttcgatcttaaaaagtattagtgagacccaaattcatagaaagatttccatgacatatatcatttaagtgaaaaaagaagttggagaaaacgtgcactgtgcaaaaataaaatacgtgtgaatataatgttaaagaactcaaagtgcattcactgatctggttattctagggaggagaacagattggcaaaagatgacttactcattttattccatatatttagatatttgaatttttacaaggacacattcatgtacataaatacataggctgttaggattgctcatgcctgtagtcccatgcttttagaaaccaaaatgggaagagtgcttgaggtcaggagttttcatttgttttgttttttgagacggagtctccctgtgatgcccaggctggagtgcagtggtgcgatcttggctcaccgcaacctctgcctcccaggttcaagcgattctcctgcctcagcctcccgagtagctgggactacaggcatgcgccaccatgcccagctaatttttatatttttagtagagatgtggtttcaccatattggccaggctgggctcgaactccgaggtcaggagttttagaccaaccagggcaacatagcaagacctcatctcaagaacaacaacaaaaaattaaaattagctgggcatagtggcacacacctgtagtcccagctgctcaggaggctaatgcgggaggatagcttaagcccaggagttcaaagctgcactgaggtatgattgtgttgctgcattccagcctgggtgatagaatgaaaccctgtctctaaaacaataaaaaatatgtaagtaattaaaaataatgataatgaacactttgtgtgtactatgtgtcaggcactgttcctcacaccatcactctgaaatatatactattttcataattttatggatgaggaaactgaggcactgaaggatttttgtccaaagtcccacctttagtgagtggttccagagtctttattattaacccccaagatcttctgagtgattttatcttaaaatagttaggaacctgaggttaggcagatctgggtgagaatccagctctgtcattgacaggctgctcaactctgagcaggccatattgaaaggtggcatctgatctgaaaattgaatcataggagaagtcagcctcgtggaaccttggtgagctcacttgctaatctgtaaaatggtaaagaataactgccttatgggattactgtggtgggaggagctagcccggaggagccttgggtaaagaggtcccaagtacgctttgattccaaaatcccagaattccgatttttacatctatttagaaactcaaaaatgtactccagagttataaataggaccatgtaagcattctgaggtataggggagaaatgtttagaagagtaagttctgaatcatccacacaccatctagaattccagttagatattcactgggtttactaagtaagcacatctgggagacgaaggtggaaggtagcagctacaattttacgaaccttagtttaatcatatcttataacccacaaggtaccaggcattgtgctaggcactgggggttcagagcataccgtgagagaagataatgttgagagatggtccataaacaactattcaacaattgcaacagcagttataaaaggagtcatgatgtagagtgaatggatgggggcttgaagggacagtaatcctagggggacggaacagagaaggtcaaagtgaagaagtgatactcagtctgaaaattgagtggtagaaggagccaaacagagaagatctgggggaggaacattatgacacaagagacaggaagaggaaagccttggaaacagggaccagcttgagagatttaggggaataaaaaggttcattgtgactggaaatcagcaaacacgtgggaagggtgtgggagatggaaccagagagggagtgctcggagttttgggggtcttgtaaaccaagggcagtggagactgagaactgaggaaaaggggtcaggcttgttggagtgatattggtgatcactgcaacatcagtatcagaattgtgaggaaaaaagtcaaatcgtaaaaggtttaaagttagtgagtgtgggaaaagcagaagcagtggctttatatttctctttcctggagagaggtgccgaaggcattcaggagtagaggaaagaagggttggaagttccacatggttcactctaagaaggagagttattatgtatagatgagaaatagatagatagatagatagatagatacatatatacatacatacatatagataaataggtagattatgtacacatagaaagatagacgatatatagaaatagaagaaaaaatgcaggccagctgtttatggttacgtttctaacaaataataagatcagtagaaataatcaacctgcacccttttctgacatgtgttgttagaaagtcgatatgtggtgtcacataactgagaccggcactgtagccagttctttggcatttcattaaaaacattatctctaccaggtatcattgtatattggtatttttccatgtatctataattttttaaactaccccaaagtagagccagcatcattttagaagtaaatttaaaacctctttgctaggcatgctgcttggaaaatcgaacatggtaggttagtcagccatgccgtggctgtgattcaggcagcctgatcatatttgcagtgctgctcaaacaagcagcgctctcatccttcatttcatggtgattcagactaaaattactcacaacttatgaggatcattgttaaatggctattgaagattttgatatttgaaaataatatcaactaaaagataatatttctcagaacaatttggaattcttggtgtagacttgaggatttagtaggttttttcctaattttgatgagaagtacatcatagtgtatacaaatataaaacacaattagcccctgtgaaagtcatgattggagtgaaaatacagagtcatgatagacatgtaatacatatatgtatttttctgacacatacgtaccagtaaaatacgtaggtaccactttgatcagcaagagacagtttatattacttttcaatttgtataagctaaattagcttttcacttatatttatttgcttctagtttattgctcaaagatggatgagattttatctcaaaattgccttcagtaagtcaaattgggtaagattagttttcaagaatattaaccaacaatagtgaccattattaatgggaaagtgattcttttgtaaagcctaactttagaaagtttgcactgagaaacagattttgatatttgtttttatagacacagtacttagtttttgtcttttttgatatttttctcagaaaagccattcacatggagtgctgtatggacagaattctgttcctccaaaatgtatatgttgaagccttaaccctgaatgtgactatatctgaagacagggcctttcaggaggtaattaaggttaaataaggtcataagagtagggcactaatcctgtaggacggtggtcttataggaagagagggggagagagagagagagagcactgccatgtgaggacacagtgagaaggtggtcgtccacaagccaggaagaaagccctcatctggcaccctggtcttggccttcccagcctccagagctgtgcgagaataagtgtctattatttaaacctcccagtctgcagtattttgttatgacagcctcaacagactaaggcagggtgcctgacacctagccagacaagtccactgttttccacattcttttgtgctgtattaatgattaataagcctcaacacataacttcaaaataaatatttgcagaaaatagattccttttgaaattaatccgcatatgtacccgtaaattattctctgaacaaaatttgctacgttatctgtataaacgattcacccaaatgcttctctttgtctaccattatcccctccatgtgaggccatttgtttctaaacagtaatatttcatgtacctcagccattatcatggggagctacattctctctgtggattttaagtgaagatggaacagaatgcaatcattagcttttagaaggagccagtgtaggctgtgggtttcagtcttagacctgcgagttcaaagcttaagatactgaaataacatatattttggataagtgatacaaataattattttaaagctatagtgttaaatggcagaaaggtaactgtgaaggccataaaatccctttggaaaggtatgtaagggggaataaatctactaagagatttgtaaccagaaaaaaaggcgtcatgcaggcggggctcctgggagatactaataaaggcggagcatttgggcaggccccgttcgcacaaactcaccatccatccgacacgacctcctccgcctgctctcagacaagcttcagatccacctgcagcttcaagacatgattctattgctttacctaaaatggcaaaggaaaatttttcttcaaattgtatttgagttcagtgacattatagctccaagtcccattttctgaaaataatcttcatccagccagacttggaatggaaagagaattcacacagaaaaggagaaaaaagagaggaaacgtatcgagtaaatgtttacatgtgaagcgctgtctgaaatgttttacatttatcacattttattttcatgaagacatatgggaaaatggaggcgtagcaggcaacgtgtgtaaacgtcactgtttactcatactgacatgggctaaatgaagatagaattaatgcctctgagagttatttatgtatatataagagctaattacgtattttatcccaaacatagagcagccagccacacattttggactctgtggaagccacaattttaaaaattcagcgctgtcttgttccatattttcatcttatcatcaaaccctctgtctcaaatttagaacagtaagtttggacacagctcctggccaaaccttcttttggcatctgtgaatgaaagtgcagttatacagcaaagatcaccgtcagtgggagatccagaattaatgtggattgaagctgagtcgagacgcagtggctttaattcagaactgctgttaatccagtgtccacggacactctcgtagagaaaagaatgcaaagtacggggtgcaggagatgatattaaacagtctccgaatgtaggtaagtgcaagaaaagaaggtggaggcagtttatagaggtgatttaaaagttttcatatagtagaagcacatcctgaaccaatcaggaagagttggtttaaaaaaaatcatgaaaaggatattttggtgattctgtactgaaaggggagaagacgagagaaaaatcaatcagaagattcaaacctagagataaagagactcaaacctggagagaattacttcattttgctagagatgtctagcaaaacgaagtaattttgcaaatgaaagattgaaggtagagtgaagaagtgtcttctgagagatccttgggccttgaaagaggctgagaaccctatgtggtccccttggtcagtcctaatacagaccctaaatcatagcacacatctctctctctctctctctctctctctctctctcctctctctctctctctctctcgcacacatctctctctctctctctctctctctctctctctctgtatctctttctcactcccttctccgggcaggagagacagctgcaggtgggggaagggtggtgtccagtgaggggcccaggccagctttctcaggggtcgcactgggctggtgaggatctttgcagcctgagggcaccaacactggatgggataagggcagaccagatggaaggaacctggcacaagccatttaattaaatgcccctgcccctcacccttaagttagagagaaccagtctgcaagcttcagattccagagtaggaacccaggtaaggagggaggaagtgccaggagcacacacagacccagagccaaaggggaaggtctgtacaaagctgcccccatcctcggcatcgctggtgtgcctgagtgtcatgggagacagcgaccacacaacacccttggggaaatgggtgagagagcaacacagcgtggctaaagatgagcactattctaaaagaaaatacggactaagaaaagatgatcacaattttcatcttttcttcaagagtggttacttttggggttcagtgaaagagtggctatcattttttagcttaacttttatttcagtcttctttttttttctttttctttttttttttgagacagagtctcgctctgtcgcccaggctggagtgcagtggcgcaatcttagctcactgcaagctccgcctcccgggttcatgccattctcctgtctcagcctccccagaagctgggactacaggcgcccaccaccacacccggctgattttttgtatttttttagtagagacggggtttcactgtgttagccaggatggtcttgatctcctgacctcgtgatccacccacctcagcctcccaaagtgctgggattacaggcgtgagccactgcacccggccttatttcaattttctaaccaagaatgtttatgtgcctggcgcggtggctcacacctgtaatcccagcactttgggaggccaaggtgggcagatcacgaggtcaggagttcaagaccagcctggccaacatggtgaaactgtgtctctaccaaaaatacaacaattagctgggcatagtggcatgtgcctgtagtcctagctactcaggaggctgaggcaggagaatctcctgaacccaggaggcagaggttgtggtgagccgagactgcaccactgcactccagcctgggcgacagagcaagactccatctgaaaaaaaaaaaaaaaagaatgtatatgtgatcatactttgttggtttattaatacatttattttgtatgtcaacaagggttatctgactggtaagactgtgaaccatattttgttttttctttgttattctctgctaaaaacaaacaataaaaggaaataaacagaaggtcctcaaaatgtggacttgtaattgtgcactgatggaaacaaatgaaaaagcaacacatttatcgcagtataataaaacacaaactgacatattaaaaatgggaacttttttgtttaattactccatcaggtacattttatttctatccctttgggagtcagctgagcatctttcagggaattgacctcctgcagaaaattagtcaccctggggtctcagctttctggattcctgaggatgtgccctacacctgacagggcagaaacaaggacagaatgcctcatgcttacttcagtttgcttttcagataaatatttatttttcttttctctccagctcaacatttaacttttcatgcatagtaagcattcatcttgaatttattgttaattacatagctctcgtcattttggtttagcaatattgccgactcatttaaatgccaaaaaaattttaatttatttatgaaagcttctaaaaaagcttgaaaacacaatttggtggaggttagccatttgatttcaacaaatttcagatgtatatggctggattctatttaaatcaattttttttctgaatgcaaaattgatatttcttataaatgctaagcattattttatataaaaatgccaaacttctgtgataatcaacatatttcccttattaacgtagtctaaaatatatttaaaaattctaatttgatgagaaaattttgaatggggatggttatcattcactctttctggattgtttctcaacattgaaatggacagtcatcctcttaggaaaaacccaaactgaagttctcaaaactaggtttggggagaattataactgatttgagatttggttgataaatgcatcattcctgattgggaaatgattaaattttcagcaattggcatttgggccaatttaaagtgattcgagatagattgtaactgcagtaatattactggggaaatggagtatttgctcaagacaggtcttgttcttttaaccaattttccttttttcttgtgatctgaacttatttcaaattagttagatgagacatggcatatgctattcaaccaaaatgtaatggtcaatgaagatgttaacacatgtcctcgttcacattttaagcacatattaatattctcaatctcaaaaacatttacagtcatctccctgcaagggattggttccaggaccccctcgggtaccagaatctgctcatacttaagtcccacagtcagccttgtagagacttctgatacagaaggccaaccatatttattgaaaaaaaggtgacacattgattataatgcaaaagtgtaaatatgaaggaaaccatcttcctttagtacagaaggcatatttgtgccaggtgaaatgactgaatataagaacaatatttaaaataagctctgtagaactcgcatattacctaaccttgttaaatatggcttatttgcctctggtgtttctattttttagtccaaggtgttttccctttttttctctctgattacttatctttcttctttgtcatcaatattcacagtattgaagcatccctttaatttcttagtctatttgatttcctctaaaatgtcattagcatactctttacatactcagacacacagtactaattgattaaataaattccaagaaagacataaaattaagcacattattacattcagaacgaatgagagacatttaaagtcaaaaacccccaccaaactttaaattttcagcaaatagaagctctgtatgaatatgattttaattaacagtcacttcattttaaataatcacatcacttacagaggtatgatgttaagaggcttggttttcgcataatcgctgtgggaaggtgagcgctcacataaaaagcacacccagctgaacctggaggattcatgcagtggggaaactgaacttgcgttcaatgtagccttgctgaggaatattgaaagacgtgaccaatcataggtactaatgccctattgggacaaccatagatcctgataaagaattctgaggaacttaacaccagagcaagcctgatacagaagtatgtaaaacagaacatcagagtaagctcactgtaattactggtgcaaattgaacatctgctgactattttctaaagataggatgatgtgtaacaactgcaacattaatttcatataaatggagctgaatattcattacagctttgtagccacttgctgcctgtccacatacattcaggttatttgttttgcccaataataaaatcaactaattctgtatttgtgaattggcatgtttctttgggtattgattttccccccaacaatttggtgatgaggatgggatttcttgagtgagtgcttctattggttaatttgtgggaagatttgtgtccaccttcttaaaaagtcattttattgtgataaaacacacttaacataaaatgtggcctcttggattaggtaagagaccccgactgtttgcttaaaagtctcccattatctactttggctcagcaggattgggttcctggggaaaatttcaaaaccttactacaaatttggagttattattgagcaaaatgtgtaatacaggctcacaggtcctatatgattcaggataggttttaacggcagaaaaatatgggaagtccagaatgttgctggcaggtctttctcttagaagggttatttcactctattatgtttagaatgggtaaacttctgaaaattctgctttgcaatggccagagaaaggcttttttttttttttttccctgagacggaggctcactctgtcgcccgggctggagtgccgtgccgtggagccatctgggctcgctgcaagctccgcctcccagcttcatgtcattctcctgcctcggcctcctgagtagctgggactgcaggcgcctgccaccatgccctgctaatttttatgtacttttagtagagacagggtttcaccgtgttagccaggatggtctcgatcgtgatctgcccgcctctgcctcccaaagtgctgggattgcaggcatgagccaccgtgcccggccgagaaagactcttttgaggtagacaaattagtgtatgcacggagattttaaggaaaaaaaatcccaaataaacggataatttatattcctgagatgaagtagtcagtaataaaacaaaaaccaaaaagagtgaattaagaaattggaagaatagagtaagaatctgaaagctctttttcttcctccagcttctcatttcttctctgctgtcattccttttgtttcctcagcttctcttcacccttctttgctcaatctgggatctcagaggagggaggtaatggtctcttggatgaattggaaacctgggatgaattccctttagaaggagcaaattgtttagctttattagaatatcctgatattggatgccctagttctgatcccatctctgtgattccctctaaactgaatatgcaaaacacaactaaacatctataaattactcagaagaaagatcaaagagtcagtgagaatttgggtaagagattgtatcctagaataaaggttttgggttgctgaatggttgattgccttaagaacttagaagaaatggagggagtcaaattactatggcataacagggactgaaactacagtgccatacaaaccaacttatttttcatttcatgatgaaaatcagccctatccctttgcaactgcagtgacacaaatgccagaatccatattgccttcccccaagttgatatacttctcttaagagatttttttctattgctctgggaagattcacacaaatttgcagaagtgctctgcagcattttttcaacatataactacacacgtgaggatataaactggctgctgtgtgatgtgttgcctctggctgacttgctcaactagtggaacaggtgtgatagaggccaaattataaccccctcatcagggagtgccatggcctcaggaaaccagccgtccacctctttccataactcagtgtgagggatggctgatggcagtccttggagcctctctgcatatggtgacctctagcagtgctacaataacgcactcaagaggcaggtgtgtccctgttgcttttcatcagcagtgcactgaagcagtttataaatttttggggcccaatccaagggaagatcagaatatatccttggtcctctaccttttaagcaggctttttgccaggaatttccctgccagcaattgtcaggagaaaaaatagtttgatggcaagggcggacagttggtgccagcaatccattttgggaaaatgtggggaagaacttaagactgcagtgttagctgcccagttagaattattcacagatgggacagactttattgtgagccaacaacaaataaaaaggaatgctctaatggaaagttgatatatcactgttgtaagaaaccaggatattcagaaaggggatgctgaagaaattaagacgcaaaggattcaacctgagtctgaagctttattagcttctctaggagatttttctcctgagaaactggatgagaaataattggcaaacggtgcaaactagtgtgcaaaattgacataatgaggaaacctttgagttgggaagcagacagctttatatgtctgtttcttttcctcatcttaatcttttcatgtttttttttctttttttttttttttgtgaaccctggagccatgtattctgtaatttcttctgaccttttttttgttttaatgttttggatatctccggacaaccttctgtctgttcttgctgctctgaaattattctgcaaatagatcttttgtaaaagaaacatgcttttatctagtctcctgatgcacctagctatttgttggaaagggactcgctgtgtaaactaatgcctcccacccattctgtattctgggtgaaatgattttggagccctgggaggcaaggcacctgatgataaggtaaagatgtgccttctgaaaccaatgggggcagtggtgagtggcaatctcaccttgcactggaatagatcaattgacaagaagtagatccatttttttggatcccaggaacaaatattttagtaaaatgtatcaatgctataattatagcttacaacatggaatagctcaattataagatataatctatacattttttaattaggaaaatgagctgtaataaagggcattcagtttgtaatgcttctacattacctgtgaaaaaggaaggaaaatatgacagggaaggtggacctgtttatagatttgtacaagatcttatagaaataagtatgtttgtgattcttctggtacctgtgcttgtgctagctgacctggctactattttaattacaatacctatgccaactaagtatttttctgcagtagacttttgttcaggtttttttctgtacctttacatgagaaatcaaggttcatccttacatttacctatggcagctttcaatatttgtggcaacggattcctcaggatttagagattcacctactatattctctagacatttactgttcaagagaacttaaagtcattttcctcaccttagagtttcatgctgattcaatatgcagatgaatcattgatagctgctgacaccttacatgtgataagaagaaaatgtaactttctacaaatttttagcttcctaagcatataaaacatccctagataaatagcaatagtgtcaaactgaactcaagcatttgggacatttgtgactggccaataaaaaatagtcccttcctagactcagcctattttacaaattaagcttgcttaattaaaaaaaatcaagtttgccagttttggggattggttgggaattgcagtcaggagatccctgcctgttcagaaaaggcgaagcctgtcactgagctgttgcatcaaacgtcaccagcacctttactggggtcatgttagcagtggaagatctgtacaggtctgcaacaacctcagttcttgctacctcagaagaaggaattcaaccgaggagcttaaggcggaggaagagactgaggcagagactcggagcaggagtgaatgtttattaaaaagtttcagagcaggaaccaaagaaagtgaagtacatttggaagaggggcaagccggcagcctgagagattcaagtgcacggtttgacctttaacttggggttttatacattggcattccatatgcacagtggcctgtcagcacttgggaggggtcataggcataatgtgttcactggagttgtatgcatgttcctagaagaaggtcatgtaccagttaaactccaccattttgcctcttagtgcgcatgcttgaggccactcacccagctcctgagatcatattgggaagcttctgatcaccagttacaggtgtttctatctattgcgagactgcctttccctggcactggctacaaccaattattttagagagacagtgtaacaactgcctgaccatcacctgatggttgcctgacattcctggggtcggggggtcctctcctgttctgctcatgtctgactaactactatcacagtcagaagaagctgaaaagcctttcaaaccctttaaggacctattgtctccccacgtgtattcataactctggtaaactattctactttttccatctggagaataaaggagttgctagtggtgtgcttactcagaacctaggccctgactatagacctattggttactttcctgtcttgttggattctgttgttctggatatgccaggctttctacaagccacagtagctcttctgattgtgtcactgcccgatgggttcttcctgctcgctgcaaaaaaacaaaacaaaacaaaaaacatggtatttgctgtaaagagtttaaattaactcaaggttggcaacaccacattagagatgaagttattgttcaagtcagtctcatcgaaggctcataggttagggatttttcaaaggtagtttagggaaagggcggggagtggctaggcaatgggtgcttgccgctgattggttgggggtgtaatcataggggtgtgggaaatgattcttctgcatgctgagttacttatgggtggagctacgggagctgttggcaggtccagtggagccatcggtagtcaaacatgcaaaaaacctggatatctcaaaaggctaatcttagattctacaatactgatgttatctgctggaattcatgaggaagttgcatatctcgtgacctctggacaaatggctaacaatcatttatgtctgtattttagcagaatttaggctcctctattctcctagcctggtggtctctcattagctttagttttggggaagggctattatcatttaaactataaactagatgtctctcacggttggcttgcctaagcccaggaatgattaagggcaacttgaaggtcaagggcaagaagggggttaactagatcaggtctccccattgccataattttgtcactgttagaatttgtgcaaaggcagtttcaatttcactgttagaatttgtgcaaaggcggtttcagagctcagctttgaccctaggacattgaacttccatgtgcctcatgttgttgctgctgttttacaaattcatagacagaaaatttctagcacactgccggataagccacgagcaagtcttattatctcatactaatattattctaggcaggtggcaccttttgagtctggttactctgtttgtagatcctaaccaaataggaggatgtgactgcctcatagtcacagaaaatactcaacctaggcctgattcattcagtattcttattctcaatgctggcaatattgttcattgatggatctgtgtgagagacacacaggaatatacaattgcatcttattttataggtagagatggctttttcttagaacatattatacatgattacaagtgtaaaaatatggtgaaataattttatttgcttttcaaatgatttttgttgctaaaaactaaaattaaaaatagagaacaagtatcctaaatgtttttgaaactattatcatagcaattctcagactatcaagactatgaactattttccatgatagcacactaatcataacaatcataaccatttgtatgtgcatatctaatatctaatattcagggataaggtcatacagattacccagtttaatgctcacagattcttatgtgaaaaaatatatatttggtcatagttaaaatggacaaaataagtgaatctgtctgatggtcagatagtaaatatgtcaaacaaacaaatgattacaattttcagttagaataacaaaagcacttagatcactgatttaataatagtgattccctaggtaattttttcatctgtgcaggttgattatcagggatgaaaaagtgtgaaaacattccaattaagtaaattgctctgcagttggtgggaagtactaagtaattacttgtggtgagtccagagatgaagatggagtgggcatctctgagtcatccaggcaaaggaagacaggtgctgctcctcacagcagaacaaggagctgggtttagagagactggatagaatatagcattaggaaggttatctctaacaatcaagtcaatgcaccagcatttgcctgggaccaactgtgtgttaaacactggtaaatactgggagggttaaaggtgcagatcttggggaacctagcataaaattcaacacagcagacatttattctccttgaagaattcctgattttgcaacaatgcctatcatgtcccagaacgaggctggttgttgaaagtctctgagaaaccagagatggcaccagcataataccctgaacttttataaagcacaaagatttataattataataaggaaatctgagagcaagaagacatgctgatcgatctcacacaggaaatttgtcccagatccaagtcaaatgacaagttagatgaattgcctgctttctaaaaaggtattttaacatttaactaatgtgatcatttaaagtcaatagcaatatctcagaaagaacacctgttaagttgtgatatatttagttatatgcactatacacagagagctaagtggctagttctgctctcttcattatctgaattattttaaaaattacatttaagttaatcttgattcgtattttggattgctttatgtttctgaatgatcatttcctcaaagttatcagtagtgagcaaacacaaggaaacatttatttgtcttttttaaacatgcactacactttgtttttctctttttgacttattcaaatatggtaaattaattaatttttatttaaaaaaatgataggatgctcaagtatcaaacatacaaatgtatttgcagtgtttcatttttcaatgattatgtatatttaattaattaaagatatgcataagtgcatatacacatacatttttttcaataaggtactcttgctgtcattgattattcatttattttctaacatttctttctttcttgacccaaatataaactaactatttcaggccatgctcttttagtgctagagaaaactttagattccatagtacttttttttttttttttttgagatagagtctcactctgtcaccaaggctggagtgcagtggtgcaatcttggctcactgcaacctccacctcccaggttcatgtgattctcctgcctcagcctcctgagtagctgggactacaggggcacgccaccatgctagggtaattttttttttttttttttttgaagtagagatgaggtttcaccatattggtcaggctggtctcaaattcctgacctcaggtgatccacctgcctcagcctcccaaagtgctgagattacaggcgtaagccaccgtgcctggccccgtagtactttgtagcgtgctttccagctaaactgaagcctcaggtgacataccatggctctcacagctaattaatgaaaaagctggaaccatcacccacatttcttaattcctacttcagttcatttaataatgctagaataaggcaaagtcacacttttctcattttgtgttgataaacattgtattctaatggttagtaaaatattaataatgcattcatgagcactttaaaataattaagtacagctgttcacataggcagttatcgatactaatttaaataagaaacagttttgcatgttacatcattatctgtaatcttctgaaaataacagggacaaaagcagtatcatccttgcctaatgtcatctgctagtgaggggatgcagacctaagtgactaagttgattccggctgagaatcaaaggaaaaggtccatagattcatccttgctttcaaagagtggcatagtgagaatgagtaagaggaaatatcacttagtattaacagatgataataagtagtgtttcctactaattgattatttaccatatgctagtcctatgctaagagtttagagatacgtgagagtcttgtgagtccggatcatcattctccccagtgttcagaggggaaggctccgcatggttgagtatcttgcccatagtcacagaaccagtatatgttgggacttggcctcagacccaggtctctccagcttcgcagcctgtgttcatcatatgatgtatcacttacaggaaactccaaaactgagctgaagtctttgacagtcgcaggagtcagcatcctgctggagccgtggcctcacagtcctgtctgtgtccttgggagggctctgtggcagccccaggtcccacttgccaggagtcccttcttcacccatgggcatcctgagaacagaggaggctgagggggcagcagcagagggttaacagctcttcagcaggcactgggtccacatgctggagcccttttttgttgatttattgtgtttagacatcagatgtgaaggtttccatgagtcaccttcctcagtgaggaatcatgaaggaatgatcggtctggcctgcataaggccctactcttgccttggtgttcattcattcattaatcatatttttttatacatgattcatatttccccagtccaatacattttatttgtacatattcttttaaaaatcataattcttttgttcacacatatttacacttacatataatattgttttatatctttcattttgctttttactgattaactctgcataaatataattgtactagtcatactaaggtgataaagataatatgctaatttttaataatctatagaaacattttaattacttcataaaatcatcaaggtatatgtcatggtaattatattattaatgctatatacttagaaataatacagtttcttcatataacacttataattaacaaagtgtcttaatcaaataatcttgttaacaggcattacagggagcagcttaacaatatctttcatttgtatagttccttagaattttcaagtcacctacagaaacatcttccaacaagctataattgggcagagcagttagtattatccccatgttactcataaagaagctgagattacaagcactaaaatttgtatccaatatcagcatagtctggcaattaaggaaacagaattagaactcagggactcacgggcactttcttaccccacacacagacagcttaaaataataacagcatattaaaataagaatctctcgtagtacatttgagtgtttgggaaactaataataagctgaagctgctgaagaatctatttcttttagacaggtttttctaacatctttgtgaggactaactgaattgatgtgtgaaattgcataggacagtggtggccctatgcatagtagagatttaatgcttattttaaaattcagagactcatttcagtatctcgtaatttaaaataaagatttgatgataaaaacccactaaaacagaaacgacaaaatgacaaatttggaaaaataacaaatttctaacagtcttcttaaaaatagttgttgatgagtcttaccttgacagatttttttctgcttatggctgtcaatctgggtatttcatactcaaccacaactatccatgtgcttaacattttgcagaccaggatatcacatgagcaccatcactgactgtgactgttagatttaactaatgtgactgctaaaaatcaaagtacagtgttggaaatttttcagtaatgtcattaattcctaagttatttatgaaacatatttccagcatgtgagtggactccaagccacagatttcagtcactttcatgtatacctaaggaacatgttatgaaaactgatcattttatctgaaaatactcatttttgattacttaatataatacttagctagaatgccctcaaagacagagaatccacatcaaacttaagtgactgtctttcaataagatggagcttttatacatgaacacaccacacacacacacaaattgcagaggaatgctgtaaaaaataaatgatttataatcttaaaaatacattatatatattaactagtttaattcttaccaagattgccagatagatataatttttctactttacaaagaaagatgatgatttctcccaaggtcacatgcctgctaagacagaaaagaatttgaaggactatggcttccaaaaactattctgtatactctcactctccacagagctgtaacttttgctgtttatgtctaaaatgaagacgtaatcctctgcagaattgttgaaggctgcatatttctataaaagctggcttatccttctagaaggttcatttttccaccttaataaaacaaagcaggaataggtatttgtgttcgccattcttttgtccgtagtggtcatgtgcttacgtatgaactcatgtctgctctgcaagctctcgaagcaaactttgaatataatgaataagagactacactgcatatttttaagacacacattattttactgttatagataaggttatttcaataataagccctgaatgttatgacagtgaaatgctagtataaatctttcctgcccaaaatgtattctctttaatttctatatctttaaagaacaatggttcatttggttggtatcccatgaagctggttataattctatataagacaataatgtgatttctgaaatttcaaatgaattaatgtgattatatatataaacttttaaatatattttagtcatatgtaataaatgtttgattttttattgatatctctgaagttgcaaagagtatgtttctcatctgccttattcacaaactattaggtaatgtctatttaaagtttcttaaatgttaatctatttaattacgcaaaaattgacattaaattttattttgctacatgatcctattatcacatcactcagaagtatattttccagagtttacactttgaaacaaattgagaaagaagtaacatttggcagataaaggtgaaaaaattctgttttggtagggttcctttgaaaggtttttattgtattgtttttactgaggtttacaaagtttattcagctacagaaaaatatgattttaattctgcaactgaattttaacattggagtcaaaatgctcataggatctgatgttcctgtattagcttggctgtatgtcttagatattaaacccaaattagaaccaaaataaaaggatggatcaaccatctctaccaaccatgccaacaatgaccaacctgggtcacagtcacagcagccacctccacgcaggtggtgggctgattgatttccaggtgttatctcaattagtactctggcccttcaagatcagttttacagatgaagaaaccgcagcttgcagcagagtagcagggtttgaggtggtggagctgggatatggcttattttatataggtcagcctgggctgtccagacagaaggttgtgagtgcagaggttgtgcaaatatttacctgaagtttgtatagcgattgttaactcaaaaaatgttgatgtacatgaccctttagttggaacaagagtgaaatgattatctctggctgggcatggtggcttaatgactgtaatcctagcattttgggaggcccaggtgggcaaattacttgaggctgggggttcgaaaccagcctggctaacatggcaaaaccccgtctctactaaaaatacaaaaattagccaggtgtggtggcatgctcttggaatgccagctactgggcaggctgaggcaggagaattgcttaaatctgggaggcagaggttgcagtgagtctagatcgcaccactgcattccagcctggaagacaaagtgagaacctgtctcagaaaaaaaaaaaaaaaaaaaaggtgaaatgattctcttggaactggcatgaattagcaatagacgaactgttaccaagtctgacatcaacactagcatttaaaattgaccacattcactaaggcatttcctatatttttatttccatgtgtttatacccagggacacccattggtggttggatatgaggcaggctgatctttattctcttcgttttgttgttaagcctggtacattctttttttttttttttttttgtgacggagtctacctctgttgcccaggctggagtgcagtggcacgatctcggctcactgcaagctccacctcccgggttcacaccattcttctgcctcagcctcctgagtagctgggactacaggggcccaccaccatgcccggctaatttttttgtatttttagtagagacagggtttcaccgtgttagccaggatgatctcgatctcctgacctcgtgatctgtccgacttggcctcccaaagtactgggattacaggcgtgagccaacgcgctggccctaagcctggtacattctttagtacagcaaaataattaggcaggagacattcttcattcttggttgaactaactgctggcctgttccatacataaatattaactatgtgccccagtcatgttaggtgatagcacttctagtgcaaaagagcattaaccctttccttgttctcacacatgccatattcttaaaaatctgaaaacaatgaaaaaatatctaaaacaattttgtttgctttgcactctgatccttcccaatgttcagatagcaagatggagtgaagagtgaaagcccctttgtcctggagcagatagtggcagtgtgctcctcttgacacccccaggaagcaggccacaggtgcatggagctgtgttcactgtgaagtggattcagcctgataacatggaatcaatgatgccattgaaataaaagccagatgtaatcctgcccacactctatgatagctgtcctacatccagagtgtcctttcttcttcctagactgtagtttttcatttataaattaagggtgtggggctggaatcatgtctaggtcccttccaactctctaattgcagattccaggattctcactgcagatcctttgcatgttaccgtggtgctcgattgccctgccatgtgatgtggctttttgtgagcatctttaccacttgattagggaggaatctgtgggatagcattttagaaaagtgaacttcatagaggttgccatgtttatagtcattttaatgatgtggatgaaatttaaactaccttgtaaataaaaaaacgtagacaatggtgacgaattcagggactggagaggttgtcacatccttgttaaccattagcagtgtttcctttaaaacagcagctttttgcatattagcaaagcgagcatacattgctcattgccatgagaggtgacgacatgaagatggtgcatcctgcagatacattgatccctttctctgttttctcctagggttttccaggaaacacaaacgcagacagtgtggtgcactacagactccagcctccctttgaagccaggttcctgcgctttctccctttagcctggaaccccaggggcaggattgggatgcggatcgaagtgtacggatgtgcatatagtaagtggcctttattccctgtgtgaaatcaaggtcagcatgagattctgtcaaagccaaactgtaaaagccaatgtcggcatgaaatgttgaacttgactttttctgtctttttatatagctgggcaagcagaactggtttttattgaaacactctagtgtctccccatgacaatatgaactttagttactgtcttttatagttgaatttagtggtggacctgaactgaaacttacctgtctttagattcccagagtttagcaaagtacttgcaatatggtaggcatctgatgaaacgaatacaattcaaactaacaacagatgatgctgtttttctgaagctgagatgacacgctgtctgggaaaacaggagctgtactgggggcagggtgtgatttctcgcaatctcttggttctctgtgtttttctctgctaacgtcctcttttgcacaccatgctgtcgcttcacttgatcttcacttggtgggaacctgtgtttagttagcctcttttctcacctattctttgttataaaagtggaaaggatggggccgacatgaatataacacaaacaaaaagccggccgtgagattatttggtggtactcagtgacacagttgccacttgatgatctagaacatacttgtattctttctttacattatcataaaaatgttttaaattattgtcaaaatggaataaaattgaaaaatactcctgtataaaactggagaacaagtcaaagagcagtctggatggaaatgtcttaagtggcttcaatttgggtccggccggatgttcatatcacactatttacacacagtcactcccattctctgcctactcacagctttagccctgcagaatattaattttctaaagcatgataacaacgtctgtcattcatgcagcatttaatgtctcagatactattatttccattttattacataacccctgtacaacccagttcatttcctaactctgcttgttttttagtgtttacatttctacagggctaaatataatgatgttgctttaccaacggtcttttttcttcctgttattgttcatctccttccatccctgtgttttctgggacctataactgtgctctctgtttcaatggctaagatgtctgatatttagaatttctctttgatgctgtgaagttaccttctcctctcattactctgaaacaacttcaggtttactgactccaaagtggaacatgctctttgatggcgatttgccattagcttgatgttccttcatgaagagatattactccagttccttgggctggaggttggtaccaggaagatcaaagccctgtgcctgattccaggaagggccggtgggcggtgcagctgccatgcaatctgctggcaccgttaacttctgtaaacacatgctgttggctgtaagggactactagtaaaaaaacccaaacatgcagacagataatatgtgaccactgctaactagctaaaagtaattctttagaacaagtggacatctacattgtctttttttccttagaagaataattgttcaagtatggtgattttatttttgttgttgacagtaatacaaccctttatgacttatgttaataatggtagtttcagtattttcctttgtatttccactgccctgcttgttttctagaacgttgcttataatgacttataatatcccttccacgcagcatctcttcccatttatttgtttatgtatttatcaatttatctttttttattttaagaggcaagttctcattatgttgcccaggctggagtgcagtggctacaggcacaatcccactgctgatcagcacgggagtcttgacctgcttcatttgggagcagggctagttcactcttccttaagcaacctgatggtcctccgctcggagagatcaccatttgatgctaaaatttgttcagacacctgatcatcatagtgcacccctgggctccatcgatcctctacctcagcctcctgagtagctgggactgcccagccctagtgttattagcttttctacacttcatttacagtaatagattcattattcctttaaactgtgtgtgttttcacagactcctggcttactctatgcatttatttctatttccacttctagcctggggataggttgtaggttctcccagagttgctgctcaactgcagaataaagccatgagcacagatggcctcgggcccttcttgacagctgtattctcctggttttccatgcacctttgcatgctactcttcttgccactccttaaaggctaacattatccacagattggttgtaggtcttttatcctgctcccaagctctctctgagtcttttatccacttccatgagttttcagtagcatttacacactgtggctgataacttccaaatagacgtatccgcaacctactctgaggagttccaacctctggtaccaacctctcttcactggccctgtgagcacttaaaactcagttgtctatctgctcattttcctttgttttccatcttataaaatgataccaacagccacctattgactgaaacctgattctatctcctaaatgttttgaatttctttctcttcctccagtttagcctaaatgagcaccagcctcctaaatcagctatttgtctctggtcttgatctttccagtttttagtccacacaataatcaggatgattcctggaaaaacatgcacattcgattgttcaaactcgattgttgaaacatgcttaaagccacacccaagacactaggattgtttcccagaggccttagacagaaaaataaattccctatgctctactgcctgtccaggcctttgagggcatctctcaagaacaaaggggaactcccagaatcttaggccagaaccctataagtccttgacgcatctatctctcttgccctccatgtccagtgagtcacgaaattctgtattcttccctccaaattacaccttgcatgatttcagctctctttagctctactaccgacttaatctaaacttggtgtcccacagattatggaaattgccttccaagtttgggtcattctgtctctgttcatagctgactacattatattctccacactgcaactcaagttaccttttaaaaatgcagaactgatacaattacgtccctgtttaataccatcagtggctttccattgttcctaaaacaacatccagactcccagcaaggcctgaaggagcttgtccctgaataactctccagtgccacctcttgctgccgtcacctgctacctgtccactgtcaattgtatccagctttttactgactcaaagcctttacgcctgtggtctcccctgcttgaaatgctccttccctatgttcttgactggctatttactcttcctcttttggatcttagtttaaatgatgcttcctaggccctcactctacatttggttcctcattataagttcccaggaagcctatagtatgacttcatgtgctatagtcactttttataatgtatctgtatctgtcttattagaggcctaatttcctttttcctcattagccttcaggctacactagggtaaggtacattcattgctgtaacatcagcacctaatacagagccaggaacatactaagtgcaccatagctttgcattgagtgaatgaatgaatgaagcaattcagaaaaaaagtctgacagatgataataaaatctgaataatgaatctaaatttcagatatttatttctctcttatactagccatccaggtaaggcaggtatcttggagattatattgttataaagtgtagtattaaaaattgtaataactctagtaaaaatagcgaatataaggttttacagttatgtttccattcttccatctgatatttgatgcatctttatgtagtagaaaggcagttattaacacccagatgttccaagtgagcaatctgagaagccacaccaagggccggcagtgcaggagctacaaatagtcaccagagacagggagaggactccagtcctctgactaccaattccatgttcttgatggataataactgccgaggtttcataaaggatcattatattgatacttgttttgatatattgctatattgattgatggcggcagcttcttttctactttcagagagacagcatcaagctgcattgtattgtatataaacatttagtttttgattctgtgccttcctcctttttatcatgccagctttaattatcctcaatttcagagttctttaaatcactccactttctttgatattaatgcaaaaaatagaacagtcctcttcttgttgttttctcaagtggttagtatcctttccatctctttaattcccagtccgctagtgcagattttaagggcttacattccactccatgctagtgtttcagtattttcattagataacactcaaacatggcttttgtctgattcatgtttctgttaaactgagattgggcttctattcctttgtaagtcacggcaataattcatgaagaaaaaagaaaatggttagtattcaaggttgacttcataaataaccaagaagagcttggttcaccacttttttggtcccttagtggcggaaaatttggtgggggagggggtctgggagtggtggattcctttttaaaattttaatacttggagcacagccgagataattaacagaattctaaaatgttcttttcacgaagatttcttttataatgtcccaagtgaaaatcattttttattactcacaggtaattctttattcatgcattttctgttacattttcttataacttagtcttcaaatagttttatatgtcattcagactgtcttacatagctatgctattaccaatcagtccttttcttattcatcattctagcttcacttataattggttgaaccatatatttgccagttttgtagatcaaatacagttgaatattagcagcttcatctggattaactgagtgctgtactgttttctgtaggaacaacagatggcaagtggaggtttccggtaaaacaaaacaaatagaacaaatagtgactggacaaaagcaaattttattttctcccttccaaaattttacctgtccttgattagaatttgagacatgggaaattttcataactcctgagatggtccaagtttgtatttcttcattggtgttctaatgaagttagaactacctacctctgtaaagttcctttaattgttttatcacttttatatatacacgctgtgctagtttgcatcactggcaccaattctgcacctgttccttgccagtacgtgtgagtggcgtatgcttccctgccccctgatttttgagccagccagtgacttcctttggctagtggtaggcagagtcaactctacagtgtacctactgtcctcctttgtgtctaccattaataagcatgcctgaactatgaattccagtaaaatgaaaagagatacatgctttacatattttgaagctgtttcattaaatgcatatagattgggaattgttttatctcccttaaagttgattttttgtaattatgaaatatccttgtttatttctaataatgcctcctgcatgtaagtctgcattctctgatgatagtactgtatagctatgccggatttcttctgattagtgttttcatggaataactttttccattctttactttcaaactttttgtcttcatatgtaaggactctttctttattatttaaaccgaatctggaaatcattgagttttagttgttatatttagtccacttatattaaatgtaattactgacatatgtgaaattgtagctgacatgttactctctgttttatatttggttcacttgttttatactcctttttctctcctcttcttttgggttaatcaagtttaatttttccagtttttccactattgtttgctgttctaattttgttcccccaggtacttgagctactacttttatcactttccaaacaatcctaggatgtaagtacaacttatgttagtttagttaaactcttcccaccatgtgtgctatgttgacacattttagtttcatacatacatgtgtatatgtgtacatatatttttaatcacaaaatttaatataattttgtttgcaatcagtattcacttgaatctactcacatatttactttctctgcattttcatgctctttctgaatcaaattctttcagctagaaagactccttttaatatttgtcttagcccagttctactggtaataaattgtcatatagcttttgtttgcttgaaaattgtctttattttatgtgaacttctgaaggctgtttcagcttgctggagaatacggtctgtagttattttctttcggccttttaaagatggcattctattgttttcatgatatttattaagaaatcaataggtaattgatttttatcctataagggaaatgtgtatttttcttctggttacttttgagaatttattctttgtctttgattttcagcagttttgccttgatgtggctattttagttttcactgaatttgtcctctttggatttcactaaatttcttttttctgtgcattgattattagattgggtaattcttcactgttacttcttcaaaatattgcctctgtctcgcatttcctttcctcctttctgagactccaattacatctgtctgagatgtttgtatcttattttctttctttgtctctctctttctccctcctcctgcttctctctctccctctcctctttcatcttttctttctatttatgctgcagtctagacattgtgtactgctttatcttctatactactaatcagatcttctgctgtgaccaatctgttgttgaatatgccagtgagctattaattttagttattgcgattttcagtttgggaatttctgttcatgtatcctagtgaaactccttatcttgctctctattttcctggaaatattaattacagttattttaaagatttttcgttaacttcaatatctggattatctcttgatcttttccattgtctggtttttgtttccgttttgatgtctgataattttggctgaattctggacatgttggacagaaatttgtagaggctagagaagacaaagtgatcccccagtgaatccccaccacagcctctgataggcttctaggttaggcacagttgttaattcaaatcagcatttaactgactcagtgcagcgtctcagtccccatgagacctagttgatatcttatatctggagtacagtgcttcactagtcccaactgagatttgaaggcctttgccaaaacatttttttgaaaatctctgaattctgccatctgactcctaattgtgatgagtctacagagacccctgcttcgtgacccagcctcatagctgtcctgtcactttctgcttggccaccttgtctcttgcccattgctccttgggagttgaccagtgcttcaagggtaaaagcagaaagagtgttctgagcttgtcttctaagatctttacattcttgagtcctggcagtcatagtagatctttaaaactttcaagaagattatttaaactttacttggtacacattttctacttgtccttggtaggaagtgtagtcttctgaatgtttgcttgtcataactgaaaatataactaactgcatttcttttaatgccatgggaaatgtattgaagaaaacaaagtgtatataattttttcatataataatgtgtttataatacaatctacttaatattttggaaaattatttttctgtaaaacactgaagtgctaattaaatttcaataaatattttttaaaaataaataaagccggtcacagtggctcatgcctgtaatcccaggactttaggaggccaaggcaggcagattacttgattgcccagtctgggcaacacagcaaaactccatctctacaaaaaatacaaaaattatctggacatggtgatgtgtgcctgtagtcccagctactcagtaggctgaggtgtgagggtcgcttgatcccagtgaggtcaaggctgcagtgagccaagatcatgccactgtactccagcctgcgtggcagagtgagaccttgtctcaaaaaaaataaaaatttgtaataaaaaagtaaaataaatagaaactcaaaataagatgaaaaagtaaatccatgtccatcagaaataagtaagttgaagaattggaatgtgaacctactcacagaggattccagactctgtgcaatcaactatctttaccaggaaatgggagaaggagaaaagagagaggaaagaaaagaaatagagaggaaagatcatgcatgaaaattaaagatagagatcaaggcctttactgagaatgcagaaccaaggcctgttttccctaagttcctcttattatgcccagaaggaaagaaaatatgtgagtgaataaaggcaaatatttcctaggaaagctttgtgtattcatcgattgcaggattcaatattcttatcatcctccccgaattgatctacagaatcccaatacatctattctaacttattattatattaaaatgaatcgtcactagtctttagagaaataaaatcacaatgagaaaccactatacacctagcagaaaggctaaaattaaaaagggtggaaacaccaagtgtttggcaaagatatggaattctcatacattgctggtgggaaatgtgaaaatgatactatcactttggaaaacaatttggcattcttctaagctaaatatacacttaatatatagctcagcaattccactcccatgtatttacccagcagaaatgaatgcatatgtcaacataaagatgtatgtgtgaatgttcctagcagctttatttataagagtttaaacctggaaacagttcaaatgtctatcagcaggtaaatggataaacaagttgtcaaacagttgaataccccaagcaataagaaagaacagactgttgatatatgcaacagcatgtgtgtatctcaaaaatgttacacttagcaaggaactcagacacaaaagaacacatacacgatacaattttatgaaattttggaactgacaaaactaatctgtagttacggaatgtagatcattggtttcctgggtctgggtctgggtctcggtgacagtgttgggagtttgatgcaaatggcaattagtgagttgatatgaaattgcctacaccttgattctttggcaataacgtaggtatatatatttgttaaaactcattgaactataaccttaaatttattgaatataaattataactctatgaaaatgatattcatgtttccatattggcaattgtgggttttgttgttgtttttttgagagggagtctctctctgttgcccaggctggagtgcagtggagcaatcctggctcactgcaacctctgcctcctgggttcaagctattctcccacctcagcctcctgagtagctgagatcacaggcatgcaccactacacccagctgatttttttgtatttttagtagaaattttaccatgttgcccaggctggtcttgaactcctgacctcaaatgatccacctgcctttgcctcctaaagtgctaggattacagtgtgagccactgtgcctcaccccatattggaattaatattcaatttatttagagagtaaacctctgtaatttgcccattatccctgataaatcatcctgaagcctttgtgtcatcacagctacctagttagcttattaaatatgcaaacccctgggtctcaaccacagaaatcctgattcctggtctggttgaggctcacgttctaaagtctccaagtggtcactcctagtcaatctgagtgaaggtgattgatagaacactttaagaaaatttctgtggaatcgtgtttttttttttttcttttgtaagacatcagtgtttgcaccctatggaatcttgctgttttcaagcaatgttttcctctcaatgttgatgtttcccctgaaaaggcagtacaaggtaggatggggatgagacatgcctgtgcttagaatgacagtgagaagtagaaaagtagtaatgagaagccagatttaagagtacattctgggtgtgaaaaatgtgaaagtaggccaggcggggtggcttatgcctgtaatcccagcactttgtgaagctgaggtgggcagattgcttgagcccaggaattcaagaccagccttggcatcatagtgagacccccatctctagaaaaaaagtaaaaaattaaccaggcattgtagtgcatgcctataatcccagctacttgggaggctgaggctggaggatcacttgagcccaggagttcaaggctgcagtgagctatgaaggtaccactgcactacagcatgggcaacggagtgagtctctgtttctaataaaagtaaaatgtgaagataaaatatggcgtaaggaaataaaggaaatagcaactcaaaattacttatgtcttagcttttcagaagcgtcatactttgcaggagtctaaagaaggtagactccttccttatcctttcttagaagtcattctggaccagatgcctgtttacagaagcatcactgtgaatgtggcagaaacaatcatatttcaggattatatgtcctcttttccatactgtgggatccttaaaagtaattcattgtcttctgcatttttatctttcacctgcatatggaaggctttcagtgaatattagctgtatgaatgaggacataacacattttagcaaaattacttctgacacagttcttccttgtatgacaaagttctttatctgcaagaattcgtatttgggaactttgtgaacatatctgtccttagtttttccggtattctttgaggaagtgtgacaaaaacattataattgcaccaataatcttcaagtatcatttaaaaactctcgtggtcctctaacacaagaaaatgagatagatatattaatacttctgagtaagatttaggttaccagtgattgaagtgagtcagcccaggaacaagctggctggcagagaaggagctgtgtaagtgtggatgaatggttgtaaatctctttttcctggtggaaactgaagatttcctaggtccttcaaaaattaaatctgctatcattttaagctgtctactttcctatatatcccctatgtgctattttaaactcatttccacctctttttctgcccagtgccctgacaataataatgaagcagtcgttcactgaaggtaccccatgtgcccagcactgttgtaaaagtacaaatactaactcatttaaccctcacaacgatcttgtgagagaggagtgtatgtgttctcacttcacttatgagtagactgaggcagagagaggctatgtaacttttccaggatggagtcaggattcaagcccacacagtatatactctagtgtactagaaaatgtggctcctgatctaatggtgacagactaacgtgtcaggggtccacattgctaatactgatcgagattcagcaatcaaaactataatcttaattaataaagctaataattataaactaaattcatataaaattagaaaagcacttcctgctttaaaccacaagctaagttttctttattcattttggatagcaaggcttttattctgaaaactttgaggaacgttggattttatcgtaaacataataagtgacattaattttccagtatcccactacatttcctatttatataattgaatttcatacaaaggattttttccaacagatttctgagaaaagattatattaaatgtgttactggaattattttattttagtgtattattcaaatatatattgtaggggaatatttgcattgattatggctaggtagaactgtttttttcttgaaatggggtcttgctgtgttgcccaggctggggtgcagtgacacaagcactgctcactgcagcctccacctcccgagctcaagcgatcctcccacctcccccttccaagtagctgggaatataagcaagtgcgaccagtcttgccatgctgcccaggctggtctcgaactcttgggcccaagtgatctgcccgcgtcagcctcccaaagggctgggattacaagcatgagccactgcacctgaccagctgggagaacttttctttgctcttgcaagtgttttaaaatgctaaaagtatgacttttgtggacaagtgagaagagagtttaccttttagcattacttctaaagaccaagacttgaaattttgcttctccagtgggaggatcttattcaagagggactacatgggagttgtccctctccagtgctgatcttggtgggctcattactgttgacttattgaactcaatgctttccatcccaaacatcattttttgtttcatatttttatgtattgacttcataaatcatagaatgttttatgatttttagaaagtttggatttacaattcattaatctgcttttattttaaaatatgcataatgagctataagtatattcttaaatttctagatacaagcactagcgattacaataaagaaaaaatcaaggtattagctaaagaacaaaagagtttcaaggtcattgctttatgtctcttttacttgataagttttttactattctatttgcctgagggaaacattccaggaactgtacttcacatgccttagaagaccaatactgctgttggagagtaatagtaaacatagaatgagaaaaagaaatgtataggttgcaataatccagaaaaaaccttttcgggaagaaaactttgttagtcaactaaaaaaaaatagctcaaatattagcattttctttaagcaacaaataaagacatgattataagtataagggaagtgctaaaaatgtgaaagtctgtagtcaatctttttcaagtttcccttagttcatggccagggaataataatcttagatgtcttcatttacatttgacagagagttttgtttttatcatgaacacataataagttatgtaacaaggaataattgtttaatttacacatattttactcagaatgtgcttattcatcatgcacttgatacattaattccttgtaagtacattaacccaatgtgagaaaatcaaacttctaaattttaaaatgatacataaaatggagaacttttgaagtgcagtttactatatgtatttcagatactgtgaatgaaatggatagccatgcaaaaagtactagtaatatttttgtgaaattaaatataattaaacaatgccatcttattggcttgaatgacatcagctcatcagcttcaaatagtttcatatttcactaggttttcatgcatcttcatttattaaataaatatatttttcaaaggacaattgcttatttttctttttacttttaaaaagaagagattttctgggtaatattaatttcttcatgtgattttgacaaatattatcaaatattattttatattactgataaaatgaaacaacttgttttttgatgagctgaacatatgtgacatttatagtgaatttataagaccctgacagagtgctgagagagtgtggcagcattggagttctgacaagctacagcaggaagaaccaaaacagaggtgttaaggccatgctctctcaacaaagcatccaagaaaacaaaacctctgtgcctttgtcagtcagggctctccagagaaacagaaccaataggatgtctgtgtgcctgtgtgtgtgtgtgtgtgtgtatgtgtgtgtgtgtgtagagagagagagagagttttaaggaattggcttacctgattgtaaggactggcaagtcctaggtaagaggtgatattgcagctggagtccagaggttgtctggaggcaaaattccttctttcctagagaacttcagttttctttctttctcttacagccttcaactgattggatgaggcccacccacgttatagagtttaacctgctttactcaatgtttactgatttaatattggttacctctaaaaaatacctgcactgcaacatcaagactagtgtttgaccaaaagctgtttaccatggcctagccaagttgacacattgcagtgcccattagcagtaccattagctgagggttgagaaaaatattacatgtcagctcatttaaaatacatttattacatgtctaaagcagtaattaataagtatgatatgtgtttctgtatctttacagacaaaatctttagtaaagtaggtacatgtgtaagaattaagagaagccaaagctactgggaatgaacaaaggtatttaaattgagtgacactgatatttaatataagagtgaccttaaaataaataatttatgtagtgaaatatgacttctttcctgagtgtttttaatcaaacagaatgagaagaaatgggctgctctaaagataagagccattgggagtagattaataaaagcatttctagatgatgaagtttgagaaaatgttagaaaaatctaacagtgggtattacatatatcaactcctgatgccaccagaaaatatattattgtcagttgtttccttcagtgaatggcttagaaatacaatgtgtgtctatgtgtgtgtggtgtggcatatggatgcacacattttcaatgtgctactgtatggcatatttatatttagaattgctttttaatatcttctttcctagaatctgaggtggtttattttgatggacaaagtgctctgctgtatacacttgataaaaaacctttaaaaccaataagagatgttatttctttgaaatttaaagccatgcagagcaatggaattctacttcacagagaaggacaacatggaaatcacattactctggaattaattaaaggaaagcttgtcttttttcttaattcaggtaaaaaaatacttgaactttataccagtagttaaaaaaaatctgtttacatttgttggtactcagtcttttcacagttagataaaatgaccatataattcatcatctaaaccagaacacctttaagaaataaaaaatacacaagtgatagttactctgggacagtaagtgcaaagtagaactgcaatgaacaaatgtaaatgaaagtttaagagcattactaccagatgcatgcaatacatatcctaagtatgatttctgtaaacagcatatattttgacaaactgtgcaagatcaccatatgtgtgtataatatatatgtaatatatgattatccatatcataaagacaatacatcattataaaattatgagataatgctgataatgaggttctaagaaagaaaatatttgcaatgtaaatccaaatgtcatgagtaatagaaaaaatactaagaaaaatttcaacaaagtgtagaattgaacttaaaaaaataaaaacagggtaaggttattgtgttcaagatagggagaaagtgagaaaacaactctgtaagatggaaagttggatgcaaactgtgatgctcaactaaaaaagggaagccgtgattttgaacagaaataactgtttttttccttctcctttaaggcaatgctaagctgccttctactattgctcctgtgaccctcaccctgggcagcctgctggatgaccagcactggcattccgtcctcatcgagctcctcgacacgcaggtcaacttcaccgtggacaaacacactcatcatttccaagcaaagggagattccagtaacttggatcttaattttgaggttattatagatatatagtttaaattaaatataacctgaaaaataaggtagctgcatagagaaatgccattttatagtaattcataactaagttgactaatagtaataggtatgtctgtcccggtactatgaaactgtttatgccttctaataggtcagtttattataatagatcatcttttccaccttgaaaagaagtaaacagtcagtgttaggtttaggaaatccacaaatgcagaaataccaaggtagcaagcattgttattaaatgtactcatttgaatatatttcatttgaaatttcatctggtatattacacttgttgtttgactatgcagattcctgggggattttttttcttgtcttggtgcaatcctaaccaacatagcattatttaggatcactttgagaagttaacaagataaacaccaatagatttattaaataacaagaaagtcagatgctcacatataaataatatcctgatattttttaagtcattaatgctttttgcaacccattgcccatatgtatctaagctacactgttaaatagcatctattcttccagtccttcacaggacaccttaaagtgtatgaaggatcagaacaaaccagaaaaactgtgatatttactggcataagtggctttggcatataatattaaactgaagatcctagtcctatactggattattcagttttattactttaatttaaccatgtaatagcaaaagataatatctaatgcagaggttggcaaactgggcatcaggccaagtttggacattttttaattaaaaaaatacaaagcctgtttttgttcaaaagagaaggttttattggaacatattctctttctttatgtgttgtccgtggccacattggtacttcgtgtcagagttgagtgctgcaaaagagatcatatgacccacaaagggtaaatttaactacatggctgaaaatttcaacgtggcagaaaatgtgtgttgacttcttccttttaagtttgttcaaaactgtgtggtgccagaaataaaggtattaacagctgccattatgatagaacacttcatttggaataagcaagcatgcaaatataagataatgggaatggatttgtgacaattagtactagacctattaatttataaatgctttaaacacgtaccatcagaaaatcactaaacaatgttatttatgtcatttttctttctaagatcagctttgggggaattctgtcacccggaagatcacgggcattcacacgtaaaagctttcatgggtgtttagaaaatctttattataatggagtggatgttaccgaattagccaagaaacacaaaccacagatcctcatgatggtaaggaagcctaatgggaaggaaagaaaaaaggacattttattttttgcatttaaaaattattcatgtgaagtctccatttcatctaatattttaagaatcagttcttactttaacagctgcccatgtaatatagtaatttagttttatttatttatttatttttttgagacagagtctctctcttgtctcccaggttggagtgcagcggcgcaatctcagcttactgcagcttacgcctcccaggttcaagcaattctcctgcctcagcctcctgagtagctgggattacaggcgcccgccaccatgcccagctaatttttgtacttttagtagagacggggtttcgccatgttggccaggctagtctcgaattcctgacctcaggtgatctgcctgcctcggccttccaaagtgctgggattacaggtgtgagccaccgggcctggccaatttttttttttttttttttttgagacggagtctcactctgtcacccagactggagtgcagtgtcacgatcttggctcactgcaagctctgcctcctgggttcacgccattctcccgcctcagcctcccgagtacctgggactacaggtgcccaccagcatgcccggctttttgtatttttagtagagacggggtttcaccatgttagccaggatggtctcgatttcccaacctcgtgatctgcccaccttggcctcccaaagtgataggaccacaggcgcactttttttgtttttgtttttgtttttgttttgagatgcagtcttgctctgttgcccaggctggagtgcagcggtacagtcttggctcactgcaacctctgcctcctgggttcaagccattctcctgcctcagcctcctgagtagctgggactacaggtgtgtgccaccacacctggctaattttttttagtacagacagggttttgccacattggccaggctggtctcaaactcctgacctcagacgatacactcgcctcggcctcccaaaatgctgggattacaggcatgagccaccttacccagcctaatatagtaatttttattatgcataaaaagttataaagtaaatatgcctcatgggacatcattgtttcatttttatatgaaataaagtaactttctatttttacatggaaatcagaattcatatgtctcacgtgtttttggtgttgttatccacaggagaccaatcattttgcaatggcagtccctaatgatctattccctaatcaactggaaatacttccaaatcagttaataaacttctttcaatgtttaaagtttgaaatatctaagttgggttaaagggaaagctcatgtttagttgtcagtgtatctcagcagcacatcatgggaatatttatttgtattgttggaaacatgttttctttcctgttatgtgctggaggagttggctcatgggttgcaggaccaaaacctgaaaatatctctgactgtgtgtcaccagaccacacaatgaatacatcacttaggttagcatgagaaaaggggaaaaacagctgtgaagcccatgaactttccaagaaggtaaaggagaaaaaaaaaaaaaagttgggtttgaagtctaagttttactatgaacagcaccctgctgagatcataaaaatgaaaaataccatcaagatacatgaaaaaggaaacaccaaagggaagagtgataacaaggctccacagagcgcagtttcctttgacaagatgaaaaagaaatgaaaagaggaaggagataaatggaacagccctctacctaaagtttctgtccatggagaaactgacatttaagtgctgctcaacaggaaaaagaaaaaagacctggttattgaagttggctttgttggagatgcgttactcagatacagatacaaagatgggtttggccaatgggcatccgtgtcaagaagcctgacctaacacgttctgaatattaagctaccttttatctgccagtccttggtgttcagaagaatccctcctcctcaccctaacttctatggggctatttccaaagacactgtcattgaagtgaggaagagtgagttgggccttatgacacaaagagacaagactatttgaggacaatagacacaggttttcatatacattccatgttattctgaattactgatgggttcgctgatggaattattgagtatagccaataaggagaaccacagttaagctggtgtctctgggttctggatatcatcctcaagaaaactatttactaattacattgaatgaggttattaaaatgtgtaagtttcacacaaaaacaaaaagacaattcattccaaattgtgcatatggatatataatgttaattatgggaattccattttaagaattactacaattctatgtgttctgtataaaaacaggaaaatagttgttccaatatataaaaggaaaacatttaaaaatgtattttcttgggaaaatcagctgccagaattcattagtcaactaacaagcactcctctgtggcaagaagccctgcttctctgttgtagcaggcagctacccacctaaatgatgaggtcaagaaatatacagctgataaaaagataaaaaatatgtaatagtccagtgattacatgtgtactacggatcagcgccaattagttgtaagcttttggtatttagttcgttacagcaaatgttttcttttttaaattttcttctgcaaatgttttcttgtcatgaaaagtgttttccgtttagcagaattacaaaaatagtcaagaagaaatgttctgattgatgtatacagttagaatgtgtattaaagattattataaaatgataactgaattatatccatttctaaagtatgttgggacaaaattttttaaaaatgtgattctgttttgaaaattgttttaccactggatcagtgtggttcttaaacttggctttatcttggagtcaccagaggagattcaaaagatacctttacctggctccacctccagagatcgggattttaaatggtctgtatctggattttaagagcccttctggtgattcgactgtttagctaggtttgagagccactaccctagatgagctgtcctgctccagtaacattctttttctaaaatcttttatagtatattagaaataaatccatggaaattccaagtaaaatcagaattactgtggtttttctctggaactgaaattcctatgtgtgaataatgcccaagaattgcttattcctttcaccagccaaacaaagcaaaacaaacaaacaaacaaaaaccatttaaaaacctagtaagatgttgacttaccagatattaaagcatgctaaaagcttctatactagaatcagtatggtaatggataggaacagagaagtcagtagaacagtcaagatctcagaaagatcccagtttatgtgcaaagttgttagtaacaaggaatgtggctcaattcagtggaacagggatgaattatttctgaaattctgccggaacaaacaagtgtccataaggcagaaaataagcatgatcactatcttatacacactaagaatatgtaaattaaagaggatgagaaacaaacaacaatcttaaagaaaatctatgaggttgtatgtaggacctagggtagtatgaaactttcttaacaaagattggaaactcagaagctgtaaaatacaatatagacataattgactatataaaaacatcaatgttttcatgctaaaaatactatatgcaaacattgtatataactattagatctgaaaaccatttgaaaggctgtcaaatataactttccaacagctaaaaatatgaccaatacaaatatcaaataagcatgtgtcaaagatttagtcaattcgttaatgagggaaccagtaaaatagtaagctggttcaatagagattttgaggattgtgtagagaagaccaaatgttgctcaggagaaagactgagtatgaaaatgtcctgttatttgctgtatcctcagggctagcacagggcctggaaaatagctggcatagattaaactcctgttgaactaaaattatattgagactcctttactaatgctgagaagtagagaagtggagaatttctcacacacatacagaaagccacatggatatctgcccaattataataatacttatgttgaaagagaagataaatgtcatagatttcagctttagcaggcagactaatcctggattgataaaaagccttgtacgtcttcgtaaaatctggctttaattagatagaagcaccacctgtaaggctgctcaatgtgctcttttgttttatttatagggaaatgtgtccttctcatgtccacagccacagactgtccctgtgacttttctgagctccaggagttatctggctctgccaggcaactctggggaggacaaagtgtctgtcacttttcaatttcgaacgtggaacagagcaggacatttgcttttcggcgaacttcaacgtggttcagggagtttcgtcctctttcttaaggatggcaagctcaaactgagtctcttccaggcgggacagtcaccaaggaatgtcacagcaggtaagagttgtattcccataaacctgacatatccacacggaaatcatttggtaattagtgagtgagtgaggcagtgagatgctccatgcccccactagaggaacagattgctgcttccttttagactgttctgtgtggtacaccccgctgccactaaagtgttcttttgaccaaaatgactatatatgagaaatatgaaatgcatatttctgcagatgtaccttcccatatacaaggaatacccttgagctccatttcctgacaaacatataccagcctccatcccaaagaactagggtcaggacctcatggaacagacaatacctagaggcacattcctctcctgtcctccttctcctttcccttctccgccctgccgctcagggtctgtgcacaaatattctatacacagtagtcaattgataactatcactttacagggaaagatgcccggcaaataccaagagttcttattctttcgttgatggctgattcgttttctgggatagccgggcaccctggaagaatctcagctcctccacttactgcccttctgaaatgtaaatcacgaagcctcctaagcctcagctgttttcacttgtgaagtggtaaacctcagatctcctttgcagggagaacaataggaagtctgattttattagcacaatgtccaccccacacacaggccctcacatccccactccccatcagggcctgtttttgttgggcaaatgctaggttaggggctcaaatcccatgaagccagactgagttacaatagatgggaactaatctcacatgcagtcagatgtgggcaagtttgttaactacagagctgctggattttgatgattggatttgcagatgggaggagcactgggtcctaaattgacattgtgcctaaattggcatcggaactaaatgggggctttaaaaaaaaaaagcgtaatctgaaaaagaaaaaggcacagacgaagaggctgacttctgcttgagaccagggggatatcatactcaaaaaaagattccttttggctgtaagaggcacatgtgactatactgctattaaatgttgtggtacgaaagcacgatttcaagacccgtgaagaaattcggagggcggggccttatctcagtacttctggaacaatcaggcaagtcctgggtgttagaatctgtgtccacctcacacaggtgtttcaggggagataaaacagatattcagaggagacgtatattttttatcttttagaaatgcaaacctagtttccatttcctcacgaataagattttttccaagaaaggttaaaatcgtgacccacacacagatacagaatgaacacatgtcagagattttctttaactcattgatgagagaaccagtgttagggaaataagtacagataaaattgcctaccaacatagtgaatcagtttcacaaggtagaaatgaaatagtcttattatggaataagtattaagccagactgtgatgtacatttcaggcaattgctaatgtgattgcaaagataaagaaatttcatccatttatatagccaggcagatacaacccattacatacatgttctaaagataaaggacaacttgtcctcaagtaagaggacttgacagcgccttttgctacacagcccatcttacattcacctggtgattggggaggcacactcctttatgcaaaggaaaactaaactccatgtctctttgacaagtgggtagttgcaacttggagccaggcacctacgttaaactcccacggagacaaggagataggagcactgcctttcttggtgtttacatttcaaagaaatgtctccaaggtcctcaagaaaaacactcctggaaacaagaaagaggctaaataagattttgtttgtttgtttgtttgtttgaagattttaaagatgtacaattacaagttttctgaaagaaatgctctaaggaaaaaaagtgaatgaaagtgtgtatcccttttagcactaagaaagcttttgtttgttttggtttgtgtttacccttacaccagtaaggcctgtttaaagaagtaccacacatttatagtcagaaaagagatgccgactagctaaacttttcaatatccaaagggaaaggcaaatcccttctctgtacacactttgcatctctatggacaagcattatttgcattattatcaatgttctgcaagttaacttctgtcactacacagctgtaaagtaactagtccaagatgatggtttacaatcccgtaatatcagctgatctttccattgaaaagatacccagtaatctcctttgcccatttcaaagactgccctcaatttttttcctacagtagttggttcagttttactgctgatgagttgcatatattctggattcaatgaagtgctgaacaagcacttcatccagttctgggttgcacaataactagaattaaatataattaaagttcttaaatctcatcaggattttgctttagctcatggctttgtgagtatgatattttgcctctgcagttaaaatgttgtagttgttaacaagagatcatcttcatatcaaatgtgtttaaaataacatctatgttgtgggcaattaatttagtaacttctcattgaaatatttacagattctactgtatctgattttcttgtgcataaactatggccaaaggccaaatacaacctaatagaaaacaaaaagaaaacaaatgtggatgatagacatgaaaacagttatacaaagatctgcttttatttgtcaaaagatattcttaaagagggcactttttgcagttataaaaagaacatgtcaaagattttgtttaactcattagtttatgagggaatcagtaagatgttactgctgcaatgattttgtgtataatgtaaaactggcttattccatgggatggggtagaggaaccaggaagaagttcagttgtatttctgccagacaaaattcatttgcatgtctatggacaataatcatttgcctgctttcaattttctacaattcacagggtggtaaagaattcaaagaaggggccaggtgtggtggctcacgcctgtaatcccagcaatttgggaggccaaggcatacagatcacgaggtcaggagattgagaccatcctggctaacaacggtgaaaccccatctctactaaaaatacaaaaaaattagccaggcgtggtggcgggtgcctgtagtcctagctactcaggaggctgaggcaggagaatggcttgaacccagaaggcggagcttgcagtgaaccgagatggcaccactgcactccagcctgggtgacagagcgagactccatctcaaaaaaaaaaaaaaaaaaaaaaaaaaaattcaaagaaggtaaaaggcacagaaacctgcagaatcatataatcctccagattgtgtttagacaatgcctagttttacattgaagacatccagaatcttggttgattttaaagaataatttatttccttacactttattactacttctgtttctgtttcatacatcactgaaggttaaaagggaaagctaaaatattaatgttaatgtttaatttttaagaagtactacatttgaaatgctaataatatactaacttcacataaatgcatgttaggaagaaaaataaatgaagcatagagtcattttaataatttacaggtttcccaagactatcaagtaaaatgttaactttataggaaaatttctgttagtctaaagtttattataatatatgtaacttctgaaatagtttcaatcttggcctaattttaaacttcagtgcaaagttaatttaataggcctcatgaagctaatcttatttttagcccatttattggcatgtatctttgacatattatcaggtaaaagaaagcacggaatacctctagtgattttaaataccttaacatttaaatttaccatcaaagacaattcattatgttaccaaattatttgacaagattaatttcataattactactaagaatcataatgtggatgtgagtgtaaatatataaaaatattgtacatatataaagtacaactccagttctttcctaagcattttttatcaaatattaaataatcgcttttattttattttattttatctttttgagacagcgtctcactctgtcacccagactggagtacagtggtgtgatctcagcatactgcaacctccacctcccaggttcaagtgattcttgtgcctcagcctccgaagtgactgggactataggctagtgccaccatgcccagctaattttttgttttttagtagaaatgtggtttcaccatgttagccaggctggtctcgaactcccaacctcaggtgatctgcccgcctcagcctcccaaactgctgggattacaggcatgagccaccatgcccagcgaataataacttttaaaagacagtataattatatctataataataatttaattcagaaacacacgaatatatgttaaagattttaactaatcaatgaagaaaccagtaagatgttacaatcagttcagaggataattcaaagtactacacatacaggcagataagaaatgccaaaatgaattacagacagatatgaaatggttcagtaagcaactgcacctcgctaggcacaagtcatttgtatttctatgggtacaagtcattttgcattactatcagttttctacagtttacagggctgtaaaatagctcagacagtgaaagcagggtttaccttaattaatgggtgcagtaagccagacatccagtgatcttccatttcaaatcctgtcacaccccataagtatgtgcaattttgtgtcaactttttctaaaaaaaccttttcacaatcattcttgacatattttttatcaactcactttcttgattcttgtaaaatgtttttgttagattcagtaaagcaagtaagttttgcatttgaagattaaaccaaactgtgttgtttttatcccattgtaaaggcttctactgtatatatttgataattaaattctagttactttaagcaaattaccagaatttgttacagtgattcttcagaaagagtaatatttttattcatgtgttattttcataataaatgaaatttttaaattaaagataggtggttaatgtttttttcagtgatacatgaacatgtaaataccactcttctctgacttattcagtgatctgaatcaaattgttttcaagtgtttacagagctcataatttagagttgtctctgactgattgtatttcctccaggtgctggattaaacgatgggcagtggcactctgtatccttctctgccaagtggagccatatgaatgtggtggtggatgatgacacagctgttcagcccctggtggctgtgctcattgattcaggtgacacctattattttggaggtaagagaaggcaactgaatgacactggcagtggaaccactttttatctttattgctttgcattttgagtctctagtcaaatttaaaccaagttgatactaagaaataatttatctctagccatgaaattaataccttttgagtttgtaaaaaacatgaaacatttaatcaatttttcttcccaatacaaaaataagtatctgcagaaagtttacttgctgtttaaataacttcatattttcatttaacattaaaagaaaaatatatttgagctacatgtagtaaataagtggaaactttcaaacaatatcatagtcatatctctacaacagataaatccatttatacttctaacagttagctcataaaaacaaaacaaatcgtactgtctgaagtcattggcttacataaaatattacttatatatttaagtccacatctaaatctatactattgaatcattattagtacacagctcagtttatagatagatggataaatattttttacatggagaaggcataataggaaatatcatactgattatgaagtactttcaaaacattgacaatgtaaacaaatattaattaataggagacaagcatattaaatgaatccagtataattggtgttacactggtgcaaagtattgaatgtttgcttccccaccccagattcatatgttgaaatcctgaccccaaagtcatggtgtcaggaggctttggagggtaattaagtcaggagggtggagccctaatgaatggaattagtgcccttataaaagaggcccaagagaactcccttgcctttcctgccatgtgaagttataaggcgaagactgtggtctgtgaagcagacactgcatctgctttgcctcaaactcagacttagactttccagcatccagactgagagaaataactgtttgttgtataagccactctgttcatggggttctgttaatagcagcccaaactgactatgagaactcatacagctaaagaaatggaaacaagtggatcttttgattataaaggaagtttggatttttttaaattaaaagaaccactaggaataacagcaaaaccctgctatgtattctagaatgctcctgtgaatccaaagattatgcttttatatctggaaaccacagttaagagaaacaatcatgtgagaaaacttatcacatgggggcatggatgcctgtacattacagcattctgttatcatcccatatcaccacatatatgataagaaaactcactctcaagtaagaaagttttcaactaggtacgaaattccatgctggacacagatacagagagccacttgcactgtacctaaacactgaagtgttactgaggtaacttaattacttgtaattcttactggaaaggtaaatatattcagcctttcttagtaataaaaattatatgtaaacagaaatatagatctagtaatagaagacttgttatatacatgcagtcctatacattgcattttacctcatcagtatttgtggtatttcgcaaagaatatatacttttccaaatatacagccacagacattcaaagacttcactgagctgtcctctggcacacaggtgtatttaaattgttaaagaaaattaaaatggcctgaggtatctctgaccagacaaagccttgtaagtggccttaactttgcttgatttaccaatataagcaaaacttaacttgagctatttcttgtaaatggctttaaaaataaaaaaagtcaaacttaaggctaaccaatcagaagccaattaacttatataactagagactttccagcaggatcaaccaaataaggcaattgtataactacaaccagtgaaaaatttgctactatatttaccttacagaagctgtccctttttgttcccttgaaagggtccctgaaccagttcccatttgaagctgcttcaacagtgattcatgaatcactgttagctcaaataaacttttgtgcctccatttaccttttattaatggatacatttatatctgtagttggatgcttttttcctctaagcagacacaaagtaaacctgaagagcttaagatttttatttatttatttatttttattttttgaggcggagtctcgctgtgtcccccaggctggagtgcagtggcgcgatctcggctcactgcaagctctgcaccgccaggttcacgccattctcctgcctcagcctcctgagtagctgggactacaggcacccaccatcacatctggctaattttttgtatttttggtagagacggggttttcaccatgttagccaggatggtctcgatctcctgaccttgtgattcgaccgcctcggcctcccaaagttctgggattacaggcgtgagccactgtgccaggccaagatttttaaaattagttaatgccttggtgtatcttgagtggatgataacataggagtcctcagaaaaatgcagccatgcccgccagccttttcagaagagcgaagttggcttaaggaatcatcatcggtccaagattgttagtgatctgagaaatttcatgtgctgaggatgatgccaaattaagggtttccaagtatgagtaccaggatacctcctatacctgctctcagccatatgtggtatcgacaattgcctctaacaaaatttttccaaaccaagtagaagaaaacagtaaacggaacagagattttttttttattaggatgggactgaaatctgtccctccttcaggatgagggctgtaatctgtgtgacagaaacagatgacagagtttgatccacactactttgttttcagaattgctagcccagattgaataggtccagaaagaaactaatgaaataagcaatagaaaatctctaacattatagtctttgacaatgtatattcatatataattcccatttcctacagaaaatacgtgatgcttctcttttttttttaaacttattttaggttcagaggtatacatgtgcaggtttgttatataggtaaattgcatgtaatgggggcttggggtacagattattccatcacccaggtaatgagcatagtacctagtaggtagtttttcgatcttcaccctcctcccaccctccaccctcaagtaggctgtggtgtctattgttcccttctttgtgtccatgggtactcaatactaagctcccactcataagtcagaatacatggtatttggttttctgttcctgtgttagttcactttggataatggcctccagctccatccatgttgctacaaaggacattatctcattttttttatggctacatagtattccatggtatatatgtacattttctttacgctaccgttgatgggtatttaggttgattctatgtcattgctattgtgaatgaacatgcacgtctgtgtgtctttatggtagaaagattattattcctttgggtgtgtactcaatggggttgctgggtcgagtggcagctctgctttaagttctttgagaaatcacgaaactgcttgctgcaatggctgaactaatgtataattcccccagcagtgtataagcactcccttttctccacagctttaccagcacctgttatttttcgccttttaaataatagcaattctgactggtgtgagatggtatctcattgtggttttgatatgcatttatctcatgactagtgatgctgaggagtttttcttatgcttgttggccacatgtatgtcttcttttgaaaagtgtctgttcacgtcctttgcccgttttttaatggggtaggtttttttttctttcttgttaagttccttatagattccagacattagacctttgtcagatgcataatttgtgaatattttcttccagtaggttgtctgtttactctgtggatagtttcttttgctgtgcagaaaccctttagtttaattaggtcccatttgtcaacttttgtttttgttgcaattgctttcggtgtctttgtcatgaaatttttgccatgtcctgtgtccaaaatggcatttcctatatttcctaggttatcttccaggatttttgtagttataggctttacttttttttttttttttttttgagactttagagtcagtctcacctgttgcccaggctggagtgcaatgacacgatacagcctcaacctcccaggcttaagaggttcccccgcctcagcctcctgattagcctggactacaggcacgtgccaccacattcagctaatttattattattattattattattattgtttgtagagacgaggtctcgttatttgcccaggcttgtctcaaactccgaggttcaagctatcctcccacctcaccctcccaaagtgttgggattataggcgtgagccactgcacctgacaggttttacattttattctttaatccatcttgagttgatttttgtatatggtgtaaggaaggggtctaggaactgcttatggttagccagttatcccagcaccatttattgaatagggagtcctttccctactgcatgtttttgtcgactttgttgaagatcaaatggttgtaagtgtgtggcattatttctgggcgctctattctgttccattggtctgtgtatctgtttttgtaccagtactatgctattttggttactatagccttgtagtagaggttgaagttggctaacgaaatgcctccagatttgttctttttgccttggattcccttggctattcaggctcttttttggttctatattaattttaaaatagtttttactggttctttgaagaatgccattggtgatttgataggaatagcattgaatctataaattgctttgggcagtatggcccaatatggttaaaaaccatatttattattcctatccatgattatggaatgtttttccatttgtatgtcatctgtgatttctttgagcagtgttttgtaattcttcttgtagagatcattcatctccctggttagctgtatttctaggtagtttattctttttgtggtcattgcgaataggattgcattcttgatttggctctcagcttgcatgttgttggtatataggaatgctactaatttttgtacattaattttgtatcctgaaactttgctgagattatcagatcgagaagcttttgggcagagacgatggggttttgtaggtacagaatcatatcatctgcaaacagagacagtttgacctctttttctcctgtttagatgccttttgtttctctctcttgcctgattgctctggcgaggacatccagtactatgttgggtaggaataatgagagacggtatccctgtcttgtcccagttttcaaggggaatgcttcacatcttttgcccattcagtatgatgctggctgtgggtttgtcataggtggctcttactatgttgaagtatgttcctccaatgcctcatttgttgagggtttttaacatgaagggatgttgagaaaatacctgatgcttctctagagacaaatatatgaaagcaaacaacatttcatgaaggaatgaggaatattttgtggcagcaagaatgagaatgactctccaagatgccctggaaactgaatatgttacatcacataagggattttgcagatgtaattaaggttgcagaccttaggagatgatcgtgattcatgcagtgggctccatgtaatcacatgagcacttaagagatttaactctggttggaggcagaagagacacagaagagaggtgtgggtgaggggaagccagagaaactagaagcaggagaatgtctctctgcaccattgctggtttagaaaataaactgggcactatgaagagcaacgcaggcagcctgacattgctgagaggccccaactaccagccagtgatgaattgggacctcactcctacaactacaagaagttgaattctgctctaacctgtatgtgcttggacacacattctgccctagggccttcataaggagcccaagagcaccttgattttgtccttgtaagactataagcagagtcatcagtccagccctcccacacttctaaagtgagagataataaagagaatgttttagtaatttgttacagtgatgattaaaagctgatacacattccaacctccatcagatccatttacagacattcccattcagttctaaacccttggacaatggccaaaaaaaaaaaaaaaaaaaaaaaaaggtttcctcaaacacaccctgagaatatactgaaaaagattacatatatatatatatatcttaggtggtggcccacgcctgtaatcccagcaatctgggaggctgaggccggcggatcacctgagatcaggagttgaagacgagcctggttaaaatggtgaaaccctgtatctacaaaaatacacacacaaaaaaaatttagccgggcatgatggcaggtgcctgtaatcccagctacttgggaggctgaggcaggataatcacttgaaaaaaaaaatatatatatatataaaatattttttaaatatatatatgaccaaagagaatagtttcaacagaaagtcaaaatagccaacacagtttctgtgttttgttttgtttggattgtgtatggccttcgagtgaagtaacatacatgataatgaaccatatagggacacagtgacagaaatgggaaggctgatccatgatcatatatgcatacatagatacactatggattccaaagtcccctttgacctgaaagtgtgagaagagcccataacccatttgaaacagatacgcagcaaccacaacccaaattgtatatgcataagtaaagttgtccttatttcagagatgatattatggattgaattgttttccctcaaattcatatgaactccagaatgtgaccttgtttggagataagatctttgcagaggtaatcaagttaaaatgaggtcattaaggtgagctccaatccaatatgaccagtgtccttatgaaaaatggaaatggaggtgcagagacacacagagagggaagacgctgggacaacatgcaggaacaacgcctcaggaagacagaggcctagactgttacacctgcaaggccagggctgtttactgggttcctccctgaccccacatcccacctggggatgaacccgacccagaccttaccacccactgctgctacactgccataaatccctttttcaaaaaaattaaaatatttatttgacaaataaaaattctatatatttaaggtatactatgtgacgatttgatataggtatacactgtgttctgattaccacagtcaagttgattaacacatccatcacatcacacatagttaccatgttgatggcagaggggagtgaagtcattgaaaatctgctctcttaccaaattccaggtaaataacacagtatcattatgtatcaccatgctggatcatcatgctggatcccttttgtttcatggggttgtatcaccatgaaacagtatcaccatgctggatcccttttgtttcatggggttgttgaaaaaagactacaaattaaggactgaaatgcatgtcttccagataggcctaaataaaagatcacactcaggaaccgattttaaatagaccaccctttatgaagcttcccttcatcattgtgcccaacggaattgtaacagtgtgaaatgagtgccactaccttttccactgctttatgtgctggttttattgcaccatacaggtatccctagagcctcggctcctctggagcatcttattgatttcccactgccgcatgaagaaaggccatgctttgcccaaagtgactaatagttttactcagtcggttatttcaacttatttttattgcccagtaatgatgcagtgaaacattttaccaagtcagggagcacatcagcctttcctagacaataataaacagaatatttgccagctcagtcaatgattgagtacagccaagagacactgcagcctaagagagggcagtcagagtggggaggtcacagaagggtgcaataaatcttctgcccagggatgtttactcagaaagtccttggtcattagaaatgtcatttaactctgtaaataataagatacatttgctaatcaatgcttgaggtgcttcttgagagtattagtatagttttgcattttactgttttttttttccagaatccttttaaaattatgttggagacagcacaatatgaaagtaaaattcggccaggcacagtggctcacgcctgtaatcccagcactttgggaggcctaggcaggtggatcacaaggtcaggagatcgagaccatcctggctaacacggtgaaaccccgtctctactaaaaatacaaaaaaaaaaaaaaaaaattagctgggcatggtggtgggcgcctgtagtcccagcttcccaggaggctgaggcaggagaatggcatgaacctgggaggcagagcttatacagtgagctgagactgcgccactgcactccagcctgggtgacagagtgagacgccgtctcaaaaaaaaaaaaaaaggtaaaattcatccctaaaattggctgtcagcatggaaattataaaactcattttctaaactctaacagtccttcagagcaaactttccaagagcaactgtgaaaacagacaatgtcaatctgcaaagtttctgattgttttctttcctcatattccgaggtgtgcatatgtgcctcaaattgtattaaaacatttgctatagatgacacattttataacaaaaaacaaataagccaatatatccaagacctatcatttcaaaggtaaaatatttaggaagcactaaaagggataagaatgaaagtactattcatttttttaagtgatactaaataaagttgattacagaaaatgatttgtcaaagtataaatatagtatcacctttagggtttaaattctacaggtgagattattcaagagcccatttccataaatatatacatgctaatgtgagaaatgcttttgagttatttttatgcatatcataattttattcatttttactgtgaaatagatcatatatgtacagttaaaaatattgctaatttttcaaaagaatgtatatattgttacatgaatataccacattttatcagttctactgtcccattttgctattgttaggcaattttcatttttgcttttagatttgctttataaaatttaggggggtggtgtttcgttgttttgccttttttttagacagggagtcactctgttgcccaggctggagtgcaatggagcaatcacagctcactgcagcctctgcctctccaagctcaagcacttcttccacctcagcctctggagtagctgggactgcaggcctgcaccaccacacccagctaatttttgttgttgttgtttttcttcgtattttgtagagacagagttttgccacgttgttcaggttggtctgcggtgatccatccacctcagcctcccaaagtgccaggattacaggcatgagccaccatgcccagcctaaaatttagtttttaaaatattcttaacatacctagtttttccagtgaattttgcattccttgtgtgtgcttttgtaactttatttacccatctgtatagtaaacttcgggaaacaccagctctaaccaccatgtttaacagcataagctggttgttaaattttactgatgtatataaacccaaaatagatcatttcttcacatagaaacagcctttggttccgctagtattcattactcattttagtaatttaaagaccacatgacccaaattcttcttgaatgctgtgcagtgcactgaaagagactaataagcccttttctgttttctaagcaaatttacttcttgggatatttctgttcatacggtttcctatgacacatagcatcactaagagtcaaataagtgaaactgaaaacattaaaattaatcctgtaatccagttttaataatgagttcatttcattatgtttctttttcctttccatttgttttatactggcctggagaaaacaggcttgatggataaaatccacagtattttcttcctaactagcttatatatttagaatggcctgaatatgtacagctgcagacactaacttcattcctacagtataatatctaccaatgattgaaactagtcagctgcacgttttatttatttattaaaaaggatttggatttttatacaatatttaaaaaccacaaaatgaaaagggatcaatcaacgtatatcttggaggtccttccaagagtctcagtatctaacagccatggaggctgtgacctttttccttcttttctcagcctgcttgtcatttaagggtcaccagagatgactcatgctctagttcttaaaatcaaacttgttccaccaaatccaagatgctgaatttgtacaaatgtaaaaacatcctcttgccacctgtccaccaaaataccttctattcaagtgaacaacagctttaattgctgactcaactctcaaattctaaaaaggtctgtgcttcatcatcagggacaccaagaatttcacatatcacacattttctaactttgccatatttttcatggcaaaattgggaaataccatggactttatccatcaagcctgttttctctgagccaatataaattgacaatggaaaagaaaaagaaacataacagaatgaactcattatgaaaactagattaactatactcttttcagtttcacttattttatccttaatgatgctatgtctcataggaaaccatatcaactgaaaaatatgtcatcacacattcttctctggtttcaacttccaagtcttcttccacctccccttcaccaaccatgttccttagtaggaccaccttagtaggactcaagtatttcagtcagtggatttgtacctgacctttcaatgcatctttctctgcggcgtcgcccacgatgatcttgccgcctgatttgctagtcttccccaccggaaaggcgtctcgaagcccctgcaggtgctccccgaggccccagccttcccggaagccgcgcttctgcatgatgttgtgcaccaccgttcccaccacgttagtgaggaaggagctgctaggacggtttggagatctcagtctgtcctgttcctccttcactgggggaggaatggctgctttggaagaccgtgactgaggtcttgaatcctcttcataaggaaaatctcggggtgactcttggtctttctctaccagagaagtgggaggggcaatggcagctccaccctactacttttcctcctctctccctcctaatcttccccttcatcagaatctggatttggtcgccttgatcagaactcccctaatttcttgcctgtcttcaggcctcttttccctttcttctatttcctttcatatttctagctcctgctgtgtctgtcgttcctctctttggcacttcactactttctcataatcataagggaacataggatcatattcgtcagctaagggaatcagaacgtcccctgcaaaaacccactgggagcaggatccttcagcccacctgctgcatgccgtggtgtgtccccaatttgcaggtcatctgaggagccgcctggccttaggtcaatgactggcaagagctgcactgtttctaactttggctctttccctgagtgagagctgccttcctcacctgaagctgagactgcagaagtttgacgttttggaaccagccttctgcttttgagtcactggtctccactctcaggccatcgtatgggggcatctttttttttttttcaatttaatgttgccctgctgactctacccatgggtagccaggttaatatgaaaaaatgaagaagaagaaaaacccaccaatttcctgatgccagataaatggaaaatgttatttgcaccaaagaaaccttgagagacttggaacaaatcactggtggatgtgggtttctggatctcactagatttattttaatagaaagtttaggccagacgcggtggctctcacctgtaatcccagcactttgagaggctgaggtgggtggatcatctgaggttagtaattcaagaccagcctggccaacatggtgcaaccttgtctctactaaaaatacaaagattagctgggcatggtggcgggagcctgtagtcccagctactgggtaggctgaggcaggagaattccttgaacctggaaggcaaaggttgcagtgaaccgagatggtgccactgcactccagcctggcaacagagcgagactctgtcaagaaagagagagagagagaaagaaagagaaagtctaatttgcagatgcagacctatcttctatactgtcatttgtccattcttttttttctggtctgtgatttcatctttttgaagtgtttttcaagcagcactctgtacggttgcaggttgtgcatatagcctgcagttttttgcattcatgcctgaaatagagattgactgaaggtcaaattcttttaaacttacctttatggaatctttctgctattcaatgccatgcctccttccatgatattgagaatacaaaattgactgttgtgtcgccagtcctcacatccttcttgtaggaatctgctagaccaagaacttgtggcaacactgcattgaagtctgtcactgcaataacacacagtgacaattttcttgccaacctcatatgcttacacaagtgaaaataaccgggctaaaattttcatgggtcttaatatctttatttgtttgatttcatatccatgcagtactttatgattagaatttgtcctgaaagtttcataactttttgcgggacacctggatttattttagtttttttttttctaacagagttatcgaattcattttcttttaagaataacctggctgggcgctgtggcttatgcctgtaatcccagcattttgggaggctgaggcaggtggatcacgaggtcaggagatcaaaaccatcctggctaatatggtgaaaccccgtctctactgaaaaaaaatacaaaaaaaaaaaattagcagggcatggtggtgcgtgtctgtagtcccagccactcgggaggctgaggcaggagaatgctgtgaacctgggtggtggagcttgcagtgagcagagatcacaccactgcactgcagcctgggtgacagcatgagactcaggtctcaaaaaaaaaaaaaaaaaagataacctaagttatgtgtcaggaaacaccacatggtgaaagaaagattagcagaactgttgatattcctataattcattactggaaaatatttattgaattaataatcctcttaattcttaatgtgtttatttcttaatgattagtgagatgcagtagaattatacaaagttcactctctatcccattcttcagaaggttctgctgtaccatttaaacttttatttcttttgtaaatataaaaatataaaagattttagtcttcaaacttttaaacaaatatggtgttaaatgttaaacttccaagtgtctgtgaggttatgtatagtttcgataagctaaaaagaagccttaatatgagggaggcttttactttagggatctaaagcagaaagtattaaagttaaagagataaagcttcagttattaaaatggaaatctaaacacaacatttaatttttatggaacttttagggaggaaataagagtacaggcattgagaggtgcttcatttattccagtaagaggaatcttcattgactattttttgaaattgtgctagtgattaacaatataaggtcaaagagaggtcaatgaaaaacacataagtacaaattctatacttcatttttttcattttaatgaacactgtaaagaaaactcaatcctctagtgataaatattgatgtatatttactataatctttggagaaaagggtatttgcatggactgaaagtgtcatgccaaatattaggtttaatacctaatatttgaatgattgggaaaagaaaataagaaattatatctcacaagtttgaaagagacaatacttacagaatcaatataagcaggcttcttttttaaaataaggcaaaggataaaatttttaaaagctatataatttcataatatacaattaaattaattactaattcaatttctcttgtcattggcattacaccattatgaaatgaggttcctctttcatatttgtatgttaaaattaagtattcatttagatcagaggtaggcaaatcacggtccatggcatattatataagcccaaatgaataattgctttgtatttttatttttatttttattttatttgagatgaagtctcgctctgttgcccaggctggagtgcagtggcaccatctcggctcactgcaagctccgcctgctgggttcacgccattctcctgcctcagcttcccgagtaactgggactacaggcacccgccaccacgcccagctaatttttttttgtatttttagtagagacggggtttcaccgaattagccaggatggtctcgatctcctgacctcatgatccgcccgccttggcctcccaaagtgctgggtttacaggcgtgagccaccgcgcccagccctgctttgtatttttaaagggttataacaagaaggacatgcaacagagaccaggtgtgacccacaaaaccaaaagtgtttactatctgcgttttacagaaaacctttgcagactcctgacgtagacaaatgccttatgattttattctgaattaatatgactctttctacaaacagttgtctttaaataataagattttacaattattgtgttttctttaactagagtgtgtactttcatccttttccttacttttcaaacttagagttccattattaggttatatattgtaactcaagagggtgggagtaagttcaagacactactttcctatatgcttggactggtgtggagtaatactgcttacgtcaaagtcaggcactcaccactgcttcttataagtactcttcttgtttcacaaaacaagcccacatagtaaagggaagtgatgtcataagcattgccatttgtaatttaggtgaaattagctgacgattgtagtgaaatttttaatatttaacttctaatattggaaataatcaaatgtctattttatctctttctattcatagaacattctggactgcaaatttttatccttatgtaccctaacagtgtgttatgtcctgttactttttgtgttgttgttaacattagaatttaatctttagttatatatttgactaaagtacctaataccaaagaaagtgttactagaaaagcaaatctaggtatttccacccagtcagtataaaaaaatacgtttttaaatactcccaaatatacatacatcgcaacgcacaaaaacagctatagggtagatatttaacatattttagataaatggtagtatacaattatattttcaggtagcatttttcacacttcacagcatatcctaaataaaatttgggctatgatttcatttattttaatttaacctccactttaatttttttcacttatactacataatgctaaaatgcatgcttatttcttagatgagatttcacaaaagaagccaaacctcttttcacttggttgggaaataattcctgttataggaattttagatctgaattttcccccgcaatttcttattctgaattccaggtattatcttaaatttgatcagttctaaccttgccccttctcacctctctaatgaatggtgaagctcatcgcatcataccgatgtccataaacaagcgggagcagcagtcttcatatagtaaatactgtggaatagttttgtcatagttgttgcttttgtcctatttttgtcttcatattcaggctgcctgggcaacagctctggctctggatgtaaaagccccctgggagggtttcagggctgcctaaggctcatcaccattggtgacaaagcggtggatcccatcttagtacagcagggggcgctggggagtttcagggacctccagatagactcctgcggcatcacagacaggtaagggccatcctaggtcactttagcttgcctgttttcaaagttgaagaaagcaaatgtagagagctggaaaaaggcattccgttctctttttcgttgttgttatctttcgagagggaatgaaatagtcataattactatgaggattagaaaacttcatcttggccgggcgtggtggctcacacctgtaatgcggctgaggctggcggatcacgagatcaggagatcaacttcatcctggctaacatggtgaaaccccgtctctactaaaaatacagaaaaaaaaaaattagccaggcgtggtggcaggcgcctgtagtcccagctactggggaggctgaggcaggagaatggcatgaacccgggaggtggagcttgcagtgagcagagatcgcgccactgcactccagcctgggcgacagagcgagactcggtctcaaaacaaaaacaaaaactgcatctctaatggaataaatagcattttttaaatgatagtattttattagaagatatacaccttatgaattttaccttaatatgatcccgagttgctcagctaatagttataaagctcgcttttgcaaccacacacccatcagttggatgatatttttccaggcagaggaatttgccaggttactattcatcagccacccaaccccacatgttctgcagagaaaataaaaagtaatttctgctagaaaagtttgaatcataaagacggatgaagatgtgtgcagaaggacatactcaatgaaatatggaggttagacaagaaaaacatttaattcaaataagtattacaaccacagttatgctagttgtgccataattttacaaagattttggctgagaagaatcatagggtcacacctggaaaaataatatttctacatacaatttgccccagtacatttggtatttactttcagtgaataaataaatgctacagatttaaaaattgaaaagtgataatctggcccagcgtggtggctcacgcctgtaatcccagcactttgggaggccaaggcgggcggatcacgaggtcaggagatcgagaccatcctggctaacatggtgaaaccccgtctctactaaaaatgcaaaaaattagccaggcatggtggcgggcgcctgtagttccagctactcggcaggctgaggcaggagaatggcgtgaacccgggaggcggagcttgcagtgaatgagatagtgccactgcactccagactgggcaacagagccagactcttctcaaaaaaaaaaaaaaagttatatctgcatctggtagaactttcaaaacctgccttcttcatggagtaaattcagttagtcaattctgttttaaacattaactgtaaaattatcttctctggctaaacaggttttaatttataactcacagttagtgacatactaaaaaaacgcaattactactaaatgaaaagttcattcatatggactttatttattcagcatggaataatttccccctgtgaacattctgttgatttgtaggaaaaatgaattaattcaaagatgaggagtatatgaagtgtaagaatttgtcaagtacctctcattcttgaccttgagatttgaattcttggcacacagctgggactgcatttacatctcaacaccagctccagaaccacactctgtagtcgtgggaagggtagttgggaaggtttctggccatttgctcacttaatataatcccaagttgctcagctaactagccagggagctcatctctctctgagttaaggggtaatgtcccatgggcccacactgtgagtgacaacagctgtcagctcaactgtgatgcaagtgtgattttcttcacttgtatgacattattttgataccttgttaattactcacaaaatatgatccatttgcagtgtttctgttatgagatatatattgtgaggctgcctcttttcagagatgatccattttgcctgctttgtgcatgtagctcccaaagtacaaaactattgtttttactgttataggctgttttgttttaaccttaaagtcccaagagttacattggtgcctaacttggtctctaagatcccacattttaaaaaggcctccaaattgtaccccaaagttacttgtaaacatgctcaactaagcatgaatgtgtgagccacacttaaacttcagccatgatgtgtacaataatcattgcagataaggattttaagaaagcacttttaaattattttcaaatagggctacaaataaaggctatttactatttcattcccaaagtcagtaacgtagaagactagctcctctgagattattttgaaaacctgaattttataaagcaataaaattagaaaactttggggacacaaaatgacatcctacagagttaaaattaaagacctttgctgttccctttacataaagttttgaaaacctgaaaatactgaaaattcacttttaagtatcctgaaaacaggcctgtaagcatctatcagcctttctttgttgttgttaacaaacaaacaaacaaaaatctaattgtattagtctgttctcatgctgctaataaagatatacccaagactgggtaattataaagaaaaaaggcttaatggattcacagttccacatggctggggagacctcacaatgatagcagaaggtgaaggagaaacaagacacgtcttatatggcagcacgcaagagaacctgtgcagggaaactcccctttataaaaccatcagatctcgtgagacttattcactatcatgagaacagcatgagaaagatctgcctgcatgattcagttacctcccacaggttccctcccatgacacagtgggaattatgagaactacaattcaagatgagatttgggtggggacacagccaaaccatatcactaactcacaaagtagaaacatatgttactcaaataccacacctaaaaatcctacttagggacagataaggggtatgaagttatcttttttagtcaaaattttaagctacgcaaaaaatagcaatgggcactttggatgacagagtcacaaataatggatgtttatgtttggataggtgtttgtttgtttgtttttttgagacagagtctcgctctatcgcccaggctggagtgcagtggcacgatctcggctcactgcaagctccgcctcctgggttcatgccattctcatgcctcggcctcccgagtagctggaactacaggcgcccgccaccacacctggctaattttttgtatttttagtaaagacggggtttcaccgtgttagccaggatggtctcgatctcctgacctcgtgatccacccgcgtcagcctcccaaagttctgggattacaggcgtgagccaccacacccagccaggataggttttaacttcttaatcacctcttacatcagactcctatactgttttaaggtttgccctgtataccacatggcagagcttccagtggagtcctgtgctgcgttccaactggggctccctgagcagggaggcctctgtcacctcctcacctggctgtgctgaccaggctgctgaccccactcctgccctccctctgccatcttcccctctgttggtcttctgcatgctagctacttcctctattatttgtactacatgtaaatttttcacaattgatgttgtgtttagttgaagaaaaatagtgtatacatgttgatagtctctagatcacttaaatagttcttatttccaaatattttgaactaaaattattctctccctgttgatatcaaacagcagtggtttttaatgttttttaaaatttgtggaatcttcaagtcaggtatgatcttaagatgctccattatattaagaaggaaggggaggagggggagaaggatgtgggggaagaggaacagctgctcttttaaaaatggtatgagggtgggcccccaccccagccaaccttgcctgtcgctccagctccccctcttctgatcagttcacacaggcttttccatgccttggcctttgaaatacttgaaaagttgtgattctcatggcccctaactcttctctgaatgcagactaaatgctcattaacaccatgtaattatggaagtcttggccctgagctggtggtgcagtgctggagagccaggatagggggctgggggcatggggagggtagggaatgctgcggattcttcccagcccctcaggttcccctcaaaggatctctcccgaggccaaatacaggcccctggggctttctgtcaacttcataccccagttctctgctggtcgtccttccaccacagccaggaggcctgtcacaacctcccagcccctcttctgttacttctctgggtcccatggtgaggggcacttgggtgctccccgcctctgccgctccagcatggactatgatgtccctcacggcctggaaggtcagtgtcctttagaatcttcactctttaccaggtccttagctgtgtactcagcagtgggagacagcggccagaggctgagatccaaccctgctcaaggcagaggtgggtcatggtattcaggccaggcctccagaaggtcacactacctcttggtgacactctgtgtcaggtgctggtcagtttccatagtgtaccctgctccctgttcccctaacaatcctgagaggcaggcatgctaggcccccaatattatagtgggcggcagcagattccaagaattctgaaagtgtgagacctccaactgttctttttcaacattggctggttcagggtcccttgaggttccctgtgaattttaggatggattattgttttctgcaaaaaaaggcattgagattttaataagaattgtattgaatttgtggattgctttgggtcatattgacatattaccagtgttaagattgcttaaaaagcaataaccgactgcttattgcaaatctaaaaggcgacaagatgacctaaattaaatgttcttcaaaatttctgaacctctgtcactatgtgactgaagctgttcctgtttctttcttctcccctctgtatcttcctccctgtttccccttctttcttttaaaaatgaccacaatatagtaactgagcatgccatatttcatagttttatgtgtgtaattggttttgctagccacatgtcaagttattgtgtcacttgggacaaagaaaaaaagaaatgtgttgaaaattcagctgtcacagaaacctaataatcagctgcatgctaatggatatatttatctaaagtttgtcaatataattagagaaccttgatggcagacccagtaatcacgtcatgtggggttatcttgcgtatgctggcctttcacattaacctgtttttggtaagacacttattttttgatgattgaaaaagggaaacagcagttgtatctgttttcttttaggtgcttgcccagctactgtgagcatgggggcgagtgttcccagtcgtgggacaccttctcctgtgactgtctaggcacaggctatacgggcgagacctgccattcctgtaagcctcacacctccctctcgtttctgtcagcatctctttgtcatttcattttgattagttgtttatatgtatctgcatatttgcaatcatgcaaacacatcagaagagatatttcagcactcaatttctagtttacttttaatccaccttatttaatacaagggtgttgagacagtgcacagaaatacgtggtacgcataggattgaaaaaaagaaactggcaagcaatggggaaataagtctaggagaatcagatatagtaaaaggtagaaactaaattaaattaaaaatgcatgatgttaacagcttgttccattacttgagttggaccataattttaattctgagaatcttctcagtcaaagaaaggtggaaaaacaaccccttgccaggctgtcaatgttacatttaaggtatttaaagattttttaacaatcactgggatgatgcaatcatgggattgtacatggcaagatttttgaagaggtaatgggatatcagctagaaactagaggacctttaagatctcttacaatgactgtgattttctttggtggtggtgatgatgattgtaaagtgaataattgtaaaagtattaatgtattgagtacttatgtcagccctctgctattgctttgcatatattaactcatttaaccctaaagcagctggaagaaagtactcttattatcttcattgcagagttgaggacagaaagaggttaagtaacttggcccccagctagtttgtgggaagatgaggagttgagctaaggaggttggctccacagccttggctccaggatgcctgattggtggtccatgcaccagcagcacccacagcccctgggaacctgttgcaagtaaagactctcaggccttacccaaacctactaaatcagaatcgctggagatggggccccgagtctcttgtaaccaaccttcctcatgcttctggtagacatttaagtgtaagaacaatgtctaagggatggcatattctaacacttctcaactgcctctgccatattaaaaatcatctgtctttactgaagaatcaccctctgtgaatttcaaaggccatgccgttttattgaactctaacctgttataattagaacatcacagaatctgaaaagccttttttttcctatttgtttttaacttttagagttttctttctgtatatctctactgacgtttctgagcaacttctcctcaggaatatttcgcccatccctgggtcttcaaggaaacagagatgcaaagtcctcagttccacttgctcatcctgagttcctaattgaaacttttaagaactcttccatgagacatttgattttcacaaaagccacaggagaaaggcaggctgtggagtgttaaaaccacacttcatacatgcaatgagaattctgcgctcccagtcctgaggttctgtaaaggatctgggcaaaagaggagacagtccaggagtgactctcacagattgaagcatgaagtatgatttttgtactagaagggtccctgtttataaagctgtgacacattttcttttttttgtttgtttgttttttgttttttgagacggagtcttgctctgtcgcccaggctggagcccagtgtcatgatctcagctcactgcaagttccgcctcctgggttcacgccattctcctgcctcagcctcccgagtacctgggactacaggcgcccgccaccacgcctggctaattttttgtatttttagtagagacggggttttgccatgttagccgggatggtctcgatctcctgaccttgtgatccacctgccttggactcccgaagcgctgggattacaggcatgagccaccatgcccagccgctgtgacacattttctaggagttgagtggcctctcacaccagaggctgaatgtcttgataaggtcatagagttggtgcagggaccacatcttttacttctgtgtatctttcatcctccaggcatagtatcttacctaaaagcagaagcctattcttgtgtgttacctggaaaatttatatctgccaccacactcagcattgtctgattgcatttaatgttgcaattaatcaatgagttatattagtccatggttattcactgcaatcaaaatataactccaaaaacttctgagggaaaatatcaggagattgaaaaagtatttcaagtgtcagtctcatctaataattgacggctataggtagaaatttgccaagcccacagtcattcactgtgagactagactgccacacctagttgaataggttattttgtatttctaattgtataacatgtatcaattatgtgcaactaattaattgtatataattattaattgtatataactcattgtatataattaattatacaattaaaatcaattgtattcaattaatatatactatacattaatacatgtatacattatcatttaaaaagccaaacagttcacataaagcacaagttctagtcactttcctcaatatttgtctccattccaaacctagtctgtgccctatatttaagtattgttattaatttgagtgaatcctaccagacatatacaaatatatgtatctatttaaatcaatatgccataagtggcacaaaaataaagattagcaatgtccatctcctgcagatattaattccataccttgtacttggtaaaacatttacttgcacaaatgaaaatattcaattatgctagagtaaatttacattatatagggatatctttcaaaaaagtttctctcctgttttgaatttcagctgtcttgaattgtcacttgcaaaatacttagggacgtttcttttttaaatcagctttaattattttttaatgacgagaagttgatagcttataaattccatttatctctttaaaatgctcattcatattgttttaaaggaagcaaagggtataactgccgcatagcttaagaaaaactttacagaatgcttatgggaaaataccagattatttaggccttttaatgtgcttaggtattcagttattacagggagaatgagggtttcttccttaattatagagtttaattctgaggtatatttgccatgagtttgaaaagaaccatgcttcaatagcacgcagaattcagattcacaaagttttcctctcgtatctcttcaagtgttttacactgtgcttcagagtttgcatgctttcttgcctaaaagcaaaagaaaacatttatgtagagaaagtacagtctctagacattgccaaaagattgtctattgaagatagtatcgcattcccactgtaagcacatcttcatgtttgaacaccaacacaatctttccttcttcctcaaaatagaaatacactgtgaccgaatatttattcagcatctaacaacatccaacatttgaatgtattttgactaggtaatttttttctcctttgttaataaaaatagatttaattttttaaatgtcatttttcttgcatctcatcaaatatactttcatacactataaaaatgatgttgggtcatatgtatcacatgtctgtaattcagaaatgcaaacctttggacactgactcaacatctggagatattttttctggttcttatggctggtgttctcctacagctctctacgagcagtcttgtgaagcccacaagcaccgagggaacccatccgggctttactatattgatgcagatggaagtggccccctgggaccatttcttgtgtactgcaatatgacaggtatgttgataatcgttagatgcatagatcagaatagaccaaggagaaatttacctagttggcagcattattaaaacatgcagtttgatagtgtgtacttgctaagtagaagcattaaatatgtatttattaattttgttgtcaacaaaattttcttgtatttcttctttgcctgggttggattataggcaagattcaatgctctgccaaggcatctctctagctcctacactcctcataatacatctgttcatgtgcatcatgataaaatacaaacctctgattcggtgatttacatgctttctgtatttagaaaaaacagaggtgtttaaaaatgctaagaaataacatagatatgttaatgttctatgtgcatcttaaataatttagtgatttttatgtcatataattttttcataaccaaagaaacttgattatttctcatgctttagatattagaaatgaacactgcttgggctgcgcatggtggctcacgcctgtaatctcagcactttgggaggccaaggcgggcagatcacgagatcgagagatcgagaccatcctggccaacgtggtgaaaccccatctctactaaaaatacaaaaattagctgggcatggtggcgcccacacctgtagtcccagctacttgggaggctgaggcaggagaatcccttgaaccagggaggcagaggttgcagtgagccaagattgcaccattgcactccagcctggcgacagagcaagactgcatctcaaaaaaaaaaaaaaaaaaaaggaaaaaaagaaatgaacacagcttgattatagaagattgcactagaacgccttttaaatagttacatttttacagaaatttgttgtcacctagctcttccaactctctgcaaagtggaaatctggaataaactgttctcatttattgtgctgacaaaaggtttcaaaagtttcataaatttggacaataaccaaatgggtcagcaagcatcaaggataaagaaacaaataactgaaattacatgggcatttaaagtgccttagcaaagattgtcaaaaaatagtaaaactttacaggggatgttcagaagattcagagccacctgcacagcaatgtgctgaagataaagaaacacaggcgttctgccataagataccaattacctccaaaatcccgactcaaacaatgaaagcaaagtgagaaatcccataaaaatggtcttggtggatatcaaaagactcaaccaaagtcacaaccaggaaggaccttggttgtcatcattttaagatgaggaaatcaaggctcagaaaagttggttagggaagtatctactgacaaaatctagctaatggtaggggaatcactaaactctggtctcttttctgccctagaaaatgtcaccttctctttagatgccgcattgctctatagccagtaataaattctctagttgtacaaatcaagcaataatgattataaaatgtgcaatttcaaactactctaatagcttgaaatgtatatatcgtaataaccttcaaaaagcagttgcttcagagcttggaagtcagcactctatcttaagaacaagtaaaaagccaggcaaactgaaaaattaaccaatttttttagatccagcagagaagtgaggtcacagaacaaaccactgcccctcaaaattggagagacaggcaggcttatatacagaatgacagttttcttccacaagcactaacctttggggaaaccgttgtcaaggtaggaaaacctaaacttaattgacgaattgttggatgtttgatgtggacacatctgagaattaaaaactccaggaagacccagacagagaaggatccccacacttctgtgagtttgacacctagcttgactgggttctcacagtgaatgttggagaaaaatctcctcatgcttccagaaagggaaggtgaaaaggaaccgtcttgaagtacaccagagctttctgttcttcttaacaaggtctttcctcaagggcaaatatttcacctaagctactggtgttttgttttcttttgttttgttttgttttgttttttgttttcagagcctaacctgcctggaggaaggaaattacccacctctggccatcctgtcccatgtaagggtggtgatgggagggagggctgagaagctcttgtgaaggtcacagcccagaggcacaggctccctaaaggactcagacctaatcacaggactacagaacctttccccttcccacacatgttacttatagtactgcaggcctctttacagcagttacagttacttttacctggtacatcacatctggttatcaagaaaaaatttcagctggacctataatcctattactttgagaagctgaggagggaagatagccttagaccagttttgagaccagtctgggcaacacagtgagacccccacctctgcaacaacaacaacaaaaacaacaacaaaacagcattgtgacaacaacaacaacaacaaaacagcatggtgacatgtatctgtagtcccagctacttgggaggctgaggtgggaggatcgcttgagcctgggagttggagactgcagtgagccatggtcacaccactgcactctagcctgggcaacagagaaagaccttgtctccaaaaaaagaaaaagaaaaaagttcaaggcaaaaaacacactttgaagagacagagcaagcattaaaaacagacggtggctcacgcctgtaatcccagcactgtgggaggctgaggcaggcggatcacgaggtcaggagatcgagaccatcctggctaacactgtgaaaccctgtctctactaaaaatacaaacaaaattagccgggcgtagtggcgggtgcctgtagtcccagctactcgggaggctgagaaggaagaatggcatgaatccaggaggcggagcttgcagtgagctgagatcatgccactgaactccagcctgggtgacagagcgagattttgtctcaaaaaaaccaaaaaacaaacaaaacaaacaaacaaaaaccagagtcagatatggcagggacattggaattatcagaccaggactttaaacaactataattaatatggaaaaagctgtaatgggtaaagtagatagcatgcaagaccagatgaacaatgtaagcagcaagatggaaattctaagaagcaaaaaggagtgctagagatcaaaaacagcataacagaaatgaagaatgcctttgatgggcttattagtagaccaggcacagctttggaaagaatccctaagcttagagatacctcaatagaaacttgcaaaactgaaaagcaaagagaaaaaaagactgaaccccaccccctgcaaaaagaaaacccagaacataatatctgagtacagtggcacaactacaaaaggtgtaacatacgtgtaaagagaattctaggagaagaaagaaagaaaggaacagaagcatatttgaagaaataatgactgagaattcccacaaattagtatcagacaccaaaccacaaatccaggaagtttagagaacaccaaagaaggagaaatgcccccaaaactctaccaggcatatattttcaaactatagaattcaaagataaaagtaaactcctttttttgagatggagttttactctcgttgcccaggctggagtgcaatggtacgatcttggctcaccacaactccgcctactgggttcaggtgattctcctgcctcagcctcctgagtagctgggattatgggcatgtgacaccatgcctggctaatttttgtatttttagtacagacagggtttctccatgttggtcaggctggtcttcaactcccgaactcaggtgatccacccacctcagcctcccaaagtgctgggattacaggcataagccaccatgcccaggccaggtaaaagtaaattcttaaaaataatcagaggaagaaagcaccttacctacataggagataagtattacagcatcttctcttcagaaatcatgccagcaagaatgcagtgagatacttaaagtgtgaaagagagaaaacaaaacaaaacaaaaccttctccttgaaaagtgaagaaataaagattttctcagacaaatgaaagggtcagttctctaaaagagataaccttaatatgtatgctcctgacaacagaacacagtggatcttattttcttttttcttctgggacatataggaatgggtataccagatgctggggatttcatatgatatactgagtaaattttaagtgcagacaatccccgtttacagtagttctacttacaatattgcgacttccctatgtgaaaccatatgcatccctatttcaagtacccatacaactattattttattattattattattttgagacagaggcttgctctgtcacccaggctggagtacagtggcacgatctcggctcactgcaacctccacctcccgggttcaaatgattcttctgcctcggcctccccggtagctgggactacaggcatgtgccaccacgcccggctaattttttgtatttttagtagagatagggttttactatgttagccaggatggtctcgatctcctgacctcgtaatccgcctgcctcggcctcccaaagtgctgggattacaggcgtgagccaccacgcctggccacaaccaatattattatttttttttttactctcagtacagtagttaataaatgacatgagatattcaacactttattataaaataggcattgtgttagatgattttgcccaactgtgggctgatttaagtgttctgagcacatttaagttaggctggtttgagctaggttcagtaggtcacatgtattaaaatgcatttttaatttataataagttcatccagatgcaacttcatcataaattgaggaacatctgtactgttaattccaatcaaaatcatgagttaaattagcttaattttcaaagttggatatttatttgagcaacaggagtggaacagggatcaacgtgttacagttaccctccttctgggctagtgagacagcctccagtgtgttctgactcagccacacctctgaacccctttccacatttagccactgttataattaatctactcaggtccaattcacttgagcccaggaggtcgaggctgcagtaaactatgaaggtgccactgcactccaagctgggcaacagagggagaccctatctctaataaaaaagaaaaagaaaaatataagggttatattagatgctctttaagatcctttccagttccaatatgcttataatcaattgaaataaattatgagcaattagggaaaccacaatggtctgtgtccttctttgggtcttttactactgatattataaggagaagtgagtcaagtggaattttataaacacaaatgcatatcctataatgtccctggttactattctactcttcagaaaaacaagttttacagatgtattctcaacagttcccttctcagtactgagggcatttctgtgattacatcttaaccatgggtgactgcaaatctatcatactgcccaccagcctatgtgaactactccggaccatcatttctctcccattgtacaagaaatcatgaacacatggccaaaaatggcatgtggttgagcatcttcaatgcccaacttagtgttccataggtttttctatatttgattcagttgataggaaaactctgaaggtgagagtaggtgatgtgcacagagtaacaccaggttgtaaaaattctaaaatgaggccaggcgtggtggctcacacctgtaatcccagcactttgggaggccaaggcgggtggatcacctgaggttgggagttcaagaccagcctggccaacatggtgaaacccccgtctctaccaaaaaatacaaaaattagccaggtgtggtggtgtgtgcctgtagtcccagctacttgtgaggctgagacaggagaactgcttgaacccaggaggcagaggctgcagtgagctgagatagcgccactgcactccagcctgggcaacagagcgagactcttatctcaaaaataaataagttaaataaaaaatctaaaataaaaaaatagagcaatattaaaggaagaacccatggaattgaaattaccataggcacacttagagcctcctttggtgagtacagtgagtggagtgataatttaatttaaaattgcattcgttatttaaatttgcagatttttttctgtacttgtggctcatttgtgggtatcacacctttgctctccatgggttctgtgactaaagagatatttcagtagcatggctggttttcttttccttctttcctctgatctctgttgttaggcgtgtgtaagtaacagtaaggctgtgaaatttgtcttacgcacaagccatttagccatttagcagccaagccattaaaaatcctgagatgtgaagggctgggagggtgatttctcaaggtaaaatgtatcacattgttttgtttcgtagttcttaaaaaatccccatacaaatgtttcttcgtttctccagttcggaaaatttttatgtaaaatgtccattattctaaatacatcttattagaggttaaaggaccagacagcaccagcatagtagaattaaagtgacttcaagtctggtgggaggtccattgttgggaacactaaagaactcaagatgcacttcttcccttttgagattgtggagtcattttgtttttatttcatcaaaacaatataagtaatcaagtgacagagatacatcagaaatgatgtcagcaggcagtcagatgctcagggtcaccgcctggaaagtgctgttagaagctcaaggcctctgattcctctgggcttggtcactgatggagaagctgacataattaaaccactttattttaatagagctgcttcctatcatacctgtgagtatgtgcgtcacatcgtcccaatatgtatcttttataaatttattcgataatgaaagaaatagaggcacatacagatgaggaaaatgcagatgagtttaaaaagataaaggtccaggtagtaacagtttggccccatgcttgtgttgatataaaaaaatggttttaacaactaaaaagtcattgcttacatgatacatttttaggcgtgacgtcgcaaaagtttggtcatcagttcttccaatatgctttctcttagaggctgagttctggctcagtacattgttacacaggtccaactcctcaaatcgcggcaaacatgcagtaatgtaaatttcaattaaacgttaattcacataaaaggtctgctttgcctcttgctgctggcgtctgccgcccagtgatgcctctcctttgcccgtttctgctcagcagactccgcgtggacggtggtgcggcacggtggccccgacgcggtgaccctccgaggtgcccccagcgggcacccgctctcggctgtgtccttcgcgtacgcagcgggcgcggggcagctgcgggccgcggtgaacctggcggagcgctgcgagcagcggctggctctgcgctgcgggacagcgcggcgcccggactcacgaggtaagcgccactgctggaggctacaggggctcacgaggccggggcgcggccctcgggctgcgagatgcctttgagggagaaaaggccagggtccctcccgtggctcttagttcaaagccctgaccgctctctccttctcttcccgctcttggttggaccaaagagcattcaagagcgccttcctgaccgttgagagacgttcagcgcgttcatatgcaggactagtgacttgtcctttcttaatcaagggaaattttgctaataacttatgccttagctttccgttcacactgaggagataatggctgtagggcaggctgggtctaacagttcttcatgaagaccagtgggaaccggtaacctccttactcttctcaaagtcttcctctaaatctacttggaacctttgtttcctccctttagattaactgaatatgcccttcctcagccccgccactttcactgtggtctaggatgaaataatgactagggttattaaaaccttttgtcagtgggtgtctcatttttttgaaattatatcttgagaaatgtataccttaatcttcatatatggaagtaatgttttggaaactctgcctgcatcaaaaccgtcttctcctaagttaaagaccaacttccccctcctttccggaatccccacagtcccctgcaggactcaccgctgctctccaacagtttccatatagtttcttgaaagcactttattgctaattatagttaaatactgaaatttacctttcatttttttagttttagcaatcccaaatagtatataggcgggaggatcactggagcccaggaagtccaggctgcagtgagctgtgattgcttcactgcctccagcttgggcagcagagcaacaccttgtcttaaaaaaacaaaaacagtgtatgtcggtagcataataaagccacttaaattaaatttcactcttaaattttcaatacaaaatctttaagttggaaagtggtgtatgactgtcatctgaaggtggtttgcgctgatccactaacccatacctgcattgccttccctagtccgtctggccaatcagcccctggaatatgccagaccatttcctctgcctggattgacctctctgtcacccaggctggagtgcagtggcacgatctttgctcactgcaacccgctcccctcccggattcaagcgattctcctgcctcagcctcctgaatagctgagaatacaggcgggtgccgccacgcccggctaatttttgtatttttagtagagacggggtttcaccgtgttggtcaggctgttcttgaactcctgacctcaggtgatccgcccgcctcagcctcccaaagtgttgggattacaggcgtgagccaccgcgcccggccctcacactcttaaatcttacccactgtgctagacctgtgcagtcggcatctgggtcccttcccagggtgatccctctctcccctggatgcctgccagccaatttggtctagtagaaagagcaaaggtctggttgcattcaaagtttgaagttcaagtgctaagtctgtcacttagcagttgtggaaatttaggccattccttaatctttctcagactttgtttcctctttgatgaaatggaccctgtagtactgatctcatggggtttcttttataaatgagatatcttacataagttcagtaagtaagaaactctccttcccagttctccagttttttaaagttggcattacaaaacttaattatttgttagttcattgctgttgaatgaagtgtagccttggctttggaatcgtttaaaaaaaaaatccccaggtgatcttttggaaactactgggctaggggctaaaataacacaagaaatggaatattctactcccatcagtgagaatttccctatttctcctcttttgaaaagataatttaaaaaaaattttgagataattgtagatttacatacacttgtgagaagtaacagagagaacccgaatagccgttaagcagttcccccaccccaaggtgacatcttgtagaagtatagtgcaatatcacagccggaatcttgacatccatacagtcaagatacacagtatttccatcagcacaagaattcctcctattggctgggcacggtggctcatgcctgtaatcccaacacttcgggaggccgaggcgggcggatcacgaggtcaggaaatcagaccatcctggctaacacgatgaaaccccgtctctactaaaaatacaaaaaagtagccaggtgtggtggcgggtgcctgtagtctacttgggaggctgacgcaggagaatggcgtgaacccgggaggtggagcttgcagtgagccgagatggcgccactgcactccagcctgggcgacagagcaagactccgttccgtctcaaaaaaaaaaaaaaaaaaaaaaaaaagaattcctcctattgctctattgctcgttaataaccactagtatgttctccatttctatgggtttttttaaacttcaagaatgttatgtaaatgaaattatatagtatgtactctttgtggttgagtttttttcactctgtgtaatcctctctagattcatttgcataattgtgtatatcagtaatttgttccttttcattgctgattagcaatcggtggcatggatatgccagagtttattcactcattgaagggcatctgggttgtttgtttacagtttggggcaattatgaataaagcttttatgaacattgtgtacaggttttgtgtgaacattagttttcatttctctggaattaatgccccaaagggcaataggtgggtcatatatggtaattgcatacttagttttataaaaagctgccaaattgttttctagaatggttgtaccattcccaccaacagtgtatgatttcatttcctccacatgctcatccgcatttggtgttgtgactattttttattttagctattctgataactgtgtagtaatatctttattgtggttttaatttgtgtctccctgatgtctaataatattgagcatgttttatatgcttatttgccatctgtatatcgttttcagtgagatagatgtctgtgaatgtttttgttgttgttcattttctaattggattgtttggatttgttttgttactgttgaattttcagttctttatatattctagatactagccttttgttggatatgtgatttgcgaatattttttcccactctgttgcttgcctattcatcgactcttaactggaattttttagagcaaaagttttaattttgatgagattcagtttatcatattttccttttatgggttgtacacatcgtgtcaattctaaaaattctttacctaaccctaaattccaattccaaagatttttgaatttttttcctaaaagttttatagttttaccttttacttttaattccatgccctattttgggacacattttatataagatgtgagagttgattctctctcactctctctgactatgaatgttcagttgctccagaaccatttgttgaaaaggctatccttcctgcattgaattgcattttaaatagtgttaaaaattggttgaacttacttgtgtggtgggtctgtttctgcattctttatctgtttcattaatttatatgcctccaccaatatcacactgtcttgaacgtggtagctgtgtagcagggttgagttattcctcctgctttattcttctttttcaagattgtttaagtctgtagcttgcctcattctgtataaattttgtaataaatttgtttatgtctacaaacatcttgctagaatttttatgggaatgacattaaacataatagctcaatgaagggaaaattggtgttttactgttttgagtcttccaatccatgaacatgagatatctttccatttatttggatctttgatttcttgcctcagcattttgtaattcttagcatccagagattatatgttttataagtatgcttaggcatttagttagtttcttgattgattgtaagtgctgttgtgctttaaatttttgtttacatatgtttcttgttagaatatgaaatatgattgtttcatactaatcttataagctcttttttgaacttaatatttttttagattccttgggattttctatatggaaaatcatgtcatctgcaagtagagtcagctttatttcttcctcgtcaatctgtagggagttaatttatttttcttgctttattgcagtagctagactttcaatactaggttgagctagagtggtgagggcagacatccttgccttgtttcctgtcttaggggaaaagcattcattcttgtttcctatgttatgtggaggtagttcccttttattcctggttggctgacagtttttattttgaaaggacattggatttttgtcaaatgtcttttctgtgtcaattggtattaaaatattatatttcttcttttgtctgttgatatgttgaatcagctttgcataactagagcaactcccattttgccataatgtataatttaaaaaatacatttctaatgtgtttgatttattaatattttattgaatatttttgcattcaaattcataagagatattgatatgtagttttcttttttcatattgtctttatctggtttcagtatcaggacaatactgcctacataaaatgaatttggtagcattctctagtctcctgttttctggaagagattatgtaaaattgactttaatttttatttaaacatttggtagaattctccagtaaggcccggcagggtggctctgtgatcccagcactttgggaggctgaggcagatggatcacttgaggtcaggagttcgagacctgcctggccaacatggtgaaaccccgtctccactaaaaatacaaaaattagttgggtgtggtggcacacacctataatcccagctactcaggaggctgaggcaggagaatcgcttgaacttgggaggcagaggttgcagtgagccaagatcacaccactgcactccagcctggacaacagaacgagatttcatctcaaaaataaaaaccaaaaccaaaacaaaacaaaaagaattctccaataaaaccatctgggccaagagattttttttcagtaattttaaattatgaattcaattttcttaataattacaattacttaaattacctatttcatgttaggtgaattgtggtagtttgtactttttgagaaatttgtccattaatctgaattgtcaagttgatttgtgtagaattatttgtagtattttcttattattcgtttgatgtctccagcatctgtagtgatatccacttaaatttctcatattcatagtttgtctcatctttttttgtctgtcagtctttatagaagtttttcaatcttactgttttttagaactagattttcgtttcttgattttctctattatttttgtttcaaattctattgaaatctgctcttctctttgttatctccttccttcagcttgtatgagttaattttgttttctagtttctagaggtaagaacttacattattggctttagggctttcttctttcctaatgtaggcatttagtgctacgttttccctatcaacacagttttacctacatttcacatattttgatatgttgtattctcattttcatttagtttttcatgtagtttcattttcatttaagtattttaataaatttctttgaagcatattctttgacctgtagcttatttagaagtgtattttaaaaaatttctaagtgtttagagattttctttttctctttctggtattgatttccagtttgattccattatgcttagagaatatactttgtgtgattttagttcttttaaatatgttgaggtttgtttggctcccagggatatggtctgtcttgtaaatttttcatgggcatttgaaaaaaaaatgtatattctgctattcttaagtggagtattctgtatgtatttcaatgagatcctgttggttgattatgttgttcagatcttgtatatccttgctgacttcttgtccagtagttctgtcagttgctaagagagacattttgaaatctgtactataattgtggatctgtttatttttccattctgctccatcagttttcttatattaataggctttatattttttagcaattttaagtttacatagaaattgagcagaaagtactggaagcatatgatttttattctttagtttgttgatctgatggactatattaattaattttcaaatgttaaaggcatatctagagtaaatcccacttggttgtggtgtttatttttaaaaattgtttggttcaatttgctaatattttttaaggattgcttcatccatgttcaagggagatatttgtttgcagtttacttttttgtaaggttttgctggtttgggtattagggtaatgctggcccatggaatgagttaagaaatagtcactctgcttctattttctgcaacagattgtggaaaattggtatcatttatttctccaatgttgatagaactcaccagtgaatcatctgggcttggtactttctgtttgggaaggttattaattactggcttagttaaaaaattttgtttctcttgagactttctctttcaccatgttttattatttagaaatgtgtttttaaattttttggtatttgaggatatttcagctctctttctgctattattagtttaattccattctgattcaagaacatgccttttgtgatttctattcttttaaatttggtaaagtgttctgtggcctagaatgtggtttaacttaatgaattgtgcatttgtatttgagaagaatgtgtattctgcagtgtctagataaaatattctataacgctaattgaattctaaagtattcagttagatccagttgattgatggtgctgttcagttcaaatctatccttaatgattttcttcctgctgagtctgtaacttactcatagaggggtgttgaagtctccagtggtaataatggatgtgtctctctgtccttgcagttctatcagtttccccctaatatattttgactcttctgttgctaggtatatacatattaagcattattatatcttcttgttatattgacccctttattattgtgtaatgccctttttcatctctgataattttccttgctctgcagttggctttgtctaaaattaatttagatactctgtctttctttttggttagtgttaccatggtatatctttctctagctcttcaaatctacccgctattttatatttaaagaggatttcagtagacaacatgtaggtggatcatgggttttgttgttgttgttcactctgacagtctcagtcttttattttattattatcataccttaatttctagggtacatgtgcacaacatgcaggtttgttacatatgtatccatatgttaatggtgtgctgcacccattaactcatcatttacattagctatatctcctaatgctattcctcccctctccccacaccccatgacaggccccggtgtgtgatgttccccttcctgtgtccaagtgttctcattgttcaattcccacctatgagtgagaacatgcagtgtttggttttttgtccttgcgatagtttgctgagaatgatggtttccagcttcatccatggccctacaaaggacatgaactcatcctttttcatggctgcatagtattccatggtatatatgtgccacattttcttaatccagtctgtcattgatggacatttgggttggttccaagtctttgctattgtgaatactgcctcagtaaacatatgtgtgcatgtgtctttatagcagcatgatttataatcctttgggtatatacccagtaatgggatggctgggtcaaatggtatttctagttctagatccatgaggaatcgcaacactgtcttccacaatggttgaactagtttacagtcccaccaacagtgtaaaagtgttcctatttctccacatcctctcctgcacctgttgtttcctgactttttaatgatcgtcattctaactggtgtgagatggtatctcattgtggttttgatttgcatttctctgatggccagtgatgatgagcattttttcatgtgtctgttggctgcataaatgtcttcttttgagaagtgtctgttcatatacttcgcccactttttgatgaggttgattttttcttgtaaatttgtttaagttctgtgtagattctggatattagccctttgtcagatgggtagattgcaaaaattttctcccattctataggttgcctgttcactctgatggtagtttcttttgctgtgcagaagctctttagtttaattagatcccatttgtcaattttggcttttgttgccattgctttcttaattggtatatttagactgtttacatttaaagtgattattgatacttggattaatatttgccatattgtaactcttttttatttgttgcccttgtttcttctttttttcctgaattcccctctcacattttttgttttaattgagcattttatatgattccatatcctcacttctcctagaatattaattacatttcttggtaattgttttagtggtagcctttgagtataaaatatacactataacaatctactttcaaataacactattccacttcattaatggtgctggtactttataacacagcatttccaatccttctgtcttattttgtattacattattatcattcattttacttattcataagccataatcacccaatacattgttagtattatttagagctgttacctattacatcaattaagaagaagacactagattttattttaatttttttcttctctaatgctcctacctttctttatgtatttctgtgtttttgacctatattgtttttcttttctctgaggaacttctattaacatggcttgcaaggtaggtctactggagaaagatttcctcaattctgtttatctaagtctttatttctactttactatttaggataattttactggatatagaattttatattagtgtgtgttttctctcaacagtttaaatatttcacttcactttcttcttgcttgcatggtttcttaagggaaatctggcataattctcattcttgctcctatgtaggtaaggtgttttattttactctggtttatttcgagattttatttttaaaagattttattttaattttaagaaagtcttcaattttttgcaatttgaatatgagatgcctaggtgtggttttttttgtatttaacctgcttggtgattgctgagattcctgaacctatggtttcatgtctgtcattaattttgaaacattctcaactgtcattattttaaatatttcttctggttctcactctcttccttctacttctggtattccgattatgggttacataggttacaccgtttgaatttatccaacagggctgggcgcggtgactcacttgcctgtaatcccagcactttgggaggccgaggcgggcggatcacaagttcaggagatccagaccatcctggctaccacggggaaaccacgtctctactaaaaatacaaaaaattagctgggcgtggtggcaggcgcctgtagtcccagctactcgggaggctgaggcaggagaatggcgtgaacccaggaggcggagcttgcagtgagccgagattgcaccactgcactccagcctgagcgacagagagagactccatctcaaaaaaaaaaaaaaaaaaaaaaaaattattgtccaacagtttggatattatgtttcatttttcattctttttctctttgtgtttaatggaaaattttcattgacgtatcttcaaactcactgattctttcctcagcacttcccagtcttcccagactttgatgaggccatcaaagacactctacaatgtttacttttaatctctgtatttccttctgattttgagatttcatatctttgtttatagtacctatctcttcttgcatgttgcccactttttcaacatagagcccttagcatattgattattatttcaaattccttatctgatatttccaaatctgtcataactgcatgtttgcttgattcgtctcataagactgtattgtttggctttagcataccttgcaattttctgttgaaagccagacatgttgtattggcaaaggaactgaggtaaggaagcctttaatgtaaggttttatgtttatctggttagtagttaggctgaatttgctctttgcataactgttgtgtcagaggccaaaatttcctctaaggttattttatttttctttcttccgttttgagttttcccagagactctgtcttaaatagggtctaaaattgacagctctttcatttttaatctcctgttactatacaggtaatgtactgatctgattgatgataaggtgcggggagaggagaagcatcctatactcttttttttttaatgtttttattttattttaatttttttgagagagtctcgctctgtagcccaggctggagtgcagtggcgccatctcagctgactgcaagctccgtctcccgggttcacgccattctcccgcctcagcctccccagtagctgggactacaggcgcccgccaccacgcccggctaatttttttctatttttagtagatacggggtttcaccatgttagccaggatggtctggatctcctgacctcgtgatccgcccgcctcagcctcccaaaatgctgggattacaggcttgagccacctcacccgacccaattttttgtatttttagtagagatggggtttcaccatgttagccaggatggtctcgatctcctgacctcatgatctgcccgcctcggcctcccaaagtgctgggattacaggcgtgagccaccgcgcccggccagaagcatcctgtactcttaggattaggtcagtcttttagagaacctgtcttcctggactgtgaccttcagagtgcttctcagcttccttccccttcccttgggtaagaaaagaagggtagagggggctggttctgggtatttccattcccctaggtggtttaggctctagtaaactagctttttgggggattagaatgttgttaaggagaacataatgttcagcgcttatttcaaaaatgttttctccttccctccccctgctggagacataagagcgtttttttcctatctttattctgagaacttgatggggctcttcctggagataaaactcttgaaggtgtgttgaccctctaaggcgtatcccccactctaggagttttcaatctctgtagcttgtccttgctcagtatccatcaattagtcagttacattttaagtgcttttaccagactccaccatctgctttggcaccattagccgtgatgctgttttcagttgtctctgcagctttaggagtaatgtttgccctatgactttaactgtgtaagaagaactgtttatttttagttagtgcagcttttttcttgttgtgagaatgggagcgatgacttccagactcttaatgtcatatcagattggaaaccagaagtctcaatttttgcctcatttttttaagggtgtattgtttcttgcatatgcatttatgtcttcctggtgatttttttttaaatcattatgtaatgtccctgttctagtatttttgttctgaagtctattttatgagatagccattctgctttctttcaaatttaagttttgcagagtgtattttttccatccttttacttttaacctgcctatgtttattttgaagtgagtttcttataaatttctcgttgtgttatttttttttcagttgattctgccagcatctaacttttgttatattttaaccatttacatttaaggtaatttttataattttcttactcgttgcttggtattatagtgtacatatgtgacttaccacagtcaacttaaatatcttcactctcataatgaaatatggaatccttatgtctatttgggtcctttatcttccccacttctaaatatcattgtcttgagtatcatatggtattacagtttttgtgtcaattatcatatatcatttcaaaaattgataaggatagtctattatatttatccatatttcttctcttttcatttttttcctgatgttccaagaatccttcgttataatttctttttgaaaaacctcctttagccattctttagggaatgtctgctagcgacaaattattttagttttcttttgtgttaaaaaggttttttgttgttgttattgttttggagatggagtctcactctgtcgccctggctggagtgcagtggcacaatctcggctcactgcaggctccgcctcccgggttcacgccattctcctgcctcagcctcctgagtagctgggactacaggctcccgccgctacgctcgtctattttttgtatttttagtagagacggggtttcaccgtgttagccaggatggtctcgatctgacctcgtgatccgcccacctcggcctccgaaagtgctgggattacaggcgtgagccaccgcacccggcctaaaaagattttatttccatttttattcttgaaggatagtttctctggatatataatttatagttgacaattcttttctatcagccctgaaaaaaaatatgccattccttctggttctgtaatttcagatgagtaatctactatcattcaaattagggttcttttacaggcaggtaatgtgttattctctcaggctgctttcaagatttgttttgttttgtttccaaaaagttcaattatgatggatcttggtgtcgatatttttgggtttatccttttttggacttaacttcctaaatctgtgggtttgtatctttcaccacatgtgggaagtttacagccagtattttttcagtactctttcagcacactttgttctctctttttgagattcggatgatattgtctgataggaccctatggctcagttctttttatattccgtctgttttctcttttttggtcaggttagataaagcctattggtgggtcctcaagttcagtgattctgtcctgtgtcttttcactctattcttgagcccattcagagtttttttaaaacgttatgttattgtatgttccagtcctggggtcctaagcttcctctttctacttttcagaattctcttcggttgtcttctgtattatttccagaatctatcattatacttggtggaaatagcagggatagacaagtctacaagatcttttatcagtctagaagttcacccacttacatctttttgttactgtttctaaaaaaatacatttttactactttatggggaatatgggagatttagatgtaaatttacacttgtacattaggatataatgagtgttttgctctttaatctgcgacagtttaatggtgaagtcggtaacttttaaagtggcattccgagaagagtgtattaatttttaaaaatatcttttacgttgtagtgacaagcttttagcacatttttaaaagattcctggtactaatccctctttaaattttcccagattgcctttttttcgttgttttttttgttttttggcagaggggcaggtgatagatagtggtggtggtaatgaatgcagagatcttatctatgaatgagttataattgagttgtaataagcagtaaggtagaagctaagttccagatctcgattcatattccaatggtaacaacctattgaaatttgaaaaacagcaccacatgatcaagcatgtttaaaaaactggttgagttaatccaatttcattttcctcatggcctaatctgtgatgactgcaacttgtggcctctgacccctttccttttttaagataggtggcctgacacctgctttttaaattatcctaactttactgtgatgtgctgtcagtccatcaccccaatcttcactcccaacccctggcagcatcccttgtcctaatatgcagttctatagatctgagttagtgtctgactctatcatttaatcattgtcagtgctgagaaggaggcgcactcgtcagagctgtagttgacccagggcactttgtttcttcgcatgagaaatttctaacctcagagatgagaaaagcctatcaatgtcattccttaacctccaaataaagagtcaggacatccaatgcaataaaaacaaatacctccaaaaattagtaagtactgacagagaataccatatctttccaaatgtgtaatatacaggtagttagcaaaaagatgggatgagataaatcaatgtctttgtataatattaaactttctcaatgaacatttcataatttcaaatagattttatctttagtgtgcaaattaccctggtattaattttaatggtgaatttttttgaatgttatttctatagaaagtatgtatcacgtgcaactgactgatttctaatagaagaaaaatagatggaatcatttaagcctagatattgaaatattgggggaaaaacattggttaggcttaaagaaacgtttcagaggtaaaatacaagtgtttaagtatagtttcattttctctctctctgcctctcacacatacactttacacctgggagtaaagggagatatatggggagggtgatagtgagggacaaagtagatgtcatctttcttatacttgtctttcagatggaaccccactgagctggtgggttggaagaaccaatgaaacacacacttcctggggaggttctctgcctgatgctcaaaagtgtacttgtggattagaggggaactgcattgattctcagtattactgcaactgtgatgctggccagaatgaatggtgatttccacatgatttccctgcacaaaaatgtggtttttattctttaattatgcatagttaattaaatgtcagacaagctggtacaataaggtaactagattaaagtatgttcaagcaagctgaaatacaagttttgatgaaatatgatcagttaatctaaggattaaattttatgaccaaagatttactaattcattgtgaatactatataatgtgttttttatttttcgtaaaagagaagcagctgttaagttttccactcactggaaatcaaatatcattctctgcgaagtttagttaattaattaacgtagtattcatgtggcaattcaaaaagcaaattcctccaaatctttgtcttaaattgatttgggatataatgctgcatattctgtctttcttttagaaattaacattaacacaagaaactctgagaggtcctgcataaaaggactgtgtttattttttagaagcaacaatttcccacactcattgaaatctgcagtgcaatagcaaagcttcaagcaccaactgttctgtagaccatactttgaaacaactaacatagaatttccggaatttgaaaattattttgtaagctttcttttgagcagaaacaattttctcatgtagattgcaatgcctctttttcagaagttctttttgaggttattcttgaaatgcatattggttttctttttttttatttgtaatatgtaaatgttttcaacctttgggttcatgtcagcaacttaaaaagcattgtcataaaacaactagatcgtgtagagtacgtgctttaaaaaaaaacttaggccaggcactgtggctcatgcctgtaatcacagcactttgggaggccaaggcaggtggatcacctgaggtcagaaggttgagaccagcctggccaatgtggcgaaaccccgtctccactgaaaatacaaaaattagccaggtgtggctgtgtgtgcctgtagtcccagctgctcaggagggtgagacagtagaattgcttaacccaggaggtagaggttgcagtgagctgagatcgcgccactgcactccagcctgggcgacagagcaagactccacctcaaaataataataataataataataataataaattaataaataaaaaatgtaatggtcattccaggtgtcagtataattgatttggacataaaatagctaatctaagcagtaatttgattcctaaaaattgagttgtttggcctgcatggtagtccacttatttatttggcataaaaagtctactttgcatcactttaaaaaatattgtgaagttgggaaaactcacttgaatctactggagctttctatagaatacatactatacatttacatggatattatttttaatcttcctcaagttcaaaattacaaaatgatcatacagatttatgagacactctttttgaatattttgatatgcaatcttaatacaactttctcttacttaaaaatgaatgcagttttagtgcagtgagtaacaggaacagatctgatccatagtttcaaatctggccaccagtaagtttcaggtctgaagtaatttgccgtcagttaaaatggttttgtaccatattttgtatgatgtacattttaaagtgtctggtatgataatgtgatgatgtgtgttagctttgggctctaatgagacaaacagcgaccttcaaatcttttgacggacatctttaacaatcctagaggttttcatttcctccattccacaaggggctcctgcctgtgagggctccagccctccagctcctggctgttcagaagacctccagctcattggtctgtccccacccccattctctacaggtcagaaaggagagcattggcaggttattacaagaaagccagaatggcatatatgctagtggctttataacttagttcgaagaatgttaaccgttttgttttgtttttgttttgagacagagtctctctctgtcgcccaggctggaatgcagtggtgcgatctcagctcactgcaacctgcgcctcccggattcaagcgattctcctgcctcagcctcccgagtaactgggattacagccgagtgccacacctggctaatttttgtatttttagtagagactgggtttcactattggccaggctggtcaactgtttttttgttacagaaccttctgttagtattaagtgcatactttattgtagacttcacgtatgcttagggcagtaaccagaggaacgtatcacttggagccacctgtattgagtgaccctcccatgaactgagtttgaggaggggatgggaggaactgaggtgggtgcaggtcctctgatacccttagccatgtcacttcagcaccgtcaaggactgcactggtgtgacagaagccctgggctttcatttggaaaaaaattcaggagagaagcaggttttaaaaattaactcccctcctacattcagaagggagcattgtggagtcatttgctttttaaccttattttatttactttgcagcttccagtagacaggtctatccaacagtaagaccacaagcattctgaaatcctaacccaactcttgtagattgttttgtaaatgtgggggtgtgtatgggggtgggaaattacaatttctattttaatttttcaaataaaattgatttttcagtttataaaaatggaatttaccagtctcatgaaatgaaaagatttataattgtaataatttagattaaggtgtagacataagaacataaatcttagtctttattacttattttctattactgaggtgtgcttagtaaagttttcctggtggaaagtttataataaaaatagtatttgggaatgaaagtaaagtgaaagctattttaagtctcttcaggcatatgtccgttaatggggcaggcagtattgttaatataaaccatcgccatttttccataagttgtccctgtaatcagcaactcgtctaagcatattacttaaaaaaaagtttatgatcagacagttcctcaggcacagtaagaatattctatcaaataactataacatgccaaagatttattataaaaacatatatttaaaaggcactataatgatttaaaatattgaactatgctgcaagtcaatatatgtgtataaatgtatagtggactatgttcaaatagaccaatatattctctaaaatatacatataacatataattcagctgtctgcaaaaatccacaagttgttttgctaatataatgatgacacatgtaactgtaatattattttacttaagaatttaaataggacttttgtgtgattatcttagagtctttaaaagtaaccacaaataaaaagcataaaataagatggtttaaatgcatactagtgtacaaataatcataataaatacgagtaaactctgttcatttaaaaaccagatattagattttatcatattggatttttaaagaagctatagcttgtttacaaaagataaaatataagcactcggtgaagttgaaactaaaagaatagaaaatatttaccaagtaaatacaaatcaaaagaaagcagatatagctgtattatgtcagacaaagatgaaaagcattgttagggataaacttgaactctatctaatgctgagataaactcactagaaagatctcactacacttgtgtgtatcatcagattgtttaaaatatataaagaagtggcagggcgccgtggctcacgcctgtaatcccagcactttgggaggccgaggcgggcagatcacaaggtcagaagatcgagaccatcctggctaacacaggtgaaaccccgtctctactaaaaatacaaaaaatattagccaggcatggtggtgggcgcctgtagtcccagctactcgggaggctgaggcaggagaatggcatgaacctggaaggcggagcttacagtgagtcaagatcacaccactgcactccagcctgggcgacagaccaagactctgtctcaaaaaaaaaaaaaaaaaagtatgtgtgtgtgtgtatgtatatatatatgtgtgtgtgtgtatatatatgtgtgtgtgtgtatatatatgtgtgtgtatatatatatgtgtgtgtatatatatatatatatatatatgtaacaaatatgcaaaggcaaattgacacccaaaacagtggaataattaacataacatttttgggaatgagtaagtgaagcaggtaagaatattttaatattataattaacaaacttgatatagcagccatatatcgtttagcaaggaaaaattatttctttatagaatgtattatacattattgttgaataagtataaaaaattttgtaaatggatggaatcttaacaaattttacggaattgtcatgatggaaactatattcttaactgtaatcaataatgaatatataacttttaaaagctcatgcatgtgtcagttaaagacacaagaggaaataaaatagatgtaagtgatgaaaagtttggaaaagaaacaaacctggcagatattgtagataatatgattgcctacatagaaaatccaaaataatataaagaaatatcaggaaaaatgagagttcagtaagtttgctgaatttatggtcagtcagtattgaggaattacttgaatttctataaaatcgtaaaataattaccattacacacctagaaaaattttatttgcaatattaacaaaaatgtaaagttctgtggaataactgcagtacttttatggaaaaaattacaaaacttattcaagagaattaaggacagccaaataaatggattgactcactactgtcgtggatagtatgactcagtatcttaaagcagtagttctcaatcgggggtgatttcgactcttgggacatttggcattgtctgaagacatttttgtcatcacacagagaggaaggttgtttatattagtgtctattaattagaaatcagggtgctgctgagcatcctacagtgcacaggacagccccccccatgacaaaaaaaaattagcccaaaatatcagtaacgctgctgttgagataccctcttttaaagttgacattctcctcaaattagtctgtaattttaacaaaattccaaaaaatgccaagtgtttttacttgtgtggattgcagcaacctggttttaaaattcatatggaaattaaggatgaaaggataagcaagataatttttaagatgaaaaataaagtgaagaaactagttctgttagctgtcaagacatactgtattgctgtagtaattaatgcaggttgaactggccagaagataggcaattaaacagaaactgagaatctagaaattttttaagtgggttagatgtggatcataatgattttattattgctgacctactcccccaaaataatcattaacagttgggctgggcgcggtggctcacacctgttatcccagcactttgcgaggccaaggcgggcagatcatgaagtcagaagttcgagaccagcctgaccaacatggtgaaaccccgtctatactaaaaatacaaaaattagctgagcgtagtggcgcacgcatgtaatcccagctactctggaggctgaggcaggagaatcgcttgaatcctgggggtggaggttgcagtgagcagagatcacaccattgcactccagcctgggcgacaagagtgagactctgtctcgaaaaaaaaaaaaaaagaagaaaaaaaagttaaaaagttgactcaacatttctcccttttagctttctttgcaacctcccaaacttatggctctactttgccttaaataaagttccctggcaaataataagtagtagcttttagaagttttcacacttcctaggaaagtacaatttccagaaccgtaggaatttctaataaataaaaattttaataaaatataaaataaaagcaaaaagtctttgaaagttctcttactgaatttttaatactgctccaagagattatggtacctatgaaagcactatttccaagtgtagactatagtataagctttagaaaataatagggagaaaagaaaaatgagatgtccctattaattaggaagttttgaggaagtctgataactattacaaatcctgagtattctattttgatttccaaaggttgggaatctgcctgtaacaataagaaactggtgaaaaacactggctatctttatgctcagaatgaaaacaccagactttccaaaacaatgaaaaaacaagactttattatagtatctgccctaattaaactgaaatgtggatttcatttacacattctcaatattttgcacagtcagtattgaaaatggaatgaaacttggagctcccgtgaaatagatcttttaaaatacaagcatcctccataaataattaaattgcattttctctactagactatcttgctaaaatgatgatcacagaattggaaatggtaatttttaatggctaccacattaataaaaaatttcctagacctacctcattcagcaggagacatatttctagcttgtctaccatcagtccactctaaagctgaatggtgatgcctttagataatcaatattctgttctttgcattaaaatgaataacagaatcttaactaggtaaagcaacagggttttagtctgaattttagaaataagctttctttaccattaagtgtattttttcagggaataatcttaaataatatagccattttattttagttttatattttccaatttgaaagtttgatacctagtcttttataaaagaagttgattaatgggtacaaaagtcgagttaagtaaaagaaattctagtatttgatagaactagagaaattatagttaacagtaatttattggatatttcaaaatagccagaagagaattgtaatgttcccaccacagaggataactgctcaaagtgatggatatcccaattaccctgatttgatcattatgcattgtattctagtatcaaaatagcacatgtgcccccagtatatgtacaactctgacatgccaatttaattttttttaattcagaaagccttattctgaaaatacaaaagtgttgcaatgatgaaatatcaattattgtgatcttttgccacaaatgcatacaaaagaaggtttgagaactgggcaatttaaaaaatacagtatttactagatactgtggagtttctaaccgtaactggactaagagtgttttgtctgtaaatcagaatatacatgcagttgagacatatatgtaataaaatataaccaaaagtatataaatataagcattttattatatatgcatatatgcaatattattggccaaatatttattacatatacagttacatacacatatataataaaatacttttgcagcagagtagacaaatgcctttattttggccagagacaaaattagtggcatagctaagaccaggaccccaggttcccctaggggatcctccaggtctctttgtattggacacagacgtgtgcatttattttcccagtcacataattaatactcatggtattcaataggctgtgtgctttcagaaggcagagactaaaatatattttttactctgtgtcctcaattcccaggacaatgtctgttcgacaaaaggtgagcgctgagtgtttggggttttttgtttgttttttgtattttttgagacagggtctcactttgccacccaggctggagtgcagtgttgcacacatggctcactacagcctctacctcccaggctcaagggatcctcccacctcagcctcccatgtagctgggactacaggtgtgcaccatcacacccagctaatttttgtattttttgtagagacggggcctcactatgttgcccaggctggtttcgaactccagagctcaagcaatctgcccaccccagtcttctaaagtgttgggattacaggcatgagccactgtgcccggcctgtgtttgttgcctgaactactgggagcagtgtttcacagaccactttcacactcattagtctatgtattacttataagggtgtagtatgtatttggttttgaatctgtgggactcattttgcatttacaaagttaacaaggaaagaaatacccagtaatcataaaaggactttaaaaaataatgataaattaatattctgcaaaatgaatatctaaatccagtgttactatttttatttgtaaagaataatcacttagatattattctaagacaattttagaagggaagttaccttcttgatttttccccttctctgtaatcatttagatcaggaattggcaaacgggtcaggaattaataacctcttgctttgggtgaaatccagaccactagtctatttttgcatggcagtgagctaagaatgttttctttacatttttaaaaggttgaaaaataaaaagaatatttcatgtcatataaaacttgtatgaaattcagatttcatatccaaaaatttttattgcaacccagccatgcctgtgtctgtggctgctttcacacttggtggcagagttaagtagttgctgtgagaagctgcatggcctgcacagcttactgtatggtcctttacacaaaatgtttgcccatccctgatttagattcatggtagtctctgtgctctcaaaatattgaaaatgttaagtattctgttaagctctatgatgttagtttcaaattgagataagagatcagagttaattttgcccgtatgttaatcagaataattttaatggtttcggttgttgttctttaggactagtgacacaatagtcctttcccaaaaggagcacctcccagtcactcagattgtgatgacagacacaggccaaccacattccgaagcagattatacactggggccactgctctgccgcggagatagtaagtagtgtcaagaaaaagctttattttcataataactttttttggttataaaggggtagacaaatgcccttgttcttgccagaaagagaatagtggcagtactaggactggggcgaatatcaggaaaacacacataccataaaggcacagtcagtactgaagatctgtgtttccttactgaagcattagtttatagaaaatgaatcatctttgttttaacttattacttgcttggctggatttattatcaattgattgtattttttccagaacaatcatgagatgaactattttctgaatgctaagggatatttattcattgcccttatactcttcagacaactatagtggtaggaaattattggacactctctattttctgacctctgtacatactgttttacattacatggcaccgaatgtgtattaatctctttcctgcagcattttcgttcatgggtggctttcatggtcaagtcctcactcccccacctcagtggcactataagcccagggttcttagaggatctacctactgggtagcacgggaaccacaactaagctagtaaaaatcttctttccctgagaaaaattgtaatagtgtttcttacccactagcatcatacattgccgtggagaagtctgagactaaatgtatttttatttcctgttctacctcaatgtgtgggggctacttctgagaggggtggttcaacaaggagcctgagcctctctgtacattcttgccgagtgtgccagatggtgtggtgtctccatcccctaataccaagcagtttctgtagccaatcgtgtaggcagctaagtagttcaaagagaacacaacatcactatcgatgtgtactcactccccagagagggcggggaccggcttgtctcctgcttgatgaaggagtcccggacccttgtctgggggctcctcatctgagatgcaaacctacccactgtgtgtgtagcatccacctgggccaatggattgtgttgccctgtgaaatttggagataaggggaaccaatgcaaatattctgacactcatgctgcatgctgtgctgtgagcaataaagttctttaactctgacccagaaattttgtgttttctatcagcatccattaatctgtggcaagctaaattgttagcttgcaagtagggtgaaatctcagattcttcacagctcttgacagatatgttatccttcaatttcaaaaacttatccagaatatgccttagcgttaattattctgttatttttttctaaaatgaaatatgcttattttgaccgaaatattctgttctcttttaagaaaaaatggtttttattatgctttgaatactttgtttcatttggtggattctcttcatctaggactgttgacttgtttcctttgccccccatacattttttctgtttcttccaatggctttaatctctttgtccttctcctatgcattcaatatgattattctaagcttttcccaatgtcagtaatttgttatcagctgtgttctccatttccagatatttccgatttctctgttacctctgtgattttgtttgggtctttgattttttttccttaaaaatcatcttttctgtttatctcatattttagctcttattttactgaattggtttttatattattcccatagtgtgaaactcttatgaaatttttctttccttgtgttctctcttaatttccttcctccatcccattcagatggctccttccttccttcctccctccctccctccctctttctctccttcccttcctccctcccattcagtctggcttttatactccttccttccttccttccccactccctccctccctctcttctttctttctctctctttcttttctttctttttctttctttctttcctgtcttctttttttctttctcagtatgtttgcactgtttctgtgctttttgaaacattgtttatacttgtagtgtaagtctacactacaggtctgtctggcaggtctgtccagacatttaattcatttatatggaatggagttgaattcttctcgacattcatctcttcacaatcagacacatacttcttgtcccttctgaactgcaatagcaggactagagttggtcatcctatcaatattttttcccataatctaagagctcaagggagggatctgttgaattgtatctgatttactggccattctctgtgctgttttatcttcaagaattattaaatgtcctgtgccaggcatcacactgaagcatggagggtatatctgcaggcttcagatgcctcccacagttcagtaataacccctggaaatttgtagctttttcccctgcctattgatactctgacatcaaacactggtttctaggtactctgtacttctcaaaaacattttctagattattttctctctggaaatttacctcagcccttcatttctctccaaatgtggctgtatttgtgagactcttcaggatatgtcattcaccttcagtttatatcctactttcagcaagacttctgaaagtatggagaagagaaagtgtgatatttgaaatattcccttctctttttgggagactgagatgggaggatggcttgagccaaggagttcaacacaagcccggacaagatggtaagaccttgtctcttacaaaaaaactaaaaattagctgggcatggtggcctgtagtcccagcaactaggaaggcttaggtgagatgatctcttgagcccaggaatgtgaggtggcagtgaactatgatcatgccactgcactccagcctgggtgacaaagtgagacctcatctctaaaataaataaataaattgattaatgaagaaagaaagaaaaataaaatattctcttctgtaaaacttgtagcttcctcttcgtttctcttttcctttccttatcttcatctctgttttctttaacataacacttattgattcttttcccttcttttggggcagctgggactaggggatctgcagggatagggtcaaggaatgaccactgggttagaagctaggttccacactggggaatgagcaaatatgtaaaaaaagtgaggagcataggagtgacctcactgaggaaagagttatacatgtgggaaggaggaagactgtaatgaaccctgtggtgctgggttaaaaacggaggtatccacatgaactcatggattttaatatacataatagataactgtagaatacacatagaagagagagactgcgtgtgtgtatgtgtgtgtgagagagagagagagagatacaaatacacatatttcctagctgactactgagagggctagaagcaatgacaccctagtaaatagcctgcagatctgggcttctaaacaccattttctgtcattctctgctaaaaaagaaaccacgactccttgaagaaatggctgattccagaaatgtggcagagaaaatttaagatgagcctggatcattttgttatgacaaaggggaaaaaaaaagctgaaaaaggcatgggtgtcagcttaaaggagctgccacatttgagacaacttaagcatcaaaataagttatagagtataaaccattgaatagaatacaaattcaagagtgacgtgaataaacaaatggataaatacacaaataaattagtaaaagatcaagagaaaagctatttcttggtttgtttgtttgtttgtttttgagatggagtctcgctctgttgcgcaggctggagtgcagtggcaggatctcggctcactgcaagctccgcctcccgggttcacgtcattctcctgcctcagcctcccgactagctgggactacaggcacccaccaccatgcctggctaattttttgtatttttagtagagacggggtttcaccgtgttagccaggatggtctggatctcctgacctcatgatccgtccgccttggcctcccaaactgctgggattacaggcgtgagccactgcgcctagccgagaaaagctatttctaacgtaggcatgtcaaccaattaatgtggaaggaatgacagagcttagaaaatcactattggcagccatcagaataaaaattcaatcaggagccatcaatatattgtaaaaccattggatgaaaaaattttaaactgggtaaagttgtgtttctgtaaccttaaagtgtcaaaaatacatgaaaaaagagaaaaataataacttcatgttggagaaactggacaaatgccactttacaaggcagttgaaactaacaggaccagtgatgggcttatcagcattgctgcctgctgctgcgacacactgaggagaacacagcagcccttctgtggtatttttgacaaaaatgcacaacatgaatccaatcatgagtatgtcagacaaatccaagttgaggaacattctgaaagtcaactgaaaaataccaaaaagtcaaaagtacacaaaagataagaaaagactcacacactgtaccagaataaaggacactaaagaggcctgagtaatacatgtgatgtgcagtcctgtgatgggttttggacagaagggaacaaataagcttcttcttgttcttgattgttcttgccatgaaaggaattaagactgtgtgtgtgtgtgtgtgtgtgtgtgtgtgtgtgtgtgtgtgtgtgcaggaaggaaagcaagagtctgtgttctggcttctggagtcatttttccaactacctccttcaaatctccacttggatgcctaatagatatctcaaatgaaacatgtcccaaactgagctgctgctcgaacctgcttctttagaattatttcccttcccagttagaccaaaaaccccaaagtcacctcagactccacccttcttctcacatcttaccgagttcttcagtaagttctgttggtcgtacctttgaggtgattctgaacttgaccctgtccctactgtgttgctgcgcgatcccctgactggtctcattgcttttgcttcgcttttgtttggccttctctgaacacagaattccaatcctcagcgtaatcaccatttagctcttgatgtcatcagtatatgacatggatgctcagaacccccagtgaaagctcatatacattctattaatgtatttagcagtcataatcctgtaagtatcaaatgtagctgttatttttgtttcatgactttttttccttttgtcgttttctctattgtaaacagagtcattttggaattcagcttccttcaacactgagacttcataccttcatttccctgctttccacggagaactcactgctgacgtgtgcttcttttttaagaccacagtttcctctggggtgtttatggagaacctggggatcacagacttcatcaggattgagctgcggggtaggctggccactctggacaagtcacagggtacccattatttagcaataaaagctttaactcaacaaaatggtagtatttcattcttactttgtgattctatttcattataaaacactaaacttctatgattttaggtaattttttgtttttgagagagggagagaggattttgctgtgtcactcatgctggagtgcagtggcattatcttggctcactgcaacctcagcctcctgggttcaagcaattctcctgcctcagtctcctgagtagctgggactataggcacgcaccaccatgcccagctaatttttgtatttttggtagaggtggggttttgccatgttgaccaggctggtcttcaactcctggcctcaagtgatccgcctgcctcgggttcccaaagtgctgggattacaggtgtgaactgccacacccagccagtaatcatttttaagagaaaataaaacaatgaagcatgaagcacgtaataatccattaaaatgtcatgccttccctagagtactgaacagcagagccagagctttaaaccaaactcatcacattgtttactgaattccaaaaatatttgaccagacatattgttttttatgtacccaaagcttaatttatgactgtcaaaatttacattcagtgtttatagaattagatgagactttgagccgtttgtaaataaaattactgaaacctcaaaaacaaatactatttggtattctagctatgggtacatagctatgggtagtccagctatgggtacatatctctactatttaggacttaacaaggttgaattgtgaactctgaggataaatatgttaaaatccattctgttttcctccaggatacagatttattctgcccccaccccaactcacagtcttgtttttctgcatcgccgtcattatctccttccatcctgagcgtgccttcatgttttcctgtgtctgcacaagactcaattttctgtgaatttgcttgagcaatattcatatctaatatttctagctcccacagaagtgacattttccttcgatgtggggaatggaccttgtgaggtcacggtgcagtcacccactccctttaatgacaatcagtggcaccacgtgagggcagagagaaatgttaaaggagcgtctcttcaagttgatcagcttcctcagaagatgcagcctgcccctgctgatgggcacgttcgtttacagctcaacagccagctcttcattggtgagtgctggtggtttataactgaatttagtgtgagtccagagagggaccaaaagaaaataagaactgtgatgtactgagagcaacagttgccaacaactactgcttattggtactatttgctgataacctggtaggttccaggagcttgctgtgtgcttcttatgtgacatttcttttgtttgtttgtttttgtttttatttttgttttcagacagagtctcactgtgtcgcccaggctggagtgcagtggtgcaatctcagcccactgaaacctccacctgccgggttcaagcgattctcctgcctcagcctcctgagtagctgggattacaggcgcaggtgccaccacgcctggctaatttttgtatttttaatagagacacagttttaccatgttggccaggatggtcgtgatctcttgacctgatgatccacccacctcagcctctcaaagtgctgggattacaggcgcgagccaccgggccctgcagtatctcagtgtttaggtatcaatgtttaggtattgtcatctgtttacagatgagatagccaagcctcagagaagtggagtaaccagctaatgagagagatcccaggatagccgacccccaaacttgaaccattcacattgcagaggattggcatatgtgacagctatattttatcaacactattagtgagatcattagacatttttatccattccttcagtttcacttctcggtggagttagagagcttgtaattgggacagaagtcctccagggtccactcaaaaccagatcgcaggatacccgctgattggaagcagcactgcgcacctcccccgcggccaggcttccaggagcccactcccggttttcctcgctgctgttctcacttctggggctctctcatcacaggctccttgtttataacccggtctggctcatctgttcttgcactccatttatttaaaggtgatagctctggaagtctttcctttagtttgcttacttactgttttatcactgttgtttatttttccccttgggaaaaatatattttgctatattgcttttgaaactattctaacgtaggagctacacagattaaagctctcacttgttcattcttaagtgttttaaagcgaataaggatgcaatctaattaaaactggactaaatcacaaattatcacccaacctaatttacaggggagggtagatacaacttccaggtactaaatgctacacgtgaacccacgtatgtatgtggatgtggatggggtgttataccatgacttcctaaaacctagcttcaggcgtggttagctcttctattaaggtgcagtgaggctttttcaaaggacatgaaaccatcaaactactggaaaggaggactacacggaggggtcaaaccaagaacttgattttctcacttgtaatcttggagattatttaagggaatgcctagaaacacaattagcataaaattcacctagaatcagcattcattgcggtggatgaagcactggcttcagaatcacccacaaagctgattgatagttcagatttggggcccccaccttaggcccaccgaattggaatctctgggaggaggctaaaaactgcattttccagaaactctaggtaatttccatgctcctaacattgagaattgtcgccttcataatggtgtttgtcactacacaggtgttgtaaacctctctaaatggtttcttcagcattcaagtttgacatgacaaaatgtgcatgcatgcagtattcaattactgtttagcactgtaccctctgagaggaggagatcctggggtatggtgtcaccccttccaacttcccctcctttgcttatccatttcctttcacactttatttttagagtccatccaagtaagaaatttatccatatatatttttattattgtgaaaaatttggaagttcatacctaaccattataatgcacattcttattcataaagaaattaaaataatgtttgatgaatgcacattcttattcctaaacaaagtaaaatagtgtttgatgtggtttatattatgtattttgttctttgtaaaggaactaaagtgaaattctttcttacctgaagttaaggaaatgtttttagaaggactatttgccagactcaccatgtttgaaagttatgtaaataaatgttttattcaatgtcatttaaagctgcatatctcataacagttatattttcaaaattgtatatgttcacaaaattttttgacacattgtgattattgccactctccataaggcctgagtttgacatggacataaaatcctgaataaaataccaaggaacacatttctatttgcagtgtttccgttgtaggtggaacggccaccagacagagaggctttctaggatgcattcggtctctgcagttgaacggggtggccctggatctggaagaaagagccacagtgacgccaggagtggagccagggtgtgcaggacactgcagcacctatggacacttgtgtcgcaatggagggagatgcagagagaaacgcaggggggtcacctgtgactgtgccttctcagcctatgatggaccgttctgctccaatggtaagtgtgaccaaggagcaggttatagggaaagtacatgaaacttaaatagtatgaagaatgcttctggcatttgatattataaagagaggataagattgaattatttgaaatggaataatttctgtaccaaattcctctattgaatttagaagggatatgactgtttttgaaaacttaaggctatcagtcctctctgggtttcttatttagaagatctctgggttaccccagcatctgttcaatgctaatcctctcgaaataatttggttttcaaaactctgtccttgtactgttctaattttaacatcagtaaagcatcattcttatttttgtttttaatttttagagacaacgtattgctattcaagcctctctgttgcccaggccggacttgaactcctaggcttgagcaatcgtcttacccattgtcccttgtgacagtgactttaagtgattcaaaaggcctttatagaaatgtcttttcttataaaacaagcatactaactagaaggggaaaagaatatttaaatattgacagtcattaacaggatcactcaaacactttgctctatgatgtttgactcttcttagaggagtgcagtggggtatcacacagcttctgctcaggtacaatcatgttttcaaaagaaaagggctgggcgtggtggcttatgcctgtaatcccagcactttgggaggccaaggcaggcggatcacgaggtcaggaattcaagaccagcctggccaacatggtgaaacctcatctttactaaaaatacaaaaattagcagggcatcccagctactcgggaggctgaggcaggagaattgcttgaacccgggaggcagaggttgcagtgagtcgagatcgcaccactgcactcactcctgggcgacagagtgagactccgtcttggggaaaaaaaaaaagaaaaggaaaaagggactgattttagtattaagtactctgtactgacttatttaatatatttataatacttttatgaaacctcttacaatattgaatcatcagagctaaaatgtaattgtgtgtttaagtgtctctgggctgttacacttactatttttagcagcaaaacaggctttaatcactataaattgtgtgactttcaaaagaattttgaggattcattatctagaagtcatttaaattttcagaagttcttgcatatgtcttttattagtcctgaagatctctgtgctcacaaatctcatagctctggtgcaaatacagagctctttttatatctcaagccaacatcaggagtaaccactccttcatgagcacaagtgctgatttctaaatcattcccaatccacatttgctaagtgcaatttgaatgttattttataacccaaaattttcttaaggatagacgttatatggtaagtaaatggaaaatggtcctccagtggctggggcatatgttatagttagattacctaatctaataagaatgatctggattttcagtaaattctttatattttatggaaatggaaagagtggagtagtattccaagacagtgatcatcacccaacattttctttttatttacagatatatttggggggtgtgtgtatgtgtatgtgtgtactaaacacatttttggaattaacttgatataaaattaaaatatcaacctttcataaagtgttttaagagaagctgaaagcccttcaacttttctctctcagaatactgtagataccactttggattagcctttctatccagacagtaaatttgagaaacatctttggcataaaagaacatttctaaattctgaccttgaaggagggttggtcttcaaatcaccttttctctagttacttcaggagctctgtttcatgcttcctacaaagtaaatcgatttttaaagaggaggtaacattcaaataaaaaacctggtactctggcatttccaggctggccacataaggagctctgtaaaccctctctcatacgaaacaggcataactagtaaaaattattattttaaaaaacaactattgaaagtctttagaaaatgtcctaaggaaatacatcaaatgaagaaacatttattaatcagtaataacagtgagagtttgaggcatttaagccaagaccctctccctgcacctccccatccctagctcagtatgacggaagctccactctatatggatatagccaagaagccaaaggtttcctctctacccaggtcctactacagagatactgcattaccccaagattgggtgccagcatttcttgtcatccccagttttgtaggacagaagctctgttcacgcagaaacagctgagaagtctggggtttccttcctacaccaactcctcattccaggacataaggtcttcaggtgtggcagctggaaaaatcctgtgtcccaattgccctcactccagcttacttgtaaggaacagtttctccaccaggagaggcaaggcaagaagttacctttcccaccctgtgccctacttgtaagcagaggttttactacaaaggagcaggccactctcactctccacagcttcagagcagtgaggcacatttaaccaagaggtagagggaggccatgaaaatacacagcttggtagccctccccaagtgaactgatttctatttggaacagagcatggatcagtttaagctagtggtatgaagatattggcagtaagcaattaagagaatgttgataactctaagagagtaatgagttaagccagggaagtttaacagagaaaagaaaaaagaatcagcaaacttgaagcaagatcagtagagattatgtatcctgaagaatacagagaaataataatgaaaaaaataaacagatcatcagagaaatatcagacataactaagcacaccaacatatacgtaattgaaaataccaggagagagagaaaggatcagaaaaaaatatttgaaaaataatggttgaaaacatccccaaattaataaaaatcattaatctaagatacagaagctcagtgaaatacagatgacacaaagaagtttatatccagacacatcttattaaaaactttgaaagccaaagtcaagaaggaaattttaaaagcagtaagagaaaaatcatatatacaaggaaacgccaggatcaacagctaacttctaatctgaaagaatggaggccaaaggacagtgagataacatattcaaagagatgaaagaaaaccattgtcatgaagaaacttacacccagcacaaccatctttcatgttcagtagcacaggatgactatagttaacaataatttattgtatatttcaaaataactagaagagtggaactggaatgttcctaacaaaaagaaatgataaatgtttaaggtgatggatatctcagttaccctgatttgatcattacacattgtttggttgtatcaaaatattacctctaccccataaatacatacaactattaggtattcataaaaactaaaaattataaaagatagtaaatatatccctacttacaaaaagcagagaattcactgctattagcctgcattagaggaaataacaaagaacgttccttcaggttgaagggatataacccagacaataatctgaatctacacacaaaaaacaaatagcactaataaatgtaagtgtgcaggtaattataaaagaaagtataatgtcatatttcttacccttttcagtgcttaactattttaaaaagcaatgtataaaactataatagagaatatacaaatatataatgtatatattttcattgttgggcctatagaaatatattacaaaaaaacagcacagaggagacagatggcagcaaggctgtactgaaataaggaataacaccaaatggtaacatgagtcagaggaacaaagaaagagaactagaaatggtaaataagagagtttatagacaaagtctataaatatttatttgatcttgtttcttttctcagattttttaaaaagagaacaaattatataaaataataatgggtttggtatgcataaaaatagttccaaaagagaagaaatagagctatgtagaaataacttttctaaatctcacttgtattaagttagtgtaaacctgaagcagattattgataagatatatataatgcaagcttagagcaatcactaaagaaaataaaacattgtcatgaagtatattaaaaggcctatataccaaaacctagtaggatttatcccaggatttcaggagtggttcaacaaatgaaaatcagtcaacatattacacaagattaatagaatgagaggggaaaaaaaaacatgattatcttaattgttgctgaaaaaaaaaaacatttaacaaactccagtaacctttcatgattgaaaaacaaaaacactcaataaactaggaatagaagggaactttctcaatatgataaacgccatatatgaaaaacctgcaactaacatcatactcaatggtgaaagcttcttccgtaaaataagaaacacaacaagtatgcccagttttaccacctctatttatcatagtactggaagttccagctaaagtcattaagcaagaagaagaaataaaaggcatccaaatttcaatagaaaggctatctctctctcagattaccttatcttatatgtagaaaactcttcagaaaataaaagctgttaagagaaaataaataaattcagcaaagttgcaggatacaaaattaacaccaaaaatttggttgtatttctctacactagcaatgaaaaatctgaaagtgagattaaggaaacaattccatttgcaatatcatcaaaaagaataaaaaacttagaaataaacttaactgagaaagtgaaagacttagacattgaaaactataaaacgttgttgaaagagattaaagaaagaactaaatagatggaaagacattccatattcatgaattggaaaacttgagattattaaaatgacaatacaaccccagcagattcaatctaattcttatcagaatccccaaagcactttttatacaaatgaaaaagcccctatcaatatttaaataaaatttgaaaaagcccagaataagcaaaacaattttacaaaagaacaaagttggaggattcacccttcttgacttcaaaacttactataaactacattattcaaaacaatgtggtactgaatgaggataaacctataaatcaatggaatagagctgagaggccagaaataaacctacatacatacagtcaattgatgtttaacatagtctttgtcaagatcattcagtagggaagtaacagtctattcaacataaaggtaggaaaagtggatgttcacatgcaaagattgaagttagacccttaccaaaattaactcaaaatgaatcaaagttttaaatctaaaagctaaaactataaaatttttagaagatatataggcagatcttcatgatcttggatttggcagtggttttttaaaaatcaccccaaaagcacgggcaacaacaacaacaaaaatagattatttggactttataaaaattaacaacttctgtgtatcaaagaacactatcaagagagtaaaaagacaatccacagaatgtgataaaatatttgcaaattatgtatctgatggaggttcactatctagaatatgttaataatttccacaacttaacaacaaaaagtctaattggacaaaggacttgatgagacatttctccaaaaagatatacaaagagtcaataatcacatggaaagatgatactcgacatcattagttattaaagaaatgcaaacgaaaagtataatgagctgcctcttcaaacctactagattgactataaaaataaataaataaataaataaaaacagaaaataacaagttttggcaagaacctagagaaattggaactctcttttgttactggtgggaaagtaaatgccacagccactgtagaaattgatttagagttaactcaaaatagttaaacatagaattaccttcgaacccagcaattccacttctacatatataaccaaaacaattgaaaacaagaactcaagcagatacttgtatacaaatgttcatagtagcactaatcacaatagtggaaataatacaagtgtccgtcaacacatgaattgattaaaaaatgtagtgtatacatataatggtatattgttcagccattaaaaggaatgaggttctgatacatgatacaacattaattaacatagaagacattatgctaagtgaaataagccagacccaagagggcagatattatataacttcatgtttactagatatcaatagacaaatttgtagagacaaagtagattcaaggataccagcagctgagatgagggggcaatggagagttattgcttaatgaatagagtttaattttgggaagatgaaaaattttggatatcaaaagaggtgataattgcacaacattgtgaatttaattaatgctactgaatttcatattttaaatggttaagtggcaaattatatattatatatattttaccccaaagtatagtgaaatcaagaaagaaattaaaatgttacactccaaaatatccaccaacacaaaataataagtcagaaggaaagtgaaaagaaaacaaatgaaacacatagaaaaagaaaaagaaaatggcagatgtaaatctaactgtatcaataataatattaaatgttcatcgattgagcaatccaatcaaaagacaaatattgtcagaatggataacaaaagaaatcttaactatatgctgtctaaggacatacaatttagattgaaaggggtaatttagttgaaaataaaagaagggaaaacatgtaccatgcaaagagtaaccctagagagccaaagggactatactaataccagaaaaaataaactctaaaacaaaaggtgctactagaaatagggaaacttatataatgataaaaagttaattccctcaaaaagatataacaattacaaacttatatgcagttaataatatagccccaaattgcataaagaatacctgacagaactgaaaagagaaatagaaaaaccaggaataaaacctggaggattcaatacttcactttcaataaaggatagaataattactcagaagattaccaagaaaatagagttgaaaaaaataaaaacgcaatcattctaacacacatctgtagaacacaccacttaacaatagcagaatgtatattcttctcaagtgttcatggaacatattctaggttagacaacatgctacctgtaaatcaagcctcaacacatttaaaaggattgaaatcatatgaagggactttttaaaacacaatgagatgaaattaataacataaagaaattgtggaatatcacaaatatgtggaaattaaactatacactccgaaatcaaaagggaaattagaaaaggttttgagataaatgaaagcaaaaatacaacattactaaaacatatagtaacacagctaaagcagggtttagagggaattttaaagctgtaaacatcaatatttaaaaagaaaaatggttcccaaataaaaaacctgacctgccaccttaagacactgaaaaaagaagagcaaactaaatctaatgtaaggagaaacaggaaataataaataaaacaggagaaatttctcaaatggataatataaaagtgacagaaaaaattaaccaaaccaaaagtcagtcctttaaaattgttaacaaaattggcaaacctttagtacaactgaccaagaataaaagagatgattcaaattactagaatgacatatgaaagagtgatattactaccaaccttacagaaataacatggattgcaagagaatataaacaactgtatgttgaaaaaaattacgtaacttagataaaatggacgaattcctaggatgacactaactacaaaattaacacaaactactacttctgtttcaagaaggaggagaaaatataaattggcctataacaataaaaggaatgtcttaataatattaaaataccacagaaagtaaagcccaggtccagatggtttcaaacaattgatgctatcaactatcagaatatatcaactatttaaaaatatatcaactatttaaataagaagtattaattcttcaaaactcttccaaaaaataaaagagaaaggagcatttttcaacttattctgtaaggtcagtatttccctaataccaaagccagacatagatataccagtatatatattttaaatctacagaccaatatcatttaagtagatagatgtgaaaaccctgaacagagtattaccaaagcaaatccagtcacatataaaaatgactatacatcaagacaaagtggaaatgatcccagaaatggaaagttgttttaacagctgaaaatcaattaatataatatactatatcttagaataaaggacagaaacacatgatagtctactgatgcagaaaagtcatttgataaaatccaacatcctttcatgaatttttgtttaaattcagtaaactaattatagacgataacttcctcagtctaacaaatggtatttttgaaaaactcatagctaaaattatatttaattttaaagactgaattttttttcctaagatcaagaatgagacaagaatgtatactctcactagttctattcagcattgtactagaggttcaggccagactgattaggcaagaaaatgaaaaaaaaaaaaaagaagaaaaacatccaaattagaaaggaaataaaactatctctatttgaggatgacatgattttttatataaaaaatcccaaagaatctacttagaacaattaaaactaaaaccaagttcagcaaaattgcagaatgcaaaaacaatatacaaaatcaattgtatttctacaaattagctgtgaaccatctgaaaataaaaccaataaaacaattttatttacagtagcatcaaaaagaataacatacatagcaatacatttaacaaaagaaatggaaaacgcactgaaaactataaagcattgaaagaaattaaaggtaaataaatggagagatatttcatgtcatggattgaataattaatataaataaaataccagtgttctctaaagtaatatacagattcagtacagtttcaatcaatatcccagctggcttctttcctgaaattgacaagctgatttcatatgaaaatttaaatgatgcagaatagccaaaacaatctttaagaagaagaaatttgatagattcacactgcccaatttctaaacttaatgtaaggcagtatataactggcctaagactaaacagatagctcattgggataaaattgaaagtccagatagatacctcgccatttatggtcaatggattttacaagagtgccaggacaacccaatgggaagaagtagtctctgagactactgagtatacatgcacatgcaaatgaatgaaattagacctctatctcacacatacataaaaatgtaccaaatagacctcaatgtaagaactaaaactataaaactgttaaaacatgggagaacaaaagagaagataacccacagaatggaagaaattattgcaaatcatgtctcttataagggtctagtattcaaattatttaaagagcttttacagctgaataagatgccgtgcgtggtggctcacacctgtaatcccagcattttgggaggccgaggtgggcagatcacgaggtcaggagttcgagaccatcctggctaacacagtgaaaccccatctctactaaaaatacaaaaaattagacgggcgtggtggcgggcgcctgtagtcccagctactcgggaggctgaggcaggagaatggcgtgaacccaggaggcagagcttgcagtgagcggagatcacgccactgcactccagcctgggcaacagagcgagactctgtctcaaaaaaacaaaaataaaaacaaaaaaccaacaactgaataagaaaaagaaatttaacctaattgaataataggtaaagcttataagtagatatttattcagcaaatatgtgtgaatgtccaataaaatcatgaaaaaatagttggcaacattagccagtaggcaatcaaagtcacaatgaaatacctcttcacacagacaagtatagctgtaatttaaaagaatgataataataaatgttggtgaggatgtggagatattaaaaccctcatgatttctgtttggaatgtaaaatggtatagctattttggaaaaaatatggcagctcctccaaattttaaagttggtgttttcataagattgaacaattttactcctaggtatatattcctaagaaaaataaaaacgtatccatagaaaaacttacacgtgaattttcatggaagcattatttataatagtcaaaaagtggaaacaacccaaatgtctatcaactgttaaatagatccgcaaaatgtggcacatccattactatttacatccaatgaaatattattcaataaaatgcataaaatactcatacatgctacaagatggatgaaccttgaaaataccatgctaagtgaaagaggccagattgaaaagaccacacgttatatgattccactgatatgaaatctctcgaataggaaactctgcagagacagaaagtaaattagtagttgcctaggctggggtgttggggagaaacagagaatgactgctagaggatatggaggtttttgtaggagggaataagaaggtgcacgggggaggggagtaaaaatactctaaaattgatcatggcaatgtttgcacatgcctgcaaatatactaaaagacatagaattttacactgtaattgggtctattacatggcatatggattatatcagaataaagatgtttaaaaattaatgatttgggaaaaaattggaaaccaaagatgagataagtcacctataaattatacatttatactgaagaattagttatatgtaaatataagatgaggatgatttagagaattaaaatctctattaagtgttagtcaattctgggttatgagtatattggagtttgctactttttcttcaagttgtagtttttaaaaaactttaaaaagtgaaaaataaaaaataaaacaggaaaggatttcactattactttatctcccaggatatttaaggtttggtctcattctctaaatgtacttaaaacaagaccgttggacttacattttgttaacataacaaaaatgtatttatcatttcagagatttccgcatattttgcaactggctcctcaatgacataccattttcaagaacattacactttaagtgaaaactccagctctctcgtttcttcattatacagagatgtaacattgaccagagaaatgatcacactgagcttccgaaccacacgatctccgagcttattgctgtatgtgagctctttctatgaggaatacctttcagttatcctcgccaacaatggtgaatatcttttgtgtaaagaaaaagagaaccctgagttagaaaaataggactgtaatgacatgggtcttttcagcagtcaaactacaaacgatgagagaaaactgtatgccctccaatgggtttggtttttcagtgcctcccttaatggttattataaaagctagcatttcaagattaaattaagatgcttttctcccattacatgtttgataatttaacggagttgatatgcagttatatttcttattattgataggatgactttaatagtacatgatgactcaaattggttttgcagttcattttgaaataagatatctagatacatgacatacattccctcctcattctaagcaaaatagaggagcatttatgtggatgttatagtgcaactatataaaagccaattcctataagcaacagataagtacagctgttctttatctcgtcagtggctgaaaaactagttatatcacttttatagaagaaaagtgtaatgacagcctctcaaacagtggtaattggggcattgcaaggttttcacagttgaacaagaagaccaagctttaagtttgttaggtacacagcacaaaaatttcatgtctagaaaaaaatctacaaaatctctgattaggctggacacggtggctcacgcctataatcccagcactttgggaggccaaggcgggtggatcacgaggtcaggacatcgagaccatcctggctaacacggtgaaaccccatctctactaaaaatacaaaaaatgagccgggcatggtggtgggcacctgtagtcccagctactcgggaggctgaggcaggagaatggcgtgaacccaggaggcggagcttgcagtgagccgagatagcgccactgcactccagcctgggcgacagagcgagactccacctcaaaaaaaaaaaaaaaaaaaaaaaaaatctccgattaacaggatcttagtataagctaaaagagaattacagataatgagggtacctctgtgtaggagaggggtatgtatattagaagatgtagatactatggaaaccttgtctcctgacaaaaccttttcttgtcctcatttttggattatggcagaagacttaaaataatctggctataaaaaaatctttatgcacatatcagtaatacattaaaatgagccttattaaaagttataattacaggaactgaatgttgatacaatattgcatagagcttcatcatttcataaatatcaaagtcataatgaatttagatctgagttctgagctcatatgcataatttaaaccttttcatttttaaatgaaaagctttggggagactgcttattaacaacacatttagtcttgacttttaaaatagcatcattggactcagagtctggcacaggaatagcatttaagtaatcactgttccaggaaagataactattgggtgcatctaaattgaggctaaatagattcaaaagtgctataagtaaataataataaaagtgctctagaatctgtatcaagagttttataaaataccactttaattttaaatgccatttatttttctttttaggaagtttgcagattaggtacaagctagatagacatcaaaatcctgatgcatttacctttgattttaaaaatatggctgatgggcaacttcaccaagtgaagattaacagagaagaagccgtggtcatggtagaggtaatcccacaaatgcaaaagtcaaactaactaatattattattttgagaacaaataatctaatgaaaaaatttgacaataaatattaatagaagagcaacccattcagtgctgctcttccataagtcaagaagaggccaaatatggccaggatctgggagagaggaggtggttgtttattctgtattgctttgttttgtttgtttagcaatgcaattctgtcaaaggtattattaatattttactatttaaaatatcaaaatatctttatttgttttactttactcaataggggaatgttctctagtttatcatagtgactactggtggaatctattcattgatattgcagtgggaacttgtcttattccgattataaaagaacaaatactttagcaacttaaaaacacggtttaaaagcacacaacatagttattaaaatgggaataagtaagaaaatagacctgagtcaccacagaggaagtaaattacacattgtcattggcattggaaggaaaatacactgtatagagaacagcagtgcttggttttatgtttcatattttctccacagaatgagtacgtatttaagtttaaaacagccagttccatctttttcatggattctgccaattatagatccttccattatgaagaagagtaaagccagcaagtaggtacatcgtggatagagtggtagctgatggcatcataggaattgcttataaaatagcttccccttctaaatgattaattatttgaaggtggcttcttgagcttttgtagtggtacttaaaagtgatttattttcatctttcctttcctcatcttcctttgcttccttatcattaaaattgtactttgtgttgatgtttgcttctcatgggacatctaataggttaaccagagcgcaaagaaacaagtcatcttgtcctcagggacagaattcaacgccgtcaaatctctcatattgggaaaggttttaggtaagtaggagaaagagctttttcccaaaaaatctaagtgtcatgtcacaaactctggaagcattcatcatgctgaaagaagctccttgtcttacttgaataataatttcacagtgagtgacaatcaaggtgcaaactgtactcttgcctgagtgtacatataatcatgagtaagtgctgcctgtgagatgtgcaagggcgttcctggaaaaatacctccacacttaacctctcacttggcaatcatgcataatgaatcacggtatttttctaaaccttcttgaaaagtgaaatgttatcaaagctgacacgaagttcacagattatgtatgtattaatcaacatcaactccggagaccatcattcaatgataaaactacatttgaggtgaacacaagagaaaaaactggtaatcttattacagcagatgaatacagttttatttctctctcaagccctgctttgcctgttgcttccatcctttttgactttagtatctaacaggaatggggaggcatattcataaatatctgttacgcaaggtagaaagttacagtaattgtctatcatattgtctatcataacctgttgtaaaagcacagttagctttacatttaataaaggaactgaggaaagtaatcttttttaaaaaaaacccatcttatgtaactcaattaagaaaatgaactatactttaatattaggatcaaaaagttgaataatatttattatatacatctttgtttccttccaaataaaggagaacatggaattgaaggtgttaatgttttcattcaaggatggtatattcaaaggcttgtaacttacggtataaaaatctacattgaaattcagcaacgaagtatatactcagaagcaattgatctcagaaaattataaatattcattttgcctgtccttggaggtagagataatcatcaaacattaataaaacactttatactttgaaaaactgtattttaggattggttctgctatacattttttgccactctcacatcatttagtaattataccaaaactacaactttatctttaaatttggaattatataggaagtgctttccttaacttatagtaaaatagaccaacaagttggctaatagagaagccactaattttacaaagaaagttacccaaaacactgtgttctaagttaccaatatatttctcttgagtccctgtaaatctttgattcatcccttcatttaaaaatatttggtgagcggctgggtgtggtggcttacgcctgtaatcccagcactttgggaggccgaggcgggcggatcacgaggtcaggagatccagaccatcctggctaacacggtgaaaccctgtctctactaaaaatacaaaaaaaattagccgggcacggtggcgggcgcctgtagtcccagctactcgggaggctgaggcaggagaatggcgtgaacctaggaggcggagcttgcagtgagcagagatcctgcactccagcctggatgacagagcgagactctgtcgcaaaaaaaaaaaaaaaaaaaaaaacttggtgagcatctgctatgaacagtttattaagcacggagaaagcctctgaatgagagaaacactatacctacccaccctcactacactcacatgttaataggtacataggctaatatatgagcaattctaataaaataatgctcatatccagcctaatttattattatgcaccctaacaatgccttagaaaaaaatggcccaaaatccatcataattaagatgctgtttctgagcacctcaatatgattttgccatttctgagtagtcttagtgaatgaagaccattcagattgattatcacaagatcaattcagagtaaacctatttaaatataagctttttagattctgaattttctatatagctttgaattttatccaagaggtagctttaaagaatgcaaacacctaaaatactttataattcagtaaagatgatccatcataaattaagatttgtttttagatactttggtattattggtattctttctgttttgctttgtgtgtgtacatgtgcacatgtatttaaacacttttgagatgagtatcactctgtcgcccaggctggagtgcagtggcgcaatctcggctcactgcaacctccgcctcccaggttcacacgattctcctgcctcagcctcctgagtagctgggactacaggcgtgtaccaccacgcctggctaatttttgtatttttagtagagacggggcttcatcatgttggtcaggctggtctcgaattcctgacctcgtgatccacccgcctcagtctcccaaagtgctgggattacaagtgtgagccaccgcgcccggccccttaaacactatcttaaaaattacatatatatatcaaaaatacagagtgcaaaaatggaagatgcctttttgctcccaaaaagtaaaaaaaattagcctgtaaacagttgcctatgaatacagctgagcttatataccttaggaggtatacattctaggctgaagaaaagaaaacccactgaaggactatatttcaaatagagctctaggtatgtaagaatgccaaatagttttggtaattaaatatttctggaaattgccttttgagttttgtaaggagatgtcacataagacatacagttttaacatttaaaattcatcaacttatgtattttatattacttctatactatggtgtttgtctcatttagaagaaatgttttatgttgggtctgggatttgattttacctgatttacaagctaggaagttaacagcttttaactgttttgtggatgctgtcctggtacagagacaaaggaccctattactcatggcacggcaagcctcgtgagcagcagttcatttgcattgttttcccttggccctgaagccttatggggcagtgatgggtgcagatgaaggctgcacctgcggccaggtttgcactgcagcagaggaacactgagtttggggaatccaccgattttgtaacaagcactaagcaagtctattctttgtcctggagggggtcatgaccttatccctcaatgttgcttgcttcaattataaccttgagaagtggcctgagtaaagtgctgtcagcatcttgcacttcttggcaaacccagcaaagcatgaggagacactcagagccaatggtggattgcctctttcaacattacagaataaaaacacccaaaaaccctataaaaagtcaagaagataggagattttgtggggtttttttcccaagaaagagcaatgattatatcaattagtcctttattggtaaaatgaggaggctgcactaagttatcttcaagattctcttcgatagaaaattctaagattgttctaacttggtccattaaccaggattcagtgggcatcacagatgtcttgaggtctttgaaagtataagtcaacaaaactaatgctgtccaatagaactttctgtgatgatgaaaacgtgtaaagtctgtgctgtcctatgtggtagtccccagacacacttgagataaatgagtttttaagcactagaaatgtggctagtataactgagggactaaattttacattttatttcattttaattgatttgagtttctttttttttttttttttgagatcgagtctcactctgtcatccaggctggagtacagtggcgtgaactcggctcactgcaagctctgcctcccgggttcacgccattctcctgcctcagcctcccaagtagctgagactacaggcacccaccaccatgcccggctaattttttttattttttattttttatttttatttttagtagagacggggtttcaccatgttagccaggatggtcttgatctcctgacctcatgatccgcctgcctcggcctcccaaagtgctgggattacaggcatgagccaccgtgcctggcctgatttgaatctcaatggtcacatgtggctagtgtctaccatattgcacagtgtagaagactgtccacttacttatctagtagttttttcctttagttcaaccaagtggcacccttttgtaaggatagacatctgtctatttggcatgacttcaatgggctgggaagacaaccctatctcaaatattttttttcccacaacgtcaagtgccaatatttcaaattctgtattagagatccattcttttgactcttctgccaaaatacacatgcccctgaaagtgttatcaaaagccatgaccaggaatttgtgcaaacatgaatttactcgggagcaggctttgatggaacagaatagagaattggaagggggctgggtgcaggaccccgaagttgagaaagcccagaaagggaggcagacaggtcaccatacatttttgattagagctatttagctaagagtagcaaaagtgaagggttttgaccatgttgccatgtcaaggtaatagacaggaaactgtatctacatgtcaccacagttaagagttgagttctactgaatattggttaactgataaacaataaatagtagtgctggctaaaatctgggagtacagaatcacgagtttcttcctggattgtggtgtgattgccaggtacacttcagagtgggcaaaggaactcctttctttcagattttccagcttaaacaaagtatatatgaccattttctaattaagtcatttattaaagatgtaagaaagttctactctgtttcatcagctccaaattaaacaattgctcaaggtttttattcagggttttaaagagaagtctggccaggcgcagtggctcatgcctgtaatcctgacactttgggaggccaaggtgggcagatcacaaggtcaagagatcgagaccgtcctggccaacatggtgaaatcccgtctctactaaaaatacacaaaaaaaattagctgggtgtggtggtgcatgcctgtagtcccaactacttgggaggctgaggcaggagaatcgcttgtacccaggaggcggaggttgcagtgagccgagattgcaccactgcactccagcctggggacagagtgagactccatctcaaaaaaaaaaaaaaaaaggtctgccctaaaattatgtgattcttctctaaactacagttacttaatgtaaaaccatcttgtatcatgtcaaaagataaaaatactcttgttaagatcgtgtggcagactttattcaggactatggcaataggtataggaattactggaatggggctttgcagttggggaaagagactgagctcaacttcaaatacaacaaggagaagtgtggattcgtagccaaggagcagagtggctggggtggggtgtctgagtggtaaactacaaaatgggagagtaattcttgctaaactgactcaccaggtttcctggtgatgccaggccagtgttgtcagacatcacctgtggggtggtgagagggatgagaaaggtgattagatattgagagtgatcagatattgagggtgggagatttgggttaaaagcaaattggcaggattcttgctaagctggacgatgaaagaccaaaggtcaggctggttgagcagagagcttagagtagcctgaccaacatctggtcatagggagaatctttgtccatcatgtcaaagttctttcttggaaaaaataaattatgtaaagatccttgaactggaaacatcatagaaaaatagaaatgtaagagaaattgtcattctggtcaggatctaaatgtactagagtaaaaccaaagaagagtaaaaagggaaaagtgagagaagaaaaagaaaaatttcccaagcctctcatttagggaagaactgttgtggggaaccccgcggtggtgtgggagggagggtggggagaaagaaccatgcaatcgctcatctcactgttgggaatgggggaaagttggaaaaagaggatcttgttttcatataacagtgtgaaggaatgattttgattgtgagggctagggaagttgagctctcaaactcataaaagggaaagcaggaaataagaaggaaactgattaaagcagcaaaataaaagaaaaaaagatgaaataatgtgaaataaatagtgtaagataaaaaataaaatcagatatagtggttattactctaaagacaaatggactaaattctgtcaaactaggtttaaaaacaacagttaaatgctcttagaatattgaaaatgaaggggcatgccaagaactagcaggcaacagctgataaatttaagaaatgcagcactactttcagataagattgaatttaagattggaatataatcgaatcttaaatgagataaagagggatattatctgatgacaaaagatacagtttattaagataatatgaaagtcatcatacaaaatagcaactatagtatgaaggatttccagagctctgccctcatctccaagagtcgcttttctgtaatcctccggattattggctgtgagcgccattaaaattttattttaatgctatattgtaaaaattaaatggcagaggatttcttaaatttatgccatgtaactgctttcctatgaagctctgttacttgcagagagccagccatctgcacttgaacaaatctgttaaaaacctgcctttcataaccctgacaatggaaatagttgcctaacaggtaaagattcagggtgacctctcctggagtgaaggaacgaggggatcggagggacctctcctggagtgaaggaacgagggtcgctgtcttgcagatgcggggtgtccctgcgcccccatctccgccgctgcgccctaactgtgtgttccccttctgtcctcagaggctgccggcgcggacccggacacaaggcgggcggcgactagtggcttcactggctgcctctcggcggtgcgcttcggccgcgctgctcccctgaaggcggcgctgcgccccagcggcccctcccgggtcaccgtccgcggccacgtggcccctatggcccgctgcgcggcgggggcggcgtccggctccccggcgcgggaactggctccccgactcgcggggggcgcaggtgtgtggccctccacccctgcgcacctgaaactgcgcttctctcaaatgtttttgaatttctcaaaagccttcttttctccgtctctgtcatccttctttttttcgttttttaaaatacatttttgtgatgttcttattttaattcacttttaattgacaaaagtttgctatgtgtaaattgtggcgtgattaaatcaagctattaaacatcattcttcctttccctgttgtaggtcgttctggaccagtggatgagggagagcccttggttaatgcagacagaagagactctgctgtcatgggaggtaacaaggccctgaatgacctggtgcttgtcattatcgctttagataatgataccattacttagcacaatgggaaatatatgtaagcatcaacactcaatggtgaggtcagaggggtgctatgtattgcggttggtggtggttttttgttttttgttctttgttttttttctatttgagacaagagcctcacgctgtcacccaggctggagtgcagtggtgagatctccactcactgcaacctctgcctcctgggttcaagcgattctcctgcctcagcctcctgaatagttagggttataagagtgtgccactatgcctggctaatttgttgtgtttttggtagacacagggtttctccgtattggccgtgctggtttcgaactcctggcctcaagtgatctgcccgcctcagcctcccaaagtgctgagatcacaggcgtgagccaccatgcccggccttcgttgattttctgaggcagtatttgctgatttcagcttccctgggggtgctcagcatgtaagaattctgctgaaacaattttttttgaagaacagttacaaagctaataatgaaaagttattaatttgaaaatagctgtattccctaggacatgcgggatatttgtcacggtaatgacaactgttggacggacctgaagtaattatgttcaaagcaatggaaacctcagctaattatcagagcatacactttatggtacttttcttcaatgacaaatagtatgatttagatactcccatgacaatgtttcacttatttaagaagtttttgtttgtttgtttgttttttgagacggagtctcgctgtgtcgcccaggctggagtgcagtgaagcaatctcgacttactgcaagctccgcttcccgggttcacgccattctcctgccgcagcctcctgagtagctgaaactacaggcgcccgccaccacgcccggctattttttgtatttttagtagaggcggggtttcaccctgttagccaggatggtctcgatctcctgacctcgtgatccacccgcctcggcctcccaaagtgctgggattacaggcgtgattatttaagaagttttaaaggcacacattatttaaagtgtattgttattttaaagtgtataattccctgtcattaaggacatttacaatgttgtgcagcagtagccattgtatgtttcacttttaatcatactttggaaagaactaatctaataggctaagaatgttttgtggttatttttaattgaagaaaagtgaagttaagcatagcttaaaaatatgttttggcaatgaaaactttttttctaaaatataatttatttagagctggtgcaaaaaataagcattcacctttccttgttaattaatgagtgaattattgaaatctttgtttgtttgagacggagtctcgctcgtcgcaaaggctggagtgcagtggcgccatcttggctcactgcaagctccgcctcccattctcctgcctcagccgcccaagtagctggggatacaggtgcccaccaccacgcacggctaattttttatatttttagtagagacggggtttcaccgtgttagccagaatggtctcgatctcctgacctcatgatccacctaccttggcctcccaaagtgctaggattacaggcatgagccaccatgcccggctgagttattgaaatcttaattgtattcttattctgcagactctccatagcacatacaagagtaaactagttgtgtttgtttccttcaaaatgacaggaaacaattttgacataataaagttctgactaaatttcagttgaggatattcacatttccatcactatctcaattctttttctcttagaaatcagtaaggtgtaaattaaaaatacatgacctgatgaacaaaaactgttttaaacagtttccagtgggattgtggtcaataatgcatatctaaaaggtatactttcgtgttcaattttaaatcaaatccaatcctaaatcaatcatgcctttttaggagatttttttcattgcaatgcaaaagcaatttcaacatgccgaacattttcacgctaggtttccaagtcctacagacgtttacacaatgtcagggttagtacccagcttttggtgagaaggaaatgggcaagttgatcatagaaccagctctttggaattgtattatattgctggtggtcaaatatcactggcaagattgacggagtaaacgtaaggaaacatcttagcagtgttctcttccgctgagaaattcttagcctgaacgaggggatgaaaaggagtctgtggaaggcttcccctgggctttcccaaaggcaatttgcattttctaatagggactggctgaagatataaattaatatttgtgtgaagtactttaaatgtacgatgtaggcagtaaaagcgtgggggaggaaatataatttctcctcatcattcctaactttgtagttgggacagacctctgattaacaagagaaaaacaagcaagtttactaaggcatgcggtccacagcacgtgggagaaacctcagtgaaactcaaagcgcagtggcttagaagtctggctcatcttcaacaatacatttgcggagaaatgacaggacaatggaaagcaattttaggtgtccgaaggcgagaaaccgtgggaagataaatatatgggaagaaactagtggagtacgtgtgtttgtacattcttctgctgacatccctgagctggtaagaatggtctccggtaaaagataatttacatcctgtctttagatgaaaagaggggaggatctagagagctcttcctccattggctgcttcttaattgcctttacttcaaaatatttgtcaaaaaggcatatttgggggtgacatattctgattaccttcagaagcttgtctttatacacatttatttcttttagggtagattttactttcatttgtcactaatatgattgcttcagtacacagcattctgtggcatggcttcatgctttagcactctggctctgaattaaagcctgaaacaatttataaagatactggtatccaggccttccattcatttattctgatttactgacttagtgtgcagctagagtcgagaatcatggacactgctaatggtttcaatattttaaaacattttgcccaggtctttcaaataatccacattccaggtaaaaaaaaaatgaataaatatgcctgcaatatttttggtaatagggattgattacatatatgcgaccctactgcgtttgaaaagtatattatcggccgcgcgcgttggctcacgcctgtaatcccagcactttgggaggccgaggcggacggatcatgaggtcaggagatcgagaccatcctagctaacacggtgaaaccccgtctctactaaaaatgcaaaaagttagccgggcgctgtggcgcgcgcctgtagtcccagctactcaggagcctgaggcaggagaatggcgtgaacctgggaggcggagcttgcagtgagccgagatcgcaccactgcactccagactgggcgacagagcaagactccgtctcagaaaaaaaagaaaagtgtattatcataaaagtatttgaaaacaatttcattaaaatgtacccatttcattgtactaacaataacatgtaatgatctatgatgatgcaaacactctatacttgtaaaatgatttaaaatttcccacttgttaactgaaggatgtacgcggtcttagagacatgtatgtctctattcttttaaatctgaaagcattatctaaaacccaatcatcatatacctgtagggaaaaagcctaacacagccatatccaaaagtcatagtccgtcagaagtatgttaaatgttataaaattacttgacctcagcatttctgagttttggtgttttcaatttataatataataggtggttggtttattttaaccaaacttaaaaagcaatgatgtctgcaaagcctctgattggaccaaaagtcaccatttatactctgacattgaggccaggcacggtaactcacacctgtaatcccaacaatttgggaggccaaggtgagaggatcactttagcccaggagttcgagaccagcctgggcaacatagcaacaccccatctctacaaagaataattgtaaaaagaaaaaaaaaaataagctgaacggtggagtgggcctatagtctcagctacttgggaggatcaaggctacagttagctgtgatcatgccactgcactccagcgtgggcgacagagtgagaccctctctctaaaaagaaaaaagaaaaaaaattatgatgttttattcttttctctccctaggtgtgatagcagtggtgatatttattttgctttgcatcactgccatagccatacgcatctatcaacagagaaagttacgcaaagaaaatgagtcaaaagtctcaaaaaaagaagagtgctaggacagctctaaacagtgagctcgatgtgcaaaacgcagtccatgaaaaccagaaagagtgagtcttctgattggcagctgtggctgtctctatcatcgtgactgtggacttccctgctgttgccatcagggtgcacacagcaggtgcagtgctgtcacctggctgaagatctgcagcctcagagcctctgggaggtccctttctccctcggtgaaacacagtcctccacatcaatttccaaacaatgaattagttatggccattcatcactgttcagtagtttccccgtccaaaggctctcttccaaaactgcagtttgatctgtgttaataattgtggggttttagatgagaaaatgactataaagctgtggccctactttattttttaaaaatgacagaacttttgttcagatgtaaaagacaaaattgcactttaatgttttttgttacttgaaaacatatctgggatccctttttttggtcctctgctgatatttataaaacaagaaatgcttcttggactaccttcactggcatttccatagtcctggaatccagagccaagtggcctatctaaaattcacagcccttttattctcctgtgtgatggttaatacaacacagttgaagcctggaaacactaccattatttttggtgtattgctttttctaattgactgtttttaatgattttgatacattttaatgttgaaattaatattgaatgttagctatgaaattttagtattgaattttataatggaacagaacattggtaggtaacaagatgcaagaggatgtcaatacaagattgtctgcctgtttttctttgtaatttgtaattacagtttttgtaacttgtgattatgtttttaactaaatttaccaccagatacaaacactacttcttacacagagttatcctttatttatatcattaagacgtgaatgaaacatcatcctaacttacttccccaagatattgagaggtcatatctgtttttctttatcattcatttctttttctaaaagttgttactgatatgcttttgatttcctatgactctattatgttgtacagaacatcttttcaatttattaaaaaaaatagcttaactgaagatcactaattccttttctaaattttgaactgctctaggcataaatatcattgtgtattatcctttcatctaatcacttttggaatgtaaactgaaggctgttcactccaagttaagttaacatttacatgatgtttattaaatctgccagtctgatcaaaggtttatgaccatggggccaaattcccatagattacccaaaattgaatatgtgcagttaactggaacatgtctcattaaggtttacatacacactaagacagcaaaggattggaattaactttatggagacagttccagggactaatattgaagcagtggttatttgataatgcatggaaccaccatttggattcaataaaccaattacataaaagcaatgatgctacgctcttcatattccagataccaactgcctaccaaggactaatgagatggtatatttcttccacatcagggcaagctgaaaatatattgattcagcgttactgttatgtaaatgaatttccatcttctcatatgtgttatttttgaaagaatgaatacactctctgtcttaaatccgctcttaacaaatgatctcttctcagaatactacatctgtattgagagtacagacagcccattggtcactgcaccttttgcaagacagcgaaacggatgcatcaaattgcattgatacatcatcaccatcaatcttttgcactgatttttagacttaatcttcttatttgaaaataaactcatttttaaataaaataaaaaatattttagggaaagctctataaaattaaaattacagaattatatgctttttaaaatttatgcaaaaatgtgcagacaaatgtattctgtattggtttatgtatcactttgcccttgtatattttgagattattaagatttgttgacttttttggtttgatatttatcatctgttaaatttttccttttaaattattaaatgcaaagtgcaagaa

SEQ ID NO: 666 - DNA, 1258 bp, Homo sapiens
agtcggctcagccaatgcgcatgcgcgaggcgggagcggtttctcccgtcacagtggttcccatggttgtcttagaaaccagtccccgaggcttggcaaagcaggagccctctgtggcagtgcttgggtgtcggggctctgaggatccggcctcacctctccacggggtcgacgggaacgtctccggatgccaggagtcgcaaagggccgaccacgatgaggaaaccccaggctgggacgggggaagcagcacgggatcccagcctcaggcctgcccggacggtgttggttggggtgagtctccccaaaagtcgtgccgccatccgtgatctcgaggacaggtcggcctgcgtgcccctgggctgctctctcacccgagggtcgttctcgtcgtgagcagaaccccgcagcctcaggggttgcctggtggtgtgtgtttcaatgcctctgctgtatgacgctgtgtgtgtgtctctgtgtgtgtgtgtgtgtgtgtgtgagtgtgtgtgtgtgtgtctgtgtgtgtgtctcccagtctctcttctctctctgtctctcagtctctgtgtgtttctttccctctctctgtgggtttgtgtgtgtatgcccgtgtgcgtgtgtgtctttggccgaatgtgccctgtgcgccacaaagcggtttgtcgcatggcggcctgtctttggtgagcctctttctgcgtctctacctgggtcatgaggccggctgtcaatcgttttcgccgcggcggatccgctttgggtgcctgaaagcctggcccacgtgaggagatgcgtcgctcccggagcaactgaaatctcatccccatcctgagtggcctcttttctaggatcaagatgagtacactgcagccgagaacaagagccccagaggaactctttgtcccacaggagagcagcggatccacgccagagaagatgcttgtatcttttcacggctcttctctgagaaatgaagccacaccacgatacagtcagcaagaggaagccgggaatgggagatggcaacagtccctgtcactggaacgctggcctccctggacaagccaccctttaggaaccccaccccttatgtctgtggcggtggcacggtgctgtatcctgcctgggctctggcctctactctctcctccctctggctctgcctcccctgtttctcaggggcctggatgcctctcgctctggccaaatgccttcaaaaaagatgacttcccagtccgtcagggagacacttcctgga

SEQ ID NO: 667 - DNA, 1368338 bp, Homo sapiens
tttgaaaggctgcatgtactcagaagatttgcaagcaacactccaattcttgtcatagagctcgcagacttctcacttatcggcttttttccttccttattttttaagaattattcttattttcccctctctttttctgctctctcctctctcagtctctccttttctatctgcctcttcatttttctcctagtctgtttttttttttcctgctctgcacctggattgtatcttcagcaaacaatcgggcactttgagaactaactggagacagtcttgtagggaagatctgtatggaattatctgcttttatggtgaacttggcatttgtgaatgggaatcttgttcacaatattaattgctagcaaaaacaagaaaaagaacacaggagtaaaacgtggatttttctgaatacgcattgtgatgaccagcaattaccttaccgactaatatccagaggagaataatttggaagactgttgtgggtaaggtcattttatatatgcaaacccatcagtggcatgagcaaacttgggcatttgtaatgggaatgggtgacttgaatgattgctgcatcgcattgatggctgtgatgtggccgttattggcactgaatggaataactgcagttgggtgtgttgatatgtgtgtgtgtgtgtgtgtgtgtgtgtgtgtgtgtgtgtgtatgtgtgtgtgcgtgtgtgtgtatatgtatgtgtgcccgtattctgagtgcaattgaaaatcaaagtatcactctctcccccaattattttgatatggaagagtgtcttgaattaattctgggtagacactctttgtttgaatgtaatatttgtggcccctgcgttctggaaggggtagcagcagtaaaagaaacacttagtgaagagccccatttaaaatgaaacgagctactctctatgcattaaaagaaatatgttttcaactcagtgcagcattctgctgcatttcacagccgcaatgggaccagggacatcccacttgtcaagttcttaaactttaaggtgataatcatcgttaattgttctctaggttgtggttactggagattattaagcgccctgggctacttttttatctactggattatcactcagagtgaaaaaaggaaaagaaaagaaaaagctaaaaatgatggctaacatagagaagaataaggcaacattatcttaaatatcaccacagtgctttctttctcaagttcaattgcccaataatataattatttacccaatatcctaaatagctgaagctgagacccacgtgcaggggagtcgaaggtctgaaagcagagaccgtccttttattgcaatgcagccagcttgggaaatgcaggcaattaattacatacttcccctaaccttaagttgaagatgtgtcctgtctgctacatctattttaccctttcggtaaaaagttagagactagaacactaaggatgtttaagcatattctgcctgggaaatgggataaagaaatcaatattgatgacgtggttcagtgcactgtactgcaatgctaaagttccatattcagtgcctgtgatgagagagtggagcatttacatatgttataaatctcacctggtagattgatccaaaggggaggggagaagatatgtggatatgtaggaagatggatggaagtcgtgcataatcggtgattatgtaacttcattacatcagcgagtttcagtcaacgatagtgagatgagatgattgtatagagagaggctccatcaccctgttaacttttgaaggcttgtaacagctaacagaggaggagggcagagagagattagctccaagggtcctgtaaaccttgatctctatggcaaattttgcatgagttttctcatagtgagtttcggagggacatcagatcatataagctttagggctggacaggaccaattttagccacacccgtggagagtcaaaatgagtctgcgatgtttcagaagtgccccattgagtaactgggactgatgattccagccaaggtcatagttctttaccctaggattgaaatatatgaccccaactgaatggaaagttaaattcattgaaatgatgactgtgaacggaatgaatatttagggtcctttcttgcatttttcctggtagagcttgatgcagatttcagcctggtggttccctcataaaaatgatgattgcttccacagcgtgtcagaaatgactgttttgtccctttatcttaaccatgacaatctctttctgggccattttaaccttctgggaaaagagaagtaaaagcattcaaaggtaacagtaccctgttaaattacaaattaaatggcactggattcattattaacacaaatcccagaaaaaaagagcaatccatgttcaagtttcacttattgaatggcttaaaagacaggttgcagctgccaaagacttttaccatcatatgagataaatgtactgtgctcactgtgcagagaagggaatactgcagaataaaatgtcattttccctcatgttttatctggagttgtgattttttttaaagaagatacacatcaggtccttttggccttctactgttttaggatctgttttctcctcaatagatcacatattcacaaaaaatgaaacttctgaaatcctaaccctgttcagttgaatcaccttattatctagttgtgctatttcctatttctctttacatttattttacaaagagggctaaacgacttttctgtcagggagatgagatgatttttttctgtttttcttttatttctcatattccatttccttccagtcctaaggagtaagatgcagaatctagacaccctctaagtaactttgaaaagatttgctcaccctgagtcagaatggtgggattggggaatgaaattctaaggtctgatatttgaggtgactttcatacttctgcaggacatgcacaaacattgatgtattgtgccagtggattgggaggtttggcgttcatattgtgtaggaaattgaatgtgaatttaactcctgattccttccttcaggggtcagggtagcacaacagctgcttccaggctgttggtttccaactatgtgcacaaatatagtctgtaatgatttttcctactccttctttcaatattttataaatgacttcctcagttgttttctgacgtaagccacacatatgttaccaagcagggcataggttttctaagctcagtaggagatggaaataatagcaggatggaaaaagattctgtacaaaaagacactggttgtgaagcaaatatacatatgtaattgctaactccttacttgaagactgcatatacttctattaggaaagatagtttcaatcatgttaatggcactttataagctgttactttctttaggaagattatgtaactaaggcaggttatggcatttttcttaagtatcctacacattagtaataaaaagctttgtctaataggaaagcatttaaacatgatggcagtgggtaatttgaaatgtaacatctattttctattttatttccattttgtcagccgcagtcatgtagttaggttagaaaatatttgggaaaaaaagaaataccatttatgaatatgaaagctatcaattttgcttcctgaccagttgcttcagcaaagtaaggagatttagcagataagtaatcacggtattcctaaaactagagaaaattttaaattgaattttcattatgtttgcaacatatgtgaacaaatcagtattacttttaaaatggctattagataaaacattttaaagaacagttgaactttgaagatttatatttcagaatttgttagtttgttacacactgaaatgtttgggatgtactttgacttacaacagatatgatgtttggtgtttggcaaatcttgtgtttttataaagcagactactctataatttgtagcaacaaaacaagtgttgattattgagatttaaaagtagcaagttttctggtgatgctcaagttataaagcataattataattgtaccggttgggcagctataggtaaggtcgcgtcagcctttttattactaaattccaaccctatttccattaggtttatcgggaatctcaaagaggagagtccagttctgtgagacatcaaggcattgtagaattccgggctgagtcagagggctcgaaactgtacttccggctctgtcaattactagccttgtgacctctgacaccacatttgatttctcagtgttccagagaatcattttttaaaaaaataaatagttgcacattgctctacagaaaggagataatatgtgtctaagtacttaccaccatcctatgccttagaaatatatggaattattattaaggattcccttaagtcttattaatttagctgtgcatgttttttacacccttattgtaaatctgaataggtgctttctagtagcaattacagttagctgtacataatactgttcagtgattaaccaacaaagacaaattaaaagctttgttggttaactttcactcagtactcagttttttccagaagtactcatatgggaatatagttgtcttaagtaattaaaaaaatagttgcttttgaataacattcaaacagtggtaactaagggttttatgtgtgagagtgttttctgcagattgctttttaaaaaatgcttctgagtacttaggagtttctgtttctgctaccaagagcacacaaacaaatgtacacaaacttgatgctacttcacagactgagtacattgaccagaaagtgactcttgtctttcagtatattaacaaaagcataatgagtttgaataccaagtgtaatagagaaaatgagaatataaagatacccggtctgtttggaattttctagttgtaataattactaactttctttagggggaggcaatcccccatgtgtcactactaaaactgcatctctttaatgttcttgtatcttaacagaatgatatttacatatatgcaaagaggatagtttagtgatatgagcttccatgtatgtttttcagtgactgaataatcaggttacagagtaagtttttgtattttggttaaaatagaattggaaagtgcaaaattaaccctgtaataaattagtagtcctgggcttaaaataaagaattttcatgttgtagagcaacctcctcttcgtaacttcccagtgtcttgcttttcttttcaaggattcccaatatatttttgtttcagatgaatttcattatgcatgtttatctgacttcattgatgcctattaatagcaagcattttcttggtttcctatatttaaaaaatgcatgttctttatgtcttatggcaatactttagatttgctctggcagatttatgaaagaatattgtatgaatgtagacaggcttgtttatttgacaaattcagctaatcaccttacaaatatgcttttaattttcacccagaaaatgccaccctggagtgtcttatactgcatataacattctattacagtccaaccacatggctcagtggacatacttatccattaagtatgcttatcctgaccattggtttactaggaaagatccttaattgacatgctttttggtatccttgtgtagacacaatattcaggtgcccaaactctaaaactcctgtcttttagctacagagaagggatgactaggtggcttgatgttgctttcttatcacatgatctgaaaatcccaggcactgaactgtgaataaagcaaagggagaaagaaaagaaagagaactaaaagaaaattttacttctgaaaattttgctctttcccattttaatatcacaatattaaaagcaatcttttttatcacaagctattcaaatggtttgttatagttactatgctcatatatatcaaatacgataaatggcactaaatgagctgctttgttcttacaggagctacacctctgtgaacataaatttaagagttaaactagattgtacgttgtaacactacgtcaggatattgtgtgtagaatttggacttactgaaaaattgaaatggattgtggattgtaatcatataattatagacttttactctttcgatgtttattaggtatcttatactttatttgaattataattataataaatcagcatatggataatcataaaattattcatagtagtttatcttcttatgacctaatcaaaacgagttaccttatcgatgttttagattaatatgtatgacttggtatagtgatcttcatcattttctggtgcaaagttccctttttaattaaaaaaattcactggaagtccacttagtcatagttatactttcagtatccattaattgagaaaatgcatgataataatagtaaattattatgaatataataactctttaaaaatgaatttatgtatagtcacaacagagtctacttatatctttgaaatgcatggtttattctatctacatagaaagtttggtgtttatatagattctagattccttggagtaactcctgcagctgtagtaaataaaagatccatatgtctagaggcaaaatacttgcattacatatacatattaatcatgttcatcttacagagaaaatgaaaggtaagtgcgtatggtggtggtttgtggatcaaaggagttgaatttcggtatagatggacttaagagtatataattttctgaggatgtacatttagagttccaaaatattcccattcgagttttaggattcaacagttgtaatttaaaattggttgattttggaaaataattgcttttttaaaaaataaacattgtttttattgtagccaaaataaaaatgaattattataaaagccaaaggtgatcaaaatctcataaaaacctaatagaattatatgcattataggagtaagggatgccccattatgtgattttaaacaaggaatttgcaaaccagagaaatgaagtgaagtttccaagatcttacaatttgttggctctctcatgatgcatgatttcagttccttcatataagccctcagctgggtgttctagttatatagcaatatgtcctggcatacagcattattttttattagtacagctaatgttggcatatcgaatcctttggcctctagcttactttaccgatttgtgatcagtcgtctgacttctgcactcagaatctgtggactttatttttcctttacgcacacctgatttttgacctcatttgatccctggagacacaatacaaaggagagttgagaacataggtcactggtgggtcttcttgtcttttccatactgtgcttttcccattagctttgtatctttccacctgcagggaattgctcttctttggagcctctccactttctggactttcctgaacatccctggccatctttgtctcagtgctgcatgctaccttcttgcttccaggggattccactaaggggtcctatcaaaatatcttctagctacactttatcccactttgacgatattgaatttcatatttcatttcttcatcaacagggtcagtctgcttacataaacaatagtgaaccaattttggaataatgaagacagtaatattttatcaagtttgccaagctacaatcatataactactactaaatgaacaagatacagctggtgtgtgtgtgtgtatcctcatatcctaatgactgcattaatatgtgtatccacacacatacatgatttttgttgaaatgtttgacaaatgaatcatcgttaatatgctaaagaggaaagtttggaataacaggctttatccctttgtattataatagtgacatttctagaaaagatgccattaacttctgaccccgaaaaatagcttgaaaggactgcattttagatgataaggtggagacagggctgtggaggacatacttttgttcaggctgaatcccgcagtgccctctagagttactgggtagggagctggtagcatacctgtatgaagaaatgacactggctatgaacactatgatgcttacaacctctctgccaactttatttcagaagagacacagtcaggagagctaaatacagtggtaaaaatggaaaaactgagagagttagaatggtatcaagtattttgtgtaaacaaagcttcatgtggccaagggagaaaatttgaatgtaacaaatggatctggtagctctcagtgtttggtttttggatacccctattaaagctcctaattgttctcaccatgacagaactcctgaatggtactcaagaggcacccagctccacagtgtgcagagtaaatgcattcaagggatctctaggggtttttgactctgctgttttttcttgtcgaggttctcctacagggcccttaataacacagccacagagcaagccgcttatgtcagtgggtgtgctcttctcaatgagtgaatggtttagcttagctctaggaggcaagtgcctgctggtcttgtatttccagggcccaacattgtgcacagcatatagtaggtcatcagtaaatcattacacaagcaaacgcttaaacacttacggataacaggtcagttttagatctgtgttctccaaaactcatgctacattatacgtagagacaaaagcttctgatttaaaaaagtaaaaaaaggaaaattgagtaataaaggagagagaattaatattaggtagtttaaaacctacaaatgaactgaaggagaagaaatcacctgcctgcctgtctccctccctcccttccttccttccctccctccccttcttcttcctttcctcccccttccttccacctctatcataggtatttaagtgccttcactgttcaaggggatgcaagagggactgcaaaggtccctccctacagagatgactgatgtcatgtgtctgggcccaaaaatggtttagttagggatatgactactaaacaaaatcacatataccgacatcccttggtgtccatggggattggttccaggaccccttgtggacaccaaaatccacagatgctcgagtccctaatataaaatggtctcgtatttgcatatgacctatgtacatcctcctgtataaattatctgaagattacttatacctaatacagtgtaaatgctatgtaaatagttgttacattgtatttttatttgtattatttttaattattttgttgttctttttaaattgtttttaaaaaatattcctgatccatggttgcttggatccacagatatggaaggccacctgttattataattcaagatagtctaccatacatacttctaagagagatgccaagtatgctatgggctcaagaaacgttcaggacacatgcacgtagagggattaggtgaggcttgctgaaggaggcagcctttgtattggactttgaaggagttaacatgggtatggagatgtgaccttctaaatagaggggagatcaaaaatatactgtaaggaggaccaaatggagcatggttaaggaagatccaatgttcttgtttccccagagaagggggtatatgatatgaaatgtaagaagataaggctggagccctgagccttcatgtctggcaagcaggagccaatggaatggtattgcatgagcttaaggaaaacagaacatttcatgacccgctcagatttatgctttaggaagaagggggatgaattaagagtgtgtatctccaggttaccattgatttcaagttgtgtgaatttcccagtgactcctgagtttcacgcttattccaattttctcatgtagaaccccaggcctcaaacaggcatcactggctctcttcattttcctctttctttcttcctttcaaagaagaaactgctgggtgcagtggcttcacgcctgtaatcccagcactttgggaggcggaggcaggcggatcaccggaggtcaggagttcgagaccagcctgaccagcatggtgaaaccccgtctctactaaaaatacaaaattagccgggcatggtggcacatgtctgtaatcccagctacttaggaggctgaggcaggagaattgcttgaacctgggaggcagaggctgcaatgagccgagatcacaccattgcacttaagcctgggcaacaagagtgaaactctgttcaaataaataaataaataagcaaacaaaccactgctaccagtgctggataaatacagaagccagagtttaacattagcttttacttttttcaagcagaaggcaagattctgtaatggggctgatccattcaaactatccttgcttggtagtattagaaagttgccacacactgtagcaacaatgctaagatttaagtaactctttaatgagtacactggataatgtttaaagtttatttctttactgtgatggcaacagcaaagtgactctaaagtgacaattcatctggaagaaagaagttgaaggaagcaactgggaaaaaagaaaaaaggaaagtgctttatataatgtaatgccaaggtggaaatatagatttcaaaatggttttatagtaagatcatatggaataagaatattgctttcgagtagaatgtacattcagtaataagataataggatttatttctaacaagtgtgaactcttttgctaactaccaataattataacaattttgaattgtagctggaaattggaaagtgagcctcctagtaataaaaaatccccatgctagtttagtttaaattatttttcttatcaaatactttatctacacttctaataagtggaagaaaagaaaccagtaggtatagttttttttcccatactgtatctgatcattctatattggaagatgtagtaagctggaaaatagccaaacgttgaagacaaaatgagaaaaaatgcaatttacttaggcacaaactaaatgttatgtacatcatccttaggattcaggtgaaagaacaagtctcacagtctagctgttgtcaaaactcactcccctatccctgaggatcctgattcggtgtttggaatgcagtatagaaatttgtaggtttttttttttttttttgagatggagtttcgctcttttttgcccaggctggagtgcaatggtgcaatcttggctcactgcaacctctgcctcccgggttcaagcaaatctcctccctcagcctcccgagtagctgggattacaggtgtgcgccaccacacccggctaattttgtatttttagtagagacggggtttcaccatgtcggccaggctggtctcaaactcctgacttcaggagatccacccaccttggcctcccaaagtgctgggattacaggcatgagccaccgcacccagccgagaaatttgtactttcaaaaacatttgagggccaggcatggtggctcatgcctgtaaccccagcactttgggaggccgaggcaagggaaacagcctgagttcagcagttcaagaccagcctggccaacatggagaaatcccgtctctactaaaaatacaaaaattagctgggcacattggcaggttcttgtgatcccagccggctactcgggaggctgaggcaggagaatcgcttgaacctgggaggtggaggttgcagtgagccgagattgcaccatgcaccattgcactccagcctgggtgacagagcgagactccatctcaaaaaaaaaaaaaaaaaattgaggtcagtaggatcaccaagatgttccttgggagggcttcagcagaaacctctcagtctctgtcagtattactttcctcctggcgtcataagttacaatggatattggatgctttcttgatgttttccaaagtgcccctccaactcagcttcaactttcaagtaataagtcatttccaaccacaatggcacagggtaggcccctactatgctgaaatcctcacactgccactgtctcagttgattatcatgcagcaattgtggctcattgtgggtccctactaaccactgtccttcagtcctattacgtgatcagaattgccccttcccatatgtattttaatgaactccttcatgtgagtgaatgagaaatactacttgagggccctatctgttgtaagaatggtgcttaacacaggctgtagatgctcaagacagttcttgccatctaaagcttatggaccagtgggaaaggcatatgtgttcaattgggctccctggaaacagactccgagatgaagaattgcatacaaaagttttagttgtttctgaggcagagaaactgactgcaatgtggttgcagctggggccccagcagttccaatgagaagttctaaagatttgatggtccttcaaaattgtctcacattgagtcaagggggttggggctttctgttttcacgtcaggcagtgactggcggggggctgccccacaggaaggagcataatgttgggaagacagttacttgcagctgagggtaaatcccgatgagggactcggctgtgagccaccaacggcaggatgggtatacaggccattaagaggggaatgaaagttatttggagtctctgacaagatcgtattttttctctcaccccttgaggcatgatgcaataataccatatgaaattactgaggaaatgctgtgaaatcgtaaacatttgtttaaagagataaagaaactaaatacaatggagtataaggccttgctctatgtagttttgcttcagagaatgtgattttctcaggaatgtagttcaagtcacattatagttactctgttgtaagttaccaggccacaaatatctaatgagcacgttctatgtgtcctggacttccagagagagagaggaaaaagtggaaaattcatgcctggagaatttacataggacctttttttttttcctcggtggttcatgtgcctgattttgagtttaaggaggggatttgggggtgggggtcaaggaaggggcaaggaaatggaacagagtagagtggggccaagttttctgaattccaaggataataagacaattgtttgggttgtacaggaccaggctacagaggaatattgaaagttggcggaaggcacagacttgatgaactgagtggtagtggaataagtcgaatgtagatttactggtacagaacagacagtgaaagcagtgtttcattagcattagccagtctatgatttggactggaggggaactagttttgaatacgatgaatttgaaatcatcgaaataatatatcctagagttcaattttcactgaaaggaagcatttcatataacactattcacttttatattatgtggaaatattaatttccttccttaatgcaagggaagtgacattacttagatttttaaaatgctttcttcaaccctagtgaggtaataggagcaccttctatttttatcctataaagattttcaatcaagttaaatacactgacacttaattttgccagtaagtttttaaagtactggctgtgtctaaatgggcaaccattcattaaatcatagaaaaattgaatagggatgaactaagtacatacctttacagatataaacatctctcggccaggcacggtggctcatgcctgtaatcccagcactttgggaggctgaggtgggcggatcatgaggtaaagagatcgagaccatcctggccaacatggtgaaaccctgtctttactaaaaaaatacaataattagctgggcgtggtggcgcgtgcctgtagtaccagctactctaactagaggctgaggcaggagaattgcttgaacctgggaggcagaggttgcagtgagctgagatcatgccactgcactctagcctgagtgacagagcaagactccatctcaaaacaaaacaaaacaaaacatacaagcaaacaaaaaatctctcaactaccaaaaaattatccattaactgatattcactttaataaataaccactttggcaattttttccctcacttgacctaacattgactagatggtcaactcaattcagttcaacaaatacttccagatgatccacctactccatgcttaattcaagcacaaagctagaatgaggaatttactcattgccacagcaactgaggatgcacattgttaagcattttaaaagatctgtcttaaaaaaaaatagtaatctttgctaccagcacctagcttgctttaaaagcatttgttagattccttctctggctttggcttggtttttttggaataataataataaaaaaaaaagttggccaggtatggtggttcatgcctggaatcccagcactttgggaggccaaggtgagtggatcacctaaggtcagaagttcgagatcagcctggtcaacatggtgaaaccccgtctctactaaaaatataaaaattagccagacgtggtggcgcacgcctgtaatcccagctacttgggaggctgaggcaggagaatcgcttgaacctgggaggcggaggttacagtgagccgaaattgcaccactgcactccagcctgggcaacagaacgagactccatctcaaaaaaaaaaaaaaaaaagaaaggttcatggtatttttaaaagaccaagaattcaatcaaggtgacactccttttccatcacaatactctacttgtgtgtatggacctatatattttattgtttcaaatacaaattgtgaagcttattaaggagagtccaacatttctatatattcactagctgttttttcattaaatataacttcaaggctccaggctcaaaaattgttccatttttactgattgcatcatgctatttgtgcacagcacacttttatttttgtccgcatagatttgaagcaatggtttttttactctgccacacaatgccacatccctgacagtaggtaagttatgttcttttgcattttttactcaagagctatgtaggtggtatgggagatgagtggcggctattggaacagactgtgcatcagacgctatttaaacctcatctatatgtgcaagttaagagttactatttcctgtttccaaagtgaaaattagttttaatttcttaaatttgtaatcagagaagatgtgggttattgttctaagcatcttctttggactcttccaatgttttggtagcaaagattcaaatattagtaagtctaaattcatcttttattaatttgggtactcctgctagcccaatcttattatttttaatattagtgttaatgttactattggctatgattacaaaagtataaaaataatatatttaataaagcctcatcatgtggcttcagtctagttttgggaacctgaaagatattatgaaaattaaaggtttagtattgcttcattgaatcattacttaagtcaaagatgttaagcagacttagttattatgattaaatcctttccactccaagaattacagtaccagaaatgtgcaatttgtatacacacaaatttactttttgagactattgaaaggtaattggaaataatttcatacctgaggacagtctcttagaaaacatatttgtgtgagtccttgtttatttggatcatactggagttgtaggcaacatatttgtgtgactaatatcatcaccattgtctccatcataatcattatcaacaagctggtattaattttaaaagtgttcattatacaatcaaaaaagaactatataggacaggaccctgactattgaatataatgagcttgaaccaaggattatgtggcttgcggaaatactgtgaggtaaatgaattttgcctgtgacatacttctgtgttcagtttcagcaactcccacttcgtttgaatcccaaatgctcacgtgaataactttagtttctgaatgctaagagtattctgtcacagagaagactgttttcttaaaaatatatgctcccaagctaccactagctatgtatttttctcatcaaatttattatttttaaatgtatttctttgtgtcttcctaactttagtataaggctgagaggatatgacctcatttatctggttcaccacatatctttggtgcccaggagagtgcctgtcacattgtgcaatttagttcaataattatcaaaggaaggaaagaaaggaagaagaaagggagaaagaaagaaaagaaagaagaatctcccgaggtgtcctggtctaagcaagataataggagaaaagagagtttgatttaaaaacacactaagcctagcttggtagatatatgacatttgcattgtaaaggtgttgttcatgatgcaatgttactggtatagtaaagttagcgtttattccatccctcatggggatgggtacaggtatatcacatgctctaaattgccaggtctgttgacagaatgccagaatgccaagctgatagcttagaacctatagccaaagattttggttgcatcaataatgcagaaagcgatgtcttaaggaccattattctgacagtatgtttttaaggtgagcaatgccaagatagactgaagcctacagttagatggcactatatattttataaattacaaggtgataaaagttctcattgttttagcttcttagcttttttccctacttttccctatatataagtatccattaagaagaagctttaaaaaaacactaatttcatttttatctctttcatagtatcaatataccttctcccaattgcagaagacatcatgttatactagaattcacatttggatcaaggcaagtgtgagttccaattttggctttgacatttactagctgtgtaaccttggataggttacttatgtttcagagtttcagtttccagatctctggagagaaaagaatacctacctttaggattactggaaaaagtaaaaattgtatttgtaggccaggtgtggtggctcatacctgtaatcccagcactttgggaggccgaggcgggtggatcacgaggtcaagagatcgagaccatcctggccaacatggtgaaaccctgtctctgctaaaaatacaaaaatgtgctgggtgtggtggcacgcacctgtagtcccagctacttgggaggctgaggcaggagaatcacttgaacccgggaggcggaggttgcagtgagccgagattgcaccattgcactccaggttggcgacagagcgagactcaaaaaaaaaaaaaaaaaaaaaggtatttgttaagcatatcgtgcagtgcttgacaaatcatagctacataataaatgctaatccttattttaatattttaacatgttatattaaaatataacaggaatattctttagttttctccctgtacccaatggtcaatattccatctttatcatacttgacctgtgggtaacaattgcacaatggatcagtccttgtccttgtttatttggatcatacttgacttgtgggcaacacttacacaatggatcactcctcctcagtacattttctttacctggctttggggacagcacaatctcttggtttaacttttttgctccttttaattctttgctgggaaaatgctccatggtttaactcttggctgtcttctcagtctacactcaccccttagtgatttcattcactcactctcatggctatcagtatcctttttgtcaccacctcttaaatttatatctaccttggtaacttttctgatttccaaacacatatatctaaccacttatttgacatcatcagctatttgacatttgtcacttactttgtccaaaactaaacttcttttttccctcccaaatctactttgttcgcaattttcccatctcgattgatgtcagtttcatccttgtatttgttcagacccaaaaccttgaaatcactcatcatttctctccctctctcacaaaccacatccagtcatcaagccttgttggtactatctttacccagatctagaatttaaccacttctcatcacctctactgctattatcctgtggaaccctccatcatctcttttctaaattactgcaaaccgccaaactgactctatgcctctgttattgttttctacagtctgctctcaatatagcagctacggttgccttttgaaaatggacaggttgtgtcactctacttttcaaatccctgcaaaggttgctgattttacttggagtaaaagtaaagttcttataatggcctaaggaaattcgcctacattacttccttgatttcatttccccgactcattctctcttttctagctctctcatttctcaccactctcaacttgctgttctttgaaggtgacaggtaagttcttgccataggaccttttcactggctgttctctttgtttggagcattatttacccagaagtctcaaggctaacttcctcacttccatcatttttggcttacctgtcatcttctccatgagacctaccccgaccacaccctctaaaatttcaatacactcacctccacactcctgatctccttatctggttctactttctaattcttttaggtacttcttaccatgtaacttttttataagttatttattattcttattgattattgctagagtttaagctccacaagagcaaagatctttgtccttttagttcactgaagtatcccaagcactgagaatgctatatgtaaatttggtaaaataaatattgttgtaaaataaagataattttcttacctagtgttactattgtgaaggtttaaataagataatgcagttagagcattttttcacagggcctgacataaattaagggcttaataaatggtcgccattatgaagtgtctcatggcgtaaacacacatggtatacaccaaaaatcaaaagtattacagcatgaaccctttttctcacattgaagttttaccaataccacaggcatataatatcttctctaggtatacacaagcatatcttattgtttcatgctcatctagtaaagataaagatatgctagcattcagcagtagctgacagttcacatatgtcagtgaaataaattgacactgttcttttttactttataccaattaaacttcatataatttaaaaagttggtgacaaatattctctaataaggataattttaaaaatatcactataagatgatattctctaataaggataatttttaaaatatcacaataagatgatttataagattcctgagagctccctaagaattaaagagctaacaaaaaaatgatattcccattatgcattttaatgaacaaccaattttcttctttttgtagatttcaatgacaacttggagagttcaacatgtttaacatttttgattcttttccatgttttataaatagaaaaaaataaaaatgattgtaatgaggtattcttatgtgcatcacaaatgtaggttttagtgtgcgggattcaatagaaaataaatactttctttttccatcttcatttgtgaaaatactgaaaaatagttataacggaaagtcttttgtaaatcaaaacaaaaagtattatttctgaatactgaatagatgttctcatcttgtctattgcctgatcatctagttgcttagtctaatcaaatacatttattcttctatgtttcattcgcatagcttagtcttttccagagaatttacgaatgttttactgcatgccaaaccttgggtaattaaagtcgacgacagaatgtgcccatagtttattctgtagatctgactgtagatgcagaggcttacattacatttggggtgaatgataagcttatattattttcttcttctactaaaaatattttaaagatatagattctagaattcactaaacaggtaatttgtgaataaatatattgccattttttaaaattgctcttttgttctctcatatgttcatcatgcagcttaatttcctttctccatgtttgggatggtcaggtagtcaccacttcccactaaagttcgttaatttttcaaccaccagaaaaaaaggtgaggaatgaaagaaggagaggaaaagagaagaatggcaaactccacgtaattgcctgaatgctaccttagatctaaatgttgtaagttttcctctaacattttagaaagaatcactttttttcaagcatttttattgccactcgtgcctactttactttgttactcctctgctgcttgtgggtggatggaatttgactatttcagaatagttactggtgggtgggttcaagaatctctagtgggttgaggaaaaagccatgtttatatagatagtgatccttctattaaaatcctaagagtgagtaatatttaatagctatgttcaccacgcacatagcagagtccatctgtacagaaactgagggtatctgaaaagaattccacgggagttttggcttcctatagagtttgcacgcagaggctctaatctcccaaattaaattttgtgacttgatggatagacaaggtttctttcctgagggcatgacatggacctggatgcctactggtctatacaagtgtaagatgctatgaacctgtcaagacttagctttcccactatagtggatcataacacacagctttagtgccttgtgtacattgctttgactacagatgtaaaacgtttaggttgactggctttaaattgtgggtagctgtggtaagggtaatcacatgatctacttagatgccaagtgagtgaattctcttctttgatttgaaatccagttcttttatatatatatttgagtacagagctggtagcagccagtgatgcaatgtacacattgaaagtgccataaatttagagatactttctgtatggccagaccacgggaaatgacaggcctttcaaactatagactattttagatgattgttcttgaaagaccacttcacttaatgtgatatttggattacaataaattctaaatcattgtgttctcatttctttcttttctatactgaagaaaatgccttaccttaatctttaccacttaccttaatcttcagagattgagtagtcattgatgttcattacccactttattgcagcaatgctactatcaaagcatgagatttgggtagctgcaacatgtgtacagctgaattctaagttttgcaggcagaacaccagtggtcaaattacatatattgtgtcataattattaaaaaatgtaacatatgaggacaattaaaggtctaaataatttgagatagacagcccattttaaaataacattttactttcattttattggcaagttttaagaccaaaatttaaaaggaccaaaaatggacataatttagatgtgcattttaatgaagaaagagaaaatgctaaatgatttggaaaaaaaagatatttagcatgatgcaacttctataaatgttttttttctcctgttctttaaagaatgaaataaagttacatgtaatggacggtattaaattcagactggcattaagatgtgaatgttttaaataagtgacatattttaatttgaaaatttgaatctaatataaaatgcaaattgcaatagcccttaatgtagaaaaagggaaaaatgtagtgattgagtttgggggaattgtaacttgggcagctctagccagctgcaatgatgaacaaggcttcctttattattgcttcaagaaaagctattgagtgtctagcacaaagtagctgcttgaatacgggaatatccaatatccctttgagaggcgtatttgattatacattttccctttaccctcttgtttctttctaactctccaagttccacaaaaagccccaagatcactgttgttattatcattggtgttgttttttgacccagaggttataccactgacaactactgttacctatgtaaaatgatctctatcaatctttgactaaatttatacctgatcctgttgttcttttgtttaaaatcttcccataaatctttggtccttacaggattatctgtaagagggttagcctggcaggcattttttttttttttacaatcagattcaacagagttcttttttggcttcatttctcactttgatcaaaatgacttctcagcatgcatgttcttacacacacacacacacacacacacacacacacacaacatacctacctctctgatatatgcttcctattaatttctgcctagaaaactcttactcatcctctaatacccatctcagatatatctcttgttttaacccttccttaatgtctctggtagaatgtgttatccaataaccctccctgtcccccgaccccactcaaccccaatgatcagagaacatattcctgttaaatcacctattttactgaaattatttcatttgtctctctcactttttagaatggaatcttcataaggcctgagatgctatttatttagctctgaaaaaactagccttgcatacaagtcttgtcataataagtcctaatgaatagttgattgactgaatgaacggatcttcacttgtggattttgcacaacctacagttgtgggtgccaactcaatgtgcagagttggaagctgtttgtagctctgccagtcagttttatgttctgccagcacattcttggttgttgtacattccccactgataggattttacccaacagtacttggcttgattacagtgttcaaaattgtttttcaccatgtctgggtttttttcccctactcgacttcattctctcagtttctgtacagcaggcttctgggacatcctgttgttacccattcccctcctgtacctcgcccatccaagtaactttgtgaggaaaggctgggagactggccaatttccagcatcttgttgctggtgatcctgtattactgtaggcatataagtggtgaacctgggcatgctgccatggctagcagtgaaggtgaatgcattccggtgccaataagggctaaggcatggaagtaaatccatgcagaattgactttgtcagtgctttctagtaaaggaggagtttatacatggaaagtatatcggtagcagttagcatcattttgtcccttatagttctagatgaaagaacaccaatatttttttaccttaattgcctagtaagaatctgatgttcgtagaaagttctgtacccttgttgcatttgctgcctagctcagctccgagacaggaaactgaattaggtatacagtcctagaagtcactgttgctcaaacttgaattgcacatggatcattaagggattttaattcagtaggtctgcggtggagccaagattctgcatttctaataagctctctggtgataccatgatgttgatattgttggtctgaaaaattcacattgagcagcaggatgtagagggcagagtgagctctttgacaagcagtgccagctaatgcgcgtaccctctacatcttgagtgcctcaacaatgccacaggatgacagagcatgccaaaacacaaaataaatcagttccctcatcaccactgcatgttagttcagaatgttactgacggtggtggaagcatccctgagttagtgttctccctcccacagagctcatttagattctttgtggagaagggaagaggttggcttccccaccaaatctttgttgaaaatgatttaacacattaaaagagcaaatcagtatcttaaggtttaaacttcttagctgcagaggaagttaagttcagttcccaaggacttaagggttcagtgaattttcaccaggttcttttttcacctaaacttcaagagcgcggtaggagagccatcatttattgagttcctgctatatgtgggcactgtttgttaggtgctggaggtacaaagaggcatcacacataatctcttgcccgagggagtttacaattgactccattaaaggttcaaattttgaggataaaggtgtgtcttatttgactttatatttcccaaagtgtaaaattaataactgcctattaactaaaatgttgctaaaccacagcataagaagagtgtattttaaggctaaatcatgccacaaattatgacatggttagtatagttacaagtgacaattgcatgccatttccattctgtaaatcagagcttcctaatactgctttaaacacaaaatgtgccgttgggcaaatgctgtattagcaccactagtactctgtttttcaaactgcaaagggcatcccagagttttaattttgtttcttggtgtaaatttatatgttctttggataaccacccaatttgtccatgtagccaagcttctcataggagagatgacagaggggaacagataactgtagaacacaagataaaatatgatgagggccaggacactgaaacacagataacgtaggtatcaataaactactacccatgacccaaatccagccagccacctgtttttttaaataaagttttattggaacacagccatggccattcatttaggtattatctatggctgccttcatgctacaactgcagagttgaggaattgcaccagaaaccatatatggcttgcagaacctaaaagctatgccttagagtctaagaagcaggctttctaatatttgtggggtcagggcaagaaaacaaaaagataccttccaactatgacccgccactctgctgttctcaccctggctctgtcctgcactgcgagaggtctcaaatacaccctacttatatgtaagttccatctactatcctcacactcctgcttcacaaacacctgtatcttgaccttctttcaaagaaaggggtgcacacacaaacattggtgtctgccctcagaaagtaaaccaatggaagaggcccatagaggccctagaagtggtcccagggaccccgggcggggcgttttaaattttggggtggcagatagtgttctgaaagataaaggacaatggctttgggcaggcacacctccttggttcccctagactccttgtcccatggctaaggcatggcaggaatagggccagagtagcaccccctaaagggaggggcaggaaacaggtttctctgcctgagtatgagggtgatattgttaaggagtcctgtttaaattggctaggcaaggacactattattacaaacagcttttagctagtgcttgatgattatgagaacactgttgtgcacaaatggtgaagagaggtattctaaggagaggaaactttatgagcaaagtcatagagatgaaaaagctttaaacactagtagagaatggctataaaagatggatttttacacctgtgaaaatatatactatatcattttatctttgcaacaggctctaatggctagtatggaaacttttctcttcagtggggagaaattgaaccatatattagttaaaattagaacctggaaacctgaatgcttgtttgaatggcaatgctatcaaaaatatcttgggcaaatctcgtaacatttctgcctatcagtttggaagattagggactcttgtcatatagatctatgatgattaactgtgtggagggtatcactgtaaatactaggaatttgttgtgtgctttaaaagtgtttcagtgtgatttgggagagaagagaaagaaaacccagctgtaagttgagaaccagtgctcagctgagataatggctcaggttgcctttattttaagattagacttaaactaaaaatcttctgttaattagtggctgagctggaattagcaaatagtcctggtcctcttgactttgggccctgttgtttgtcctgtgtatcagatttgataatcagcaacatgggactggatacaaaatctattagcctgtgggaaacagggcatgtattagaccagtggttttcaaatcttggtgaaaacagtaatcccctggtgagttttctaaagtgctaatcccttaaccaaaggtgagggactctgattcagaaggacggcctgaggcctgggaagctgcattttaaaaacatcggtagaaatttggataaaggtagtccttgggactcatgttgaaaagcagtggtttagaatgtgctttctttccttttggacagaagctctgtactgaagagcctttagtctgtgaaagacctgagttatttctccagggaaggtgactgtctttggctgaaccatccacattctcttgcccagttcctctgaggtctatggagtgcccatatatgagactaaagttaaggagtcacctccagccacgggacagaaggcagttttctgaccttatcagattttatcattgccatactttaacttgctgagctaaccagccacagttttgttggaactcaccatggagacagattaattttaactctgagagaacatgggcttttcaacacaagttaaatataggctggcacagaacatcacagaagcattaggtcctcagaaattttctttagctcccaaactttgagctgccactaatttatgctactcatactttctcctggtcatttttatgtttttgtcttcctttgatcactgaaacagagaaggcagtacttaacctgctggaaacaggtcatctatgagcatgtttctcctaaacaattacatggaaaattaatggaaagaataggctatatgtcttaggctcttgggcagaccataagctttcgttcttgtttttttatgttttcttgggtgaaaaacttagcttaaagaaatatgaaatgcatttaaaaattaatttccacaaaaccaaagtgctgagatttgaccaaatgaaaaaacttggaggtaaaaacactgcacggttccatgtgtaatagttttttttttcctggaactaaagagagcacacacatattcacacaattcctacctttagcagatatttcattaaaacaccacacaatttaaatgttgataagaccttttcaaatagagaaattaaaatgataccttattaactttcattatagggcattaataatttttgtatttctgattagaatatggatttttgttaatgtggtgattttcagtggcagtcatgttcagtgcaagtgtgttctacaataatattgagaaataggagatgaaagttaaaatactggtgatgatgggccacatatgacctacacgacgatacacagtagtgtttcaaaataccaataatttaataaattactaatactaacaaatctgtgataagataggaatttttagtgcttcgaatattgacctccctaagttacatttcaatgccagttgtacaatactagtattgaactagtgaggataagagtactagaggccattgcttgtgttacagttcacatcccggctttatgacctttggtgacttacataaactgtcgtctgtttttgttttttgttttttttcgggacacagtcttgctctgtcacccaggctggagtgcagttgggagatcgtggctcactgcaagctccgcctcccggcttcactccattcttctgcctcagcctccggagtagctgggactacaggtgcccgccaccacgcccggctacttttttgtatttttagtagagacggggtttcactgtgttagccaggatggtctcgacctcctgacctcgtgatctgcccgccttggcctcctaaagtgctgagattacaggtatgaggcactgcgcctggccaactgttgtctgtttttttttttttttttttttttttttttttttttacctacaaattgaatgaaattactcatagggttgatattaatattaagagagatcacatatgtaaagagcttagtacagtgtagtatagtgcaagtagttaataagagttaggtattagcaatatattatagtttcataatttttcttctaaaaaccaattgccaaaggatgtattcctttagttgaaatactatagctcgattgtgtatataaacatatacattaatttgtaaaagtcagtttaaaaataagtataatggcatttttgaaacatagccctataaataataaacatgcttccaagttctcaatggatgataaaagccatcaacaggcccttgtcctgctgagtttccctgtgaagccaacagctcagccagcccctcaaaggccatggaagcttgaaggtcagacactgcgtgtaggggtcacctgcagatttaactcttaaatgcgagtcgcttagatctgtggctgcatctatttctgtgaggtaccagacgtcttctacatttggaacattgatgatatgataaaggaagtcatgccaataatcatacccaaagctgcttaatgaaaggaagaatggagagtcacacaaacatcacctcttagtaatagaaacttgactgggagacccaagcgaggccccttctaccaccagcattcaagctgcattaaactaaaatgtcaaaaatacttaaataatagtaataataataattgtgtttaaggccatattcactgatcagtggtcctttattgatttagatctttacagaagtggagctcctgagttcattgcttcatccaattcctcgtttttattatttgagaaaggcactcccccaggggatttgacagattcacatatgtagttcaaaatggttgattagcatgtcatatgaaaacatatcagaaggactaagggctcttggacagattacatttgtagttttcctgatgtctttcaggcctatcattttgtcataaaatgaagttgaaagggtctgaatatgtagacttcttacaggctccatggagacttctcaccacttctgttttctggtacgtgcttagaaaacgactatttgttcctggatttatgtacagatcaaagcatcctggctgatttgttattttctagaatttacatttaaaagcgtgaaggtttctatttgtagaaaaggcatttttctttcttttttttttttttagatggcgtttcactcttgtcacccgggctggagtgcaatggcacgatctcggctcactgcaacctccacctcccaggttcaagggagtctcctgcctcagcctcccaagtagcggggactacaggcgtacgccaccatgcctggctaatttttgtatttttagtagagacggggtttcaccatcttggccaggcttgactcaaactcctgacctcatgatccacccaccttggcctcccaaagtgctgggattacaggcgtgagccaccgcgcccggccagaaaaggcatttttctatttgtatttgggtatttttcataatcccttactcattcatcagtttagaacaatatctaactttaattggaatgaatttcagtgtaaattaaacaattgcagcaaaaaaggagatatccataactaaatccacagtggaagacaactaatgagaatgcatagagagctaaagaatacagaactacatcagtcacagggaagtattcaaaaattgtgaaactttacaagtttgtttttcatatcttggcttcaaatttgtgttgctttcctccacaagggatttcaagagatgtttcagagaactttaaaactttcaataatgttttaaatacctggggaataaaaacaaaaccaacagtaataatgttggaggaggaggcagtggaaaggaacagagaataggagcaaaaagaaaaagatgttaacatccttaggtgctacaatggctgattcatctgtagtctcctattataaaatcttatgtggatttgggagtaagccccttactaccccttcccacccccatgccattcctatcactagtctttttggggaagaggctgtcattgacaagtccctactttcgccatactgttctctacagtttctaaattctattaaaatgaaggattgtatgataattctgttaatatttttattcttgaaatatttcagctctgccatgtattatcaatatggccttatctttaaaatgaggatgataataatactggcatcaaggcatgctttgagaattaaaagagtcaacccaaatatgggacctcaaatatagcctttagcaagcagaggctagctcatagagcatgcttgataaatggcaatcctcattgataaagctcattcaatggaatcacttatttttaaactgtagtttaaccagatatgggatcttactatccaattgaacctaggaaatacaaatgattataggcacagcctttccttggctttgtttagaatagttacagaaatagactaatattttggaatttcatatgttgatagattcaagtaatttgaatgggaaagaggcaggagagaaattattattattttttccagtcttgaaatttttcaaagcattttaatattctcaaagtaggaagcctgattagccttatcttcatcagttctttatacacatccctatatcactaacattttttcttatcccattcaaccttccagtccacttgtaaggctacttaaaagatgctagattaaagaatggtttgtgtcatcctcccatgtctttgacatctccatttttcttgaacctacaggggtaagtgagcactgcatgacaatattgagagaatagatatctttttttcacacctgtctcttcaagtgtatgattctgcttatctctttgtgacatttcagtggtatagtttctgcaaacatgattttatcaggactttgctttctgctttagacttgaaagtgaatttcttttgggatagttacatcttacttgttcaaggtgtgaaacataaaacgatatctgatttttcagtgttctactgatacacaataattctaaactgaagcaatatggtactcttgcctcctgcttttatcttagaagaatgaaaattgaatatttgggttaagttaatatacacaatacgtggattactaaagttattacattttcaatatcttatagtgcagtaatacatattttaacaataaagctcttaggagagtcacagtgtagggaagttatcttatctttacaacaataaccattatgtattgctctaacatgactttggtttaattgtactttctgaccatctgggtaacaaaaattattcttattggattggaccaagtgaatatttgatcaagaacaactttaattttcagcatttttttcaaaattactagggaaatgtaattgtaaacatatttttataaattatattttatttcctattctgagattataaagttaacttttcaatttcttattaacagggtgttgagaagccagattccacattaagccacttaaatattctgtgggtggactacagcaggaggtggaggagctcccatgtttctgaagatagtttgagataatattgtgggtggtgaaggggagggtacttacagtgtgtggagtcacggactcagcaagaatgtaatcctgctggctgcaccttcttttcctcacagggaattccaacaaagcaagaaggggtgaagtggctgagaagggccagtgccagtggtatgtgactccaggatctactcaaagaagtttgcaggttcatttgtagactcaatagttattttactcactaagttaaaggatttatgtatccaattttaacagatgcaataaaagttatttacattaatctttaccatatgtccctcttatcctttacattattctatacatttagaaatttataaaaatggtggtggaaaatacagaacatgatgtaaaatgtcaactcttatctcttttaaagaggttagaataggagatggttgattagtgcatctataaaattgtttacctgaaggccaggcatggtggctcacgcctgtaaccccagcactttgggaggccgagacgagtggatcgcttgagtccaggagttcaagaccagcctgggtaacatggtgaaaccccatctctacaaaaacaaacaaacaaacaaacaaaaattagccggcatagtggcacatgcttgcagtcccagctacttgggaggttgagatgggaggattgctggagcccaggaggcagagattgcagtgggctgagatcacgacactgcattccagcctgggcaacagagtgagaccccgtctccaaaaaaaaaaaaaaaaaaagataaaaaaaattgtttaactgagttgtgccgcacaaataccaatggttgagtgtgtcataatacttacagaatgattttgattgtgtacgtttgcttctctttacatgattcatgcataatttacaataagaactaccatggtgagctaaattaagtttaacattttgaagttttcttatgcagtggttatctgagtctccaagttaacttacattgcatttgttcactgtctccatttcctaagtcatattttagtagatgataccatgtagttttgcatttctatccaaatgcattttgcttgggagattagttgtatgaaatattctaaggggggcataaagaaggttctttgatgaaataactttggaacatgctgcttctatgtctcttacatggatattcacaatgataagtataaccaaaggctctgagaagtcctgcagtttaaaaaaaaaaacactaaagtgttttaacccaggattttgtagacacatttgaccataggcactctctttccataatgctttgttatatcctactgaactttgggaaatgccatcttagacatccagtaagatcatatacacttcaaattgcctaagtatttttacagaaataaatctaagaacataaactaaggtttgccagaaatatattacatttctctgttaaataaacgttttccattgcatgtcaatatctcacatgggaatgcctcttgtctccccagtatagtcaccagacagtcttcctctctggagtcctggtttctttccaagaattaggcccccatctctggtcttgccagattttacacccctcaagcccctcatgtcagggtaatctctttctcctctgggcgatggtgaggaagaattgggacgtgatgaggctctgtgagtctcaagcccattggcattcttacttttctaagatattctgcgtcttccttcagacttttcctctatttctttcaccacggattttgatggctcattaaacccagagcctgatttatccccttttggtttgtattcatagagggcttaatccttcaatgctccaagaaggtgagaaagcagattttcattccatctttccaatctagtacagaggaaaagaaaaacaaattcccatatgaaaagagtctgaaaatatttagaccatgatatagttgaaaaggcatcaacttcatttaccttttgctcttacattattttatcttgggcccagtctatctatctcatatcattgtatatcactctcctctttgcctattaatctccatccagaccagtctttaatccactttctgcttttgggccttttccctagctgtcctctctgcatcttccctgctcttcacattggctgtcccttgaaatacaaggcctcattaagtgtttcttccttggagaagtcttctctaactaccagactaaagtatctgactagtccctcacatgacatcttaattctcttaattctctgcagagcacctattgttatttggtattttattatttgtttatctgtttgtttcttccatcaagaatcaaagttccgtaaaagctcggacactatctttctccttctccattgcttccccagtacctaatacagtgccaggaaaataccacaggctacatagataattgctgaatgaatgattgaatatttgacttttcatgtctgttacttccttggttatttcttggcctttttttactgaaaatttcagtcgctctttggaggcattcgttgcattgtttcaatctcctccctctactcctgaccactctatgccacatttgacatggcaatgcaccttcctctttcttacctcaaattctgtggcacttttgaggctctgacttagtcttttatgtctctttgtattatgctaccttggagaccgcattcttttgcaaacttaaaagtacaaattctatggcaaaaacctttctgtaaattcttctttgacacctgtatcttaatcctgtcactcacttctctgctttactgtttcaatgttagcaaaattgccaactaaatctttagtttcttattgttcattgtggattaatattaagtccttaagcagactaggaatgtctttagggaaggaggcataccatgtccattatttatttatttttaatagcacacaacacatttcttgaacttaccatatttcagtggttcaataaatgcatgcatgtccatagatagacaatgtatactgaaaacacagcatcagtattaatttacgatcttagatgagccacttgtattgtttaatatattattggaattaggaaggaagaggcaggtggcagatccctatcccatactcccttacccccttcttgctttaatgtgctttcttttgccagtcttgcttcctattgtgcctttcccttcacatctaaatatacaacgttaagctagaaaagtactataagaatactaaacctagttgagaaaataaagagaaaaaaatataaaccatgggcaaatcgtcttcttgaatattcttctctcaatattttaaaattaagatgtatgattttgatgatctagaataaaaccaatctccctaacatattttgcatatagtatctgttttggccttttttcagatacagtatcatttcaagttattattgcttaagaaatttatgtttgtggtcacaaattcaaacattaccaaattgcaccaaataaaaaaatgaaatgaccttctctggttagattaaacttgtagcacatttattcctctaatatacaaaggttttattagtgaattgtttttttaaaaaaagaagataaatggaatccaacaacagcaatatatattttccagtaaaattttatctatgtgatcataaaattcatttatgctttttattaatcagtgagagaagtaatgctgtcagcaaaagtgggttatagctctatcacaaagttctaaaagcagccatggaacctatgcattttttcatgttttcagttaacattacttggggtataaaatgctattgtgttgtcaagtgaattgattctaatcacagctgttttctgtgaattaaatcaccaagaaaactcaatcaccaaccaaagacttttaaacaataaaatcccatttgtggttgaagatcaaatttaagaacgctactggatattcatttattttgtcacgtttaattttctactctgactctcagtttcttaaagaaacaaatatttaatatctccccaaagccaatatctgctgtgtagtgggttcatatcttagcactgagagttaaataattgtgtgtagaaaaaaataggatatacagtgattgaattttcacttcatggaaaatggcagaaaagctagctatttgcttgctttcattcctttactatttcagaaacaaacacatctctaacttcaagtgaaattaattagttacttagggagatatatatctatatatctctctatatatacctttgctttttgggttgtggcacttatgctaaagttatcctctgggtttccttatatgggtcatgccataaaaatatccatttgagggctgctcaggtgagactctctgagagagccgttatactgtctgtgcatccttcgtccttgtcacatcataatgttttcattcaacctctttgtacagatcaaggagagaattgttatgtatgtataaagttatgaattgttttgtactagcgaccaaactcagggaatttatcgcaacgggtattccataatggcttggcactaggtcagaagccattgtcagcaaatcaatttatgttacttagggtgtctcttgcagcaggacaggcagattcaggctgaaggtgttgagaaggctaaaaccttctcaaacagcagcgatgtttaaagtgtagctttattacctgcatacgtggcactgtgctggtagaaatgagaatggaagaaaaacagaacattggattattggttaaggaatggcattttattctttccttcataagttttatcttaaaccttgaacatctggctttgtgaaattgagccctgtgtctgaatgacacaacagaagagcaattgcaaagtcctgtgttcagacaagtcctgaatatatatctatttcattgtcatggattgtttatcagtggctggaatgattttatatgtcctttaatttaacaagcagtaccaaaagcaaaacagaaaaaaaaaactctttgaggctgcattttagaaattcttcagtgtcatctggcactggggacatttggtatttctttcatttcttgctgctataccctcttacacaaagtcacaggcttaagctgtttcccttcaactgtgggaaggaaaaaaattaatttgaacatttcatatattttaggaagagtttagaaaatagggtcacatttttcaaatgtgcacgtcagttgcttctcctccttgcctttttctatcttcaaatttgttttcctttagtagtttttagttaattgtgaatgtttacagtatggttagagataaaataattctcttacttttcttttccatcgtcacacctgagacaaatgggggaaagcagacttcaaaccacacacgatgtgtttgatttctgctcctttcaaatatccattttatttaccaagaggtaaaaacactctgaaaactggcaacatcttatgtcccacagcattacttttgatgaaatcctgctgtattttagccaaaacttctttagacaaactataactgagtcacgtcgaccctcagatgacatcaatcttcactcctcttctatccaactaccgactagacacacgtacacatgcgtatgcaccccacagatcaaacttatttcattttctctacctgttggtcacggccttttcttcttatagcttactttattcccattattagacctgtttccatgttactgaaccttttccatcaaacctcaagtcctttatctttgtcaacaactccgtgaagcttttatcaatctgcctgtcagtaatctctctcttatctgaactcggaatctataatctgcaacacggcacagagtatcaaactatgtacttgtttttgttatccttttagctgttttgtgtatgttgatttcccctgtaattcctcacacattttttgtagtccccaatgactctgaaccgacagcagttagtttttaaatatgaataccctatttaaggatcaatttctgcacactttcaaagctttctttaggataattatgtcaccataagtgaattaaggttcctcaccttctccatggagctttgcatagtactttagttggatcataaagaaatgccctgaattataggatgggatcactgcaaagtcctacttgcatgtgagcaaggagcagagtctctacaaggtaacctgttacttggatatctctgaggatattaatgataaaaaggagtggccagaggaaagacttttcgcttctcaattgcagcactgtaactaagtgacttctggtagatcaaatagactattttggggattcctgctcacccatctcctctgtgttttcagagctgctgtagagctgttagaacagtgaactgatgctttttgacttgccaaacagtgggagctttctatttaaatagttatcccttagaagagctatattagggagctcaaaggaaaggatttaagggcccacacagagtagagaggcagcagatcagccacctactgggcccttgttccttcgaatgcttcaaactacatatttgtaaggcagaaggcctcctgctcacagaactgtatgctcctcacctgcccttttgtatttagcaaacacatgggaagggcagctcttccctgctgtctaacttgtctcttgttgttcttcggaagcaatccctcacagcccagtgggcagagagccaggtgtgctgaatgcacctaggggatgtggtcatgggaggagatccttcaggggcaaggggatcaaatttgacttagtatgtggtcattttccaagtgacagatgtgtaaaatgccagtagactaagaacccaaaggagctaatcaaaatgcgtgtgtgtgtgtgtgtgtgtgtgtgtgtgtgttttaccaagaatctatataggtgctttcttatgcctttattaatatctgttcaaattctactaagtcatactgccaagcttattttgataagggaatcagtttatttatttcaccaaggttataactatattggatagagaaattgggattattttcttagcttttaagcccataataactttattaagtccacagagaatagtttatgctctattgttgctgtaataatttatttttcttgtacccattccatggggaaacatacaaacaccaggaagatacagaaaatatgagttagagttgggagactcactgtcctgccagataaaggtctctttctaaatctcattgaaacctgacattcagaagtaggccagaaaataggcctagctatctacacagatatctctttttgtattatcattaaacatctcctaggaggcagcaagctctgtggtgggctgacataaattctgccattacatttttgtttcttttttattatatgtgtattattatgaactattttaaacataaagaaaagctagaaaaatatgacaaaatcatttcaacacccagatttagcatatgttaatgtgttgtcaaatcttctccaactttctttttctctctttttttaaagcaaatgaatgttaaagatacagctaaagcctccctctccatcccctctttatgccactgtgtttcttatataattattacatataaggttgctaactcttaggagtgaatttctttcttaagtccaaggaccatctcctgtcttaggtttttcacaaaggggcaaatcagaacagtactactctactgagtgtcaaatttaattgtctcctcctctggtgtcactggtgtgcaaatactttcccccttgggaaggatatctggggttgtctaaagggcagcaatctctatctagcataacagtttcaaagtgcaagagctgtttatgacctacctgaaaccatgcaccactgtcattcagaccttcgccttttgttctgagccgccctgatgtgatcattcattttgctctgtgcctttttctttttagcatcctatcatgaatagcttgattgactcttctcatctcttgggtcctggatctacagaataatttaataaaatgaggtaaggtagattaataactggcttaaaatcagacttttggctatccctattttgtaactgatgctatactctccccactccctgggatacatcatgttctcttagctttgtgtcttcccaaatcaaaatatagaacaaaagtgaagaagtggaagttggcagctatgtggtttgggtattgaattgttcccacatcaaaagatttatgaactgtgcattttaaacagttctcagttcatggctccctttaactaaattgagaaaacaggtaaggaaagtgaggcaaatgctaaagaaaatggccttgactgttcaatctagcattaaagataaagatttaatgaaggtaggtttaggacttataattttgagtcttgaaaacccaacttttaaaggattaaacgggagggtggggagtaaattcaagtttatgtggtggttctcctcctctgtcgctcgctaatgcagctcttctgaaggatagaaatttaaatagaaagctctcactgcttaggaagcaaaaacattaagaaattgctttaacagctttacggaatctgccattttcatcctgactacagtgctacaaagtgagcagtaatctctggggtaggagcacggcccacagtcaacacctatgctcactctgtgctttttacacttttagttttcattttccttaatcaatatttaccaggcgacagtcacagctttagcagcttctgttttctaccaatctttctgttgctgatacttcagacatttaataatttccttgtctataataatttctgtgctagttccttttataaatatctgcagtatgtgtacctaatttctgggatcaggtgcacatctgaaaaattgggattccttaatgaatgttggcattcaaaaatctcctccagtactcttactttattgggtcacatcattttctttctttttttttttgacatcattttctttgttgtttattttaagcaatcctctttcagacaattgtcacttacaaggttagctactgctgtgaagcaaaccatcacaaaatgtagtggataaaacaataaggtcgcccgtctgagcagttcttctgatttgggctgggctaaactggatctcgctggagcatgtccaagtgtctgtagtcagttatagaggggctgcgggctggctcatctggctgtcacctgggtcatgtagctctgataatccagcaggtcagcctgggtttgcttttatctgatggtcacaatgttctgagtgagagaagaagaaacatgaaaggtctcttaaagggtaggctcaggactggcagattgtgatgtctgctgcaatctattaaccaaaagaagtcacaaggccagtacagatgtaagggcaggggaaatggactctgcctctttagtgagaagaatttcaaaatcacattgcaaagtgtgtggacacagggaggggcaaagaattgtggtgtttttgccatctgcctcttgcacttaaccttctcccatgacatagttgtctcaagtaatttcccttctgggagcagctgttttgatatacaggaaatattgatccatcatactctgaagaaaattgcagcacagaaaggattatttaggcatcataggtggtcatgagaataagaaatgctgaagccttaagcagatgagctttaagcagctgagccctttatgttcttaagtgaagcatttttattcttccaagcatcaactgtagtcttgttttcaccagatgaaagcaactccaagtcaaatgcatgaaactgcactaaaattgtgatgcatttggttactctgtatcatgtgtggacaaaataaataccctgatatggagcacagattatacacacatcgtttctctgaattcatagctatgcaaacagttccttacggttgacgggttttattttttatctactgtgattaagttgcagtttagccttgcattatctcatctaaaacattttagcttttctttttaattcttattctctaactcattaaaacttttttagggctttgctagccgattccatttcttcattttatcctaggaagaagaccagcaaaataaatgtggatattaaataatatgtattatcattttgcaaaatcaaaatgttttacatgagactactaaatagcaagttcatagtttgagggacgatgattttgccaatgagacagaattctctcataacacacttagggggcatatcacatgagggtaccttgcatagtacacaattggaaagtaggagaataaatagtgtgagtaggagacatttatgcaaagaaaaggcgcccttgtttcttgactttgctttagtatagaaatataaagtttgtggcttgaagggaccttaattatttcatggtttattcctgctaaaacttctaatgatgggaaactcactatacctaaagaagcaaagtccatttatctaagtggacgattgggtggtcatcactgggggaccttactatgtgtcattgtttttatcttcatgaaagacatgatctattaaagagatggacatggaaagtatcacagcaaaatatgctatgtaccaaaatataatacacacttaccttggggaccaaacggaaagtgaatttattatccagtttactagtcagaacttgataattctctaaataggtaggatagtggagatggaagagctaaagatggtagatgctgtctactgaaattgggactatctaataagcatgattaccgggagcatgtcagaacattctgtgtatccatggtggtcaatgacttaaatctacatccattttcagagatcaaattccattcctggcccattacagaaacactacctgggcctcgagtgagcaaatgccaagaagctatttaacaataggcaagcacggcaaagagaggcttaaaattggcgaaaagtgcttcctttgcagtcatcctattcaacttgtggcagctttgaaacagcatcatgaattattattttaatattacaaataaactttattcttctcagcaacttgcctcctgatatgttaaaaatatacaaaactcagtttgtcaattcctgggaaattattgtcatagcggggagccataccaaggaagtttaaaagaacaatgataacaatataaaaaactgcaggagaaaagccataaagataggtttcaaggcacacttttctatcttccttttcactgttgatttgcagtcagtgatagatcgactttttttttgtttgtttcatttgtcctcttcctttcactaatctgggctttatttttgtttcaattttccctagctttcttcccagataataactatttccttttcccaagccctaattcacactttatcattctctcactgaagtgcctttcacagcaatccaatcaggacacttctgttcagtttgttccaaggggcttatttgatcatcatcaagaagataattgtctatccttagagctgggctaaacaaaagggtgaagcaggttgtgcacaaattcacaagactccattatcattcccctgcagactcccagctgcacttttactcaacccgtctgccttcttccccttcaggccaccttggttgagcttcttcagctgtccctgcttctatttcatccacctgttttcatccttcatgctttcctaattcaggttttctattcgtctactgcaactgatattttctagcaattttaaggaggataaaaataattcttgagtgaaataattcatactaggctgagagtgaatgatttcagatgtataggaggtgtgttataaaatgatttattaaatgtgaagaaattcctagtgaaaatatacatcgatatattatgtggggatcatgggtgcctctatgaattaattcattcagaaatgttcattaaatgcctaactcattgctaacggtgaagaagccaaacatattccctttcccacctcttctcatggagcttacattcaaatgggcaagataggtagtgtcttagcctggatttccctgtaataagcagcgctaagacaaggctttagatgcaggtttatattgggaaaagaaaccaaaggatcaggagtagaagatggataacagtgagagaaacagaaggaaggaagggtatgtcactgagctagactcaatcccatcaggagcctcttgagaagccatacagagtgtacagtgggcttgtctgccacagatacctattggctccatcccccattggtcacaggctgccccacacatggttcactgtcttgtgcctgtgctttttggaatgtgtcagttggttcctgaaattgtcccactaagatatggcagagaaataaatagtataggtgaggagagacattttcagaataatctgcacaaagctgatggttgcaccaacagctggaatataaaggtaaatgaagaagatataagaaagggctcaagaggtgtccgatacaaagagcaataaaataaaataaatatctaattgcacactgtaataagtgctctagggtaaagggtaccaggagagcatatgcacaacacaatccaaaatagtggtatagaccataggggtgaaaaattccttcaaaccgtcatggttccttgacatgaccaaatgtttgtagtgctactaagtaaaatgtgttgaagattaaagcccatttttaattttactatttagctatcctgttcctaggtaaacgtcaaatcccccaaatctttaagcttttctccaaagtagattttcttccaaagattaagaaggtttcaacactattttagacaaaggacttctgactatcctaatacctccccaaactactacattgaaaaccttattgggagacataagtactcctagctttgtttaacgttaagtggaaaaaatgtaatatagttgagaggtcaagagcctgtgctcaaaagactccgatttaatattggcaagactcatgagctatacctctttgtatctgaattccttatttgtgaaaggggaataacattatcacttgctcgcataggttaaaaggtgattaagtaaggaaacacagataaaacttatagaaaaatgccaggcatatggtataatctcacttattagcaaatgtattaatttactagggctgccataataaaataccacagaatgggtagtttaagcatcagaaatttatttctgtacagttttggagtctagaaacccacaatcaaggtgtcgttaatggtggtttctggtgaggcctcacttcctggttagtggatatctatctgccttctcactgtgtctttatatgatctttactgtgtgtgtgcatcctttggtatctcttcctcctcttataaggacatcagtcctattgtattagatcttcacccttacaacctcatttaaccttaattacctctttaaaagccctgtttccaaatacagttacattggtgggtagggcttcaacatgtgattattatgggcccacaatttagtcaataacagcaagtggtgtaatttttacatgaaaatgtcatttcctagaagggggcttttaaaaactttttagtctcaggattcctgttatacttccaaaaattcttgaaaatgccaaaaagcttttgtttatgtgggttatatctatcgatatttaccatgtcaaacattaaaattgagaaatttaaaatatatgtatttatttatttgaaaataccaataagacctcccattacaaattaacattattttagggaaaataactacattttccaaaacaaaataaatttagtgaagagtggcattgttttccagttttgtaaatctctttaatatctatctttatacaagctgctgaatttgcatatctgcaactatagccaacttgttatgatacctcatgaaatgtaacctctagaaaacttcactgtatgcttttttttttttttttttttttgacggagtctcactctgtcaaccaggctggagtgtggtggtgcattgtctgctcactgcagccttcgcctcctgggttcaagtgattctcctgcctcaacctcttgagtagctgggactacaggtgcccgccaccacacctggctaatttttgtatttttagtagagacgggttttcgccatgttggccagaatggtctcgaactcctggcctcaggtgtcgtgcccaccttgacctctcaaagtgctgggattacaggcatgaaccaccacactttgctacactgtactcttttgaaagaatgagagcaaaaaaggcaaatagcattttggtattattatgaaaatagtacagactttgcagagcctccaaaatctcctgaggaccattggtggtccctgtagcacacatttgagaaccactgccttaaagcttaagaacactcccaaatcaatgaggtttgtaattttggcatcctacttttgaaaggctccccaactcctttaagttcaataccacattttagtgttttgtgctaataatagtaaatattgacttttttccacttgcagagaaataccaaaccatggcatacagatggatttcacttgcaagttatatttgatgatatttttcactttatacttcttcattgtccacaatgagaatgagacagaactatttttgtgatatctgttgggcaatccttcagtgaactggttcaaataatgtgttttcttgaaaactgctgctgtaacatatctgttttgctactaaagaaattcagcctatgaatattattacatctttgaagtgaacttcatcctaatggtcaaaaagttgggagccaactgtattgaacatttattttttaccattatgtaaaacagaccattcatttactcttttgaagatgacaatttaatttgttaaagttttattttatttttaatcgaaaaataattgtgtatatttatgggatgcaatgttattttaatgaccacattaggccacatttcaatagctgataaaaaagttcccaacacttaattgcttttactaaaaatactaaatatttaaagattgattatatcatagaatttttttttttaactgagacgcaatctcattctgtctccctggctggagcgcagtggtgctatctatctgggctcattgcaaccttcacctcccaggttcaagagattctcctgcctcagcttccctagtagctgggaccacaggtgtgcaccacaatgcctggctagtttttgtatttttagtagagatcatgttggccaggctggtcttgaactcctgcaacctcaagccatctgcctgcctaggcctcttaacatgccgggattacaggcatgagccaccacgccaggtctggttttggttatttatatatatatgtgtgtgtgtgtgtgtgtgtatatgtatatatgtgtatatatacatatacacgtatgtacacgtatatacgtatacacgtatgtatacatatatacgtatgtatatatacacgtatttatatatgtatatatgtgtatatatgtatatatgtgtgtatatatgtatatatatgtgtatatatatatgagctcctcaagcacagaaataagtcataaatactgtttttattttccccaactcctgccaggttgaatttcagagttgatgcttaataagtaattttgaaattaagtttaatagaatatatgtaattattattttgtgtcacaatgattctaccatattccctgtctttctaattttttagtccttcttttgttttattttcccctcattttatcacgtttttctcttacttttattctttctattttttttaacctcttatcaatcactttggactcaaactttctgaaatcacgttctttactttttaattaatatttgttcctggttttacaattattttaattatatcatttatacctacttttctcagatattttcaaatgatatttggagacaattctccatatggcttagcttttctgtatgtcttgttagaagaggcaccgaatgccttttttatgaactctttgcactatcttgggagatagaaataatatctccctttggagcaagaggaagacatgtttattgtttactgtgaaagatttgagttctctaagatcaaagtttctctcctataatgtacctattgcatgtgcaaatatcatccatctctcttcatgtcaacctgtaggaattagaccttgggaaactggcacaaaatgtgagtactctggctactgtttttgctgtgagtaatgtttaagccattttttgtttctgactcaagagtttcatgtcttctgttggcatccatgaaactgtggcaggctaacccattaccttgcaagtagggtacaatctcagattttgttatagacatcaatgacttacgatgatttgatctttgacttatgatggttcaacttcgatgtttttactttaccatggtgtgaaagtgccacacattcagtagaaactgtacttcaagtacccatacaaccattctatccttcgctttcagtacatgaggtaatcaataagttgcatgagatagtcaacactatttttttatatataaaataggctttgtgtcagattattttgcccaactgtaggctaatgtgttctaagcatgtttaagataggctaggctaagctatgatgtttggtaggttaggtgtattaaatatatttttgacttactatattttcaacttacaatgagtttattgggacacaaccccattgtaagttgagttatacatgagttaaacatggttggagtttgcggctaaagcttttggattacttttaccccatcgtaactttatcatggcgtgtgtgtgtgtgtatgtgtagcccggcaggcatggccatccactgaatactttgtcttgtattataattgctcttatttttcatattacataggcaagtttccttcacaagtacagtgttttcttgtcttcctccaagaactttttactctcctttcattgtcaggtctcattataaggcttagcagattcattttaaaaagcaaacctattattttttgtatatttatctagtctattggtctatccgtatttttccatatctccaaaagcatcagcatagccattcttacccacaaagcactgttgaccaacttatgtttagatgtggcattattttcccacctggaatgtcatctctttcttttatctatgtttcttccatttcttttaaaacttactttctctacagaggcttttgtgagtaatcccaaataagtttactcattaagcatttattttttgataattatattactaatattcattgattgcctactataattccaggcagagtgagcaaaccaccacagaacttgaataccatcttggaagttagtatcttataaatcaacatacattcaatttgatctatgttatttggatttaaagatacataattttttatttttcatgttgcctccctgatttcattggaaattcttccaaggcaggcaactgtgtctttttccttaactaataatagtttaagcccataaaaccttttctctctcttcaagcaataagaaaaaatcaggctgtccagcagtgcagtgcaatgattccatcagggacttgactaccatctggctttctgctccaccatggttagtgtgtggctttcagcttcatgattgtaattgggctgatatacctctggacctcatggccatgttcaagggaggaagaaggaataagggatagagcaaaaggggattgtctggggtcaaaatccttccaacctgagacatcaatttcagaagttttccccaaaatgctatataacattgtctcactgatcacaactgggtcaatcaccacccctagctacaaggaagtttgagaaggtgaatacgcttaactaagcatatggacactttacacaaaatcagaggtttttttaaataagaatgggacaagatatgttggttagagactaacaatgtttgccgtaccaccaaactcaacagtggcataaggatccttaaagctacaggataaataaaaagcatcttcttagagcatcttattagaaaatttgaaggaaaacttctccctaaaacaaacatggggtagaatacagataagatatgaatatttaaggttgaaattgggtgagataaaaaaattctcaccttttgccatgtcccccacctccttcatgtgccacagccacactggtgtctttcatttcttattctaatcatagccctttctaatctctgatttttctgccagaaatgctcttccctccaaattttaaataaatgggcagatctcaactttaaacttaacaacaacaacaaaaaaggttctcagagagatattccctgtccaaccagatataaaatcccagtcactttctgtgatattttcaatttagtatttatcactacatgtttattgtgtgccctccaccccacccccagaataatgtaagcttcatgcaagcaaatgcagttaggtgctgtttatcctagcaaagggcacaggaaaaggtaggctctcagtatgaagcagggcacaagaagtattcaatacactgttagattttcactgagatatttatgcttgaaactaatctggagtctttcttctcctctcttagaacattgcatcaaagaatatcaagtcaataggatattggatattttcagggaaaaaagacaaagactaggctgattgaaaatcactgtaacatttgttgtaaaacattgtgtttgcgtcctactgttgctgtataaatatattttcaagctctttttgtgaatatcaaatgaggaacaatagacaaaccactagcttgtgaaaacattttgatcccattttagtcaatgattaattttgtaagacataaggctttgcctctgtcttctcactgccaggccattattttagtgttcatccccaaaaccatactttttaaaaactggatattaatgccatgtaaatgttaagaaaatatttagctcaggaattcatagacaagattcttgttgtatatatcttggaatttttcttgggacacaactggaagtttctctatttattcaggacataaaataacccacttcttagggggaaggttccaggtcaacaatttaatgatttttaaacaaatatcctacagggaaagggaagatttagaagaattttttacatccctttatacttcattaaagcctttttggtgtatattgtgaaattatatgcctagtccagaattaaggacctggaataggctaaacaagaaaatacaggttagtagagttataattaatcctcataagtcagagaataaaatgggcaagaagagtagtcaagtacattgaatagagtcttccattaacgtaattcagaattgccctggcttcccaagagcattttcatgtttcactggtcaagtgaaatacctaccctgtcttatctcgatcttcccacattacttacttccttattaggttcctctgtaattctattgactgaaaattcactgctgtggaaatatatctactagtggagttaatccaaacaatttgggcaataggaaaaatacatgcttaatgatgtgtttgccttctcacttaattttatttcagacctactagatagtcaataagggatgggaaatgacattcttgtgaaggagagatgaaaatattaatatattaatattatgtatttaagcgtagggatgatctcgatataggcatatcataaagtaccttaatatttcattggctgattcatcagagtgaatctatgtggtcgtaaatgaatgggaagcatgtaaaaatcttgtttatctaacatgcacactaaaaagggtcctccaggaattagaatcactcaaaattgtaagttgtgccgcaatttgttgatgtaattatatcaacatttttcttgacgtcagaccattgtgggtgggaagattatggttttgatgatcacacagacataggcttgaatatattctcttattgctggctgtgtgaccacagacaagttacataaacactctgactctcagattcttttgtaaagtgggactcctttcctttgaagcatgagcacaaagattgaaagatacataaaacactttaacatgttgcctggcatgaaacaagtgctcattatgtattaatcttcttcccattctccctctgggagcaatgagtgatttagagtttgtaattcagttgagaagaaatttcagaattgtataaaaggcagtgtgcttatatattcattcattagtccccttattatcagagtgtgttatttgcattacatagtttagccatggtgtgtataatttgaatttaactggaaacaacattcctttcacaaatgttgtttccaactcaattacctgaccttcagctaggttagaagcattggcatttctagtaattttgaaattccaaaaatgtaacccccatactctatgctaattttcaaatcagcagttgaattggctgctcagtcacatttgttcctaaagacggaaaataaaagtgtctgtgagagggcaggcctggcttaaattctgtcttaacttgaaggatctcagaagcagactctgagccagggattccagcgcaagtaatttattaaggaagtactcacaggaaataccagtgaaggatcaaagaagcagaataaaaaagggaagaagccaagcaagggttcaatttcaggtgaagtctctgactcagtctgatcctgtggtgagccctggaacaaaaattgtacctctgagtttgtcttgtctcaagacataggaactgtcttcttataatccagagctagtcaatcatgaactgtagtctgtcccaaggaacataaactctcaggaacttctggttctaaattagggtgagacaactctagtatccaaggtcaagttttagaagtttctgctgtaagcccttatcatgaattacagaacatatgggataaaacaaagcactggtaaaggaaatgaagggtataggagcagatcactaattgtgtccagtacactcttctaggtcccttgcattttctgaaccaggaacatatagtggccatcatagcattactagttcccagtaaggtaaattgttttagtaagtgaacagtgcccaaatatttaggacttacttgaactgaacgttgcatactatgaataggctatttcattgtaccttaagggtttccaaggataatgtaaatatatgaacaattagtactgttatgatgaccaacatttattaaacacataggatatgccaagccatatattagatggtgtatatagtttcctatggtctgttttttgtttgtttgttttgttttgttttttgagacagagtcttgctctgtcacccaggctggagtgcagtggtgtcatctcggctcattgcaacctctgccccccaggttcatgcgatcttcctgcctcagcctcctgagtagctgggatgacaggtgtgcaccaccacacccggctaatttttgtattttttttttagtagagatgaggtgtcaacatgttggccaggctggtctcaaactcctgacctcaagtgatccacccaccttggcgtcccaaagtgctaggatcataggcatgagccaccccgtccagccatatatactttattatcttatcaaacattagaagcctcattttagtgatgaagaaactgagcctcaggaaattaaaaaaaaaaaactcataactagtaagtggttaaactaaaactatattcctggtgtaatccaaaaccctagatccttccaataagcaaaattttgccctttaattgcagtaatagaatctgtgaaacactaggaagctaccagtattacttatctatgctgcatatcaaatccccaaacttaaaacaacaacaaacatttatcatcctcacagtttctttgggtcagagatttaagaacagcttatctgggtagctctgacttggtgtctctaataagatggccataaagattttggctagggctgcaatcctctgaaggcttgactagaaatgtaggattttttttttttttaattatactttaagtactgggatacatgtgcagaacatgtaggtttcttacataggtatacacatgccgtggtggtttgctgcacccgtcaacctgtcatctacattaggtatttctcctaatgctatccctcccccagcccaccactccccaacaggccccagtgtgtgacgttcccctccctgtgttcatatgttctcattgttcaactcccacttataagtgggaacatgtggtgtttggttttctgttcctgtgttagtttgctgagaatgatgatttccagcttcatccatgtccctgcaaaggacatgacctcattcttttttatggctgcatagtattccatggtgtgtatgtgccacagtttctttatccagtctgtcattgatgggcatttgggttggttccaagtctttgctagtgtgaatagtgcgtgctgcaataaacatatgtgtgtaagtgtctttatagtagaatgatttataatcctttgggtatatactcagtaatgggattgctgggtcaaatggtatttctggttctacatctttgaggaatcgccgcactgtcttcctcattggttgaactaatttacactcccaccaacagtgtaaaagcattcctatttctccatatcctttccagcatctgttgtttcctgactttttaatgatcgccgttctaactggtgtgagatggtacctcattgtggttttgatttgcacttctctaatgaccagtgatgatgagtgttttttttcatatgcttattggccgcgtaaatgtcttcttttgcgaagtgtctgttcatatcgatgtgctgtattcaggagacccatctcatgtgcaaagacacacataggctcaaaataaagggatggaggaatatttaccaagcaaatggaaagcaaaaaagagctggagttgcaaacctagtctctgataaaacagactttaaaccaacaaagataaaaaaagacaaagaagggcattacataatggtaaagagatcaatgcaacaagaagagctaattatcctaaatatatatgcacccgatacaggagcacccagattcataaagcaagttcttagagacctacaaggagacttacactcccacacaatagtagtgggagactttaacaccccactgtcaatattagacagatcatcgagatggaaaattaacaaggatattcaggacttgaattcagctctggaacaagcagacctaatagacatctacagaactctccaacccaaatcaacagaatatacattcttctcagtaccacatcgcagttattctaaaatttaccacataattggaagtaaaacactcctcagcaaatgcaaaagaacagaaattataacagtctctcagaccacagtgcaatcaaattagaactcaggattaagaaactcactcataactgcatagctacatggaagcagaacaatcctctcctgaatgactactgggtaaataatgaaattaaggcagaaataaataagttgtttgaaaccaatgagaacaaagacacaacttactagaatctctgggacacagctaaagcattgtttagagggaaatttatagcactaaatgtccacaggagaaagtgggaaagatctaaaattgacaccctaacatcacaattaaaagaactagagaagcaagagcaaacaaattcgaaagctagcagaagacaagaaataactaagatcagaggagaactgaaggagacagagacacgaaacacgaaaaaccctttaaaaaatcaatgaatccaggagctggttttttgaaaagatttttttttttttagactgagtctcactctgtcatccaggctggagtgcagtggtgtgatcttggctcaatgcaacctccatctcccaggttcaagtgattctcctctctcagcctcccaagtagctgggattacaggcgtgtgccaccatacccacctaatttttgtatttttagtagagatggggtttcaccatgttggccaggctggtctcaaactcctgacctaagatgatccgcccgccttggcctcccaaaatgttggaattacaggtgtgagccaccgcacccggcagtatgtattataggatctcctatcagggtgtcccactcatagcattggcaaattaatgctggctattagcaggaagcctcagtttcttgccacacggacctccccatagtactgcttgagcatgctcaagaaatggaagttgtttgatttttttccccagagtgagtggttaagagaggacttttggaagccaccatgcattctgtgacttagccttggaagtcacataccatcacgtctacaatatcctattagttacaagatgaaacctattcaatgtgtgagaaaactacataagggcatgaatagcaggtggtaaggatcattaggagccatcttgaagaatggttaccacactaccattcctttcttcttaatcctaagtatagaactcctgctgtctcctgaggatttgttaagcactttgttgctcccacatccccctcaaaaaaaaaacttaattaaaagtagctaagtagaaacaaatattcaacacactagtaataaatgtagatgttactgaatatttagaaaggagatcaagaagaggactgacatcacacatcacttgatagaaacaaaattaatttttcttttacatctgcctgctttcccttcccaaatccctctcttcagctgccagctgtctcattcctctttatctctttcccacatagcctcaaaactctcctttgttgtgccaaataattcagctctggtcctgagtttacaaacacattcttggcaaaacaaaatcctgatggccattctcactttctttagaatgcaaacatctttgccctattatggaaaatagggatcaaagtagcttattgatatttactcaacaaaaagtcctatttcctaaggtggagggagagagacaaatatgttctcttgttcagaaaataagtttttttctcctaagtgttatatatatatataatatactcttctagcttccagatccagggaggacagtgatccttctgtttcttgctgattggttgctatacctgtttgaaattatagctcttacatttttgtcattgagttagttgctgatcagttgctatacctgtttgaagttacagatcttatgtttttgccattgagttagttacatcctttcttattttgtcactgagctcttaaccagctagcctacatctcatcttgtttagaaatattcttatgatttctgtttttcagttcacctgattctggaaaagaaaagaaaactttgcccctgaaggacgcaagcaattatgagtggatactacataagggccctagctttgtcatgctcgttgatacacactcccacctagcgccttgcactcagaagattcagttcatatatctgttaattgactctaactgactgaggttccctggatgaggagagcaatgagaacagaggcttgtcagcctgcataatccctactaataagctctactatactttgatgcttatcttcattttcttaaactgaaaaaaaaaatcttttggcaaattccaaaggagatcatcactgaaatcttgctgagttcaacttataagcttgtgggcattaaaaattatatcaatgaggtcgctgccctgtaactgttcacacttttatttagaggggaccagcaagttatgactgtagaatgttgataccagttttgagaggacaggtttaatgaagcacatcttatgcctcttcatccttttcatactcatccataaaatatgagctctattggctatgtagtaattaaaggctgaaaacaagaaggggctattatgagctaagaagaacggtaagacatttatttttgagggtggcataatctctttggggaaaaaaagtatggataaaagggagaggggccaggcgcagtggctcacacctgtaatcccagcactttgggaggccgaggtgggtggatcacctgaggttgggagttcgagaccagcctgacctacatggagtgaccctgtctctactaaaaatacaaaattagtcgggtatggtggcgtgctcctgtaatcccagctactcgggaggctgaggcaggagaattgcttgaacccaggaggtggaggtcgtggtgggctgagattgtgccattgcactccagcctgggcaacaagagtgaaattccgcctcaaaaaaaaaaaaaaaaaaaaaaaaaaggaaaagaaagagagagggaggtagaaatgaaagggtctattcagaggtgattgcaaagataaatctagatgtcatagagggaaaagtagtgagagggaaggctggaaaaggaggtttctctggattctagaggctcttgagttgcagatcaaagcttggattttatgctattggcgatgagcagtcattgatgacctaaagtgacataataatgaaaatactgctttgggaaaggtaacccgggtcaccatgtatatgaaagattaatgtaaggagaaattgaaagcaggaagagtaacaggaaaatttcagaaatttagaaatgagagagaagaattgagcctatgaatattccaatgcaaattaatgttctattttttctttgcagtttctagtttctcaaatttaggcttcatgcaatatgctttgaaaatatgatgattatattaattcatagaatcactgattcctcttctaccccaccaatgtttgtaaggtgcattctgataattttattaaccatacctcttcgtaaaggtggtaaaatattgaagctcttaaagtggccttggcaaatgcatataacctgtgagtgtattgtgcttagaattattataaaatgatttttaaaggatcttcacccaggcacagctaatatgagtaagaatcctaaatgtaagttacttctagaccagtggtccccaaccttttaggcacccgggacaggtttcgtggaagacaatttttccatggacggggtctggggggtgatttaaggattaaaccgttccacctcagaacatcaggcgttagttggattctcgtaaggaggatgcaacatagatcccttgcatgcatgtgcagttcacaatagggttcatacacctatgagaatgtagggcctcccatgatctgacagtaggcggagctcagactgtaatgcttaatactggctggccagccactcatctcctgctatgcagcccagttctgacccaggctgcagcccaggggttgaggacccctgttctagacatattattgcacttgtatcattttactgctaatatattactgtatcattttactacgaatatattgtcacattataataaattccagatgatagcgcaatcacagcacaaatacttatcttttctaaaaaaaattccagttgtagatttgttcaatgcaatgtggtatattttatctttctaaagagcagagcagtgtggcaattctgaatatacacgtgcttgctgaaagcgataaattggtgattttctccttcgtgggacagaaacaagtgagatggatataaagagaaaatcctacaagtaataattttagagcacttcttagtagcaatttcaatttgtcactagcactctatgtattcccaactgttactcctttcattccataatttttattctcagatctttccatttcatatcccaaagataacatttgctcaaacataaaaataacatttagctgcctttgcatggcccttgcaaatttatctctcacttcttgtttcccttagttccccagtagccttgaaaaacacccaagttggctgaattctaagccgaatgactgtgatagctccacagtagcataattccaaatgcttatttgatagctccaattgatggctaattggcccttcaaatttaacatacttaaaaggaaatttctgtttatcctctactctcagaattgattcttcttcaacttctcctcctagtacatggcactaccattagttggctgcccaggttaagaaaatcatgctaattttaaaaattaataataaataaaaatctagataacatttatttttcttctcattccctaaacctctacctacaagtatacaatcttccagaaacttcaaactgcaaaatatattccaaatctaatcacttgtctccttttctgctgcccccaaccttagtttacatctctcttcagctgtccttcaggtgtttcctcatgggtctctgttctcttgtttggcctttgatccacactcttcacacagtagtgttgactgtaggctccccaaatgaacaacagaaaaaccttttgatcatacatatttaagtttttggaccttctgctgtaagaaaaaaacataattctacagagtcttagtaggatctcaaaatgggaaaattagaataggttatttattatattttacagcttggtctgggttatttcaaggtgggtcttgttaggcagggattggttaagtttggacaaatttcattgcatagttttgaattgtcggatacatttgagtgaatggatttggattggtgggtactgtgagacaatggttttgaaatgagttgtgacaaatatgtcactgagtcagttcatagtcatcttttaggagcaggtgtttcttggaccaagcatctaggttattttggcttggagtaaatattctttaatatggagcagaaatgtatgcctggttctagtttcatagagagagaaaattatgcttcataggtatttaaacttaaaacatctcttcatatccctgcttataatccttggaaagcttcatgctatgatcagaataaaatttaaactcaaattagaagatcctaaataggctgtcccttgtctcctcactgacttcagttcttaccactcttccccttactctccacattccagccacactagcctttcctttccttgagtaaaccaggctcgttcctgcacttgcgaattgcctctgcctggaatgggtctttctctttcatcatttgaagtctcccacaaatatcatctcttcagagaagacttcttaaggctacccatctaaatcagctcatgactcccatatctcttcactttagagttcatggcactcatccctacctatacaaaattatggtcttttaagcctgatatcctctattcaaatctttcttctgctacttattagcagtagaaccatgactatgttactttgactatctgtgcctcaatttcctcatacattaaaaaaggacaatgatgatacatatgtcatagggttgtcatgagccataaatgaatttagctttgtaaaatgttgactctctaaatattagcaatacaacttgttggtaaaataactgtgataaggaagaccactacctcaggagaactactttggttttgtctcccaaaggtgaaggcaaggtcgggatttattgagaattggaagtttggtttaaggtggggttttttcaaaaagaggattttattaagattgggtatgaatcaggatataacagtctaggattggtgaaaacaggaaagccaggattttgagacaggatttcaaaaaattgtactttgtaagttctctgttgattctattgaaaagttgggaagagatgggtcttttggaaagtccctgtaacgaacaatcaaaccacttgcttcagccagaaactcagggaaagtaatgacagtgggatacaaagttacattatcgtggaggtatgaggttagggagctttagtcctcaatatccaagctgaatatacaggtagatggttttggtgctcagcatgtaaagcatatagaacagtgcctggcacataataagagcttaagtaaggtgaatttcatcattaacttattattgtcatggaagccacaagggtggtcatttgtctgtatctccatttcctggcacaaacattgcttagcacaaagtaggtactcaataaatcattgtggaatggataaatttatttatttactggttttctgtttgtctccctaattaggatataaactctgcgagagagaaaaacatgcctttattgttcatcaaagtattccaagggcctgcggcggtatttggcccacagtaatcacacaaagtgtatttgttgagtaaattaataagcttttaagtatcacaaaagaatcttgagtgtaaaaccagctcccagtttctttcacctccactgaaaggtgtgagtccagaaaacgagaacaaaatgaagaacagaagaataaaaaacccagttacattctaaaataaattgggggaaatgctggtttaaaaagttaagtaagatcctttcctgtaaggtttctcagatcctttaatctgccaatgtgcattgttgattactaatgggaaatagtgtgtatacttgtttgatcagggaacttgtttttcccctttttgatttgagaacacttatttgcatctctggaaatacaacattagcgttatttgagatgttctttgggaaatgctgtattaagcagttttatccaaagtcagggatgccatcataggaagccgaatgagactccttggcagtgatctggtgttgagtcacttcagggtgatgggagaagcacagatgaaggcagtcccatcctgatagggctagggctcctccagagactgcacataagtgccctgtttgctaccagaaagcactcacatgtgagggagagtctggtttaatgtccccctagttggtgaacactctccaatcttaaccacaagtttcccacgtgtctctgacatggagtgccatgagagaagagttttctactagatactcaggcagcattttgttcttttacttggccctcacgtgtaccttcaacttgggttttacccctaaaaacttatgttgttgtgtttgggggaagtcaaaaccaggacacatgaaggattcatattctggagcttgtctacttaaaatgaccaatgctttcaaacaattatttcatattcgtatgcctcagattcttcaggaagaaactgagtagcttgaatgatagtcatgggttctgaattgtacattgtattagtccattttcacattgctgatgaagacatacctgagactgggcaaattacaaaaggaaaaggtttaatggactcacagttccacatggctggggaggcctcacaatcatggcgggaggcaaggaggaacaagtcacgttttacatggatgacagcaggcaaaaagagagcttgtgcagggaaactccaccttataaagccatcagatttcatgagacttcttcactatcacaagaacagcatgggaaagacctgcccccatgattcaattacctcccaccatgtccctccgacaacgtgggaattcaagatgagatttgggtggggacacagacaaaccatatcatacattgaggaattttagtttgggcaaggcagggaggtgggcctctgggagcagcaaataggcaactcctgttagtgcctctaagtcaatgcaatcttgctcttatttgctctatgcaactttattagaagagaggaagttcctacttaaaaggtagtttttattagccccacctgtgcaatttcacttgaagacatctgctactaaaagtagtttgaaaactactgtactaaaaaatggagtccactgtctttttttgtatggtctccaagctaacaaaggttttgatatttatagatggttaaaaatgtcagaaaagaggaatacaaattaagcattcctaatctgaaaatccaaaaatctaaaatgctccaaaatccaaaactttcctggtgctaacatgacttcataagcggataattccatacttggcctcatgtgactgggtttcagtgaaaatgcagtcaaaatttcattttgtgcacacaattattaaaaatactgtataaaactaccctcatgctatgtgtataagcggtatatgaaacataaaggaatttcttctttagacttgagtcccatttctgagatatctctctatgtaaatgcaaatattcaaaaatcagaataaatcagaaatttgaaacacagtctcaagcatttcagataagggatactcaacctatattccattatgcacataaattatatgagattcggattttagtgtccataaatatagtcttattggaacacagccacacccatttgtttacatattgttaatggctgctttttattgtctatggtgcttcagcagcagagctgactatttaccacaatgactatatgattcacaaagcctacaatttttactacctagtcctttacaaggaaagtttgctaagccctgacctagatgattattaggatccttttctacccccaacatttgatttttgttcatctttgtggaaccatattgactggctatgtaagattcttctcaaagcaaattgaatcaagccaggactctttcactatgttataaaatcgatttaattatgttacaacaatccttctcatttgagaacatacactacctaactaatccatgtctttcaatctgccttcaccttcattctgaatggcgtttggtatattctactttgttatgttgaacatttctttttttatagtattttaacggggcagcataaaattgcatggctcctctgcaatgtaagtactttagcacgacagagttatagggttgtaaggaagcttgagatgccatctaatctctcctactccttctggacagaattatacttaaagtaccctggaaaggttttggtttactgtagtctttaaaaatccctccacaagaacatttccaaatactcactttgtagcacatcagctgtcaaatgatttgtaacttgggtgcctatgtctgaccaaaagtatatttagagttgttccattttaaggctttaaaatggtttattaatagggcagtacttccagctactcaaaccttgatttttattccagccctgagtcttaaatctgggcaagcacggcttctcagacatggtatcttctaagggcagtgattaagaggcaggacctgggagactactctgttgttgcatgctctattctcccctccacactgtaaaatcctcgcggataggagcaggatttcttttttttcctaactcccatagcacacacagagtgtattgaagaatgttcagcccaacctctttgcaagcatctttattacaaaagatgaagggagggtggatgtaatcaaatatgtactttatattggaaagcaaccaagcctctctgtgcatgcactaccctcatacaatcgataataaattagcattttatttatactgtataatgccgttcttttcaggagtctgatttggaagccaactactgtttgtgttctccaaagtggtttttgatggagtgctaattatgtttcacctcaagagcaatgctgacgggggaccacaatcgccttattgtagtagatccagctgatgaatctccaaggatagcctcatgctatattctggggggcaagtaaatataaaaatacatttttgatcaagaaaatgataccatttacacaacagtagcaggattcagcctttgtaaaacagctgcatagctgcataactgtgacgtgattttttttttttttagtagagaaaaaaacatggaggaaaatatatatcaactcaggaccctagctgaatctggggtttagtagttcatggtgggggcaggggactatattttcaaataaatctagcctaagtgaatttttgttccagatagaagaccaacttaataaatgagtcctgcgtagagaagtatgtcacatttagcaaaagaagacacgcgcaggtagagccaatcttttcacttgtgcgaacctcattaatcctgtcacataaagttttgcacttgtattttagctcaactcaaggaagcttgatccagatattttttcagtatatttttcaatacaacataataaagattggagaatattttaactccacctttttttctttaaagctttcttggccaggtgtggtggctcatgcctgtaatcccagcactttgggaggccaaggtgggcagatcatctgaggtcaggagttgatgaccagcctggccaacatggtgaaaccctgtctctactaaaaatacaaaaattagccaggcgtggtggcaggcacctgtaatcccagctacttgggaggctaaggcaggagaattacttgaacccgggaggcggaggttgcagtgagctgatatcatgccactgcactccagcctgggcgacagagagagactgggtctcaaaaaaaaaaaggctttctttgggtcaggctgccctttgcaaacaccatttttaccaccaaagtccctgcagctcatatactaggctgagatatatgtatgtatgtatatagtatataaaaatggacgtgctctcacattgctagaggtacatagactctctgcatgacttgggattcagaaagtgtgtaaaattaagtaagatgacaatagcaatccattaattattctacatctaccagagcacacttccatgtttggtcctgtgcttttaaggaaagacctgccttttagtgtcatgagggctctcaggaatggcatcttgatgatcacaacattaaatccaactcctctgtcaggcagctaaagtgttaatttattttgtaattagatctctcaccaaagctcacaggaacctgcatttggatctcatttgattatgtatagacccttttatatatgccatcatattaaaggttcattctatgtggcctgccttatgtgctcagtaaacatttgttgaatgctgaaacaaatcaccctggggttaaaggaaagcgttgagggtcacagaggttgacttgccaaacgttactaagctactatggggctaaggcaggagtgaatagttgctgctttaggcaactccacccacccccgaccccgtttgtgctctttctttttttctaaattgttctagcagtctatgatttggtgtacttctttggttaaaaaaaaaaacacacacgaacaaacaaacaaaaccttaagggtctttaaaaaataataagttatctgttattgaggacttaattttgtgcactacactgtaccaaatgctttatatttattaacctatttctttttaagcaataaatctaaaagcttggtattcttatccccattgaaaaattactttaaataaaaaaaacctctccaatgacttttattatattcacataaagctaatggggccgattaaatgtttattgttaaatatccatgaatcatttcaaatatatatgtatttttataattgtaactcatagataataatacagttgggctacaaaagctatttggaggaagacaacaattctaaatggaatgtgatttgtgtttgtcaagattatgtcagcaatctatgattttagcaatttatttggtccatacgtggatagaaaatatcaagcacagggaaggaaagtataaacatttgttcagcaactactatgtgtcagacatcattgatgtttgccatatttagatgtcacaaggaccctgtgagatcctttaaacattttctgtaattaaagatgaagcaactgagtctcatggaaattgggaaatttgctcaaatactttactttgacccaaaggaaaatgcaagtaaacccataccactggctgaatattgggttttaagggtttatagggagaaatatttttcaaaatgtatctgacttgggtgggtcttgagtctagatagaataaagcactctatcttctgtgacctgggaaaggggtgccgttgggggtgggaggagtcgggatggaaaatcaggtctgtttaggaccaaatttagttcccatttaaaacactgaactgcttccaaagaaattaaactcatgaccttggtctacatgaaatgaagccagataaattaacctgacatacacacttatataagaaatccttgaaaaggaagagctgatgaaaccagggaatcatatttcctgtaagaaaagttggtaaaaataccagtgaggtactttggtgtatcatattataatactatcagtagtataaatgaaacgaacaaaaatggtaaaaaaaaaaaattgatctagaataatgtcatcaacaaagtatgcaaccatttcttttttcttctttccaacttttattttaggttcaaggcatacatgtgcaggttgttatatgggtaaattgcatgttccaggggtttggtgtacaaatattacatatcctattctaagtgctgaaaaactaaagtttttaatgctcctatcagcaaaaagagcaccaagcaaataaacatgtcctaatcatttgccatggtagtagatcattaaaaaaatacatttatcttaattacagaatacatgctaagcagaggttcagaaataaaatttctaatgggaactgacagatcgacaaaaggctaacataatatttgcttcatttgtaacaagtattggttgaagggtccaggtaactcaactagcctcagaataaaggatgtaaaactgaaaaggagattttaaacattcttttttagtagcaaaattacacacatgttttatattaaaaaggtaatgaaagaaaaggtggaattttaaaattacgtgaatttctttgggatgaaagcttctggaggcctagtgactgctgaacatttctagaaaagaagacaggtgaccaaaaagcaaattggaaacaaaagacagaatgtttgaagatgaaggccagaggtaatcgatttcattattatattacatcatgtaaaaaatttcttatttcattttaaacagatacacggccatgatgtagaattagattttcttaaaactccaaagaaaaagaaatagcaatttagaaaagcaaattgtaggataagatatcaaactagttagtcatccagttgcttctaatgtcaagtgttttctactttctggcacacacccttgctattgcttttccatttctccctggtcattctcctcctttagtgtccaactcagacttcagccacccagacaaagtattttcttctcctactcttctgattgtgctgagccactttgctgcctctagccctgccacagcacctgttgaatttgcatttcaggtggccgttgaaattgcatttcagttctgagctctggtggataggaaccaggtgccattgatgtttttcactttttcatatattctcagtgccttcccagttgtttagccttcacctgtcttgcccttctctgaattccagtcccatcagctttctttctgtccccatccttgtcataaagccccatccttgtcataaagccccatcacagcatttgccctatgcctgggctactcttacttctctttgcctaattatttcctgcgtgtccttcacatcccatctcagagaggccttcggtgacctcttcatttagatcaaattgccttgcgttgatagtgttgtgtacctagcattgggcacatttgcaattataaatttgtttattaagattttacggccgggcgtggtggctcacgcctgtaatcccagcactttgggaggcctaggcgggaggatcacgaggtcaggagatcaagaccatcctggctaacacggtgaaaccccctctctactaaaaatacaaaaaattagccgggcgtggtggcgggcgcctgtagtcccagctactcgggaggctgaggcaggagaatggcatgaaccccgggaggcggagcttgcagtgagctgagatcgcgccattgcattccagcctgggcaacagatcgagactctacctcaaaaaaaaaaaaaaaaaaaagattttacacccctaccagactataaatgtaatgggggcatatactatgtccatatttcacttaaggttatatccgtagctcatttcatagggctgtacgtatagtagatggccaataaacatttgtgaaatacattgataatatggggtgtgtaacatttgtacttttgaatctaataaatactcatggtttaagtcaattatcagtggtttatggttcaagatgtttgctcttaatttttcttcactgtatcaaatagagatattgaaatttcacttttaccattttccacatttttttccagttccagtaaaattcagatttagtaaccctttcctacattatttctttccccagttattttaagagcatttcagtagataagctggtaacaggggagaaggaaaagaaactaaagggaaggaaaagatattcctgataaaaaaggtttaactatcttgccaaaatgaggttctaagggaatttgattaaagaagtattaaatatatggacatttgtatatttgatactcaattttcaaagaccttttccctttaataaagtagtcaagtgcttttacatgtgggctgtctgaccccagtaggggcataaaaaggctaagaattctggcttgttggattatggcagttggacatttgaaacctacaattttgatgtgcatccaaaatgccactggctaaagagacccccctctaaccctgtccttgcttgtgctacagctagaagcacacaggtgagagcagaatgaaacacctaagaaatctaaagaattggagtttaggaccagaaaatgaaggttggtgttcgagaggctaactggagattttataatgtctggcactctggggaagagaacccacagtgtaaagtttaaggaagtaaaatgtatctactcctttatattaggcggtagtgtattttgcctgtgtttttgttataatcaacaacattgtgttatgattgatccattttaggtctctcttttgcaagactctctgggttccttggatgatgaaaaggttgttttgtattttcatatgtccagcactgagcaatgtgcttaacacttaatagatgctccagagatatttgctgaatgaattcccatgtcctccaaatttgtcctatcctctctgattagtttatttaattaatttatttatttttgagacggagtctcactctgttgcccaggctggagtgcagaggtgtgatctcggctcactgcaaccttcgcctcctgggttcaagtgattcttgtgcctcagcctcctgagtagctgggactacaggtgcttgccaccacgcctagctaatttttgtgttttagtagaaacggggtttcaccatggtgatcaggctggtcttaaactcctgacctcaaatgatccgcctgccttggcctcccaaagtgctgggattacaggcatgagccaccatgcctggccctccccaattagtttttgtctttttttttttttagtttaatgtattttaatagcaaacttacaggaacagcacagaagacagacaacattcaaaacatgtacttggatgtaggacaactcagtcagaaaagtatagtgaatggatggaatctactgtatgataaaaatgctacaaacaccatttagttgccgtcaataagaaatgtacttgttttgaaaaaatccaaatgccggcattgtccagaaaaatttaacgggtttatttataattattttaaagttgaaccgctgaaacttgttcactgaaacattttaacttgcattaatgctttatgactccacatttatattaaaaattcacacacaaatgaaaatggaaaaactgccaatacctaattactgtcccctatttttccacttgcaatcacatacttaggtacattttgaccccatggaaaaaaattaacgttcagaactaccagtaacaggaagaagagactttttttttttattgagaatgaaatgtttcccatcatagtggattcttaagcacgttctccacgtatgcagcctgctagcttgatgtcttttggcataattgttacacgtttggcatggatagcacacaggttggtgtcttcaaaaaggccaaccagctaggcctcagttgcctcctgcaaagcaccgatagctgcactctggaagcgcagatctgttttaaagtcctgagcaatttcttgcaccaaacgctggacgggaagtttgtgaatcagaagttcagtggacttctgatgactaatttcacgaagtgccacagtaccaggcctgtaacgatgaggtttctccacccctccagtagagggcgcactcttgcaagcggcttttgtagccagttgcttcccgggtgttttaccaccagtcgatttgcgggaagtcagctttgtaggagccatgatatagagacctccttgcttaaccacccttctccttcggctggagctcggcgagctagaggcggcgctggctagaggcgagctagagactggctagctggcgagctagagagcgacggtggcggtggcgcggcggcggctgcgaacacaattgctccaattagttgtaagcatattttttaaaccatgcttacctatgttatactatagttgtgtaaagataatttaaagcattaacaaaggatttaaccatttagtaatcagagaaggaaaaacgtgttagaaaaaaatgaagagattaatctttgtactttagctcaagaaaacctgggtttcttggtaaaaaaaaaaaaaatgtagattcttgggtctaatcctggatctaatgaacaagaattttttggatgatgcccaggaatctgcctttaaaaagtcagttacttttggggaccagtgttttgagatataaatgttaaggagatgggcaggaaaacaaatattcttactagcattgttttatcttgactttttcatgtctgagtgtgggaaaatcactctataacacttcacttgtgataaaccgctccagattccaaagcagaagcagagtgaggatggtgtgtgtgtgtgtgtgtgtgtgtgtgtgtgtgtgtgtgtgtgtgtgtgtgtgttggagttactgggttgccattaaacttaattgactctagttatttctgttttctcatgtcatgcccaggataaataatgagtctcaaaagcattgaaatacttttgacccctaaaaaacaatctattagtgttttgattttataatacatgtaagagttatttgttacacctgtttcttctcttttttatcctccactcttgtcaaaatgtcagtcattaaataataggtattttagataagaattaaatatgtagatatttattcacaaagaccctgcaattttccccaaaatagaaaaagccaacttttgtcttcagtgaaagacagaaagggtaacatatgatatgaattattagatataggatactcaaattcaaatttgtttattataaatttgttattttagaaatgacagctaggacatggaatgactaaaaatatgtacattcaataacacatttagaaatacaggaaattttagaactaggtactttgagaattaagagattaagaagggattattttctatctgcacagttctcagggaatagatatgatgagtgatcctaactatttgagtaaatgtcaactgccagcagacaccaccagcttatatcgaagaaaagtcacaaaaaatatgaagagattcatcacactgggaatggaaaacatcgaataagtcagcaagtccagcaaaagaagaaagtattacaagtataatttaaaaatagttttggcaagaggaggttggggagaaagcagagtaggctataataataattataactcaaagatgggccagacctaaatgtacaccttggcctctttccatcctaaaatgttctatattagcaaaagaggtgttatgatttatactcagctccaagtctagactggtttaggtttcctgtgtttaattctgcttctttcttaacaaaaaaatctagtcatctagatctcaagtgaaatgtgcaattgaaggtataaaaataaaattcaattgaggaaggcaagtttgtccttaaaataaaatttaaaataccagcatttatttttaaaaaactacctaattacatctagtcccatacatatgttcaagattaatatgcaactgatgcatgaaaataaaattcagctgagggtaactactgtctcattaaaaagaaaatagaaaactagcatttctatgaaaacgtctagctaatcatataaaaactcatatacatgtgcattgacaagtaaatgctggtgatatattatttgattgaggtcaatttttattctaaatatttttgcatagtgggaatttgttatgttaaataattttgggattggatctctgagagggcttagtaatatattttatattaaattaatcacagtgaaaaaatctttgaaataggcttgatgtttataattatagtattctgtgtttaaacgtgaaaacattgtctccttttaaaaatggtattaactctaggagacaggatatataatgatcaattctttctaccatgaaactctattaattactaaaagtgttagtatgcaaaatacaatataagttgataagaaaaaccaattcacatttgatacccagtggacaaattagaataaaatattataatgttcaaagaacactctatattccataatgttctctgttaagcctgtgtccttctgagtatggtgagtggcaattctggccttaccttcaaacatctgcttcatgtttaaattaaattatgctacgtgcttgtccctgcataagagtagcaaatactgaaagtacagtgaaagggatagtaaaagacttctaagtaggagaagtattaaaaatattctccagctggtaaggctggaacactgatgatcaagacagttctgttgaagggtgggaggcgccctcttctttgctccttcaggtgttaaccttttttttttagatggtggttgattgcagggcctggaggagggcttgagtgtggcctgtgtggcctgggtctagagaagctgttatttaccaaccaatttggaaagagtttaactacggtatttaaaactgtggcagctgtatctgaccaaaagttaagcttctgaacttttccccatagatcacagagggcgggcctccagggaaggtttcaagcaggaggctgacttgaggaggtttttgttttagaaagagccttcaggtagcaatgttgaagatgatggattgcatgagtttgagaaaacattcaggaggattggttttaaaacctaagaaaagaattgaggtagtggctagggagcagaagtgaagaaatggatgtgagaactactttggaggaataattttacagagtcagtgacagttttagaattggatagggtgtgagtttgactcccaggattctggcttggaccactgtggaaaatagtaccattacctgggagaggataaagatgtagtggtgtctgttacttgtttgtctggtttgctggctgattggttggctttatttaattaattttctgagaagagccatgtttataagctgcaggcacaactgcaaatacattaatttaaacatataatagtgcggctttctctgtcggacaacaaaaaagaaccagaaaaggaagggggtgaggggctgaataacattccatgatcacctattatactcttttaactaattttggaatcacattcatgccatacagaggatagtactgttgccatttcacagatgagaattctgacttaccaggtttgaatgactggcctactttctcatagtcagaatgtggcagcgtcacaatttaaatccatttctgtccatcttcagggtctcagtctttaactgtatgaaaatacctccaaaatggaaaagagtgaaaaagaatgaaagggaagaaaagaaaagaaaagggaaagaacgaagaaaaaagtatttagagtgaccaaagaagaagaaagcaaattccaattgaaagggaccaagcagagatgctcatccatgagcaggtcttacccccgcctagacaagttcatagtcctccctaaaggtggcaggaagtttacacagaatattagttcctcataggtgtccctagccttcaggtgacctgaacatgcagccagtaagtgaactggtatcagtttatggccaaaccactgctctctagacttctgcttttagagtggtgcttttcaacctgggctgctgcagatcctcacattctttccggtctgtggagtaattgagagtaggctattagaaacttttataggaatctgactgagtactgttgtatctgctggatccagtaattttaaaacgggattgtattttgtatgtctgtttcatttttcaagtcattggcattgcgttttatgaaataatatatctgtgatgaatcagaaacaaaggaacaaaaactggcccttcaccacagataatttgagaagtaagctttagagcatcaaaagaaaaaaagatgatgagaacctgataggtgtttttgtgctcttggtaacagagactttctcttataaatgtgatggtttagtgaactgcctttacatagcgatctattggccccatatacaaatataatcaaatgatttgtgtcatttgaagctacacaatagatgaacctggtttttgtaatttaacaaaaaatccaatttatgtaacatattaaaagaagcattatcaacttgttttctcctcaaaagactgtagctgttaaactccttaattacttcattttcactctcagtgtaacattagcagtttagcacttcaagtacaaaaatgattaatgagcctgagaattcattcgcatacatatcactttgcatcttgacataaccctggagcctgttctctattctagccatagacatacttccctagcaaatatcttattgcatattaaatgcctaatcattgcaaagtatgcataattatagtcatctttcctgtttttttctacgcaaacaaaaaagacaacaaatcaaatgcattcaaatgtaactaacattttaaaccaaagtataaatccatagggagcatcatgatttttgcattgtaactgtccccgaaaattcaattgtgatttgagctgaagtgtcattcatctaaaaatgtatctttaaaatttttttgaacatgaaggaaaagactttcaatttctatatttatatgtatgtgagtactgtgacttgggaaaatatgacgagagtaaagactgcattgtggattcagagaataagattttatttggagttactgtaagaaatatctgcagggggctatttctgtctaaccatccttggcttgcattggtgacatgtgcctacatgtttcttttagctttagtgaatttcttttttgatctcctccaaggtgatcccacagtgctgactttgtccaatcattcccgaggcttaatcttttaagtatgatcaatggttctttgtgtctttgccttcccttgttttttctactgtattctgtggagttcagccacagctctgtgctgtccctacctaataatcctcttttccctacatgctgatcacctctaagctacactctactacattcagtatggaatcaggaagactaaatgaactttttctcagaactcagagaactgcacttgtcaggcttgttgccattacacaacattgtagttactggaaggtgaaccaaacaacttccaggggcctttcatgtgcaagggaagagcagaactgtagactacttgctagactctaaatctggtctccaattgtttttgttcatgtaggtaaagctatatgctctaaatttgtacctgtttccatttgcttttagagggagacatttagttcggggacaaaataaataatgtccattgaactggacatagtcaaatatttccaataaatttttaaaaccatgtgtgtactccggtaaagcacaggtatcattttctcactgcacaagtgtatactacaaatgcagtcttgcggctggacatctctgaccaacaactagaccactgaaattgcaaggcaatgcagtcaactaaggcactgaggcactgttcccaggaaagatcgtttgattatgatacaatcaggactccttatctagacccatacttgataaatagggttggcagataagttacaggacgcccagatataaaaacaaggaatttaaaaaagtgtaagtatgtcccaaatattacatgaaatatatttatattaaaataaaattactccttatctgaaatacaaattacactgggtgtcctgtatttttatttactaaatatggcagttctatttataagtggtactttttttttgtttgtttgtttttgagacagagtcttgccctgtcacccaggctggagtgcagtggtgtgatcttggctcactgcaacctccacctcccaggttcgaacaattctcatgccttagcctcctgtggaactgggattacaggcatgcaccaccatgcctggctaatttttgtattttcagtagagacagggtttcaccatgttggccaggctggtctcgaactcctgacctcaggtgatccacctgcctaagcctcccacagtgctgggattacaagcgtgagccaccatgcccggctataagtggtactttataagcagcaaagatcatttgaaacagtacacttcctgaggttagtgactaatgagattattcctatatccctaaatgtcatagaagtgggaggaaatgtgaaaaaacagagactcaagagtgggtgtcagctatggagcacgcacgcgcactctggtgcttgcccacgctgcactggcctacactggcccacgcaggcccacacagacccacacaggatcactcagaccgacactctccaggttagagcacttatccagtggatggttcagctttctggaggataggtggagcgttcttaatgccagcccttttctggtccccactaggctgtggtaccctcagaagtcggaaggcgatgttacatactaaggattgcttcctttgtgctgctgcaggatgcccggtgaaaaaaatctgtaaaatgacatccaaataacccaacccttacctgtgtggattttgaacttgctaaaagacacagtggaccccacctatttgtggattgagctaataaaaataatttaacaaacaatgtgataaatatgatggatatgggaaagctgatagtgaagatctttgggtcttataagactgtcaaagaggatatccaagaagaaacgggacaaagaagaaagatgaattgcatttctaagaaggtatttaaatccagtacctccaaaatattaatataaagataaatgcattactaggcggtttttgaataaattttttttgtttacaaactaaactattattctgtaagtaggactatattaaagtgaaaaagagtagcaaagtatgaatgaatacacaaacacacataaaactttctaattagaacaaaaaaaccatatttcttttggtccttttgctttgtttgtttaaggtacataattgaaaaatcagctattctgaatgaaagctttctatcaagtagatgatacttagatttatttttgctgtcacctggcttagttggctatataaacataacaaattgctaattgatattagtaaatatacagtatttgtgacttccttcagtcattatacctttcctcgagaaagtagacttaattgcaccacgtattgggggctgaattttactagtactactaatttatccagcagtggctttctatttgctatatattaacaatttgcatcttgaattagacagttttcttgtagtgtggagatatttattacttctaatgacatgtcaattctactttacttttaggcctaattttaaattcacttaagaaaaccattttttattgaagagatgtgtacatattttcaggatggtcatttaaaaaaaattccaagcaagtgaatgaaatcattcttgggctgtgaattaccttaaaaaatacatttgggaaatatacagtgcctactacccaagatagttatggtgactaattagcttcttacctagatttacagcaccgttaccctgtaaaataatctttgtaaaataggtcacaaactgggtctgcctgaatcttaagtataaatttcatgtttcatggttttgtactgcagctctaaagtaaaacaaaacttattgtcaatcgaatcactttggaggttcatgttgcctcgcatgtcttttgcttaaattcttgtctacagctgcctgcctgatttggatcttgtgccctaatcctagtaactggactcctgttttgctactgtgaacacatttttgtctgttcgcctcatgctagtaactccctttctcattcttccacatgtctggttctgaacacccttctgatgactacagctctgatccctcctctcctggtgaatgatgttctgaacctgtcttaggctgttgtataacaaagtgccatagactggatggtttgtaaacaacagaaacttatttctcccagttatgtaggcttgaagttagagaacaggatgctagcatggtggggttctggtgagaaccctcttcttgtctgcagaatgctatcttcttatatcctcacatggtggagagcagagagcaagttctctggggtctcttttgtaagggcactaatcccattcatgagggttctacccttatgtcctaattacctcccaaaggccccaccctctaataccatcacattctggattcagatttcatcatatgaattttagagggacacaaacattcagtccatagcagatcacagccttcagcggtggcagccttagaatttctatgtagcaattaggcggtgcttggagctgagctgtttgggtatgggagaaaagcagcttgttttaaagccatgtgtgcattgcaattaccctttttttagtaaaagttgcatatttagttgtggtggcttgggggtagtaataaaaattcatgaaggagcaggtttctttgtagccaatcataggcaatgccactgaattcaaggctgggaatccaaaagaattgttttttttttcttttttgagacggagtctcaccctgtcgcccaggctggagtgcaatggcgtgatgtcggctctctgcaacctctgcctcctgggttcaagtgattctcctgcctcagcctccagagtagctggtattacaggcacacaccaccatacccggctaattttttgtatctttagtagagacagggttacgccgtgttggccaggcttgtctcgaactcctgacctctgcatccgcccacctcggcctcccgaagtgctcgggctataggcgtgagccaccgcacccggccaagaattgttttcttacttagttttgtgtctgcagctttgtatataaatagcatatagctgtagtaaataaatatctttgatgattgatctaatgtcatgaatttctagtcctggattccaaatagccacatctattcaactgtaactcttgggataccctatttctcctccttgaagttttctgttggaaaacgcttgctttagccactgtctatggcctctcatgatatcctccagttatgaaggtgtttaatgtactgtgagccatggatagcataatatagtcatgagatttatcataaaacagacctggaactgaatttgtgtcataccaatggtctggttacttctctttgcctgttttacatttcaataaaataaggataataataatattcattctttctcacagtggttaagaggattaaattaggaaacttaagtgtttgacacgtatttgataatcaggaaaattgccctcatctgatatgttgaacttataaaaattgccctcatctgatatgttgaacaaagatggactttgttcaacatactttatccgtgttttagataaatatagatattcaaagtgctgagtcattcattcaacaaactgtctcttaggtgctactttatttcaggctctttgctaagatgaactggaccagaaatttatcagaaaaagtaacagggcatatgacatattagagttaaggatggctagaagagaaatggggatggttcaggtagaacaacacaattaaaaatgtagccccaaggccgggcgcagtggctcacacctgtaatctcagcactttgggaagctgaggcgggtggatcacttgatgtcaggagttcaagaccagactggccaacatggtgaaaccgtgtttctactaaaaataaaaaaactagccccttgtggtggcgcatgcctgtaatcccggctactcaggaagctgaggcaggagaatcgcttgaaccaggaggcagaggttgcagtgaacggagattgcactactgcactccagcctgggtgacagagtgagaggctctatctcaaaaaatattatatatatatatataacttatatatataaattatttatataatttataatataatataattttatatataaattatatataattatatcatttataatataatttataattatatcatatcatatataatttatatatataatcatatataaattgtatatatatatatcccctccaaaattgaagagaatggagaaataataacaattcgagttaatttcggtgatcttggagacattgctgaggctggaaaggatagaactttaagagacttgtagttatgtggactttatggataaatacaaaagttttctcaggcaaatgtagagaatctctgctttgtttccactgactttaagtatatcaccatgataaacactttggtgctattctaattgcatataaacatgcacaactcccatcctgaaggtaggatgaccaattatcccatttgcccaagcctgaggactttcccaagaaacaggactttctttgctaaagctgggagtgtcctaggcaaactgggacaagttggtcacccgctttaaagcaaagacaagactgtgtcttaatctttatgcatcccagaactttgtgtaattccttgtatagtgctttggaggggatcaatacatacttttgctgactcatcagttttaaaccagacccttgtgattttgtctggatagttaaccagaatagacgttggttgaggctgataaattagggaaaatagagctgtttggctaaaagtaaaactaagaagaagaaagccagcctcatctgcaatattgaaaaaaatatgtgttctttctctagtctgcacctgtaattttatgtttcaggtttatttggactctcagaattttcacaatatagcagaattgttccttgcactcagttaaggagtaatgcaatcagaacaggggttggaatggtaataaccaaattcctgccacagctctaccaccctctaataatataaacttaagtaagtcacttaaactctcaaagcattattgctttcaaccaaaggcatgtgtataataacaacttccttataagaaacagctccatatgataacttttataaaatagacttaggaacttcaaaggatgagataaattcgaattattctaatgaccagtcatgccataatgatagtgatatgctgatttaaatgattcagattatggttgtcaacatgtgatagtgaaaataactaaactaccaaagttgaatttccatgtacacactgaaaggacaatatctataaatatctatagcacacctcaatggtcacaatttccagtgagtaacattgattaagtaaaattaaattcttctgaagtttaagtctgtagtctcctaaaatgcccacactggctcaattattcatgaattacagttatattctttttctcaagtctttcaaaaggactaatttaaaaaccagaaaaggtattaacaaatcaaaagaacaaagggacatgttcatttcaagttatgccttgaaattgtaatgaaaacttaatctcaagggccccacatattttctaactgctaaatggaatatcctagttgtacttttgtatctagactgaacaaaacttataaaattcattccaacacacttgccagctaatggatctgagtacatttaatagtaaaaataatgctactgattacattcagtaatgcattttgttttttgcatttttttctattccgaagattgactgagttagtagtccaatgctgatgtgttacttatcagctatgatgaaattactagagtttttcccagttagctatgatgtctaccaagaaactatgatgacaaagaagtctggatttctagtccagctgggcagcacaataataagaatcattcaggagcgctgtatggactgaatttattgagcaagaagaaaactgcatgaacaaactgtggaagcttaacacatctggttagcaaagaaatttattttggccggagagattaaaaacctctttttccagtaacttattctgccagaggtactagaccagaatctgggccatcccacagatcttagcatatgggcatttttcagtagaaggagcattgaagttactgaactgttttctctgcctagccaatttaatatgaaatatgattgaaaccagtaggtccgcactggtatttatttatttcccagtgctttcctaaacgagttttatagtattcagagcatagtgttaaattgattcacctttctccatgtgagaattgtaagcaatttgattagcttttctctattttcatcttctgacatatactgttataactaagaaaaattataacccttttttcttactgaaaataatttatattcagtagtgtttttgtgcctgcacagaatataatctctacaggcttaaatatcaacatttgtaactgtatgggtatgatggtattaagaacaattccaaagacaaattacacttttaaatgttcatgatactgaatttatccctcagaccttataattgaacgttgcaaaccagacacattcctgtgtgttttatttagtgaaggaaggaaagaatgttaaaaaaaaaataaaattagggttttttatatgactgctaaacatgataaattaagggagtcttgttaccctgagagatgtaactttattgatctctcagttaaaagctgctaaatgagtgaatgaaaagatagaagctgggggagggggactgctatctttgctcttcaagaaatggtttatgctaaaatttaatgaccacctactaagagcagtgatgcatgcggaggcttgggtcctttttttcttcctttccatgcctttcacagcggagtctaccactgctgctcatccttagtttcacctgccttactttctgtccagttttcttcctggatcagggccctggcaccctatctaacttctattaattctgtttcctggctgtgggtcatgttcctcatatctaccacctgctttctagtggcagtacaacaattacagctacctgccagccccatcaccccacttgaaaggaatccattatttccagggtcctgcttggattgccttatttcaatcctttaaaaaaaatattcattcttgtgggcttttgactttctcatttccaaggtcttctttttttaacctttaaattcaggggtacaagtgcaggtttgttacataggtgaacttgtgtcatagaagtttgttgtacagattatttcctcacccaggtattaagcctagaacccagtaattatttttcctgatcctctccctcctcccaccctccaccttctgaaatgccccagtgtgtgttgttcccttctatgtgttcatgtgttctcatcatttagctcccactaatacgtgagaacatgtggtatttggttttctgttcctgtgttagtttgctaaggataatggcctcctgctccatccatgtccctgcaaagcatggtactggtacaaaaacagacacatagaccaatggaacagaatagaggacccggaaataaggctgcacagctacatctatgtgatctttgacaaacctgacaaaaacaagcaatggaaaaaggattatctattcaatgaatggtgctgggataactggctagccacatgcagaagattgaaactggaccccttccttacaccatatacaaaagttaactcaaaatggattaaagacttaagtgtaaaacccaaaactataaaaaccctggaagacaacctaggcagtaccattcaggacataggcacgggcaaagatttcataatgaagacaccaaaagtaattgcaactaaagcaaaaattgacaaatgggatctaattaaactaaagtcttcccttaaaaggtcactactttccaggtgggtagcacattcagtggctaatatcttagtttgaagggcatttccctggccagtgtcctctggagttagaaagagctgagcagcatggcagcactggtcctctgaaaggggaaaacatggagtgggatgtgattaactgagatataaaatctcggagggtgtgatccatgacccttgttgacccatgtcttcctcacacctaggagtgcctgcaacaatgtagatcctcagtgttgaatatatgaatgtgtaaatgaaggtacctatttcacaaatcgtctaggattgacatcaccctaaggatggatgttgtttatttcaccagcagtttgggattgtgaaagccctgtgtatggtcacaggctttgaaatgtgtgatgaatctgcatctttaattgggtctctatagtcaaatgagagtcttcatttttctaaaggttcatactgagaagcacaggctttctttcagtgtattgaaggtgcattgtattagattaacactgaaccaaaccattgtcctttgaattgcatgttgtaatcaaacaatgcgattgttttgttaaatactttaaaaattgtattgacttctcaaactaaatagaaacttacttagcttaatagtcagcttatatcatattttatctcatcacatttttcttttctaatgactgtatttgctttattattctgtggctaagtaagatttaaaaaaaaaacccaaaacaacattaaaatgctcccttttgaccaaggtacttccttctcattgtggaaaatgtggaaaactctcacatcaattgcaccaccaccccccttccctatgcactcaatgaaacaatttaaattaagtatctattttgtgtcagctatggagatagactttggggaaataccgttccttttttcattcttcattttgtgccaacaaaatattttgagggaggaatatttttatatcaattattttcattatctaagttaaaataggtacaatggccatttaccctagatttgttttaactgtcctaattttcaaatagtctgaattatttacctgcatttaaagctatgagtcctaatgttggttttggaacatatggtcctcttggagatatatttattttcagagaaactacctgagaatttttacgttttttcttgagtcaaagtagacttatgttttaatagcttgaatagaagaaaatttcaaaactcttagcccattgtaaagttaaagagtacataagtttatgtagtattcatgatttacgaataattggatttttagatcaaaattaactaattgaacttgaaaaatatccaactctatttttatgtcatgtattcaatgcatacacattttatatacccaaatctctagacactgtgcctggcaatatgaatttaaaataataagtaaatatttcttgattttagttttaatgcacaataaaacactaagaataaatagcctagttggtgtatatagaaaaatccataagtaatgattcaaaattatttgaagatggacatattatttttagtagtgagtatatatgggatgtggctgaaattactagacatataaccataatattatgtgaccatttggtgtagataatgcctgactgacaatagcagcaatgtatggttgttttttggtgtttctaccttttagacttacacattttaaatgcttaagatgagtaatctcattcatctttcctgttgcttgcactgaatatttgttgctgctaatccttcttatttccatagtattgttcaaaggtacattccagggcatctttgaagcatattttttaacccccgctgtgtctctaacttgtcatgtaatggttgcttgagcatgtcagccattctgtgtgtgtttgccaagccccagtgtgctggtataagtaggcattgcaattaggctgagagacaagctgcattacaagaactatttgctgcttatattgtcccaatattttaacccaagccaatacagatagcattgagcataatactttacatatagtattaaatatagcatacattacataaagcataatacaatatatataacattgcgcataatatattgagcatgtaccatatgtccagcttttgctaactactgtggagaaatatgggggtgggatgaggaaggcagtattggatgggaggctggtaagaagtataaaggagacctgctcttagtaaactgcagttttgttgaggataacagtgatatacaaaaataattagaaatcatataaggaaaatatacaaacagcgatgcttaggttgtgctgatttaactctttatgatgcagaacatgtaactgggcagctccaagtcctaaagtcttgtaggagttcagttgtttggggtaactacatttcattcatgagttgtatgagtgtagctatcttcgtgtcatgtcttactaccttttgaatcattggtaatcattgttaaacacaatactttggtagaagagatcagtgacaattcacctctatgattgttaatgaaaacgtttgactactgaaataccttcagtggtaatagcttcactattcttaatttttttttaccacaacacttaatttttaatctacgatatgatcattttattgctccatcctctaaatttagccactgagatgattttaaagcatccttaaattccttaagaaaatttaaaaatcaggaatagacagaaggaaggattcacatctatatttatcccaatatactttcctggtgttttggaggatgtcagcttcatcacagattaaacaccaagaaaaggagaggtttaaaagttcacatggatgtgctgcactatgcaatatttttttattttctgtgtgcatattagtaacacttattttatggctgggtgtggtggctcacgcctgtaatcccagcactttgggaggctgaggctggtggatcacctgaggtcaggagtttgagaccagcctggccaacgtggcgaaaccccgtctctactaaaaatacaaaagttaactgggcatggtggcgctcgcctatcctctcagctactcgggaggctgaggcaggagaatcgcttgaaccagggaggcagaggttgcagtgagtcaagattgcaccactgcactccagcctgggtgacagcctgagagtctgactgaaaaaaaaaaaaaccaacaaaacaaaacccgctttctttaggattttgccttttcttgaggacttatattgtttttgaggattttactagcattttctaggtctaaggactcaaaaatcctgaccccaattctttttctcttatacgtagtgacagactgatattattgtaccaattatataactcagcttctcatcattttgatgtgcagaggttagttaatttttagaagctacacagctaataaatagtgtatttattttttacaaaggaaagttctaccttataaaagaatagttctgttatgaaatcttatacatcagttatagaggggaggacatataaattatattacttatacaagtcaactaattttattgtatgataatgagacagatatgttattaaaatttcttcattacatcagtttttccaaaatagacagttttattgacttttctttttctaaaggtattatgaatattatctttaatgccagcatttaaagatctttatgttttgtgtgcatattatagttttttctgtgtgtttgtgtgttatataagaaggatcatgtgatatatacagttttgaaactggcttcaactccccctttcacagtatgtcatagacatctatcagtgtagtcattgattacaaatctgcatcatgattataatgactgtgtagcagcatattgaattgattcgtatgtctttgtttatttgcttaaccaatctcttattggtggacacttggttttcacattttctctctgataccaacacaactctgagatgtgtatactttctatgagactgtgtgtgtcatgcatactttcaaagatagccttctgataccttttttttttttgagacggagtctcactgtgtcacccaggctggagtgcagtggggtgattttggctcactgtatcctctgcctcctggattcaagtgattctcctgcctcagcctcctgaatagcggggattacaggcatgtaccacgaagcccaactaatttttgtatttttagtagagatggggtttccctgtattggccaggctggtctcgaactcctgacctcaggtgatctgcctctcttagcctcccaaagtgttgggattatagatgtaagccaccacacccagcctgattacttcttcaggataaatttcaggaagttgcagagcaatgtcatgttgcagcctctaccacctccttcttttcctcctccttccatttttttttgttatctgtaactatctcaagtctgactgctcgccagtcagaggccaaaaacatgagaagtgagatatggtgaaaggaaagcaactttattgattgaatgctagcagatgggagatggccaggcttctgcctcaaataagccatcttagttttttgggccggatgaaggagtttgagagggaaaaggtgtgggaagtatgctagagtggtgcaggaggttgcaagtctatgttttattccgatggctatcaagtaatcgcccgttggaagatccggtttgcatcaccttgactttggctcggtagtggtggactatctgtatctgtaattcctcctaagcaggaggattctgcctctgggtctctctctgcctgatttgtttaaaaattggcccctggaattttaaggcaagcacataattacataagcgagcactgttcactgaaatgcctggtgggaaaggaggaaacagagtttcaaagtatgtttcaaggctgaaagcaagaaaggaaaaaagttttaaaatgcattttgaggctgaaatacttggttacctgcttatttatatttataaattggtattctaaagtcccaatagaccatagagagaaaaatagagagaaggaaagtttcttttttctaatactctgctgtatgttaggtactgtaaatatagtatttaatcttcatgttaaccctgaaagctgagtggagagtttaaataatatgccaaaggctacattatcaatgtcaaggctaaaagggaatttattaatagttctgtctaatcgtagaacattgttttaaaatttaagtgaaattcatataacatacaattgaccatttaaaaatgtgcaattcaatgtgtgtttccttgtcttggctattgtgaataatgctgcaatgaacatgggagtgcaggtatcttttccagaaccaaatttcatttcctttcaatatatgcccagaagtgggatggctggatcatatggtagttttatttgtagtttttttgaggaatctccatactgttttccataatggctgtgctaattcacattcccaacaacagtgtgcaagggtccccttttctccacatcctctccaacacttgatatgttttgtctttttaataatagctattctaacaagtgtgaggtgatatctcattgtgattttgatttgcattttccccataattagcgatgttgagcaacttttcatattatctgttggccagatatgtcttatttgtatgtcttctttagagaaatatctattcagatcctttgcccatttttattcgggttttttttccattatttcgttttcattattgtatgagttcctcatatattttggatattaaccacttattagttatatagtttgcacatattttctcccacttcgtaagttttgtttttgtttttattttttttactttgttaattgtttgctgtgtagaagctttttagcttgatgtaatctcacttgtccttgattttgttgcttgagctcttggtgtcattacaaaaaagtcattggcaggagcaatatcaagaaacttctcctctgttttcttttaatagttataaggtttcaggtcttacatttaaatatttaaccactttgaactgatttttgaatgtggtgtgaaataaaagcacagttttattattctgcacatagatatccagttttcttaactccatttattaaagagactatcttttccccattttattttctgggcatctttgttaagcatcagttgaccataaatgtgtggatttatttctgggctattttgttctattggtttctatgcctgtttttatgccatcgccatactgttttcattgctgtagctttgtaatacattattttgaaaccaggaagtatgatgccttcagttttaatcttcttgctcaagattgcttcagctatttggagtctttgtggttctatatgaattttaagaatttttacatttctgtaaagaatgccattaggatttagatagggattgcattcagtgtatagatcatagatcattttgggtagtgtgaatattttaacaatactaatttttctaatcaatgaacacaggacatcatttctttcatctgtattttcttttattttcctaatcaatgttttaaattttcagtggaaaaatctttcatatttttagctaaatttattccctagtattttattctttttattgctagtgtaaataggatttttttccttgatttcctttctggatagtttgttgtcagtagatagaaatgacagtgatttttgtatgctaattttgtatcttgcaactttactgaatttgttcattattctaacagtttttttgttgccattagtgttttttacacatatgatcatgtcatctacaaacagggatagttttacttcttcctctctgatttcagtgccttttatttcttgtcttattgctctggctaggacttcttatactgtgttgaagagaagtggtaagcatgggtaccctagctttatatcagatcttagcagaaaagctttcagcttttccccattgattatgatattagctgtggagttttcatatgttgtctttattatgttgaagtcagttccttctatacctattttgttgagaggtttttcttaaatcatgaatggatgttaaattttgtcatatgctttttgtttttgcatctattgagatgatcatgtagttttatcttagagtctgttaatgtggtatatcacattgatcgatatgttgaatcatccttgaatctaagggataaatcccccttgatcattgtgtataatccttttaatatgttattaaatttagttttctgatattttgtggaggatttttgcattgtctgtagttttcttgtagtggctttgtctagctttgatattggagtgatattggcctcataaagttatttctgttttttgaaagggtttgagaaggattggtattaatatttctttgaatgtttggtagaattcacctgtgaaggcatctgcttctgggcttttctgttgttgttggaaggtttttgattactgattgaatctccttatttgttattggtcttttcaggctttctttttattctcaattccttcttgttaggttgtaggtattcaagaatttatttatgttctctaggttatctagttttttgacatataattcttcataatagtcctgtatgatccttttatttttgaggttcccattgcaatgtctcattttttcatttctggacaaatggataaagaaattgtggtgtctatatacaattagatattattcagcctttaaaaagaaggaaacccattttcaaaaacataaatgaacctagaggaaattatgctaagggaaataagccagatactcatcattgctgaatgatctcatttatatgtgagatctaaaataggcaaacttctagaacaagagagtagaatgttgtttgtcagggttggggggaaagaggaattggagagatgttgttcaaagggtacaatgttttaattatgcaagattaataatttcttgagatgggatctaatgtacagcaaggtaactacaatgaaagatacttggaatttgttaagagggtagaccttaagtgctctcgccacaaaaaggaaaataaagaaaatggtaactatgtgaggtgatgaatatgttacttaacttgattttggcagtcatttaagaatgtatacatatatcaaaacatcaaggtgaataccttaaatgtatacaatttgtttttgtcgagtatccctcaataaaatggaaaaaaaatcctaaactattcagcggccttgaatacatttgtagtgttgtgcaaccatcacctctgtttagtaccaagacattcttgttacaccaatatcaagccccacatgtattaaatgagtcttcatttccctcttgctagcctctgacagccatgaatctgctttccgtctctatggttttacttattctacatgtgtcatataaatggaatcatacaatacgtgacttttcgtgtctggcttctttcaccaaacaggtttttgagattcatttatgttgtagcatgtatcagtcctttcttatttttatggctgaataatattacatcatatagatataccacatttgtttattcattcatctgttgatatatatattcattgtttccactttttggctattgggaatagtgctgctctgaagattaatgtataagtacctattttcaattctgtttttttttgttattgtttttgtttgtttttttgttttttgtttttgaaatggagtctcattctgtcgcccaggctgaagtgcagtggcatgacctcggctcactgcaacctccacctcccgggttcaagcgattcttctgcctcagccacccaagtagccaggatgacaggcgtgcaccaccacacgcagctaatttttttatatttttggtagagacagggtttcaccatgttgaccaggctggtcctcccaaagtgctgggagtacaggcatgagctaccatgcccggcccctgttcacaattctttaggtatataactaagattggaattgctgggtcatcttatccatagaacttgtgtagccttctttcacaaggctgtgggtattgtctgataatataatattttcttactatttacaaaatagaaaattcaagttattttaaaagatttgaataatcacaaattttattattgatatgaactttgatgtttagaaatctaaaatcttaatcctctagtacgtttcttcctggaatttgagactcctgttaaaactgttacaagttaaagttgaagaaagcacaaatatactttctagctcctggctattgatatatgcgatttagctgacccatttcattcaaggtcaggagtgttagtgatcttatccagagaaaccacagattcttataaattccctagtttacaattggggatgacaaatcacattttttcgaatcttgaagctgaggatgggctttaaaggaatcatcatgatgagaacatttttacatataattgcccaggaaactattctctagggatcttgagttcatattggattcctatataatttcttcctgtgtattttgagacctgcaagatagaactaaggggaaattagagtgggcaagagaagttcccttcttattgccagtgaagtatagcagctgacatggcttgtcagggtaagtgagtctcattatccctcagtagttgctaccaggtgagctagcacaaggaattaccttcttcctgaagcataaaatacaacagagaggaaatatctcttttttttttccaagaaggggaaaggtaggaaagatgggaaaaaagaaagaaagaagatagtgtacttaattataatatttttgaaatggaggagacctgaggaatcactttagttcaacttctttactttaaatagaaagagactggtttaaagttacccagccctgtggttataaccccgcgggctagaagccaactgtgcactctcctgtggcttgtgttactagtttcctatggctgctgtaacaaattattacatacttagtggcttaaacaacacaaatttattattttactcttctggaagtgagaagtctgacataggtctcaccgggctaaaatcaaggtattggtagggttgcattattttctggaggctctagttaagaattattttctttccttttctagcttctagcagctgcctgcattctttggcttctggggcccttctgtcttcaaagccagcagtcacatcagtctgacctctccgttcatcatctttgactctgactcttctgcttctctctttcacttttaaggattcttgtgggcccacccaaagaccacaggatgatttccctaactcaagatccttaacgtaatcacatctgcacattctcttttgccatgtaaggttacatgtccacagtttccagggatttggacatggacatctttggaggacattgttctgtttaccatagcttgaccactcgttctttaaggaaaaacataaagaaagaaacaaattatataccccctcttctgaggactttgtagatttatttattgacaagtattttcactcatttaaagatggcaccttatatttgttatatttacaaactgcttttgcatatgctatttcatttcattgttgcccttttcacagtggcaacaaagactcaaaaacttaagtgaattttcagaacaaatagtggtcttggcatatgaatcccatgtatttgagtctgtctagtgtttacaacattctactcactatctcatgaaagtgattttcagcactttctaacttaattccttgagactttggatgtcatatgtgggttggtttgtggacattcttcatcatgtttaacatcctcgaagcctctcctacaaagaatgcactgctccttctggatttatgttgtaaaatatgttctaaaactaacttgaattcctatactttcttgcctattttctattcagaaaaaaacaagggaactgatatatttgtctacataattgtgagttgttagaagccaaataatcagtgtgaatggtatgccatgctctatgaatggttgttcagcagtccataaatttggtcttcttcttgagggtaggagtagtgttttgtttactttatggttcttagctattaactaagtaccttgcatttcatagggctttagtaaatttgtgatgtttttaattattgaatgctgattatatcttaagcttagaaaagaagtgaaacttgtggttttaatttaatttttaaattaatctcacattgataagtgtaactattaactacgttataaccttaaaatgagtcatttcatgagtctccaaaggctctttccttgtgtctaaaatgagcaacaaaacaaaccaaaataaaaccacagataatggcagagcttttaactttgggagactgaagaattgatgggagtaaagaaatttacaatttaaaatatcaaactagtttaaccttctaccaattaaattatgtactactggaaagcatagcttttaaaatactgtaactagttaacaaaaatcagctacaatgactgaatcaacaatcttctttcccctaattacaacattaactgcttcacttccttggtgaaaccccagctgcctctcagctccacctgaatctggtgaggcccaccatctcaagccatctttatcttttaatattttagtcaaccaaaatcaatctccatgtttcatttagctatttaggctgatacttacatttgtaaatcataacacaattgtgattatacttaacaatactcttttctctgggattttataggtaaagtagtaatttcttaatggttttctaatttatggaaccaggttgagtttaaatacttaaataaattaacttgtaaatttccattgggttgacttttagatgctctctatgaggaaggtgagcaaacaaaaataaactcacatttcatcaattctaagcacatttttaacatctctgaaatcagggtttaatctgatagtataaggtttgtcatcttttagttagcagcattttgttttttctctcttactggtacataggagatgacggtgcatcttttattcattggtttgccccttagatttcatgaaatgtggtcatttaggtgactctaagcaggaatcttttgcattctgatttgcataatacttttttaggaatgattacaaagcaggctttagaacttctcccttctcaagattttcttcattgatgtatttttctgaagtatggctctttaaaataaaattaagctggaaacaaacctgcttatgtgacatagttcaaggactatatttaacagagttgagtagattcagtggcatcttgacactaacagtggtgggaatttctcttctatattctgcattttcttggtgaacttacattatcctaaacaattgattatttgaactgaagtgaccaaattaaatgattctacgtggcctaaattttcttgggatcatgtgttgtgcacatcttgcccactgttttttctatccatatatcaactctgcctgggtcatacatcctcaataagtctataacatattgagttgaattaaacaaaacacatcatcagggattgaagtttttatcccagaagacttctgaaggtatttaaaacataaacaaaattttaaagtgaggataaataattaagggaaccactagaatttgattatcacccacttaattttcatagctttcttctagacccccaaaacagctattttcttctgtctctttcgattttctctagtgatttttctaagcaaggctgaatggaagctaccagtggtcatttgtgattgacacactaaaaatataatgtgaacacttggaaaagaaaatgcccttggacatttggttagctgcatatctcttgtctcagatgacacccatatactctttcactttccagacaacataaaaattaatgctgtttgctatagcagaaaacagtcagaattattttcagcttttaataaacagctcaatagcctcagggaaattgggcatattacttcatttcttggttttcaaatgtatttctatcacttaattatctaatgaaaatggtattatttatttaaaatatttaagaaggtttttgactcagattttctcctcatttttacctctctctattctgccttctgcatcacctgaatggccttgcaaaagacagtaagagatgttgtggacaaatctggagcaattgatgatatacattttgcatttatgtttgtagaatatgaggaagtctgacaaacttaaaacagctattcacaggctgaaatcccactttctcaaaaaataaaatgaatttttggaatggatttttagagcttataaagaaactagtttacttgtatgtttattttaggtaattactgtattaatactcttttaaattttatagtggtgtatttcaaaatgtctctattttgagatgctgagtcaaatatgtttttcattaaaatgaacctctgtgtctgctttccagtataattatttgtctactagctagaataccatattccattttatttttctttcaggattattctcctaatcccccaagaccatccctgttcagcgtatatttagggcaatgataacaataatagtattaaaattttattaggtaagccaatctgctgaattatgaatttaggtcttgttggaaggacactttttctgaatttgtatttctagctttccttatttatttgaatagttgagattttagtatatttttactttatattttgtagaacaacgtgaattttagcatggaccaaaaaattaacgctttattttaccagtgaacaactacttgaagaaaatatggggccgggcgcggtggctcaagcctgtgatcccagcactttgggaggccgaggcgggtggatcacaaggtcaggagatcgaggccatcctggctaacacggtgaaaccccatctcttctaaaaatacaaaaaattagctgggcgtggtggcgggcgcctgtagtcccagctactcggtaggctgaggcaggagaatggcatgaacccgggaggcggagcttgcagtgagcggagattgcaccactgcactccagcctgggcgacagagcgagactccgtctcagaaaaaaaaaaaaaaaataaaataaaatatgggggcagggggtgcgcggtggctcacgcctgtaattccagcactttgggaggctgaggcaggcagatcacctgaggtcaggagttagagaccagcctggccaacatggcgaaacttcgtctctactaaaaatacaaaaattatccaggcgtggtggtacatgctacagtaatcctagctactcaggaggctgaggcacgagaatcacttgaacccaggagttggaggttgcagtgagccgagactgcgtcactgcagtctagcctgggtgacagagagagactctgtctcaaaaaaaaaaaaaaaaaaaagagaaaatataggaaccactctttgttgcagaaactaccctttgtgaagtatctattaggttataatatatcacatttttttttttgagacagggtctcactctgttgtctgggctggagtgcagtgatgtgatcatggctcactgcagccttgacctcccaaggtcctccacttgggaggctcaagtggtcctcctacctcagcctccagagtagctaggactacaggtgtgcaccaccgtgcccagttaattttttagttttgtagaaacaaggtctccctatgttgcccaggctagtagtgttgaactcctggcctcaagtggtcctcccacctctgcctcccaaagcacttggattataggcatgagccactgtgcctgacctacatcatgtatttatttaactagacattaccacttacagagcactttttcattttattctcatcacaattctgtgaattaggcattattatttgaaaacagggaaacagggtttagaggggctctggggcttgtcaaaagcaatcatatttgaactttatcaatactttaatccacattttctgattttatgagtgctgccatttcccttatatcatgctgcttatttggttcgtgcatggaattgttattatcaattaaatataatctctacagaatgaatgataatgaacattatcatgtgacaataacattgtgcagccattcagagggcacttcaaactttggattttcagaggcagtatctccagtaattagctgtctttagaaaaatagcatctataaatgcttcttagtcctgcccataatgagagagttattgacaaagctaggatgtgaaccacgttctagccatgattcatttttaaattaaaatatcattatatatgttagggaagaaaataagggcctttaatcatgaatatgtcctatatagaaccaagataccaattttctcacgtcagttcgctcagtaaatggtaaatttgaatgcatttgccataaagacaagaataagtcctaatatgagaatgaaatttgctgcccccatgttatggtttggctgtgtccccacccaaaatctcaccttgaattgtaataatccccatgggtcatgggtgggaccaggtgaagataattgaatcatgggggtggtttcccccatgctgttctcatgatagtgagttctgatgagatctgatggttttataaggggcttttccctacctttgctctgcatttctctcccctgctgccacatgaagaagtacatgtttgcttccccttctgccatgattgtaagtttcctgaggcctccccagccatgctgaactgtgagtcaattaaacctctttcctttataaattacccagtctcaggtatgtctttattagcagtgtgagaacagactaatataccccattaatttatctcactataaaattatttaaaaatatttttactattgttattttatccacttatgagaactcaaaacgtcctttgaaataaatagggaaatatttccaaaaataaaacattttatttgtagagtttcttttctcaatgctacataatcaagctccacttgaggaccttaataacaatctttatcaaactctaaaaggaatttttatctttcattgctaggcagaatactcacgacttaccctggttgtctgagcagtcattatctagaatgttaccggttactatggcagaaaaaagagagcattagagagtctcccattggtaattaatttttctgtcaaaaaatgccatgttacttccttccacaagtcattatcagaactagtcaatgatgactgtgttccagtcttttgcctgtttactctgaggtcctttcccttcccttttcaaccttgccctggttttcaagaactgcatttcataggcctttttgctctctggattccaggtagttttggccattgggaggtactcatggcagaatgcagagggggtgggggtagtggataaattagattatttcatctccttctttcagccttgggcagtatctctagcagcagtggcttctctgtgatttcacctcccaactgacagcttgatatagttccaacttccacgaatggcttccggggtctgttaatcgtactttctctttgaccttcttcgcctaaagatataaccaactcctaggtggctttccatcctctatttggcctctcagctcttttaacacatgcataaacatttccctgtattaaattctctgtattgaaatgttaatgtggtttatgtttttgaggagctcctaactaataaatccagattaggacattcaatcttatcgtgttcccagaggacacagaactggaaatatttggtgaacagctctcatgattgctgtactgcctatttacatctgacttgcaatctacctctctccagccagacctctactctaaactataggaccgtatatatacatatatccaataaactacctgcttttgaatgtttcagagacacagtaaactcagcatgtcaaggtggcaacacatgctcaatcccccagcaaacctcatcctctcctgctccctccctcatgcattttgttagtcgagacaaacataattaattcttgcaacttcattccctttcagcctgcacaaccataattttaaccataatcataatcataaccataaccataccaataattaaaacccacaacctttacaattatgtaacctgtgataccctgaatatctctcacttctattcacttctctacattccactgctatcaccctattccaagctcctgccttcaactgaatgattgcaataacgtcttaaccttgtactcaatgttatattctcaaaattaaagttaatcatttttaaagacctccaaagattcaaaccttcagtgaacgaaggtcgtgaccttcagtggcttctaattgctcttaggagaaaaacaatactccttaacataatcctagaagacctagcaaaaacttcctcttcagccttatctccctccccacccctgcccctgatatgccatcttactctctgaattctggcctcaccaacttctttaagtcatttataagtgtcagtccttcccaacccccaacataacctcgggcttttaaatatacagttaccattgtctgaaacacttttcttccttactctctatgttaacatcatttagtaaggatttacttcagtgttatagcctcaggaaaaacttgcctgaccaccctgactacataaaataccctgttacacacattcaattgtgtcatgtacctctgccaggaagcattaacagaattgtgattttacatttcttcgtgtgattctttggtgagcagtaatctcctccagtcacaattgtctttaaactctttgaggtgagagacaatggatgattttgctaaccattatatccatagctcctatcagtgtctgggacataactagctcttaataagtatttgataaattaatgaatgagagcactcttcttcttccctcccttcttctatcctgtctttctctctttctttctccctcccttctttccttcctttttcattgtgtatttactattaggaaatgacaggtctggtactgaacagttaatttctacctataatttttaattcctcaccagtactttctttggttgatgtggagagtattcagacagtgtctaagttaattttgtgttgctataaaggcatacctgaggctgggtaatttataaagaaaataggtttatttggctcatgattctgcaggctgtatgagaagcatggcactagtatctgctctgtttctggtgagggcctcaagctgcttcccctcatggctgaaggtgaagaagagctggcatgtgcagagaccacatgatgagagaggaagcaagagacagacagggggaaggagcgaggctctttttaaaaacccccttttttctggaactgacattctcacccaagagccaatccagtctcatgagagctagaacttaccaccatgagaatgacatcaagccatacatgagggatctgcccccatgacggaaacaaacacctcccatcaggctccatctcccaacaacaccacactggagatcaaatttaaatatgagatttagggggacaaacttccaaactatagcagacaaaatatttgtggtcatgggcagcctatcattagcagagagagggtgcagattttcacatcagaaggaataggtttcgagtcctagctttgccacttgcttgttttgcactctgggctattgcaatgatctatctgaactcagtttccttcttggtaacataagaggataatcagtgccagcttgtgggcattacattgtagtaattatatatctaatgaaacaaactcacatgtagaagccactcaataaatagtagtcattttggccgttgtcaaaaaattattaagtaattatagattttaataagaactattaggtagcatagtgtataggaaaacctttactgagtgttcatatgtaatgtttgaatcagacaatgaaacataaataatggataagaaatataacgtacaattttggaggattaaaatgcagttcatttagtaaatactatgtgaaaacaatgtgtgtaggtgcacgactatatatacacacactgcgcctgtttctatttgcctatatattctttttttacctgtatactcttctattaatattatttaaattgacaaatcatacttgtatacctttatggagtacagtgtgatattgtcatgtaggtatacaatgtggaatgatcaaattgaggtaatggataggtccatatatcttaggtgaaagtattgtaatagcacccactgctgtcaatttttttcattaacttttgtgttgtttaaaacactgtgtttcaatacttttttaagtgtttttaattctttagaaagacaattccactggaataccttgatctcttacttcatagaggaaaagtagaggaaagaaaaagcttgtgcctctttactggtacccccaacaatgtctgtctttgtggggtgagaactgatgtcatctttggcagctatatggctgatactgttctgtgagattgcaacatatccagcacatgcctgataggaaacccttttccaaatagtaaacaacccttcacaaggcagctctgccaaagctatgtattgccattcaacagaagatcaacaggacagtccttttctctttactttaaaaagcatatgcctttaatgatgtgttatcgttcaagccatctgcagatgtactgtccatccaaattgccagggttaaattgttgattattagaaattgttgtgattgtctgattatgcttgtgtcataaaatgactattttctgtcacaatttgacgagcccctgctttagaatagcaatacaacacattttacccatttgcaggtatttcaagtattaaattggatgaatctttttaattttcttctactgaattgagttcaagtgaatttgataggattattagagcggctagtgtctggaataacaatgatgacttacagaaggagccagcagggctgatgttattgacgaagagatactttagaccctttatttgtcagcagggagccctgctctgtggttcctctatgagtccttccctgtgtacggtgcccgcctgttttactttgaaggcactaaatgcatcttttcaatcaatattcaattatataagacaaggaatgctggttaagtaaccatgcctatctgtcaaggaaatgcatttctccaaataatttgtcagggcttctgggttagttcatctttcctacctctggttgagtacttgcccagttacacttgtcgaacacgtgctttaccttcctgcacagagtctcctttggtggcgtgtttcttgcttttcttctggaaacacccttctcagctccattccttgcagtatttgactctcgctacccaggaaaccagagaacattcttcctagtttcacttcattttcttgccttctcatataggccactgccaatcagctgcctcatttaaatcctgcagtgtatgtttatattggtcttaccttgtcctttcttcctaaataaacctggggagctttggtcatgttcatttttcaacaaacctgactaggtattctaatttcgtaaattaaccatcattcttgttttattccactggaaattgacttaacatattattcactttggcccaatctgccaggcaggcatgaggatattgctttctaagctaccttctaattgaagaaatatgaagatttcacaggtcaacacataggcagtgtgaactggggagcttttagcatattaattgggctctgaataattcactatagttaatgaaagttgtgcttgttatctaagatatatggagggcactgctgtacctttcgtaggacaattcaaaaaaacaaaataaaacattaatgtaaaatagataagcaatgcataaatgggttgcagctcatattataagagttttgaattcattttatttcattcccatacttctcaaccaatccagctacacccacatcttatttaattgacagatttggactgtcttgctggctaggaggataaaggcaacaaactttctgactgatcctggattttcctcaagagcaagtttccttagttattggtgtgtcctctgggtatcctgcttcctgaattccacctttgatcctcctggttcttaaccatccatgttgtcttcagagtctgcttgtctgctcattcctgttaatttttttttaacttgatcttcaattgtgagtcttctcacttcctgcctgttctaacttgggctcaaccttgaccccagtcttcagctctgcaggtgggagatgtatggaataactgaagtactccacacggtgttcctgcttataacacaaaagccattgtcatttgacaaacagatgataaagaatctattgttattatttttactttttacctcattattactagtattagaaaatgctttactaagcttttgccaaatattagaccgtgtgctgggagttctacgtgtcatatctcttttaagcctcacatcatttacagaggaggcactgagaggctgtgttgcctcccctggccacatacttattaaatgaaggggtaagaatttgaatcctgacagtctgactgcctagcatgtgcctttatatttgatgctgtatcacactaaattaacaccccatagatccattcttaaatacaaaaatctatatcctcagactttcagggtgttaactttgcactgtaagttggagtctttacattttaaacaaatttcttactttctgtttgttttggattgtcattgcttattttttacttaggagtataaaaataagatagtgaaagtttggacaaccttacatacctttatcatcttcagaagtccgatttttaatgatacgttaaaatagtcacatgtaatcattcattctacaaattcagcaactgtttgctgagtatctactgtatactagcaatgatggaaggcactggggatgtaatggtgaacaaaaaggagtctcttcttctatagagtttacacatgtaagctgggcattggcccagccatgaagagtaagaaacaacttatgggaatttgttgagcttcaagttaaactctgttaaaaacaaacaaaccagaaatatatatgtagagtgtttaatgtgttctgtggctctcaataaatgatggcgttgaaaaataaaatgtaggtaatttgatttaatattcaatcagatgcttgcatcaatcagatgcttgcaaacagggtataacaagataatactatgatatttcttggaaggtaatttaaatttcagtttaaatattttattcagcttatttatcgctatgtaattatacataaatatataacttgaatcataatattctagttttacttttcttgcttcctattgggcttctccctctccatccctttccctcttgatgcaaaccagccatcccttgcagtcacccccaacaatatcaaagtgtgtgtactttcatttttcctccctatgttcttatatttctatttaggaattacagccacacacacaaatacagggttttattatgtcttagaaaaatttaattatcaatattggtgtttctgcatcttgcttttattaataacactcaataatgagtcatagataagttgttaattggtataaaaatacagttagaaggaataaattttagcatttgatagagtatggaaattatagttaataatttataatatatttcaaaataggtataagaggaggagcataatgctcccaacacaaagaaaagataaatgtttcaggtgatggatattccaattaacctgatttgatcattacacattgtatacaggtatcaaagtatcacatgtagcccctgacatctgtacaactatgatatgtcaacaaagacatacaaaaatttcacattacttttgtattaaataagtataattttataagtaaaaaaaatagtcattgaatctgtctaactaaacagacatagctctgttttctttttcctaataggtgcctaatattccagctgaagtggcataatttattttgttttaccctatttgccacaggcacattgctcccaggctttggcattacaaatattgctgcagtaaacatccttaaatatatgtccttaaataattgtgtatctgtggaatagattccaaagcatgagcatgattgggtaaagaagatgagtcttaaaattttaaatagatgttgagagattgctttaaaagaagaaaagatgtctcaattttgtttttacaagtatatgcggacatttcacatgttgtagattgatcagttgttgttacttttaatttgcctaatgacttgtacattggacttttttttgataagttgcttggcttttaaattttctcttctgtaaattatccaatttaaatatcctgccagtttttttctattgtactatttattctcttgtcaatttgtaagtatattttatatattgtggatattaaccctatgtgttttctgcatttcaaattatttttcaaatctagcattgccttgaattttttaatgatgttttccataaataaacatttaaagatttttgtatagtaaatttgtctgttttaggcatctaccatcttgtttaagatggattttcttgtctcttagattttatgtcttgttttctagaatttttaaaaacatatgtaatcttttaatatttttaaaaatttgtaagcctttgatagatcaggatttttaaaaacttgatttaaaatagagttactctttaaatttcctccagatggaaggacagttgtgatacaatgatttaaagcataatttatcatgttcccacaaaatttaagattgtttattaaaagtaccccctctttttatagatacaaaaatatcttcatataaatatttgatcaagttgtcattcatacattcaacaaatattaagtacctcctgttttcctggaattctgaaagaagcataggggtgggggaagcacaatcttgaaatggccactgctttttagagatacagcattcaattttgataacagtggtgggtccagaaatctcaaaaggctgaaatctgttgatggctctgtcactaagagtatgacaggtttctgacactcaacagtgctgggttttagtttcatctgaaacaaaatgaggaagttatgtccaatgatctccaaagccttttctagtcctcaaacatgacagcagctgttcaatctcttctactacccagctatttaaagttatcttctgccaaaacaagcaaaagctcatagctgagagagaatgaatgaatacaaataaatgaatatgaatatgtaaattggatagactgaactcagccaatctgaaataaaggtgaaagtgatttggtgatcaagctctatgtcatcttccttctctgaattatggtgatgggacaggggtttgaaaactcactttaatgaaagaggtgaatcactccatggctgaaaacagataacaaattacttgagaaaactggcaccatgacattttgcaggtaattaagcattcaccttccctgagctctcaccttgacccctgaagagatattcaggatttaatcacaatatatacattatgtgtagattaaccaaattttaaaattgccattcttaatttagtagtaatttgttagattattctggttcaaatcacctcaataatatcgactttaattaaaataatcagtataatcacaatgattcattttagtgcttttgttttatataaaaatctgtgaaaactttcttctttttggaagacaatttaaaaaaataggctacctgtcttaatgtatataacaagttaagtgtaaaatcctttacaggtacatattctttgtaatttatgtctagcatagtcatatatttgaaatcgagttagccattgaaatgaaggaagaactttgtcatgcaaagccattgaaacaacatacaaaaataagttgaagtttttataagtgaccattcgtggtcatcttatatgtttgaattaaggaaacaaactgaaatagccaagtagataaaggaagagcttgcctggcatgcaaagctagagaatactacacagaaagaagttcaagcacagaaattacagttcatgggaatgtcagaatacaaattctgtcctcacaatctcttttattcggtgagtttaccagttttaaagcattaatgaaattatttcaggtaattactgttttactcccatttttattgtctggtgtctctttagcacaacccattgaatcattctttcatcttaagtcactattcataaatgcacatgcaacagatggtttatattagatcatgtgatcctttgagccagagaatgaatttctatttgggtttcattcgaaattatctacctcagagataactgaaacctaacttgatagtattccctgtattctatttaatactttaaaagagtatgctttctgtttttctggttgtgtaaaatacaccttgaacacattcagcagactgctatgtacaaagaaagtgttcaataggtgtgtctgctgccgttttaaatttgggtgttagatattctaggtttcatcaaaataaggcattgtttcaagttgtttccacaataagagcatatatgcacaggcaaaacatattttgaaatggataaatggatacatatggatatgggtgatatttcttaatagcgtagctggattgactcaggcagacccttcagccagacgttttctttgaactggatcgtctctcctgtagcagaggactccagccaatgaagttaattagtgccagattaagatggtctcagcaggtggctgcttcagactctctctctcctctgtttgttgaagcctcatcgttggagaagggcttgagtagtcttgtgttactgacagctgtctactgttaatggaccatatgcaatgatggtaaagttgccatcaactgttgatgaaccatatgtaaatggtgaacagagtagcagatgaatacttagaaacaacgaaaggccttcactgctggactgagagtcagaaccttaaaatgattttaagaaaaggttgctaaaactatgtcatgatcattatacctttactgcacacaccctctgtcactcagtttgaggatctaagacagatatgccaatggaaagattattgtcttaggtcttacaaaacctgacatagaaggctataataccccacagagacatgatttttcagtttcattaatgaaaagaaaattaataatagcaaattaatcactaagctcaaccattttgaaaagttaaaagtattatttaagggaacatacgtagaagaaattcattatcaaatgaagagtatgggaggacttttttttgaaaggcagtttgattctacagggatgccctttactttctgttaagagtatgatgttctataagctgagatggggaagaagtagctacttaatttacagagaggtgattaaagattatatacaatgaacatcctcttaaagtaatataataatgataattgccaatataatagctaggtattttggatgtcctactcatttcatccactcatcattcttatgaagcagatactatcattatctttattttatagatgagggaaactgtagcctaaagaaattaagtaacttgctcaagattacgcagctgagggttttaacctcagtctgtctctggaacctctactctttttttttttttaattttactttaagttctgggatacatgtgcaaaacgtgcaggtttgttacataggtatacatgtgccatggtggtttgctgcacctatcaacctgtcatctaggttttaagccccgcatgcattagttatttgtcctgatgctcttcttcccctttgcctcccaccctccgacaggccccagtgtgtgatgttcccctccctgtatccacatgttctcattgttcagttcccacttacgagtgagaacatgcggtgtttgattttctgttcctgtgttagtttgctaagaatgatggtttccagcttcatccatgtccctgcaaaggacatgaactcattcttttttatggctacatagttttccatggtgtatatgtgccacattttctttatccagtctatcattgatgggcattagggttggttccaagtctttgctattgtgagtggtgctgaaataaacatatgcgtgcatgtgtctttatagtagaatgttttataatcctttgggtatatacccagtagtaggattgctgggtcaaatggtatttctggttctggatccttgaggaatctccacattgtcttccacaatggttgaactaatttacactcccaccaacaatgtaaaagcgttcaacctctactcttaagttatgctctaaactgggtacggttagtttaaaggtgaagtgattttgccccatttggaccttatttccaataattggaccagttattcaagtgacatccatggaacatggtatatgtttgctaactcattttttgaggtaagaataactgaataaatgggtaaaatatatgtgtaaggaagctattgttattgcattgttatgccacagggggcagttattttcctgccatgatactgatgagagattaattttactctttgtaaaatgtaagaaattacaagaatactgcaaagctgttttgcaaactccataaagcaacatatgttaagtgtcttgactgcagaagaaagttgttatacacctaaattttattgagtctgattctctgatttccattttagaaataaaatgtgtaaatctaaagacaaaaatcctttatgcaggagttagaaattattactcttggccatcctgcttacagcccatgtaggaagagattcagcacccaaaaacttcctccttacggctttatctgtggcttttaagatcagaaccatgtgtcaaagtctagtgatcttgttacttttctacagaaaagttatacagcagaaaacgtaggagggtaatttaaatgaggttagaaagggaagataattaaagaaaatctaatgatttactaaaatgaaggcataatttacaacatgtattatacatcaaatacctttaggttaataaaataaagcaagacatacttattttcaaataaccattctatactacttctgcctatattataggagttttaccaggctctcgtatctgacagtgaaatgatgctcatggactaaagtcttgtattgagagtttggaggctgtggtgctagatttccttttactatagtaacttgttttgtgatacttgctaagtcacgtaaaaagttgacctttagacattccttctatgtaactggtttagaatccatgacctcaacattttttgttagttatgttgtgtttttaatgctacaaaatgctatgattcagggtcaatgggatcttcaaatatttagttattaactcagcttaagcaaagactgtattcataaattgtatataatattagtagaaatttaaatacaattgtaaaaatgaaaacaattgaaaaatacttaaaacatttattacaaaggtgtttttcaaggttatgatggcacaattacacagattggaagaactataattggcactttcaactttaagaatactttcaatacaactgacaggttttcaaaaggaagaaactccaatacatcaagaaaccattgaccttttcaagtaatcatttccatgctagtgttaacaaaagaaacatttcaaatgcataatctcatcgtgtagtttttagagaactgttgcctaagtcactgttaatgtaaaataaagtcagaatgcttttgacttgatgctgaaatatgttggatttcagcaagtctttaaaaaaatattttcccacttgtattattgatgaaaataagatgatcgtagacacaccattcacccatttagtgacatttcacataattgtttaacatgtttttcctgtatttattgtttccactgttttacttccatgttgtgttttttttttacttgaaatgaagactgtagcttcaaacattcaaaatggaattgagacctaaactattctacctaatggtggaggctcaaagctgattatttgaagtatctgaataatcttctcagttcttatcataataagactgtccaagaatgcagattgacattgatcagttgtgagtctcttccttatgcccaattctcttgcccttgcatcagacaagctaaactttggatacttgtacacaactagtttcagttttggtggttagctttcaggaagttaagaagatagagttcttatgaaagcaagctaggaagtcttactttctacctgtgtggccctgggcaagttacttggcagattttaaggccagtttcctcagtaggcttaatgatattgcctacatcattaagttgatgtgaatatttctggagcgaatccatgtgaaaatggttaatccactgcctcacatttagtaaactattcaataaatgtcagtcattctgatgatatagatgattattgatgatgatgatgatggcagtgaagatgataatttcagagaagattttatctgtgcagttcttgtagtatcattcttaacctctcttgaaaaagcataggttccattgtataattacagattctgggacagaaaattaatggaacaggcttttgtaggggatgtgcagttattttctcaagtccccaaccccctaaagaatatctgatttttaagagatcagagtgataatcaccccaaagttggtcacagtctactagcaaatctcacaatcattgctaaacaattgcaacacctctgtaccactcttttttctgttattagcaaatcacagttctcccattagtgagagcaaacatcaaaatcgccttacatgtctactctaaagcaaagcactttgctgatcttttcaaaagaaaagactgggtgcttctggaatactatcttttgtctactacatgaatacatgtcattaccactagtctttctctaatttttatttttccaggacctcctatcctgcctcccacatttcctacctagcttgctctcttttctgttcatttgagtttccacatgcttcaaagaccttaggctatgagtggtagaggctgtgaagccttacctaatagcaaaagtggggaaatggagtatataattggatatccaaaaccaattattatgatcaattctttgcatgaaataataggcaacactcagatgaaaagtatcctagtatcaaatattccatacatatagattcttgcatgttttaacccttatttatttataccttgagatagctctaagccttctccagtctattaaactatggcaactaatatcacttgtacatttgttttccatcagggaattacatatatctaattataatctcccttttttttcatttttctccaaccttagggaatcatagtttcttttcttttcttttccctctttctattcccaatttcatcacgttccctcagaatagtattacttccacatctgcatatatttttattcattaattcatttaaaacacacaaacacacacacacacacacacacacacacacacacgcatgcacacacacccacagtttcttcatgtatcagaaaactatagtagattttggagatccagaagcaattccaacataaaggtcacttctctcatgaaacttatattcaagcgggtaagtagatcataaggtaaaagcaattgataagccctaacaataaacattacaaggagattaacatcaattatggtgatgtaatggagagtggctagataggcaaggtttttctggggagatcatatttgagcccagacctgaataagaaagcatcagacaaggaaagatatagggaagaaatacaaagtctctctggcagcggcaagttggcaggtttgagttcacacacacacacacacacacacacacacacacacaaaaaaaaaaaaaaaaaactgtgactggagcatgacaggcaagagtaagaatgagacaatactgggatggagaagtagtcataggacagatcatattgggcattggcagtgaacttgcattttgttctaaatataataggaatccattggaaggttgtaagtaggatgtgtgatatggtttgatttgccattttagtttgccactttgactgcttttggaaaatgttttgtagcaagtcatagtgggtatagtgagatgtgtggttggacgttgttacaattcttttggattgttctaagatggtgacattgtaattaaagagaaattgacaaattcaggatatattttggcaacagaggcagtgagactagcagatagtcccattgtttgtaatctaatagaattaccctaattatatttgacaaatctgaccacagtgcctgggacaaatgtgaatcagggattgggaaattaagtactgagtggaaattctaaccataaaaaaagagaaaaaacagtgtagtcaaccttaaaaacatttaaaattgttcataaatccccttcaaaatgtctgcaagactttccatcagacctaccggtgtcttttaaataggcttttctgtaaaaacaaattattcatattttgaaaagaggaattctttttccattcctaaaatacataattagatacaaaataggtaaagaaactagcaacgtgcacatgtgaattaggcaccataatagacgttgtaatataaatatagtgtacattcctcatactcaaggatttcatattccagtggagtggccaacatgtaaacaacaatacaaacatcccaatgcatctcagagggtggatataattgctcatgaaattctgctcaaggatgtctttctagaaaccggtatttatcactgatgactgtaggcacatgaattccaaagaaaaggcccaacatggaccactctatgcgtatatggcatgctgtatatcagaattatccagtagctacaactagtaaaattgtgataaattaataaatgaagtgatgaaagagttgagatgtggcttgctgtgtaggctgcaaaagattctgaaaagcccaggtgctgtggtcaaacgtttttgatgtatttgaacctgtaaagtgccatactgtttttctcagtggctgcatcattttatattgctaccagcaaggcacagggttccaattgctccatgtccttgatgacacttgttattttctattacagtcaagagccacataaggatgtttcagtcaatgacgaaccgcatgtaggatggtggtcccataagattataatgctgtatttttactgtaccttttctatgtttagatacataaatacctaccattgtgttgcaattgcctacagtattcagtacagtaatttgctatgcaggtttgtagcataggagcaataggccataccgtatagcctaagtatgtaataggctgtatcatctaggtttgcataagtacattcaatactgttcacacaatgaaattgtctaaggacatacatttcttttttctttttcttcctttctttctttcttttcttttttttttttgagacagtctcactctgtcacccagactggggtgcagtggtgtgatctcggctcactgcaacctctgcttcgcgggttcaagtgattctcctgcctcagcctcccaagtaactgggattacaggcacacgccaccatgcccagctaattttttgtatttttagtagagatggggttttgccatgttggccaggctggtctcggactcctgacctcaggtgatccacccaccttggcctctgaaagtgctgggattacaggcgtgaaccactgtacccagccattaggacacgtttcttagaacctatccccatcagtaagcaacatgtgccattaagtgacacatgactgtactttgataatagccacccaaatgggcatgaagtatctgttaagtgttttaaattatgtaccagatttgcaaatatggtgtacgtttttgggggccagatgcacaaatgtgaatcaggattgataacacaagtaaaagtgaaaagaaatgactgtcttcataaataattcgctcatctaaaaaatattattgttatgtttgtacaaggcactacgttagcctcaatgtatacattagttagcaaacagaacctgtcaagtccagtgggggattatgggcatttgttaactaactacatgaatatatagtgtggcagatgctcttggtgcccatccacatgcctttggcagtgtaaagcaaaggctgtttacttcgaacgcctgtgaatctctgcctgaggggttttgttcctggtaattacaacatacttggcccacgcaaggggtaagccctccatgctgaggcatttatattcctgggagaagccctcaagcaatgatggatgagaaatggtaaataaatagttcagtttctttgtccctcatttgggatacctctgagatgtgttctatattttctcccagagctccatagcaggattaagctctaattgctcatggtgctaacatacttgtgcaaatagtacatatcatgtagttacctaataagtctgcacatcaaccatatgattgccacataagttagtactccagaaacatctcttacactttaaaggagctcttagaactttttatagggtcgcctaaaatatatagaatatattataccacggactactcttttttcatctattaaagtttcagagggcaaatgcctgaaaatctactttggtggcaatgctgccaaggagaaatggtgacattgctgtgaatgagcttgacccgaatgatgttaactacaatatattgcttcatgtttagtccaaagtcacagagaaggctttttataaaactactaatctgagctgatgactaaaagagaaatatttaaaggtctttcctcctctccattgactcagtataaataggaatgacatgcacatagtgaggggagaatgtggtgccatgaatagagattttgtagcacatttttcattgactttaatgagatgcgtgtggataaatgtgttagtgcggttggcagagtgtcttttttttccaaagcatcaaggtttagcctaatgtctcagtgaatctttgaaatggagctggaattttaaagataacaagtagtgttcagagagcccattgacccagggagcttgcaaggcccctaccagtttcaacagtaatggaaacatttggcaacattgaggaattaaggcaagtagccctggagttgtgggcatttataaacaagtgcaaaggtaattacaggaaagagaatgggagaggtactctagcagtgaataatttttcattgtgttgattttgttgctgagaaaaatctcagaattcctagatttccatgtttagttacaggacatgcctttccataggaaaggctttgctgatgtccttagggcaatgcctttaacatgtccttggaactcttatatactgttggtatgaatgtatagtagtacagccactatggaaaacagttgtggagatgtctcagaaaactaaaaataggattaccatttgatccagctgcttaatatccacccaaaggaaagtaaatcaatatatcaaagggatacctgtactcgcatgtttattgcagcactattcacatggaatccacataagtgttcatgaacaaatgaatggataaagaaaatgtggtatatatacacataagggaatactatattgttcaggtataaaaaagaatgaaataatgtcatttgcagcaacatggatggaactggaagtcattaagtgaaagaagacaggcataaaaagacaaatatctcatggtttcacttacatgtgggagttaaaaaacttgatcacatggaggtagagaatggaaagataggtaagagacactgggaagggtgacttgagggagaggatgaagagaagtgggttaaagggtacaaatatacagtaaaatggaataaatacagtgtttgatagcagagtagggtgaatatacgtcacaaaaatatatactacttgggtgatggacacactaaataccctaacttaatcactatacgtagatacatgtaacaaaattttacatgtacccccatacatttgtgcaaaaaaagtccttaaggcaagactaaaaaataaagacagtgtaagtcagtcagtcaacagtttgattgccttctatgtacagtaaacagtgttagctgttgtcaggcatgtaattataatgcataaactcgatcctcgaggaatttgcaattatctgagaagattaaaaaaagtctgtgagggtaattgatgatatctcaatgccaagtgtgttataaatgagggcatttaggatacacatatagaaaatagacagccccaaatgttccacatattatataattcagtcaatcatcattacaaatcagtggaatgtactgtttattactattttacaaatgaggaaaatgccgggggtggggcatagaaagcttagttaactttcacaaggtcactgaatttaatagtggagcaggaatttaaacccaggtaatctgacttcagagtttgtgtgcccaaaacatgaatctgtattgaaagaagagaattgccagttttatcagaacaggaaaaaaaaatgttcagccttgaatgaagggtgtgctatagatgaatgaaaagagaatggggtggggtcgtgggagtgtgtggatctggggatgtgtttgtggggaggtggcacaaaatgataatgcttcaagcagcagcttgaaggtggaaattaaaatggcacaatatgcgtgtatatgtgggtggaagaatgagtagcaattcaaacctaggcgattttatgtaggaggttagttgatggtaggtgggaatgtagattggtacaggtttttaggcaagcaattttgcaacaccttaaaatttaaaaagtacatggcttcttattcagcctttcccaaactaggaatgcattccacagacgtacttatactgtattgttttaaaagtgaaaaaaatgacatagatgaccttcaaaaggagaactgttggattgtattttagtgtactctgaagtatttaaaaagatggaggctcatctatttttatagacagcgagagatgcttgtaatttattgtacagtggaacaaagtgatttgatgaacaatatgtataatatgattctattttaaaaattaatcaagtcaagaaacacttatggaagcctcactatgggctgggcactggttccagtatatgggatactgtagtggaccaaacatgcaaacagatcatactaaacaaatctctgacttcttggagcttacattcttgaggggagatagacaagaaacaataagcagaataaataagtaaattatataacagaagtatatcagtgcatgaaaaaataaaaagaaaaggagatcaggtaaataggattgggggtgctgattgggggtggggtgggagatagtcttaaatggggcagtcagggtaagactcattgagtaggtgagattttagcaaaggcctgaaaaacatcaagaggaacagcagtgggtcaaacataggccttaaattgggaatatgtctggtgttcaaagaacaccaagaaaaatggtatggctggtgtgggagaagtgaggggaagagtagatgagaggaggttgtagagttattgtggggtctggattatataggttaggactgtccaaaacaaatattatgtgaacctcatatataattttaattttttagtagctactttgaaaaaatggaataccaggtgaaattaattttgatagtatattttaaggtaatatattcaaaatatcatcattttaacatgtaatcaataaaaaagtattaatgtgatattttatacttttcgtactaagacattgaaacctgcggaatatttcccatgtaccacacatctaaatttggactagctacatttcaaattctcaatagcctcaagtggctagtggccatcatattgaacgacaggtatagagttgtgtaggtcacttgttatgatttggcttccacgtggagtgaaatagtcattgtggaagtttgagcagaagagtgacttagtctaatgtacatttaaatggatcactctgattggtgtgttgagaaatgcccaagtttggaaggaagaggggaatcgtgcatagaagcagggaggcctgttaggaggctgttgcgccaatccaggcaaaagatgatggagactcactcagatccaagtgttagcagtcaaaatggggagaactggtcagattgtagatttattttgaaagtagaaacagtgtagtttactgacatattgaatggggaaaaaggttgaaaggtgaaaaaggaatgtcaaggataatatcaaggcttttggcataagtggaaagatggaatttccatcagttgaaattgtggttctgcaggtggcacagatttggaggaaaaacttaagtgtgagattgctattatacccccaagtgaagatttgagttgtcagttggatatatgagtctaaatttgagaaagaagtctagactaaagatacaaatttgagagctatcagcgtaaataaaaattatttaaagctgtgagactggatgaggtcattaagggattgagggtagatggggaagagaagaggtctgatgactgagtcttggaaccctctaacactatggggactaataccagtctggatggatttataccatattgatgattatttttaccattacgtaggagaatttcaagggcctggccaagaaggggaacttttaatatataactgtatttttaataataaatatatataatatacatttatatattatatatataataaatgtatataaaatagaattttataataaatgtataatggttctggaatttaaaaatatgtgagcaatacagagaggacttacagctatagctcagatatataaagaagttgtgaacttatcactgttgtccttacaacaaggaaaagcttgacaactaattatcaatggatattgatgttcttatacacataagagaactgaatttgcagggcgaactttcatcgcaaacctaaagaggcaggtacctgcaggaagtcataaactgaagcatttgcttacctggggctgaagcctccagatgccatgaaaccatatgaggaacattaaactagaaagtctgatgaattgctggggtggttaagtatgggctagcaagagtgtgtacagctccttgagggccacagtcatgggtgtggggtgtggcttatacttacctaggcttttccttcagttagtacactaggctgtcattaggaagattggggataatccagagaaacctacctactgactttctctctgccttggtgattgtagaagtttctaaaggatattttcactggatataagattctgggttggcaggtttttttttttctctcactccacccaattccccgaatgactaagaagagcatagcaccctgacaacctgtgatggacatacagtgtgaacaagaaattaactttttttgtttgtattttagcaaaaacaaacagcaagttgtcagtacaatcatgttgattctggaaagcaagcataaggaaattttatgttttatattacatacagattggggaaaccattggatgtcttgaagaagagtagtatttgatttacccaataaaatcatgttctttgaatattaatccagtagcgatgtataggcaaagattctccactttctgaactaattctgacccttggctctattatgtgtctgaagttatttaataggaacaataataagaacccaaaccaagtgataattaccagaatcctattcatactattaaatagaattagctttgtgtattgtttgaggctattttttttaaaaaaagagaattttaatagtatcttaatgctttatataatttcccacaaaataatataaaaatactcatattgagtaattctacctgtttttacaattaaatgtccatcgctaaataatatttagctaggaatgtagttccttattattggctgttatgccaaaagataaaaaatttcttgttctataatgcctttaaaaatagttgtctattgaaaatatatctattttttttttctgagacagagtctcactgtgtcgcccaggctggagtgcagtggcctgatctcggctcactgcaaactccacctcattggttcacgccattctcctgcctcagcctcccgagtagctgggactacaggtgcccgccaccatgcccagctaatttttttttgtattttcagtagagacggggtttcactgtgttagccaggatggtctcgatctcctgaactcgtgatctgcccacctcggcctcccaaagtgctgggattacaggcgtgagccaccatgcccggcctatatctattttttaccggacttttaattaaataagaatctagagattttacctaattaaggaaaagcatgttggcttcagaaataatttttatgcatgccccataagtctttgaaaagacaatttaatattatgcctaatgttatttttgctttgggagaaaagtaacctatagccccaaaaagtcttatatatgatgggttgtcactcatggcaacttacagcaggaaggattgggtctagattttccttactttgcctcagatttttcattttcgaaaaaatgccccttttcatgtgttgcaactgaggagagttatgagtcaaacgcatcctgttttcaaactcatacatgatattttggttaataaatgcatcaggacctggaggacaattgacatataaaagaaacatagaaagaaggcagccaattgtgtctgtttacagactaaatatgacaaaaaaaggtctgtgagagttttaagttctgcctgttccctagaaatttctactcatttgaagatgaaccttgattgaaatgtaaagtttcaacttctaagaagctgagtaacatacacagcaggaactgccaatatcgttttaatagacatgtcttgtaaaggtgaatttcaatgagttttcagagctttctgaacagtattatcacacgttttaagtaaataggtcaatgttatcatttatgtataattttattgctttagtgctatatttttatgattattttacaaatactttactaagaatatactgaagtctcctgatgattttatgctctttcttattcttgttttactcgagaagttttaactttgaatccctacttagctactttaaaacctgtctcatttttccaacttacaccttgcatcatctctctttccttagagcccagacatcttgcggagccattcacttcttcctaacattttagatactccaatcttttttctatatttgattatttatttgtgaatctcaagaacagaagtagtctatccccaaaacatgcagagagctggaaaaagtatagacatatacaatttaatggaaggaaggaaggcaggaaggaaggatatgaattatatctctaaattggaaacttcaagccttatgtctttataatgatatatcataatttccttttaaaagtcaggaactcagaccaagacacaaactcatgcacatgctaaactgtgaaagcatacatttacctgtggtgacgttagctggcagttttagttggctcagaaaaataatcttacataaggaaagagcctccctccatgagcagccttgaaagtagaaaatttaggaagaatgtgtcaatgatcaaatctactgaaaatcagcaatatcttttgcatacttgtggagtaaggtgtgacaagttattagtggtatggatggctgagcttttctggaaagaagaggacatttttcaaatgtgccttgtattgtgcatggtcctttccatggttatacctacatactggccagttgtaaacattagatcatattaaaatcattcatggatctttcaaaaagacttagactcccacacaatagtagtgggatactttaacagcccactggcaatattagacagatcatcgagacagaaaattaacaaagatattcaggatgtaagctcagctctggaccaaatggatctgatagatagctacagaactctccacccaaaaacaatagaatatacgttcttctcattgccacatggcatttactctaaaattgatcgtataatcagaagtaaaacactcctcagcaaatgcagaaaactgaaaccatataaaacagtctctgggaccacagtgcagtcaaattaaaactaaagactaaggaattcactgaaaaccgtacaattacatggaaactgaataagctgctcctgaatgacttttgggtaaataataaaattaaggcagaaatcaagaagttctttgaaactaatgagaacaaagatacatcgtaccagaatctctggcacacagctaaggcagtgttaagagagaaatttatagcactaaatgcccacatcaaaaagttagaaagatctcaagttaacaacctaacatcacaactaaaagaactagagaaccaagagaaaaatcaagccacagaaatacaaacaaccatcagaaaatattacaaatacctctatgaacataaactagaaaatctagaagaaagggataaattcctggacatagacaccctcccaagactgaaccaggaagaaatagaatccctaaacagaccaataatgagttctgaaattgaggcagtaataaatagcctaccaatcaaaaaaagtccaggaccagatggattcacagctgaattctacccgatgtacaaagaagagctggtaccattcctactgaaactattccaaaaaattgaaaaaaggggactcttccctaactcattctatgagaccagcatcatcttgataccaaaaccctgcagagacacaataaaagaaagaaaacttcaggccaatttacttgataacattgatgcaaaaatcctcaataaaatactggcaaactgaatccagcaacacatcaaaaagcttatccaccacaatcaagtaggcttcatccctgggatgcaagcaagcttggttcaacatacacaaatcagtaaatgtgattcatcacataaacagaactaaagagaaaacacacatgattatctcaatagatgcagaaaaggcttgtgacaaaattcaacatcccttcgtgttaaaaactcacaataaactaggtattgaaggaacatacgtcaaaataataagagccatgtgtggcaaacccacagccaacatcgtactgaatgggcaaaagctggaagcattccccttgaaaactggcacaaggacgcctgctctcaccactcatattcaacatagtattggaagttttggccagggtagtcaggcaagagaaagaaataaagagtattcaaatagggagagaggaagtcaaactaacacttttgaagatgtttaaaaaaagcaatggggaaaggattcccttttcattaaatggtgctgggataactgtctggccatatgcagaagattgaaactggaccccttccttacaccatatacaaaatttaactcaagatggattaaaaacttaaatgtaaaacccaaacatataaaaattctggaagacaacctaggcaatactattcaggacatagcctgggcaaagatttcatgatgacgacaccaaaagcaattgcaactaaagcaaaaattgacaaatgggatccaattaaaataaagagcttctgcacagcaaagtaactatcaacagacaacctacagagtgagagaaaaatttttgcaaactatgcttccaacaaaagtctaatttataaggaacttcaacaaatttacaagaaaaaaacaccaccccattaaaaagtgggcaaaggagatgaacagacacttctcaaaggaaggcagacacatggacaacatgcatgtgaataaaagctcaacatcactgatcattagaaaaatgcaagtcaaaaccacaatgagataccatctcacaccagtcagaatggctactatgaaaaaataacagatactggtgaggttgtggagaagaaagaacacttatacactgttgatgggagtgtaaattagttcagccatcgtggaagagtgtgacaattcctcaaagacctaaagacagaaataccattcaatccagcaatcccattactgggtatatacccaaaggaatataaattgttctatcacaaagacagatgcatgcatatgttcactgcaatactattcacaatagcaaagatatggaatcaacctaaatgcccatcaatgatagactggataaagaaaatgtagtacatatataccattgaatactatacagccataaaaaagaatgagatcatgtcctttgtagggacatggatggaactggaggccattatccttagcaaactaacacaggaacagaaaaccaaataccacatattttcttttagttgggagctaaatgttgagaacccataagacacatagaggtgaacagcacacactgaggcctaccagagggtagagggtgggaggaggaagaggatcaggaaaaataactaatggatactaggcttaatacctgagtgatgaaataatctgtacaacaaacccccatgacacacatttacctatgttacaaagctacacatgtactcctgaacttaaaataaaagaataaaaaaaatcgttcatgagtctttacaaaatcttaatacctgagtctcaggattgagattcgaagtggggagggggactggaggactttttttgagttgataaagaagaaactggtactttgaaagaaggtatacgtttcttccttcctcctttttggtaatattctggaatcactgatccttaagactcccaggattttcaagttgtattctgttgcatttagatgcaaaataatctaatgtagtattttccacaatgagcttcctgaaaggctgatcttctctgaaaatgttagtaacctcatatgataaataagtaaatactaatgagtttcttccaaaatatgtttagaactctaagaaaatcactaaagaaatgtaaatagttcttactattatgcaatactttttcattagaaatacagtaccaaatcaagaatgccaaggagaatgagaaatcattcattactttaatctgttcaattaatatttttgagcatctactatatgcctggtatagttgtaggtgcttgggatacatcagtaaaatgcattaatacatgactttaattctgcagcatttagaaaaaaactctctgatgtttgatgggtttttaaaatatcgtataatgttctttattcatttttcattcaaatttataaatgaattaaaaaataaactaaaccagactaatttgctttattcatatgtaaagttaaaaataattagatattgatcatttcttacaagatttatttcattgattccttttattcttttgctgtcaaatacaagagtgaatttctatgaactgtggagattttcaatgcatttgaattaaaagactatgatgaacagaaaatgacacatccatacatgaaacttctctgtaagtgaaagctttattatatatttctttggggaaaccttttgccatgaagaaatgaagcaggttctgaaataaatttgaaacaaaatttttatgcaacttaagcaaattttacattggtaaatcacgtgatttattagaattttacaaatattacaaatgtaacatcttacactttatcaagctaaacaagaaatagaatcttttctggttgactggctgacatgaaatagtttttgattcaagcaaacttctgcaagtagctctttgtaaacagaaaaataagatagatggatatatatagataaatacataaaactaacttatttgactcttatttggtcccaccagttgggcttttagggatgttttctgcattcaggaagtttcttgaaataaagatgagtatttgttgttatgtttgtctgcagagaacagtctgcaaatagtcatatgtgtttcataaggatcgcctcaactttcttttttgtttctgttttgtttttgcatataggtagggttagacataattgtaaatactccttcttaaaaaggatatatatgcatcggaatttaggaaatggtcatataatggctttgaatcagattaacctggatttaatacaggtccctaggtattgtggaccctcatacccaattctctttgactttgttttgtcatttgtcacataaagatattaatatttaatatacaaggttgttataaatcaataagataataaaagtgtaaagagcactgcactgaacctgccttatggtaaggattcattggaaagtaattatttgttattactgttattattattaagcatctattatgtgttagggttgggaataataaatggaatattatattgggcataggtttcaagtgtagtgtctagttggagaactaaagagtatatgtttgaggtaataactaaaaataaaaacagtagtatggatgagaatagacagtttttttttaaatgtaagctttggaggtttttgtgacataaatattataaatggtcctgaagaaatctgaacctaaatttcttcatgtatacagcccatttatactgttcattaggtagaaaccagctcgtagatgaccttcaataaagtttgtattgattgctaggtttttgaggaaacaaaaacaagagacaattcaattttcccagcttatttctttttgaacagtagaaaggtgttacatcttgttgctgccaagtggagcagattaaaggtcaggacagcatgcaagatctgtttctctaataggaacattccagcacacaggaatgggggatggagtaatttttagtctatgtttctcatgaaagtcaagaatagcataacattagaggtacttttttggtctcatgtttattcagtagctttgaccgtagagttttttcctatttagtgactatattctacttggaaaatatgatgtaaaagaaattcgtagagaaaaatgcaaataccgttgcatatccccaagtaatttatgctttttcttacccccaaattcttgaaatatattcatttgtaataaaaaaagtccctgcacctggagttatcttttattttcctttctttttttaattactctgacatataattgtaagatacatatttatgaagagttgagacaggccagaatcaaattttcttgtccagcctacccagctgctgatggccatctctgagataaccaacttgctcacacatgctcctaatgatttctgttatatagttgagagggagtgtccgtctgtcagcactaaatgctatttgtgaaattaatggcacaaggaaacaatgtagctctgatactagttgcagctatacatgttagctgattttgaaaaaaggttggaatttagtaatatctttcagtcacatggtatttttccctctactcttcccctggttcatggcattctaagcatatcaaattacctactacttgttattgcaaatgatacttttaaatttctgatttgagatattacttgacccatataaaaatacaaaatgactgatttttttttattattatactttaagttctagggtacatatgcacaacgtgcaggtttgttacatatgtatccatgggccatgtgggtatgctgcacccattaacttgtcatttacattaggtatatctcctaatgctttccctcccctctcaccccaccccaccacaggccctggtgtgtgatgttccccttcctgtgtccaggttttctcattgttcaattcccacctatgagtgagaacatgtggtgtttggttttttgtccttgagatagtttgctgagaatgatggtttccagcttcatccatgtccctgcaaaggacatgaactcatttatggctgcattatattccatggtgtatatgtgccacattttcttaatccagtctatcattgatggacatttgggttggttccaagtctttgctattgtgaatagtgtcacaataaacatacgtgtgcatgtgcttttatagcagcatgatttataatcctttgggtatatacccagtaatgggatggctgggtcaaatggtatttctagttctagatccttgaggaatcaccacactgcttccacaatggttgaactagtttacagtcccaccaacagtgttaaagtgttcccatttctccacatcctctccagcacctgttgtttcctgactttttaatgatcgccattctaactggtgtgagataatatctcattgtggttttgatttgcatttctctgatggccagtgacgatgagtattttttcatgtgtctgttggctgcataaatgtcttcttttgagaagtgtctgttcatatccttcgcccactttttgatggggttgtttgtttttttcttgtaaatttgtttgagttctttgtggattctggatattagccctttgtcagatgagtagattgcaaaaattttctcccattctataggttgcctgtgcactctgatggtagtttcttttgctgtgcagaagctctttagtttaattagatcccatttgtcaattttggcttttgttgccattgcttttggtgttttagacatgaagtccttgcccgtgcctatgtcctgaatggtattgcctaggttttcttctagggtttttatggttttaggtctgacatttaagtctttaatccatcttgaattaatttttgtataaggtgtaaggaagggatccagtttcagctttctacatatggctagccagttttcccagcaccatttattaaatagggaatcctttccccatttcttgtttttgtcaggtttgtcaaagatcagatggttgtagatgtgtggaattatttctgagggctctgttctgttccactggtctgtatctctgttttggtaccagtaccatgctgttttggttactgtagccttgtagtatagtttgaagtcaggtagcatgatgcctccagctttgttcttttggcttaggattgacttggcaatgcaggctcttttttggttccatatgaactttaaagtagctttttctaattctgcgaagaaagtcattggtagcttgatggggatggcattgaatctgtaaattaccttgggcagtatggccattttcatgatattaattcttcctatccatgagcatggaatgttcttccatttgtttgtatcctcttttatttcattgagcagtggtttgtagttctccttgaagaggtccttcacatcccttgtaagttgaattcctaggtattttattctctttgaagcaattgtgaatgggagttcactcatgatttggctctttgtctgttattggtgtataagaatgcttgtgatttttgcacattgattttgtatcttgagactttgctgaagttgcttatcagcttaaggagattttgggctgagacgatggggttttctaaatatacaatcatgtcatctgcaaacagggacaatttgacttcctcttttcctaattgaataccctttatttctttctcctgcccgattgccctggccagaacttccaacactatgttgaataggagtggtgagagagggcatccctgtcttatgccagttttcgaagggaatgcttccagtttttggccattcagtatgatattggctgtgggtttgccataaatagctcttaattattttgagatacgtcccatcaatacctaatttattgagtgtttttagcatgaagggctgttgaattttgtcaaaggccttttctgcatctattgagaaaatcatgtcgtttttgtctttggttctgtttatgtgctggattacgtttattgatttgcgtatgttgaaccagccttgcaccccagggatgaagtccacttgatcatggtggataagctttttgatgtgctgctggattcggtttgccagtatcttattgaggatttttacatcgatgttcatcagggatattggtctaaaattctctttttttgttgtgtctctacccggctttggtatcaggatgatgctggcctcataaaatgagttagggaggattccctctttttctattcattggaatagtttcagaaggtatggttccatctcctccttgtacctctggtagaattgggctgtgaatccatctggtcctggactttttttgattggtaggctattaattattgcctcaatttcagatactgttattggtctattcagggattcaacttcttcctggtttagtcttgggagggtgtgtgtgtccaggaatttatccatttcttctagattttctagcttatttgcatagaggtgtttatagtattctctggtggtagtttgtatttctgtgggatcagtggtgatatcccctttatcattttttattgcaactatttgattcttctctcttttcttctttgttagtcttgctagcagtctatcaattttgttgctcttttcaaaaaagcagcttctggattcattgattttttgaagggttttttgtgtctctatctccttcagttctgctctgatcttagttatttcttgccttctgctagctcttgaatgtgtttgcttttgcttctctagttcttttaattgtgatattagggtgtcaattttagatctttcctgctttctcttgtgggcatttagtggcataaatttccctctacacaccgctttaaatgtgtcccagagattctggtatgttgtgtctttgttctcattggtttcaaagaacatctttatttctgccttcatttcgttatgtacccagtagtcattcagaagcaggttgttcagtttccatgtagttgggcgattttgagtgagtttcttaatcctgagttctagtttgattgcactgtggtctgagagacagtttgttataatttctgttcttttacatttgctgaggagagctttacttccaactatgtggtcagttttggaataagtgtgatgtggtgctgagaagaatgtatattctgttgatatggggtggagagttctgtagatgtctattaggtctgcttgttgcagagctgagttcaattcctgggtatccttattaactttctgtctcattgatccgtctaatgttgacagtgcagcgttaaagtcacccattattattgagtgggagtctaagtctctttgtagatctctaaggacttgctttatgaatctgggtgctcctgtattgggtgcatatatatttaagatagttagatcttcttgttgaattgatccctttaccattatgtaatggccttctttgtctcttttgatctttgttggtttaaagtctgttttatcagagactaggattgcaacccctgccttttttttgttttccattttcttggtagatcttcctccatccctttattttgagcctatatgtgtctctgcacgtgagatgggtctcctgaatacagcacactgatgggtcttgactctttatccaatttgccagtctgtgtcttttaactggagcatttagcccatttacatttaaggttaatattgttatgtgtgaatttggtcctgtcattatgatgttatctggttattttgcttgttagtgggtgcggtttcttcctagcctcgatggtctttaaaatttggcatgtttttgcagtggctggtactggttgtttctttccatgtttagtgcttccttgaggagctccagacctgccctacaagaatgactgattgttagagacttttttgtgtttctatggaaaaattaaaacatatgtgagagagtaaactgctgattattctatacaaagccttctagcatatctttctgactttctgtaaatggaacatgacttgacgtctacctccaactcaatttgttttttttttttttttttctgagacggagtctcactctgtcccccaggctggagtgcagtgatgcaatctcggctcactgcaagctctgcctcccgggttcacgccattgtcctgcctcagcctcctgagcatctgggactataggcgcccgcaccacgcccggctaattttttgtatttttagtagagacgaggtttcaccgtgttagcaaggatggtctcagtctccagatctcatgatccacctgtctcggcctcccaaagtgctgggattacaggcatgagccaccatgcctggcccttggtgtgttttttaaaacacaatcaaacacataaacattcacaaagaactacttcagaaaaacaagaattcactggactagagaggacctttaaaaaatctgaaagcttctttgacaagaaaggataattgctgtatatctttcttattgagtataattttcgtttacatattttattttgtgtgtttttaaaaattattattaccgggtaattatgatagatataactcagaatacgcataggtcaaggcatgggatagggattgtatggagcttccatactccccactgtgtgccaccctcttagcacatctgtgttttcaccaacccagaagttcttcatacaattttaaaacgtaattaataaaagatcttgcaagtctctgaattttcttaccttcttactcataggatcaggcaaatttcaatctctttgtgaaaatgctaacatgttgagaatgagcaaggcagagcagtggggtggataattctaataataaatcatgaacaaaagtaaatggtgatggctgtgatggtgtgaaataacctgatggtggcataggcctcttgaaggaatactctgggaatctcccttgtaacacttttaagagcaaatttaaaaaatcgagactatttatgcatttttgttgtatttagaaaagcatcatgtacttaaatggaagaaaaaaagtgagggatacttccagtgttggatggttaagtttttctgaagtctatgtttattttcaaagttatttatgacaatgaaataatatttaatgctacagctatcacagtgcactcatttatttttttctaaattgtgaagaatacatggttaataataggtttcagataggtatctggattcatgtgaatgaacttaaaaagacagttttgatgatcattctgttgaggatagaactgtggtatatgtgatcatgggttttatttttctcatgtgtaaaatgaggtatataatctgagtctcaggtgactccaaatttttaccattcttcacatattgatattatgttcaagaaatcaatagggataagggggaattaaggataataatttggttctacttaataacacacactacttgattattaacaacattgcacgcaagtgttaatacagctcatttgctttggatggaagctgtaatgtctaagattcaagcataccttcctttggtgatggccttcattcattcaaccaatatttttgtagtgactgttgtgtggggattgtggtagaattaaaactttaaggaaaaacctattataaaactccctcacaaaaaatacgataaattgaaatttaaacattatttaagaaattttattacttggcagataataaatgatacttactgagtgctaccacacccaggcactattcaattcactctacagttattaattgacttatatcatcctcatagtgttcctatgaagtaaatgtcattatttcccccactttacagatgaggaaactgaggtatagagagaataggcagtttgatcaagcttttaagattggtgaatggaagagtgtgatttgaccccagagctctagtgcctgcatgcttaaacactatattgcacagcttcttcatttagatacattgcagaaacagaggaatctaattgtagatgcatctggctcaactcctttgtgaacatagtagtaatgtaatcagaagacttatatcctcagttttattcttttatggattttatatgggaccaatgataaactttcttcatttaccccagtctcttaataaaaataattttccaattctgtgaagaaaggcattggtagcttgatggggatggcattgaatctgtaaattaccttgggcagtatggccattttcacgatattgattcttcctacccaggagcatggaatgttcttccatttgtttgtgtcctcttttatttcattgagcagtggtttgtagttctccttgaagaggtccttcacatcccttgtaagttggattcctaggtattttattctctttgaagcaattgtgaatgggagttcactcatgatttggctctctgtttgtcttttgttggtgtataagaatgcttgtgatttttgtacattgattttgtatcctgagactttgctgaagttgcttatcagcttaaggagattttgggctgagacaatggggttttctagatatacaatcatgtcgtctgcaaagagggacaatttgactccctcttttcctaattgaataccctttatttccttctcctgcctaattgccctggccagaacttccaacactatgttgaataggagtggtgagagagggcatccctgtcttgtgccagttttcagagggaatgcttccagtttttgcccattcagtatgatattggctgtgggtttgtcatagatagctcttattattttgaaatacatcccatcaatacctaatttattgagagtttttagcatgaagggctgttgaattttgtcaaaggccttttctgcatctattgagataatcatcattctcagtaaactatcgcaagaacaaaaaaccaaacgccgcatattctcactcataggtgggaattgaacaatgagatcacatggacacaggaaggggaacatcacactctggggactgttgtggggtgggggaaggggggagggatagcattgggagatatacctaatgctagatgacgagttagtgggtgcagcgcaccagcgtggcacatgtatacatatgtaactaacctgcacaatgtgcacatgtaccctaaaacttaaagtataataataaaataaaataaaataaaaaataaaaataattttcattagagtgtatatgagattatgatgatggatttcttattatatcagaattatattttcataaattcagataacactgtacagttattgttgaatactatactatgtataaatgtccacaaatcaaattttaactattcaagggtgctttcctttcaaaattagcagaaagattacgttttcaacagttaattaaaccattttgaaattacaagagataatgtagaattgtatccaaagtcttatacatttgttctggcaatacctttattcagcaagagagaagaatttattctctgcagataaccgctactcacccacaaacagtccaacatacagcccagagatgtaggcttctcattttggaaatacaaactgtttacaatgagagtatctctaaaaaaattgtttcttaggaggaaagatcgttctatcttccaggaaagggaaactccaagaagtttctttattctaaaaaattaagaaagaccctcaaacctcaaagcacataaaggagacttagcaaacaatattctgtaatatttgcagaaaaacataaacacagcatctttactaatgtttattttccaaaaatatggtaataatagacatttattgggaacttccggcattgcaatgcagaacacttttttataatgaatataaactcattatatagatgaagaagctgagttgcaaagaagtcaagtaggaaactcatttaaaccctctggagtcatgtccttccacagtgttttatatttactttcttgtagatattatggctattctaaatatttggatatttgctgctctaaaagtctttttccttaaagaaaatttttcaagttgtatttctttttcactttaaaagttattttaaacttaaagggaactttacagcccattctagctatgttactctgtattatcatttgcttatatcaaacattttgcatgctactatgactataaatatatcattttaaactttaatttgtgcaaatttaaaatgattgacttttattttgcagttagcaaataagctcccagactgaccaaaatgcttttaagggtcacatttatgttaaaaaattatatgtataaaattcccattgggaaaagtttgattccagtattcttatgtaatagccaagggagtgccagttaagtacaaatttaatagcttttctaggtaggactccagaattagtgcatgaagggaacatagttaatctgtttgaagagttcattaaattaggttatatatgctattatgaaatatagaggagcataaaagtatccagaggaaagcatagaaacaatgcaaattacttagaaccaaaaagattgatttatgatgaattattaaagataaatggatcttaatagtaaatgctctataaacagagtatatgtctaatgccaagatgctaagttcaaagaagctttacctaataattaatgaggactggaaatactctagcattctagatatagttgcccaattaaatatgttatagaaaattatctgaaaatgggaagctaactgagctcatccaaaatttagatgatgacttatttcttccagttagaagatagggatgaggccgggtgtggtggctcatgcctgtaatcccagcactttgggaggccgaggcaggcggatcatgaggtcaggagattgagaccatcctggccaacatggtgaaaccccatttctactaaaaatacaaaaattagctgggtgtggtggtgcacgcctgtagtcccagctactctggaggctgaggcaggagaatggcgtgaacccaggaggcggagcttgcagtgagccaagatccatctcaaaacaaaaaacaaaacaaaaaaaattatgacttgaatttcaattatgacttgaaattatcttatgatagtttctaataggtggttttcctcatttgtttcaattataattaaaaatagttttataattattatgacacttgtaaagatagtaaaactctgtttcagaaagcttatccatttgctgaagtttgtattgctctctcatctattccttgaagaactttaatattgaaggaaaacaatgacaacttttatgataggaaattcccctgcttaactaaaccagcacatattggtctcaaaaattgagatgacctgaatctttgaatatagtttttttacacgttgagcattgtatatagttagaaagggctatagaaactgtttcatgtttaaataattatttctttccttttataaataatataaagagtatatatcagttatgtattcagaggaacacttccgaaaaacgactaaatagatacttggccatattttctacaaaattatctaacatagaatgaacatatttattcaataaatgtatgctgaaaaaagctacatcataagtaaaatgaacaataaaaaaactaataatattttccagttttcttgataatgatttacacttgttgaactgtgatgtgtgatatacttgttgaacatgctaaggaatattaagccatgccctaattttcattattttacattcatgcattaacttgagcaagaccctaagatttatttataggtgccagttcagaaagtttttcttgctgtgaaatcctagacctgatgttttaacatatatatggactttgaaaccatgttcatttaatgcctatgaccaatagttttaatgaatgcctaacaacttacttaaaccaaacaaataattagtgtcaattacagaagtgtaaatttgactctaattaatgaatgtgccagactctacgcattggtttaagtgtaattgatcttagggccactgagatcactttaagggttggaaaaatgacaacaagtaggaagtgactcagatgtaagaatgctcactcctagaaagattaattggtgtattagtgataaactagtgggtggctgatgtaataatgatatccctatattaagatgcctcaaaataggatcaccaactctaaagcttgtaagtttatacaattactatgtcaaatatactcttttaaaagaatatctgtcacgttcatttgtccttttttcattttgattttttttctttttcatcattataaaaaaaacatcctaagggaagcatactgatgttttactttatgctttgaaatgttctcactgaactgtgttggtaggcctgggtgtggtaaattaagtggcttgtattaaaaagacaatgattgctagctagtatttttccattttctttgctgtcagcaaagtctgcttttgttgccatgataacttctccccactttgatggtgaaatctggaaggacaaaaaagaagggcatttctattgtgctattacatttcttctcttttgaagaacttctaatactttgaatgatgggttaaaaagccgagatgatgtgatgaagctgaatggtgggcaaaagctaaattatggcatattcatttttttatcagtgcgtgaaaggtcactggctgagggagagacaggcaaagtcctagatcaagagagtgagaggtggctgctaagtggggagttgagaagatcagaatactacggagtctttgtcctttttctgactattccctgcctatgttttttccctcccttctttctcccctacctcctaaccccagacaactgtcctaatgaaaagatttttaagaaagatgtcaaagaaaatagagtttttaaagaaagatgtcaaaggaaattgttgaatgaggcacaggggcagcatgagaccagagtggaggaaagtgataaaggcactttttagaagttaagcccagaaaactggggcaagaatcaaagcgacgctacaggcagggatgaggtaaccagggtcctgaagataatcataaggagctggagtctgaggcaggaaaaaaggcaagtctggttaagaggtttaaggcagaggatgacctacttagaaaaagatcttttcaacagccagacttcggactagaggggaagtaggtcaagaggcctgagagtaggttacattcgtctgagaggaagttgttttgactaaacaagaagttgtaattataccaaattatgagatcgttaaattaagtagtcatgtgcaataacatttcctccttaaatatttttaaacatttttttagcagagttgttcatcatacatcaaattttaatttgcattatgttgtgtagtacaacttcatttagactacttcagtggaagaacaatcgaaatttacgaacattctgaaagagttggaattttgcttcttgtccgtatataaataggatcaagttaacctttcatactgtgtgaactcctttgtcttatttcttcgagggctttttaaaagataagaataatgaacgtgaaagggattttataaaaacatgattaattcaggtaattgaaatagtttgatatcctaagtagtttaagcattctttctgctacctcatttggattaatagtttgtttcatcccagcactttgggaggccgaggcgggtggatcacgaggtcaagagatcaagaccatcctggccaacatggtaaaacccatctctactaaaaatacaaaaattagctgggcatggtggcacatgcctgtagtcccagctacttaggagactgaggcaggagaattgcttgaacccgggaggcagaggttgcagtgagccgagtttgcgccactgcactccagcctggcaacaaagtgagactctgtcttaaataataataataattaataatttgtttcaaaatacagcaggatggtatagtgttaaacacataaattctagaggcagattacctggattaattcctagctctatgattttctacccgtgtgaggatattggatcttaatgtttatatgtcagttctctcacctgtaaaatgggctaatagtagtgactatttcatagagtggttgtaacaatttattatacaggtgtgtgtgtgtgtgtatataatatatacaggtgcacacacagttatatatatatatacatacttaggacagtaacagaaacagagaaaatgcttatcaaatatttatgattattatgagcaatgttaacagtaattatatgtatcctaaaatacttctaaaatagtaatgatactattaatccaatcctaattttaatactaatcttaacaatatttttgtataccatcccccagctcctcctgccatttcttttctcccctttatagtaaaactcagaagagttgcctgtgcttgctctcttctcatttctcttagacctcttccagtctgggttttggagccaccactccaactaaactattcctaccaaggtcccgaatgtcctccacattgctgaattagacccaattctcaatccttaaggcagatagttgacctatcagcaacaatttatcacctacttctttgatgatgtactgtcttcacttgtctttcagaattgactcttggtataccttcagatttagttggtctttctcagccttctttctgattttgtcgactctcgtagacttctcgatgatggaagaagccagtctcattccttggtcctcttctcaattcacttccttagtcatttcacctagtactgtggttttaaatatcatttgattgttgacaattttgactaatttattttctgtttccagctcctctcccaaattccagattcgtacatctaactccttactcaagattttcactgaaagcacttatagacacttaaaatttaatatgtccaaaggctatagagccaatatcctcctcagaactggttccacaaacacccattcccatatcagttgctatagttccctgtgtctggttattcagaacaaatttctttgagtcatccttcactcctctcattttgttatactccacatcaaacagttctcactttctgttggcttgaccttcacaagagatccagatggtgaccatttcttaccacctctgctgctacaaccctactttaagtcactatcatttctctcctgaatttatgtgatgacatctggtctgcctgcttctgctcttcccctcttcaaatctattctcaacacagaagtcaaatgtcagtaaaatcctgtcagtcctcaccttgaaaccctgcagtgaaaccacaattcattcattacaaatgaaaagtgtttacaatggcttccatggatttatatagtggcccccattatttcttcttatgtcatctactcctattttccctgtaatttgtgttactctagccacagtgacacctcactgtttctgaaacatgctagacatgtgcctaccttaaggatttgcatttgctgttccctctgcctaaaaccattttcccatatataatcccacaattcctttacttcttttaggtctttaccaaagtgtcatttttttttttttttaatgtggctcttcctctagttttaaaactataactctctaactcctgactgtcacctctggcatttcccatttctcctaccctcctctagagcttagtatatgttccaacatcatgtaccatttacttatttgttatgcctgttatttatcagtcttctactagaaagtaagctccatatgggcagggaacatttttcatttactggttggatcagtacctattattttgtaggcactcaataaatacatgtcaaatgaatgagtgaatgagtattctgttgttttttcctctcccctacaaatattatgttgaaaagggttttcctcaaatgcagatcttatgcaagatacctgcatgatataggcagtgaacatcatctgctactttcgtttgctaatacaacaggcaagctcaacgtgaaaattacttactgtggcatccagtgttgctctccacatctggaatgtgtttccttaatcttatgaaacattactttcctatcaagttctgtaccacctatgaagtttttcttctctggacattcttgccaactgtgatttccaattctttagaattggtatagcacttatttttcttactatacaatttagccaatacattttatattaagtttcattgttttgtctcttcaactagcttgccaagtcttgaagggcagaaatcacatactatgccttctggtaaagcaatgtacatgttcacactccaatctatagagtattttttttttaaatcttcaaaataggttttgtctcttcaactagcttgccaagtcttgaagggcagaaagcacatattatgctttctggtaatgcaatgtacgtgttcacgctccaatctatagaatatttttcagaaaaaaatttaaaaataattttccaggaagattcctcagaatcttagtggtaacccaggagcagtggttcatgcctgtaatcccagagctttgggaggccgaggtggaaggattgcttgaggcccggagttcaagcccagcctgggtgacatagcaagaccccatgtcttaaaaaaaaattagctgggtgtagtgacacacaaccgtagtcctagctgcttgggagcctgaggcaggaagattgcttgagcccaaggattcgaggctgttgagctatgatcatgccactgcattccagactggacagcagggcaataccctgtctccaaaagtataaaattaaaaaaaaaattagaatcttagggataaattgcttaaaaacaagataaagtttcaaacaaatacctaatatacaactgtcttcaaaagacattttttagtattaatgatttaaagtattttccctttcatatttccttccttatgggtaaggaatgtggaatgtcaagccatttttcatgggttttataaatactacctattgattattcatgaaataatatgtccttttatgctttgttgttaaattcaagatattatatagcaataaaacatttaagtatttgctgaatcaaatgaccaaactggaaagaagtgatggtcaattagaatgtatacaatccttgttcattaaaatgatggctcacaggctgggcgtggtggctcacacctgtaatctcagcactttgggaggccgaggtgggcagatcacaaggtcaggagttcgagaccagcctggccaacatagtgaaaccccgtctctactaaaaaatacaaaaaataagccaggcgtggtggcgggcacctgtaatcccagctacttgggaggctgaggcaggagaattgcttgaacccaggaggcagaggttgcagtgagccgaggttgtgccattgtattccagaccgggcaatagtgtgagactgtctcaaaaaaaaaaaaaaatgatggctcatagatgatattcatgaaaaggttctctcttgccttacaaaactcttctacttatctgttaatgtatacagttaattttctacaattgcataaatacatgcacattaaacattaaaatgacttagtttatgttccaaacttacaaagccaaataaagtcagtggtaatgacagacctttaactctccccattgttcttaatggcaaccattgctactaagacagcctgtgcaattattcagtatctcaggagtacaaaccatatgctggataaaaaagtaggcaaaataagcttgatgtattaacactaggagactgcaggttgtattttgtttcatagatttgagagaatatttttattttgtttttcactattttttttccttcaggagtgtgttgcatgtttattgtcttgtgttatatatgcaacagtagattttcttaactctgtttttataaaatgtcatggattctttcattccattaacttctttgaatgttatgaaaaatgagtgttatgaatagcttaggagacttgagtgtttggagaaactgaggagacttggaggggctgctcagccctgaatatttccttttcttttcttttcttttcttttcttttcttttcttttcgttttgtttcttttcttttctcttcttttccttccttccttccttccttccttccttccttccttccttccttccttccttccttccttcctttctttcctttctctttctttctttctctttctttctttctttctttctttctttctttctttctttctttctttctttctttctttctttttttgagatagagtctcactctgttgcacaggctggaggacagtggtgcgatctcggctcactgcaacctctgcctcccagacttaagtgattctcctgcctcagcttcctgagtagctgggattacaggtgcctgccaccatgcccagctaattttttgtatttttagtagagatggggtttcatcatgttggccaggctggtcttgaactcctaagttcaagtgatccacctgcctcagcctcccaaagtattgggattacaggcatgagccactgtgctcagccagccctgaatacttctgaagtcctttcatttctctaaatattaagagagcaaacaatagaaaagtaataatcaacaaacttgatttcttacaagaaggcttatatgccaatgttttaaagttttaacattttaatatagagattttacatggtttatgttatttcctttttagtatatctttttaacttcttaaagacacaacaaatatggaatattaaacttggataaacaactctttcattataaaacaattcatccaacaaaactgtatcaaatgcctcctcagtgctaagcgttctgctagtcattggtgatacaagttgaatgaggcaaccaatgaccgaggcttcttactgttcacattcaagtggaagtgtgagaaaataaaaaatatgtaatgtagaaaagaaggaaggaaggaaggaaagagtcagggagggagggaaggaaaaaaaaaggggaaaaaagaagggaaataattatccattcagataattgctaaagcagaagtacacaggtacagtgaatagcaatttgcagccagaaaatcactattatatacatttctttgcatgtttccaaataaataactcttccaaatatctaatctctttttttaaaaaaaaaaaatcttagaacattattgaaaactagtttatgggaactagaattgtcctacaggacagaaaaatttggcccaagcagcccagttttagaaatctacttcatgttaacattattttacttagctgacaaatatttactaaatgcttattatgggccatgcactgattttggtgatatagcagagaacaaaaataagtccctgacctcatgtatcttataagaagtaggtgatgattgtaatagatcagtggatgataagcactctggacaaaaattaaaactgggggagagttatgtggtgtctgggtggaagatgttggagttctctagggtggcaaaagaagacctcactgagaagcagtcatttcaactaaatgctggaaaaggtgagggggtgagttatgtgtgtattagatctagagaaatgcaggtgcaaaggccataaggcaggcaccatactggttcaaggaaaaccaagaaggcttgtgcggctgcagtagggtaagaaagagggaggttagtgcaagatggagttagaaagataatgttgttaggagtgctttttaagggttttggagccaagaattaaacaaaaatctgcttgatggcaggaggcagcagatgacatctgtttgctactgtccttccatgtgggttgtatcattcctaggtaattgttctcatttctgaccaggagtgttagtcttttctaattagcatcctaattattttctccaactcatcttctacttggctgtctaagtgatctttccataatgcatgtcccatcttgtagtctcaatttaataccctttggtgacactccattagctttgcaaaaagacaaaggtcttaaatggtgttcaaggcccttcataatttgatgtctccaagatacctacacagcattcctcctctgggtcttgacacttgtagttccctctacctggaatgttcttttcccatttcttcccatgacagctttcttttaatcttttaaattcctatttgaatgccaccttcactgaaagacattcctttcctgaccactctttctaaagcaggtgacacggagtctatattttccatcattatcatgctgtaattttcctccttaccacaattagaaattatatattttgctttactcttttgatgtctgtctgtctcagtagtatgacgcttcatgaaggcagtgatctcgctgtctttacacttctgtaccaacaataaaagctaacacatatttaatgcttgttatttcccaggcactattcccagcacgttgcatccactaactcatttaatacttaaccatacgaggaagataccatttattaatctagactaggctatcaaggcacagagagactaagtgcctggactccaattccatggctaatagagtagaagagacaggattttaattcacacaatctgcctccatgaaatcaatgtacactctgtgcattagacaaatttgattatttattttaggtaccttatactttctataagctgaggctttcagtagtgcttcctctgccaggaatgcttatatcttcttttccctggccatatgctatctctctttctagttttcatccactcttcatctcctttccaaggcttttatgatatccccctccttccctgcccagactaaatagaagcttctctttgcctaacctctttgcttccatatgatagtttagcaattattatgctatattttaattattaattttcttatatcccctagacactgaactcccaagatggggacagtgtcttttttttttaattcccagtgctcattatagtttatggcataaaaagttggtgctcaataatgtttggttaaatgaatgtgtgacacagaacatttcaacagcatactcattaatatcgtagaaatcttacctggttcaaaaaatactaagacatctgtccaagtagaaatcataaatccaataaacccaggataatagttttgaaggaagagagatgtaggtttagaaattgtcaacagccttatgtcactgaagagaagaataagaaagctgctgtctcaaccactgaatttaaactaagctgctttagacaaagaaactaattttaagtgagaatgaggaaggacaatgagcagaagttagaattagcagaaggattggagatagggtttgactttgtgtatatctgaatctttcactaataggcaaaatttataaatcattaatatctctgatatgagccatattttgttccttgaagcaattttctttttttaaccctataatgtcataaatttattttttttccttccaacttttcttttaggttcaggtggtacatgtgcaggtttgttgtgtgggtaaattgtgtgttgctggattttggtgtaaaaatgatttgtcacccaggtagtgagcttattaccctataggtagtttttcaatcctcaccctccaccctcaactaggccccagtgtctattgtccctctctttgtgtccatgtgtactcaatgtttagctcccagttataagaacatgtataatatttggtttactgttgctgtgttaatttgcttaggataatggcctccagctgcatccatgttgctacaaggatttgatttcaatctttttatggctgtgtggcgtttcatggtgtatatgtaccacattttctttatctagtccaccattgatggacatctagattgattccacgtctttgctattgtaaatggtattgcagttaacatatgagtgcgtgtgtgtttgcacacacattggtctgtcgtccacaatgatggactacataccgtcgtttgattgaacaatgttttttttcttttggatacacatacagtaatgagattgctgggctgaatgatagctctgagtttttttgagaaatcaccaaactgctttccacagtggctgaacttatttacattcctatcagtagtgtttaagcattcccttttctccacatcctcaacaatatctgttatttttttactttttggtaatagtcattctgatgggtgtgagatgttatttcattgtggtttggattttgcatttctctaatggttagtgatgttgagcattttttcatatgcttgttggccatatgtatgtctttttttgagaagtgtctgttcatatcctttgcccatttttcactgaggttgtttgatttttgcttgttgatttgtttaaattccttatagattctagatattagacctttgtcagatggatagtttgcaaatattttctgccattctgtagggtgtctgtttactctgtttatagaccttcaagtaattttccaaacatgcttcacaaaccttgaagtacgtgcaaatattttagatggacaaacagactatattaaaacattttccaagagattccttatctcattttgttgaatgtgagaaagcaagacgaagaggatttgtaacttgtgatacaaaatagggcacaatcaaatctaatctcacctgagatcttcacctcacctttgtcagcaaatagattctttcttttgcaccctgcactataagtattctgcatctattagttttcttatcagcatgaataaataattttacaacatagttcttgaattaacaaactattttgctccaaatacctatttcataatttctctttagttaaagtttgattctgttctttgtgacattcatagttctgaatttatatttttacttcttaagcaggggatttatattttttgtttcaaactagtggtattctttatctgatcaatttcagactgaaattagattggcgtaagtgaacaattaatttggatgttagtaatgggaaatttgagttctctgcgcagactggcagaacgtctcgttgggacatgatctgagagtaaaattttgcagtatggaaaatgactatgccttctgactatacttgtcagaagaaggtagcctacaactagccgaaaatggtcaaactaagatttatggaccaaacaaattaaaataccagtaaagggcactgaaatccattaagtgacttatccaagctaatgccagacaagacggcaaccaaagactaaaaataattatgtttagtgcaagctcttggcaaataaggagacaatatatctgcagttcaacaaaatcaatggattttgagtacctgcatatgttaggcattgtaattgataataggaatacaaagatgaaaatgtattttcctatttttatttcccatagtcttcattggaagacatttgtatttccaccttaaacttttatttttaagtagtgaaagcagagggactccattatgtagtagaaaacacaatggatgttctagattcaatttgtggagtcaatccgagtcttttttggagaagaacaacagaaatattttacattttttgccaagaagtataaagtgcatatttcaaatggctgttattgcaagaaagagtggattaatcatataagtattcaacaggcacttaaggagaccgattgtgttcagttaaataatttcacttctatagatgccaaatcactggattctataacacatggtaagaccagcatgatttgttaagtgacagagacaacttgaagagtgcaaagaacataccattgtcaaaagacttgaggtttagtatttcttcagtcattactcaatctttaggaacctcaattcatcttcttataacatggatatagtaatctgtatatcttggggctttggtagaaaccaaatgtaattatatacatcaaagaacattgtaatctgtaaaatattattcctgaaaagaatgcgcttaatgaagcatcataattgattacatatgattcttccttatccttaatttaactttcaaaatatcactcaatttgtcgttctcttctcagcccaaggaattaaatggtgaatttcaaataacctctaatggtcatctattttcaaagtagaatttatgattctgtgtgcccaattttgttttcttcccactatacctgggtgcctattgatactaacctagtttaagcacttatcacctcgtatttttaaatcttacaatcatatccttatcacttcaatttatctaaggtctctcttttcaaatcatccagcatgtaatctttaaaatgacttttccgaaacataatttttacaatattacggaaaatatttgttgtttgaagtcatacagacaaagctaagccctatgtcttactagttacaagacctttcttcttattcacttctctgtgaataatagtgtctgtctcctagggttgaattgagaacaaccaagtatatagtttgcacagtatctggattagagaaatgctccaattggacctctaccacctaatcctgactcactttataactgagtagtttatcgtcatccatgggataagtatgaaaatacaaactcctttgtgattccgtatactccaaaatgtttctagtcttctccatcaccgattcttttcctgctgaaaccattcgtttgcttatttatttatttatttatttaatggcgtacaacataatgttttgatatatgtgtttgttgtgaaatgattatatcaagctaattaatcaaatcctctatttcatccaaactgttttaattttctgaaatccctatactattcacttggtctcatggcctctacaatatcttgccctgtaattatgtgaatcctatcaagtattcaagtctgagcatttgctaaccttttttaataaacctgactactttcaactcaaactgctacttctaagtatcaaaaatatttactagatccttatcatttatatttttgtttatttccctctcttctttcctccctccccttcttctgccttcctttctgtccttccatctttcttactttcattacagatttcctttcaaaatgtatatcttatacgcatatctatgctatacgttcctgaagggtaaaaagagtctttacatctttccatgcacctatgacggagagatagggaccaatcaatagttgttaattgtctgtactatgggtttaacaaaaacacattaaaactaatatatgttaaaagttccaggccttaatttaagaaacttatttatattaatgcatgtaatctgcctgacaatcctataaagatgggcagactgaagctcagcgacattaggtaatttgcccgaggtcacacaggtcttaaattttataagcagtatgagaacccaagcacattcctgtcaaagcatatgctcttaactataaaggtacagtgatgcttttgcagttttggaaaaggatccttgtgactctgggtagcgttttcaaaagatggttgcctgtgtgtctatactcaaaatgccaatagtgattattatgaattcatttagcaatgattcatagagaactattctaggcactgggaatgatatgataaacgcagcagaacaggtggttaattttgtgaagctagttggtgagagatggacgctgagcacataaattagaaaatataaagtaatgatcagttctataaataaaataaaccatggatatggattggattaagttgagtttatactttgatttgtgtggtcagtaaagtcctctttgggtaagtgacttcttacctgagaccttatattaggaaaataattctagttagtataagcgcaaggagacttattaaaggcaattagatggcttactagaaaattaaacctggatgcttcttggaaaggatcagagtgccaggagccacacacctttcgtaaatatacccaaccacactaagaaacaacttagcactgatacttgtggttcccaagttacctcagtttcttgagatacttgaaatggagagattattagagtgatttcaattaagatggaaaggggggtaagttgtgttttgcatgtaaagcttactacagaatttctcaactggtggcagaacaggttaatgaaataccatgatactgatcatctcagcctttagggtaggacccagggcagcccaaattctcacgttcattaccttcagccttgagcagccctgtttccttcagtcttccatgccgtggaaaagactggggaccactagcctatagtattggcttaagaatgtgggatagagaagaatcaaagatgaattatgggtttttaacttgattgacttgttggctcatggtgccacttactagtaaggaaataggtagggcagagcaagttatagaggaaggggaataaaagggatttttttgtaaagatgtgaggtttatgaaatttagtctttaatatgtagatgtcaaataggtagatggctacataaaacgagttcaggagggcagttcaatttggagatctacatttcagagttattagcataaagatgtagtgtaggagcatgggactgaatgaaattactaagggagaaaacagaaaacaaagagaaatgattttaagactaaggccttgtgcacataaacattttgaagtagaacagactaatagtgtgctatatagtgtatgtacaatataggaagagaattcttgatgtgatatatattttaaaaactggaaaacatactgattacacaaaactaatgcatttctacatgtgtagttgaaagaaaaaacatagttgggaataatccagtaaattataaggaggactgaacatgttggggaagaaaactttcatactaggacaaacttttttttaagaaaaataactttttaaaaatgaagcctaagagaagatattatcaaagcttataaaatcaaaaattgtatgaatagggtcaacccattctttttttaaattattatactttaagttctagggtacatgtggaaccaacccaaatgttcatcagtgatagactggattaagaaaatgtggcacatatacaccatggaatactatgcagccataaaaaaggatgagttcatgtcctttgtagggacatggatgaagctggaaaccatcattctcagcaaacacattcttatttaccaaagtcaaaatactagaactagtgctttaaagcactccctgaggctttaaagaattactctgaggacaaaatgaaagtaaattctgttttaaccagtgggtagtaaacttaaaaaactctttaccataagcggtagaatgggttgaaaatataaatagtttcaaggtggagttcatggacaatagatacacaataggttgtttaaggaaatggaatattttaatgagtggtacatctccaatcttttaattttgatatcctattttataaccactttctgtaaaaaagattatttcaagccagagttggaatagaagggatataatctgatataatatgaatttttgttctgttagcaaacatttttaaagtgaatgttctgaatagattccaattttcttaaaatagttattatgccttatgaagacctgcaatatccgtgtaagaagagcaatgctttttatatgttgtaataagtaatttattagaacatttattcacaatgatgaatcaccttaattaatatggtgagggcaaaataatttctgctatcaaatatcagtatgtacttgcaaaattcttataaacttcagttcatatgtctgtttttctttaaaatatccctaattactgacctaattttattcattttgccatttaatttatttataacgccattcttttcttctaatgcgttctcctgtttgaataatcatgttctctttattctctttttcgtctttctactggttggggaattatatattctatatacattttctgagcccttatccttaaatttatatcattcataattaatgacattctagtctaaacatcgcaagagcagtagaatgtttaaattctgatttccctcctaccatatttcatgttattgttgcctgatattttgctcctatacattgttacccctcccattagtcattttttatggtagtaaaatatttataatactattttcttcttatgagttctgattcttctttctggttcaaatttcctccttccccatgtacacatgttaacaagtacctttgtaaatctatatttcattcttacccttgaataacagttcagcaggggccgggcgcagtggctcttgcctgtaatcccaacactttaggaggctgaggcgggcggatcacttcacttgaggccaggagttcaagaccatactggccaacatggtaaaatcccgtctctactgaaaacacaaaaattagccgtgggtggtggcgcacacctgtaatcccagcgactcgggaggctgaggcatgagaattgcttgaacctgagagacagaggttgcagtgagctgagatttcactactgcatcccggcctgggcgacagagtgagactccgtctcgaaacaaaattaaaagttcagcaaggcattgtattctatatataatattctttgtgtaattatcttttgaggataatgcatcttttctttttgctgctcttaagattttgtctttcatgttctgtatttccataactatgtgttctgagtatttatacattggaacttggtatgcatcttcaagtgaggactcttgtgtttctatgattctggaacattgtctaccattatcatttcaaatattgtttcccagattctctctagtcactttttctctgattccactgtatgtgcattgaatattctcctttcatactaccacgtattttaatttctctttacatatcttctaattcactaattctctagttcaatctaatctatggttcatcacatattttgagagctttgctaaattccttaatttgtttttggaatttatgtttggttattttcaaatatatgtgttttatatgtcctctttttgttttctattttctatttttatttctctggccatttgaatcatatacacatcatgaataaaaagaaaaacaaattgttctattagtaatagttttattttgctgtccgtaaaatcaaaatacgatgagaagccatatgacagtaagatggaaaaaacatagggaagaatgagaaaatttaaaaaatagagtaagtggatggatttgaagtagcaccttatttctctttcttgcatttgggtttgcccatttttaaaaacaatccccatcccttttaccacagtatttccatgtgtttggaaaaaaagaggaaaggtttttgtgggtatatggtgaaggagtactcctacaatttcttaggactgtatgttcaacaaaatttgtttttaaatttgatggaacaaaccttttcacaaaataatattaatataaatataaaatgactgattcatgaattaccaacaaacaacttgaatttacaaaataaaccttcaaatgtatttttcccttgaatagtattttatttatatttttaattgacatgttataattgtacatatttatgaagtatcttttgatatttgaatacatgtatacattgtgtaatgttcaaatcaatgtacttagcatatccataacctcggggatttatcatttctttgtagcaagaacattacaaaccttcttctagctattttgtaatatacagtaccttactcttaaccatattcaccctactgtgcaatatgataccatattcctcttaccaaatagtaactttgcactcattgaccaacttctctccttcctcccctccctgctctctgttaatcactgttctatatctcaatgagatcaacttttaaaaaacccacatgaatgagatcatgcagtatttttcagtgtgcctggcatactcagcattatgtccttcaggtttgtccactttgtctcaaatgacaggatatcatcccttgttatggttaaatagtattcgattctgtagatataccacattttctttatccattcatctgttgttaggcattttggttgattcccagtcttggctgttgtggatagtgctacagtaaacaggagtgcagatatctctttgacgtactcatttcagttcctttggatgtatatacccaatagtgggatgactggatcctatggtagttttatttttaattttttcatgaaccttcatactgtttttcataatgggtgtaccaatttacagtcccactaacattttgtaaaagctcccttttctccaaatgctcaccaacacttcttttcttttgtctttttgataatagccattctaataggagtgagatggtatgtcgttgaggttgatttgcatttctctaatgattagtgatgttgagcatttttttcatacacttgttggccatttgtatgtcttcttttgaaaaatgtctattaaggtattttgcccattttaaaatcaggttatttggtttttgctgttaagttcttatatattctggatattaactccttgccagatatatagtttgcaaatatttcctcccattttgtaggttgtctcttcactcttgtttctttgggtttgcaaaatcttttttgtttgatgtaattccatttgtctatttttgcttttgctgcctatatttttaagttcttatctaaaaaaaaatttgctcagcccaatgttgtgaatcatttcccctatgttttcttctagtagtttcatggtttgggattttacatttaagtcattcatccaaaaaaaagaaagaaaaaaaaagaaaaaaaaagaaaattaatcactttctacatttttttttttttgagatggagtcttactctgttacccaggctggagtgcagtgacacgatctctgcttactgcaacctccgtctcccaggttcaagcaattctcctgcctcagcctccctagtagctgggattacaggcatgtgtcaccacccctggctaatttttgtatttttattagagagggggtttcactgtgttggccaggctggtctcaaactcaacctcaagtgatccatctgcctcagcctcccgaagtgctggaattacagatctacattgtatcttgatggcagtataactattattttttaaatttttggatttttaggcatcttatgtattatacaatgcctttacttaaaagtggaaaaataaggtgaacatattttgtgacttgtcccaggtaccattgtttataaatagcactaaaactaaaatgactgaattagtcactccttgtttttgtcattgctctaagtatgtgttttcttccatttatagtatgagataactcagccattttcattaaatgtcagaaaaaattttatatagatctttacacagcatgctaattttaatagttatatttatatcatatttggagtattagctttcatcatagtcctttgttatgttactcatatttttcttgatactgaatgatggaatgagtcatttctatacacttagtattaacctttcagtagttaaagaagtggcatttatttttaggacccacacaactgtttctgaacttgtaaggaaaagccatacattttttctttagttcaaataactttacatcctaatatgtatatttggttgataagtatattgattaggacaaatcagtttggaaatagttatatatgtaagaggatacttatcaggaagtgagccaaaaatgtttgtcagtagtactggttaaatattgaaattatatttcttaatttgtcagtctgtaagtgtgagcacaatgtcttagcacttgggataatttagaagcaactctggctctagattacctagcggatttctcaacgctggctgtagactttaattcaaccgtgattctgtattacgttatataataggacactatttccacaggcctatgaattttttataaatttggaatcttcactttttcattgtttttattttacctacttaatcttttttgtagtatgttttattctcccagagatcttttgactcttaaatatttatagagcttttgcactacctcagaatatcattagcaatatgatagctgttacttctgaatacttttctttttaactttcttttaataatcttccataaaagtcttctttgcatgtatgtttaatctattaattaacttctagagtctgctacttaaataggtgctatctttcttctgtccaaacttgtatagtaattaaaaccagcagtgtgtagtagaagacattttgcataccatcaatttccgaaaaatttccaaatattatggtttctagtcatatgtctacaagtttatgttttgtaattaaattcttcccttaaaatgtttatgtaaaaaaagttggtctttccttttttagtcataaatatttgatttccagtttttcataagtaatatatacatttatttctacttcagcagatactccattataatcaatgttgctacagcagtagataaaatacaagctccatgagagcagagatcatgtcagtcttcggtagttgctgcaaaaccagttttgagtaactatctttgacaaataaatgaaagaataagtttgatttcaatgtacatcttcaaaataatatctaaatgaaattcatctgtgcaggcctaaccctgtttgagtccagctgcaaatgtacaagtggtttttttttggtatagtagagtggaaagggtgaaagctttcaagctaggcaagtcttgtttcaaatcctagtgttgctgtgtaatcgctgtgtgaccttaggtatatcccttaacttctctaagccaaagtttcttaatagaaaacttgtgatggttttaacaattatgaaaaattgcattgctgaaagaagatgctcagtatatatcattgtattttacactgtgagataatgggatccacataaactggcatgcacatttttaaaataacttttatttttaaaaaatgggctttagaaattgttcaattacctaatgttctaatgcatttttaacattctctccattttcttttatttctgctatttttatttccatattccagtttatttgcgcaacttatgtctgaagcataagcaaagattcttccccagcttctcctcttattttacatcttcagttctacaataatactgtattagtcagggattggtcacaaaaagacgagctgctctatagatttcaagcagtgaagagatttaatacaaagaattaagtgctttactgaacccctggaaaggctgggagaataggattcaggtgacgatgccactagctctccacttagctacaatgttcagaaaatgagcaaattgtgcagaccacaggaaaccactagcagttttcactactgcttgtgttatcaaagcaggtgatgtttaggaagtacccagtggccactgtaaaattctcatgtctgcagaaatccaaacctctgcttctcacccccaggggaagccctaataaattttcagcctctccttagcttgcaaatctggtacaaggtttgggaaaaggtgattgatgcccaggcttccagcccctatgataacagaggagagcatggcaggtggaatgatactgagatgccaacagagaagctggtacagcttcacctgtatatgactgttcattttcattccaatttcaggcatactctctattttcagttctgatccctatgcctcctattattgcaataattattacttaataaataaatggctccaattgcagaaagaggtttacttatgtttagcatacatactactctctcttaggcatctttatatttcatttatctcagaaacttatcctttttacaaacaagtctgtagactataggtaggcaaactatgacgcagaaacgaagtccccgaggctgcctatttgtgcagataaagcttacctggaaagcagcaacacccatttgtttccacattgttagtggctgctttcacaccaccacagcagcatggaatatttgcaacagaggccatatggcacacaaagcctaaagtatttaccatctggccctttatagaaaaaagttgctgacccctactatggatattatgtaaagaaaggaactactacaggtagatttttctcacgtgcttgcctattgaatttctttcataattgatttaatgaatataggctttttatcttatgggaaaatatcatcatactgcacgtacttgtgtgggactctgtcagtgatcttaaaaataaaaatgtcatgcacccaagagaaaagtattcattcaaccaagccaatgaataggttccgaatcttcctcctgcactaggcattgtgatttcacctacatttccaaacatctgatttttaataatgcatcgtataatcttgattctcacatgcttcacaggacagccgaattctttttcaaaacttatagtcactgttgagtcataccaatgatctttgctttctagtagcttccatatcttaataacatttttaaaatatgatacaatagtaggtctattttactcccagtaattaggccttgaatcttattagcaacttgatcatgctggtcactattgagccatgaaggcaatttatgaaataaaaggcttttcattctttgccaaccaatgattcacccacatcttttcccctatcctcctgtatcttttgtatttttttctgctgtgaagtcatttttttaagacgggaaggctggcagggagggaaggaaggagggagggagagagagagagagagagagacagagaaagagagaacgagaacacaccctaaaaggttttcttattaactattctcaagtattatttcttatcagctatcatcagctatttcttcttcagcatcatcttcaggtatttttttttaatcttgtaaaacagaacacttttttctcacacattgtaacttctcccgaggtagtcctttattcttgtatgacctcctcctttgctcatcaccttgggtcttattctgcatacttctctcacttgctctttgatttctactcttcttgctccaattcttacaatttcttaacctctattttaaaaaatcttttctcttcatcattaaatgcttttacagatggaaacattcattttgttctttaaggcatttcaatatttttcttcccttgagtacatttcttatgccattttaacttgctcctttaccatctgaaatcttgaaaggggaatagttcattcttcctcttgaatatatattttcattgaattttcttcctgttaaacaagaatttatgcctgtcaatgcttttgataaaaataccaatttttttgagaaattaatttaactgtaaccaagatgtgggctttcagtttgtattctaccatgtctatgttcacctgcacataaatctattaattctggggaccattcccatccatctctgtttttattataattctgatagcaagcatctaaatatacaatctcaaattctatattcttaccagtgtatgtaagtgtatgtattgtgtgcatgtattgtgtaagtgtatgtattgtgaccacggataacttccagttacttccaacattttcatctttttctggaacaacgttggaaatccctttcaagacagaaaattccttcgtgaatgaagcacggatataaaatgcttcccctctttgtttctttggatgtagggtagctacatatataaatgtgataggccctaattcctaatttatttctttgattacatattttccagtgcaaagcatagattattaaatatctgcacaaataaaaattcatgttcacatttttttgttttgtttttttttgagatagagtttcactcttgtcgcccaggctggagtgcaacggcacgatcttggctcaccgcaacctctgcctcccgggttcaagcgattctcctgcctcagcctcccaagtagctgggattacaggtgcctgccaccacgcccagctaacttttttgtatttttagtagagatggggtttcaccatgttggtcaggctggtctcaaactcctgacctcaggtaatccacccgccttggcctcccaaagtgctgggattataggcatgagccaccacacttggcctcatgttcacatttttatcccatttatccatgtgaaattagctctaaatgtgataaccactagccacatgtggctgtgtaactttgaattaattaaaattaagtaaaatttaagatttagtttttcaactgcactagttacattccaagtgttcaatggtagcatgaggctaggagcttccaccttggatagtgcagatagagatcattttcattattgcagaactctctactggacactaaatattagaaaacatacatagttccttcatttgtaacacatctctccctatcacattaagctctcttctttgtatgaagagtgtgtaaatttgattcatttcatgtcggaatccatgggttgtacttctaaactttagtggtaatttacactttgtattatgtactcctatttctgatttcattttttcccattgtttgtcatttaattcagccaaattttcttttcttgcattctcctattctatgtattccttagatcagtggttctcaaattttaatgagcatcaaaattacttggagggtttgctgaacacatattgaagggcttaccctgagaatttctgattcagagagtctaggatttggccgagtaatttgcacttctgttattgctactcgttctgggggctcctaccctaagaaccactgcctagggaaggcttctacctctctttgcccacttttctatgcacagagctattttttatacaccctgcttcagtattttctatacagcttatttatttcttcctctatttatttaatcattatgtatttcccccataacttgaaatccatctctcttaactctacctgtctccccataccctttctgtctgtgttctctcttttcccttgcttctccaggagactttcaagatttcatttttacagacgtttcttgttctgtttccttttgctcttgcatgctggctcttgaagatggcccaactatgccttccttcctttcactataatgtgtccttggcatttaatttttattttactagtggctctcttctcagtaggcactgtggtatcactgcactccagactgaaaccacatttcctaactgtgtcctatacttaagtgacctgggaagtgacagttatatcatgtctttagctgtcttctgtgtagaagcaataatatttctctgtaacttactgagaatctctcagcaggtggtcagcacgctcaccattttgtcacctctcttgttaaaaattgctttttgcagctcaattctccaaatgtcccaacctctactggactggctcatacttaatcactttttcaaaacggtgtcacagtatgtttattttgtttctaaagctttgactcttttccttcttgtacagtctcaaaataagtttccatttttctgtttaattggaacttacatcaaacttcttacttcccagcatttgaactgctgcatgatgtgtaccctggatccattccaaattgaattaataagcagacctcaattttatctcttgctagactgtaactctcatcccctgttaagcaactcttcagtaacagcctagtattgttaaagggggggcctcttgagttagaacaacccttttcacattccacctctgcttctcatttttctcacctacacaatgggctaatattagcatctatcttatagaatcattgagaagaacaaatgaaagaaggtactttgcacaatgcctggattatggtaaatcttaaatcttggcctttactaatgttgctatattaatcacagtttcccatgaaggaagttatttctttctttatccttcaatttctttaccttgcagtagatgcaaaaaatttgcaataaatattttccagatctttattctacttctctactagcttttgccttttcctctaagttgcctatcccaactttgaaagtctttacctctgtttctcatttgcagttgaacactgacacaaaacaagagaaaacaacaagcgaataagaacacaaacacaacatcatctcagcactttctctcactgtgccaaatgttcttaaaggtttgttagttttttatcaaatcacagcttgatttatttccagcctgtgctccacaccagttgactactgttatctttgtagtaaccaagcaaaacaagtagggcaggaactactgtgcctcttgtgcagacttggaaagtgaggccacaatgacagatgtgacttagcaaggatggtgcagccatgtagtgtaaacagggctgctgttctaggctgtgaaggtggtgcaccgcagcaggacaccacagttaaagggatacctccaccttgaagacatcactgatttgttttttatagtaaggcagtttccagcactgtcatggagagaggctcctatttccaatttgcccaaaggtgctatgtgggctctcattagccaagaaaactcaactcaacacatgtgctctgctttatagcttatttactctttagtcgacgttccatacaacatagattactatgtttccttttctaattcattttatcctgttattttctttatcactctccccctctaccctgcaacaacccatttacttttcactttactatataggaaaagtaagcattaaaattcagttggacgataaggtgaaagcatgtaaagctgttgaaaagccaggtgaccattattacatgtgactacattctagactaagtgggatgactaatatattttaaatgggaagaaataatttagatagctttatttgctaatgtgagataaatagattaaagttgaaagccactcaggctattgcaaatattatagcaggagaccataagaccctgagtaggcataccacaaagtaataatgtagatgattggctttggataagaggcccagtgaggaagctaattgcagaagcttgtagttgattagttataagatgacaaggggaataaaagcaagagtttctgagtctagataaccaggatgatgatggtgccatagagagaaatggaaaaatacagagaaagaacagatttcagaggaagaaaatattttatttgaagagaggagtggtgttctggtaaaaatgtcctctaggtgatagaaaaatgtgacaggaaattagaggtaaattagaggtggagaaaaacattacatgtagttgaatagagctacttttgaaagatatcaaaggtattcagttctcaatggccaaaagagggaagctgccattgttaaggttccacagcgtaggggatctcctgcaggtaagaaatagaagaaggatgaagagcaagcacatgatttagagacagaggttctcaagaaaaaaagggatgctcagcattgtagaatgcttcttataaattaaaatgaagactggtaaaacctattctttttttctggtgatttgttacaatttaaaaaaattgtatcttccttttactatcagtgaaaattcccatgatagcttcccattttggaggcacccaccaaaaatgtccttttatatatctccttcagtcttagatttccaaattccctttttctgtaacctgacctctttctatgaaatacaaaagtttgatttaaaagatgcctttcacactccataaaatagtatacattgtcctggctgggtgcagcggctcacgcctgtaatcccagcactttgggaggccgaggagggcagatcacctaaggtcaggcgttcaagaccagcctggccaatatggcaaaaccctatttctactaaaaataccaaaaattagctgggtgtggtggtgggcacctgtaatcccagctactcaggaagctgaggcaggagaatcgcttgatcccgggaggcggaagttgcagtgaggtgagatcacgccattgcactccagcctgggcagcaagagtgaaactccatctcaaaaaaaaaaaataataataatatacgttgtccttatccaataacgtggagttttttggtttttaaagcaacacagagattcattagcacctcattagttcttgaagggaaggagctctgaatgcaatactatctgtcttccattaaaaatggaagacatcattcccataagttgggaaaatttgagatttaataagaataacaactacagtgaattgagacacatcaaatatttaaaaactgatgattttataaacatactaatcaaggaaacattgttagtttacagcattgcagcatactaggatcccgactcattattctgcaaagagacaaataaagggaaggaagcatacatttggcctgccttttttcgtaccaactgtacgtattttaggataatcacattggaaatacataaatattatttttgaagtatagtttcagctaataaatgcaggaaagaatatcacccttttgcagcccataataaaatggtacgaaatgatcaccaagcctttggctcaaaggttggtggagatgcttgagtatggaaggattagggtgaaacctcctgaaccactgctaaatcttggtgtcactaaagtgtaacaaccagaaatcaggaattacgtgagttcttgtacctaggaagtatttttgcctaattttaaaaaaagacaaatatcctctaaatcatgcatgcctgttttcattagctactttacctgactttttcatgaggaattaaaaaagttattcttctgtacttttaggactcaaattgataaaagaaaaaagtttttaattttttaaatacttcgttccctttgtcgacatgtagaatgtgagatatgagatcacactgaggaaaagagaagccagcttcatgtggctttctgaaaatatgatattattatgtgaataataattattatttagtgaaaaggtaaacaaaaatgctttgtttatatgctattagtgcaaccaaatatttgtgtcagaaatgattaataattggaaactgacagaataactggcatatgaactcttaggtctattatctagccctaactctccttgatttttattgaataatacaacaatgcttaaataatcacaaaaatgaataggaaacaggggtcattgacaatttgtaggtcaaccaaacaaatgtcttagctgtagaacattttacaatccaatagagaacaaactttatcttagattagtgaatgccaaagtgactattctttcatcagggccaaggtggcactaacactttattagcccatatggatgggtctcaaaagcagtaatatagaaactttgcagcttagctgtataagaataatgcttataaataaaataccataacgtgtaaaagtaaaaatgtctctcttctttttaaatatacttcagtctattcaagacaaagaagtagccaagaaacataagaaaaaaatgctcaacatcactgatcatcagagaaatgtaaatcaaaaccaccataagacaccacctcacattatccagaatagctattattaaaaagtcaaaaaagattggctgggcgcggtggctcatgcctgtaatcccagcactttgggaggccgaggtgggtggatcatgaggtcaggagttcaagaccagcctgaccaatatggtgaaaccccatctctactaaaaatacaaacattagccgggcatggtggcgtgcggttatagtcccagctacttaggaggctgaggtgggagaattgcttgaacctgggggggcagaggttgtagtgagctgagatcccaccactgcactccagcctgggcaacagagcgagactccttctcaaaaaaaaaaaaaagtcaaaaaagaacagatgctggtgaggctgtggggaaaagagaacacttacacactgttggtgggagtgtaaattatttcaggcattgtgggagcagcttggagatttctccaagaatttaaaacagaactatcattcaacccagaaatcccactactgggtatataccgagaggaaaataaatcattctaccaaaaatacacatgctctcatatgttcatcacagcactgttcactgttgatatgcccattaatggtggatttgacaaagaaattgtggtacatatacactgtggaatactatggagccataaaaaagaatgaaatcatttctttacagcagcttgggtgcagctagaggccatcatcctaagtgaattcacacaggaacagaaaaccaaatgccacatatactaacttataaggggaagcaaaacgttgtgtatttataaacataaagatgggaacagtaggcactggggattactagaggaataagggaaagagcggggcaagagctggaaaactacctgttgggtaccatccccactacctgggagatgagatcatttgtactagaaaccccagagtcatgcaatgtgctcatgtaacaaacttgcacatgtacccccgaatctaaaattcatacaaataaataagtaaacttcgatatattcagaagaaacacagatacctgcttataatttaaaatagaaattttgagaaaagaaaaaacggagatagttttatcagttcttaacagtgtagtcataagagtcagtcatacctgggtttgaatcctggctctccggcttactaacaagttaccttacatctctaaacctgtttcgctatctataatatgagtctaataatagcaccaacccttagacaggtgtcagaatagatgagaaaatttatgtaaacagcttagcatagcgcctaacagattgtgatacttaataaatagtaactatcatgattagtatctgtcatcataatgaattccagatgaattaaaaatttagatctgaaatgttaaaatataccaaaatccagaaggaaatatatgattttcaattgctgatctataaatagaagagaacattataaatgatgaaagacattataaaaaaagaacataaaacaatgactaactggaaatataattgccatgaaaagtaacacatttaatatccttagtgtataataaaattttacaattaagtaggaaaatgtaaatcaaaataggaataaaagggcatgaatttaaaaattttatgacacgcatacatccacaaaggaaaagacaaaagaaatgcaaaaggctgcatggcgttcagaaaaggattagtataaagaagaaaaaagaagtaacgttatctgcaatcttacctcttattaataatcactgtttaaacttggtagagtctctttcagacatatccacatgcatgtgtaaatacatacatacacgggcacacacacactttgcatcctatctgcattttgcttcatgtttttccattattccatggtaattttttcatgcctaagaacagtctttaaagtgttttatttggctctgtagagtattagtatgtcaatcaggtctctagttgaaggttcctgaaactcaacttgaactagattgtatatatataaaatctaatacgcacgcgcgcgcacacacacacacacacacacacacacacacacacacagagagagagagagagagagagagagagaagcttgtttcacgtaaccaaagcagaggaaagacttgatggaattacagaaatgaggtatttttacaccattaataatcactttgatttggcttagctttttatgccagctttacatttttaggcaagttttctctggtatgtcagggaacattgacacaaataactccaagctagtatctccatgtctccaaattcagagaaaagatgaacaggtctgcccttctaactctaattaggggaactccagggaagacctctgttggatatttgggtcatctgcttattcctggagcagttatgtggccaggggcataggataagtagcctagactcttatcaatccagagatgagttaggagaggctgttatgagaagaggatggacaggtgctgagcagccgaaaacaatgattgccacgatatgaatgtcccacaatttattcagtgttttgtacgttaatggatacttaagtttctctaccatttgatcttataattaatgttatgataattgtcgtcatgcatgcggctttgttgaaatttttattggttttctcttgtaggataatttactagaattgaaattattttatgcaatcccatgtagctatgaatacatagagtcacatctttcatgtacttaacctgtataaattcaattatgttgaatcagaaatacagggtagagaaattaagaaaacagtagtggagatagagtgagtgagaggaccagtgagaagaataaaaactagttgaatagctcagccgtacttacctcagaatcaatgaccttatgcttagagggagcagcatgaactaggagtctctagtcctatgttatgtcagtttttctcaatgttggcctgcttcttgtagagtgagattgtgcctagctgagtttcattctagtggtaagagttagattttctttttttgtatgccatggactccaaacacatggcaacccttaatctagtattcctccaaagaaaacagcaatctgttcaacaccagaggaaaatctgacgggcttgtacttaccaagtcattatattatattttgtgtgtatgtgtgtgtgtatgatttagtgatatctcaaggataattttgagtatgccctattttcatatttcataccaattctaaagcctaccccacaggaacttgaaactctgctcaattgctaaattaccattaccaaataatttatgtcaatttaaactcctaccataggatatgtacaggcacatttcacctcatccttgcctgttctgggttaaagcactttagagttaatgggaagaaagaaaaataattatttaatataaataacaaatacagaggtggtcagccacatttcattttaatgaaatggggccacgagaattccagtaaatcacaattctacttctataaataaatggaaaagaaaatagctaatcttgtcgcacctggaagcctcaaacctaagataacaacaaagctgattatttttatagtgatcagatcttaagaaatacaccagcatcttatgatgctatgctagaattattttaaaaaacatacagccggatgcagtggctcacgcctgtaatcctggcactttgggaggctgaggtgggcagatcacctgaggtcaggagtttgagaccagcctggccaatatggtgaaacacgtaaaaatacagcaagggatttattctacaacattaagattttcaatttaacagacatattctatgtgtacatatttgcatgatactagcactgagcaatactcttctgttaattcaagttactctgaatttaaatccccagacttccagaatattaagtctgcttatgatcagtgatcatttattaacttttttgcattgtattttagataatttcacagttgtaaagaatttcataggttattgcataaaattcatgcttttgaatataaacacacatgcacgcaaacacacacacacacacacatatcccccatgctcacgtatgtttattgagacacttttcacaatagcaaagactcggaaccaacccaaatgtccatcaatgatagactggattaagaaaatgtggcacatatacagcatggaatactatgcagccataaaaaaggatgagttcatgtcctttgtagggacatggatgaagttggaaaccatcattctcagcaaactatcacaaggacaaaaaaccgaacaccacatgttctcactcataggtgggaattgaacaatgacaacacttggacacaggaaggggaacatcacacactggggcctgttgtggggtgggggtggggggtagggaaagcattaggagatatacctaatgtaaatgatgagttaatgggtgcagcacaccaacatggcacatgtatacatatgtaagaaacctgcacgttgtgcacatgtaccttggaacttaaagtataaaaaaaaaattcttaggttgtgtgccttgcaaaaaagtcagtgggctagatttggctcatgggctattgtttgcttacccctgccctaagtcatagtttccaatgattttaaaattataaaaattataatcatataaattatgttggattgatcatatactgataatttaatgatctttatgaaaaaatttaaggtaatttgatacaattctttaagttacagaagaaaatgatatcatgagcgaaatgaaaaaaatgggataaaatagctaatggtgacaatacttttttggtatactatctggtatttatctttatttaatctttggataatatgtacattcctaagatgaaaatgagaatgtaatttgaccatttgaaaatatatattcttacactgacttaaaaagataaagtattgataatttcacatcatctctgtctttgcattaaaaagtatcatggaacaatagccacactttttggaaattcaagattccataaaatatagtttgaaaaacacatggacgtgtttattaatttctcctttcaatattctttctgggcatactggaggaaaattgacatgaagaatctttaaatttgttatgaaaagtagaaggtggcatgtaggcaaaactttcccctctgagagtgtttctgcattatttctttgcatgggaagatctcaccaccaaagtgtagcatgtctgtacccaataggaaaatgcataccctgatattcattttaatgaaaaatttcaatgacgtataatcctttgtcattctttcccaaattgaccctctgatggggtaagaaaaaaatgaattctacctttttcatagatagtaaccatagaaagctctggtttctagagagattcaatcctttaaaaaggaacataaagagaaaagggatttggagagaaattaattctaagactctagacctgcatgtctgtgtaacccaaattctagcaatatctagaaaatagaaatcaaatcaactaggaactggtaatacaattgctaagacttcctttatcttaggtccagcagattcaaatgacacactctttaaaaaaaaaaattattatttttagtttttgtgggtacctggcaggtgtatatattttggggatatatgagatgttctgatacagacatgcaatgtgaaataatcaaatcatggagaatagggtatccgtcccctcaagcatttattttttgtgttaaaaataatccaattacactcttttagttgttttaaaatgtacaattaagttattattgagtatagccaccctgttgtgctatcacatagtggtcttattcattctttctatttttttgtacccattaaccatcctcctctcctcccgcatcccccattacccttcccagcctctggtaaccatccttctactctccatgtccatgagttcaattgttttgatttctagatcccacaaataagtgagaacattcaatgtttgtctttctgtgcctggcttatttcactcaacataatgaccttcagttccatccatgttgttgcaaatgacaagatctctttttttttatggctgaatagtagttcattgtgtatatataccacattttctttatccattcatctgttgatggacgcttcagttgctttcaaatcttagctattgtgaccagtactgcaacaaacataggaatgtagatatccctttgatatactgatttcctttcttttgggtatatacccagcagtgggattgctggatcatatggtatctctatttttagtttttttaggaacctccaaactattctccttagtggttgtactaatttacatttccaacagtgtataaagggtccccttttctccacatccttgccagcatttgttattacctatcttttggatataagccattttaactgaggttagatgatacctcattgtagttttgatttcaggtgacacatgcttgactttagtatgaaagtgtcattgacattggctgtctagtcagtgtctaatagccttttctctatctttgtcataaaatctatcatcatctgtggtctactttgactcttttttttaatgacccctgagatagttgatatggaaaatacataaatagttgaataattgtatgaacttttcagtgtcttctcaggtgacctaccagaggagaagtagggtatagaatgacaactttttaattagggattttttttcccttaagaaacagctatggaataatggaaggaacctaggttttagattttacatatacacacacaaacatacacacatgtgtgtgtatgtgcatgtgcgtgtgtgtctgtgtatttatatatatatttgaaatccatttattccacctctcaatcttatctgagcctgggggatgtgtgtgtgtgtgtgtgtgtgtgtgtgtgcatgcacatgtgtgttcatattcaaaagctaagcatgaattttatgcaataacctgtgaaattctttacaactctgaaattatctaaaatacaatgcaaaaaagttaagtgatcactgatcataagcagactgttgctattctggaagtctggggatttaaattcagagtaaccttgaattaacagaagagtattactcagtgctagtatcatgcaaatatgtacacatagaatatgtctgttaaattgaaaatcttaatgttgtggaataaatcccttgctgtatttttacgtgttgtatttataaagatataatgggctctaatttttagagagtcctgagaagtccatgaatattaaacacatcgtgtggatttttatttatcatcatctctgattttatgttcgtgaaattataactcagtttcgttggagttctaactacaggcctagttcaacaaaattctgatttccatcatcttgactacattgattttgtgcactttgatctttactttgtattatataaaagtcaatatgttgatctataaacacatctgctgcttggatagtagttattttagaattggctctctttccaagcacagttatgacactgagaattggtactgtatgctccagtcagcacttcccagtcacaaaccttatgaagaatttaaagaactatgtggaggaaatactctttgttctaattcaacattagtgtatagattgtgtttgtgaaaaactgtatgagaaactggtctttttaaaaatgtttttccttcagttctggagtgtcaatatcaattttattctgtgattagaaatcgcatgactacagcctgtgtgtcaaatcattaattcattgaaattcctaatcaatgtaatattgcttttaggataaagttttagtaacttactgagtgggctctctctgtctctctctctctctgtttctctctctctctctctctctctctgtctctctctctctctctctctctctctatatatatatatatatatatatacacacactatatatatacagacattatatatataatgtgtgtgtgtatatatatatatatatatatatatatggcagtctaactataagagctatactttttagtgtaaaaaggttgtatattcgtgcattggatggatacctaaagctgagaggttagccctacaaagtattaaaaaacaactcaagaagtaagaaatcaagaaatgatcaagagttccatagctagttaaaacaaatcagcagtctcaaatgagttcgagtgtgaagtgaaataccacaaagatgaattattttagacctgatgtgaaaagaaatgatggtgtaagaatatgagttacagcttacacctatatgtgtgtgtgtttgtgtgtatgtgtgtgtgtgtgtatgagtatatatatatgagattatatgggaaaaagctaaagagtatatatggaaaaagtactttccagctatacatgggaaaaacaatacatgggaaaaagttataaggagttttagtttagcataagtgttctagttatctattgatatataacatagaacataaaatgtcacttttgttacattttactgaaaaggtaagacaaaagggcagccagtgttcaagaggaagggaggaatagaccccaactctcaatgaaggaatgacatgcacatatggaagggattgaattgttgaaccatattggagacagctatctaagaagtaaatattatttaatgatacttttgtatattggatatcactatcatgacaaggacatattgaaaatagtttacctgggtaattttactctcatctacttaattaaagtaatacatatagattttgtccattcatttgatgacagagagtatgacacagtgagtatgtccttttgggtttcaaattgatgaagcaggcagacctgttatcattctggggacgcttcccagtttggaggttctgagtgcaagagggcattaggaagacagagttccctactgctgctgcatctgctcattgcagtatgggattgggtctaaaattctatgactttgaggaatattaccagattatataattttaaacattccaagaaggaattgtagtgatcttcttgtccaattgttttatcaaaaagatacgaatactaaagcccagagaagttgacctcacaaagatcttaatgtatgagctatatagactctgaatctaagtcttttaactgctgagttactactcttattattccatatattgacactgctttccaaaagtctgtggtgtaattatcaatctggcaatccatgtaggaggactgttttcaccaaacggtgaataaaactttgttatttcattatattttcatgttttgggatctctaacagagtgaaaatgtttagtcaacttgaaagaagtatggtagtgagtaatttaagtgcatatggtgagctggggaggatctagttttgatgggccctgaagcttttacaagtttggctctactctgtaagaagaaaggatgtaaaattacaactgcaaaataagtacatggctttaaaagaggcctgtgtagtttaagaaccctcaagctcaagcttcatcagtctctgtggttgagttgattagtttaattgaaatactagagtttgggaaggacttaagaacaaggtgttatttcttcaaatcgttgtcgcctttgaaaagggtaaccttttttctggacttaaagtgctatccttccaacgtgtataatagtttttaaatgcaatcttgctgacatgtgtcaacatatgcaaagaaattgagaatactttctagctcttagtggtatgatactgccttgcataatgatttagacatgcagctctgccttttgtatatctccagccaccaacatttaggtaggaagcaagtactattgatctttgaaaactaaagaattgtgaatgatgcatttgattggtatgttaaagctatcctttgtatgcatatttttgtaagtcgttgaaatacagattatttgacctcaatttctccatctacaatatgaggatcaatgaggatattatatcatgtctgttgaaaatggttggatataagtggaggccagtggaagtattcagtgaaatgatgcatttccaaaatattgttttccagccaatgtccagtgttagtattccacacatggaatgcatgataggtatagagaaaataagggtagtattttacatcacagagtattttgagataggcaagaccattattatgtttgccattcttgtgaagaaaatcagttgcaggatattaacttatttaccttaagtaacatagctgggagtcaagcccaagacttaggacacaaagggcagcaggctttttaatcatcccactctgtctctttgagaggccaatagaagtttctaccatctccactgtcataccccacctggaaacgattgcattctcaaagtcttgtaatttagcttttcattatgactgcttttctctgtgttacttaattagaatctgcagcttttggcaggaaaatagtcaaccaagcagatttctaataagcaatgtctttaggggagaaagtcgaagtgagcaaagagaagagaatgaatgcgtgatagtagctgctagaatatattagttgcagacaaatttcagtgagagtgtcagtcaccgtgaattaaatttttaagtgaagtggccggaaaaacaagaatggaatggagcaaagcacatatatcatagttcagaagatttggaattctcccaaacttgtcatcctttaatggagaacctgttaggaacaaaggcagagcctgcattaatagaatgatcttgggaaatgccttccaaggacatctttttaacattcttactcagacttgatattttgaaaggtttttctgttagataaataaacttttaaaaacagtaattaatatgtatcttatttaaaaatagtcacatataatgtaggccaatggataataccattatgcattctgaagggttgaaaattgctagagacccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaagaaaaaagaaaattgctagagacaatctagtctagcttttggaaacaacttttacagaaaataaatgttaaatactgggtgaaaaaacagtggtttcactgttactgacaactatggattaagagcgctttctacccctttctctcgaaacatttcattgttggtagatgaaaaagagagggatggtagagtctgttgagaaatgctctcaacagagaaagtgagttcttcctactgggatgataacattaatatggttctttatcatgttgcaccttagaacatttcagattcctattttgtctagtaaatagttgatcacatggttctctgcatgatgttgatgagaaactttaaaaaaaatctattctccttaaagcccatagttttctcaaaattagcttttctgctggggtgattgcaataaactactactggagtttaaaattgtgcctatttttccaggaacaagcttaaatcctgttaaactagtgtcaagcccatagtttgcattgaagttaacatggagggagtggcagactagctttccgccaggaaatgtgagggtatttagaccccatcatgctgtaaaacatttttcttaaggtgtaaacattggatatattacccaggaagttaaaacatatgcagctaaagggaactggattttctcagtctgtcaaattatgtgtgtctgcttcttaatcattatcatgaaactgttctatgggactacttgaaccaagttagctttcaattagcatgacgttatattggcaggtctaaactgttagacaaaatatgattctggcatggacagtacatacatgaacaatttattggtacatttccatggtccagcactatgacaacttattaaacccttaaaactctaaaacttgcccttctattttgtgttatactcacttgtggaaaagaactccaacctgaattaaattcaactatctacctgctcctcaccttcacccaagttgttcagcattaattaaataaatcatattacctttctgacttagtctttgtgatcacatatctccaatgaacctgaaatggtgtcaaataatccttttttcttataatatctctctctctctctctctctcactttgaagaaacaaggtttcattctgtcgctcaggctggagtgcagtggtgtgatcatagcacactgcagcctcgaactcctgggctcaagatatccacccacttcaaccttcctagtagttgggactacagatgtgcaccagcatgcccagctaatttcttgtttgttttttgaagaggcagggtctcactttcttgccgaggctcgtcttgaaatcctggccttaagtgattctcccactttggcctaccaaaacacttggattacaagagtcagccaccatgccttgaatcacacaatccttttacttctctttgacattcactttaccactctttgagatattattttgttaattctcctctatctttaaacttcttactctttgcacaccctgcacactcagctgtgaaacagtcaacttacctttcctcccatttattattttacaaatgatgcattgaaatagaacaagctcatatttctatcactaaatttaccactctacctttacctttacctctatttagagtagatgaactctgctactatctgaagccaactctgaaggttatgttttccaatgatctctcgaagactgctccttcaactgtctcctcccctatatcaccaatttatctctcaatataaagtcatccccatgagtatacaaatatagcttttttcacatgttaagtaaaatgtcccctcatgctatggccctattgacttcacagaaatatctgtctaaaagttatctgtatttgatatctttgctctctcacattccattatctccttagtcaaaacaatgaggtttctgttcctcgcaaaatgtccacgttaaagttactaatgaacgttgtttaccaaatccagtggtcaattctcagttctcaccttagctgatcctttatataatttgacccagttgaccacaactttcatttcaaaactttttctggttttacgcctacctcattactttctgatttactttactgattctttttttcgatttgttctcattatgttgtagttcaagacctcaatcctgagccctcccttatatttttccctctttagatgactgcattgagttttttggctttaaataaaatctgcctgttgatgactcctaaatatgtacctgcagattatatttatcttatattgtttccatctgtattagttatctattgctgcataaaaagttatccaaaccttagtgtcttaataacatctattatatcatactttctgtgggtcaggaatctgggcatggattatccgggtcctctggctcaggatctctaacaaggctgcagtcaatgtattggatggggcagcagtcatctcagggtctgattggggcaggacccactttcaggttcactcaataatggtttacaaaattcagttccttgaaagttgagccacctgcattttcttaccacatggtcttttccatagggcagctctcaaaatggcagctggcttcatcaaagtgagtaaacgagaaaatgtcagcaaaaggtgggccagtgttttataacttaatctcagaaatgacataccatcactctggccttattaccaagtcactaggtccatttctcactcaaaggtgggggattacacaaggtaatgaataacaagaggcaagggtcatatatggtatgataaaagcatctcaaactttatccaaaacaaaacgacttcctgacttcccaaactttctatgcccctagccttcctcatctcagtaaatggtagcacaatacccctttactctctgaccaaacctggaagtgatctttgatttctcttttactcactaaccatacccgatgtattagtaactcatattattgttatctacaaattattcaccaagtctgatgaccttccatcattacctttgttaaaattgtagtctaagatgatataaattcttgtctgaactactgcattagccttctaccttattaatatcttttcttcctttcttttgttccattatagtacaagtgaacttgttaaaaatgtatattatcttattagtacttgtatttgtctcctagggctgccataacaaattaccacaaacagggtagcttgaaaaagcagaaatttattctttcacagttttagaggctagaagtcaaatatcaaggtattagcaaggccatgctctcgcagaagtctctagaggttgattctttcttgcctcttcctggtttctagtggttaccagcaatctttggctttccttgacttgtagctacatcacttcaatctctgcctccattgtcatttggccttcctcctgatgagtgttagtttgtgtctcttcttctaaggatacagtaattggatttagggtacaccctaatctgttatgaccccatcttaacttgattttatctgcagagccactctttccaagatcacatatataggtactcagagttagaatttcaacatatctttttagaggacaattcaacctgcaacagtcccctaccttaaactacaaatggctttttactacaaatacaataaaatacaaaatacttactctgttaataagcctttacatgaattggcctcagcctattctttgtgtctcacttagttccactctcacccttattcaatctactccaaccacattggccttatttatgttgtacaactatgccaagcttgtcctgttcttatggcctttccatatgttttatatctttctggaatttttctcctgtatccacctgtgactgccttctcctcatgatttaagtcctaagttacagacaacttcttggagaaattaaaatagtaacttctgtactccatcactctctaccctcataatgtgtattaactgacatatattttttatttgttcactcatgttttccctggcaagaatgtaagcttgatgaagataggatatgggtctgtcctgtttcttcttatgtctctaataccctaatatctaggacagtgcatggaatatattggtcaatgagtttatgtccccattataacctaaaagagcaagatgatatgcataatagctaagtagattctggaaagtagaatgctaatttacctctgatcttctgaacttgtggaggtggtaagaactaatgtgtagtatttctagatgtggtgggaagaacagtcaatcttagaagtcaattcttagaactccaagcagggaaaaccatatgctaagtactgggaagttaagaagcaacaagatcaaacagacataaagcaatttatattctctttgaggagacagtgcagctcctgcaataaagcaggaacctcagatagtgaaaatctttgagctgagtgactatagccaatacctagttgaaagtcacataaatatcacttagaatttcagtccatgcagagactttgcaagcccacagtttccagagaaatagtagcatagtctgcaggttgaacattggatatagatcatttatgtcctttgtgtatatatttgcatcagaggtttcagaactgttttatttattattgactatttaaattattgtcagtagaaaacatagaacctaattttctagctgcatgaccttgggaaagatactctaaatagacaacaatagcatctacctgattaataatttctaaggattaataagatagtacatataaagtgctcagatacatgcctggcacatagaaagtgctcaacaaatgttggcagttattattaataatgcttattacttacaggcattgaaaactgaatgtgaaaaattagatatgaacttgtagataatatcacaattatctgtaaatgctaatgataaacaaaaatattcctgttagctttctggcttttcaaatattttactagcttcctattgctgctgtaacaaagtatcacaaacttcgtggctcaaaacaacatagatttattcttttacaattctgtaggtcgaaagtataaaatgaaatttatggagctaaaatcaaggcattggcagggctaggtcttctagggcttcaggggagaatctgttgcttgcatcttctagttcctagtctttgatggaattccttggctcatggctgcatcactctaatatccacttccatcatcatatggccttctctctaactttgacactcctgctactctcttataaggacccttgtgattacaatgagcccaccttgtaatctggaataatctccttatctcaaaattcttcactgaatcacatctacagagttccttttgacatgtaaggtaacatgttcataagttctggagattagggtgtggatatctttgcaagccattattctgtctagcacaaatgcagtcactatcttttaattttaacagttattttgaaacaaatacattctattattgctttttcctctataagaggattctattgacacattggcacataggacaaatacttatatttcttttccttgaagcttcagtggtcatgttctcgctgagtaacgctggggtgactatggagctcttttataaaaggtaactagtttttctgtgctccatggcctcagaatggaatttttattgtttgataaagctaattattgtgaatagtgattaaacttgtgatctgagggtaccagccatgccccagattatttggaacattaggagatatttttgcttgtgacaactaggtgaaggtgctactggtatctagtgaatacaggccatggatgctgctaaacatcctacaatgtacaggacagcccacctccccaacaatgaataatctatctcaccagattaatagtaccatgtttgagaaaccctgccataggcaattttaagaaacagtattattgcttgggcctttgcttttcaaaagtgtggtgcatggaccagcagttttggcatcacgtgggtcatcagtctctttgaaatctccccaagtgatcccaaaattcagccaaggctgaaaatcactgccttagcttttctcccattatcttaccctactcataagttgttatggttatggatatatagagtttaactggaaaaataaaactaaaaaatttgccacgtgtaacaaacatcatatattagagctctaattggcataaagccacctttttcttgagaattgcaataaataataaattcctcagtgtactgaattgtaaacacacagatatgtggtaagagtcaggtttatccaactattcgttaaatatattggcagggagaactcacaaaggagggcaaattcactcagctaggatcatgtttgcagcctgcaagagcgatgatggaatatatttgcttttcctccctggctctgtcacttgcctcatccaatctgctgactttagaacccaaaaagtttctttggtatgggcttttggagctgaattacagtggagggcatgatgaatacgaaaggcgtaagaaaggtgaattagaaaagtggcagatagaaactgtgtagtgtttttatttatgctctctattcttcagcacagtgcactttccattttagctagtcaggttcatccatttacagtattttttcttgtcaccaaataagtgtgagctctattgaatttcacagaattttctggcagtgtatgaaacatatcaatttccccagtaattcccagtaatttaagtttggaattattatacaaattaattcaattaagactacagttatcagcatagccctgttaatattctgtggcttataaaaataaaaggtaacatggatctaactagacaccaatgtttaagggtaatcatacattattgtattcaatgtttgcagtaatcctttgagatacagactattcatctggccattttacagatgaagaaaatgagatattagatattggaatgtcaagtattagtaatttttccaagtttgcatagctagtaagaagtcgagctgggtttcatatacaaggacttttactcctgagtgtgtgcacttaaccactttcattgtatatttcttcaggtctgtcttcacaggcaagcatcggctagtgccagggattttctaaactatattggttacattaggcaactctagattttgcaagggatgattccattgtttttaatgaccttgattgaagccttttcctagccactattcccctaagatgggtagtttctctgctttgccaaatctgagagaaagacctagtgtctcaaaatacatttagttgctcctgttgatgataatgttatggaaatggactttttctatgcacctttgcagttccactgatctcttgtttagcagccttgacagtgtctttatattgttgttcacatggtttctgattaaaaccccatgatactaagctctgactagaatacgaaatctaacccgaattagtttatcatgatttcttttgtttaatttcctttttaacattttattgaacattgacaattatacttgtatatatttatcaggtacagagtgatactattatgtgtgtgtgtgtgtgtatatatatatatatatatatatatatatatatatatatatatagaatgtggaaagattgaatcaagctaattagcgtattgctcatcttaaatacttaccttgcttaaactgtaaaaaatactttatcttaaagcatttattgactaacttgattttaataaatgaatgtagtattaagtaaattaaaaaagaaattaaaacttgactttcataaagatataaaatgaacttttgtcaaagttttatttacatcactaattaatgagggaactagacaagatgttacacctgacttgatggagttgtcaaagaaccacaaatttatatgcaataaaggaatattgaactcaattgaacacagcatgtctatccatagaacaataatcaattgcattctaccagacacaattaataagcatttccatggataagaattgtttgcattgctattagctttctagatgttcactgtatctttacagagatataaaatagcttattcaaaagcaaagttacacatataagatcagataattcccagaggctccacctttccatggaaaggatagctaataatctctcttgcttgtttcagattctcaaatgtttccttaaagtagtattaggtggatacatttacaggcatatctcttccacagtatacatttcattctttcaatcacagtgtgtgtgtgtatgtgtgtgtgtgtgtgtgtgtgtgtgtgtgtgtctgtctgtctgtccagaatctattttaattagattcagattgctaacctggtgttttttattagtgatccattaaagtggatcatatggttgaaaacagtggaagttgttgcattgagaaaatattttgcacaatgtgatttatcaggatgactcttggatttagaaacgtatggcttttacttgtagaattagaattataataaatcattcagattctggaaaaaaagtaatataatttgatcctttaaaaccttttctaatgaaattttaaagaggcataaatacatacatatttttgtaaaaaatagtgcatgttcttttttttcaaattagggaaacatagcaatgtggaggagagccaaaatcagtataattacttatgatagccagctcatgtgatctgctgtgctgtagtttttaagtcatttttctattattaatagtaataatattattcatactatggataattttctctatacagcattatattatgctttcatctcctttccatgttattttgactatttttgcaaattattaatttcagaagtatttgtgaaagctaaataatattccatcttacagatattctctacaattgttactagtcctctatattagtcaatagaaaatataataattatctctttacataaatctgtctggattaatgaatatttaaggtggtatattatttacctatttttacataacaaattaccaaaaacttagcagcttgaaactatacaaatatattatcatgtagtttctgtgggtcaggaatctgggcacaggttagctgactcagttcagggtctcacaagtgtgaaatcaagatgtcatctgggtcttaggtcttatctgagacttgaagtcctcttccaagctcttatggttttttgcaaacttgagggttttttttttatttatttttatttttatttttatttttttttgtggttttagaactgagtccctcagctcctagaggttgatggccattccctgtcacatggctgtctccatgacatggcactttcttgttgaaagccaaaaggaaataatctctgctacttctttcctctaaccttttctatctctaacctctagaaccttttttaaaagaccacctgattaggctgggcccaaccaggataatttcccttttgattaacttaaaggcacctgattagtggccttaatcacacctacaaaatccttctatctttgttatataatataacctaatcatgggcatgatatctaccatatttataggccccacccaaacttaaaagaagacaattctacagggtgtggacacaagggagtggaagtcttggggcccatctcagaatttttaccacttacagatggatttttagaagcaggatgattgattcccagtggttaagtattttaaaggctatatattgagaaattgctttccagtaaaactgtactaatattcactcccatcatcagattatcagcatacttgttttactatatccatattgacataatagtcatttaaataactttgattactattttcctttctctataattatatatgtatgaatatacaaaattacaatcatggcatttttgtgtgagaaaattttatttttatttgacaaattattttagtatatgcttttatttactatcagttttatgattgtaatatttagtgactgtatgtcttctaggtattacctattcacttgatttgttcattttctatattcattccctttgctaattttcccaatagatttgtaagcattctttatattatatgggcactagcctattgatgtgtatgttggaaatatgtttgctaatttatatttgacttttaactttccctatacaatttatatttttatgttctaaaaaacacaataaatattccatttgaattttgactagaagtgcatattcccattttggaaaaatttgacattttatgccaaaattgataaagtagtcaatattttaatcctggagcatattatttgcatgaatttataatggaataaagttttctaacttcttgtcaccataccctactactaataaaaattttacatttctctctttctaatatttacagtcactgcctaggaattccagatcaaagctaaatgaaaatagtaacattaactatccttgccctcattctttatattagtttaaagcacttcgtcagtttaaaaagaaaaaggttttctatatttttatagccataaccatgattttctattccttggaccaaactctgtttcttgaaagtttggaagtactcatctgtattgttttcttcaattaacatttttggagtttatactttaatagcattttgagattttaaacggttttgggtttactcgtaattttcttctgtttaatgaattttagttatttttatccccaatcatccattctgtaaaatttacaaatttagtaaaattcagtgttctaaatattttatgtcattgtatattttataacttcttcagttctaattttgtttatatcattgctcttttttttcttaatagattagagggaagtttcatcaactctttgtaatacaaaaccggttttgacagtctgttctttaagcactattggtttttaacctcctgaagcatatagtcaggacatcttgagagtcaaaccaaccctttccttaccagattcctgtacaacttttcagcttcacctggtgccacccagtaggtgtgccaattatcccatagtaactgcgcttactgctccagtagtctataggtttgcaagacattccacagcattttgtgttagattgctccacagtgaactccacagtgtttaattctcgggacaatatttaaataaggcacagatgcattttggataagattatttgactgctgcgtatagtattcttcatcaccttgtagggtaatctgccaagaagcgtatgacttcagatttttattgataactttggttttttagtcatattgtgaattagcttttggagatcagtttagaagcttggttgtaagatttggaaggtcaacattcccttgtcagagaagcgctataggaataaatggtcttctgtttagaattgtgttaaaaagaaaacaagcaaattcccacagagttttgtcagggccaatttagaaaaaaattatcttggtgacctaaaacttgttttcgatgatctaaatgtatccccctccctactccccaactcatattgaatagattgtcaagtatttagctttattttcatcagtggttttccaaatggaccatgcactctttctgtcctactctacctgtaatctcttgcccaccatttatttaaccctttctaccttagtcattaatgaactccctcttctgcttccaaagtcagcccaatgccaccctcttctgtgaatgttttcatgacctatccaggctgcactgagcactttccatggattcttgagaagtcgtctctcataacatgtatccctttgctaaaattgttgatttccatgtctctcttccatgtaatccttgccacagtgaccatttcctaatcattttgtacctcagtatttagaacagcatctgcatcatgataggcactccataattaaaaaaacaaatgtatacataactttataatttgtgtttaatttcctcaaggtagtagccaaagcttatgatttagacacaagtttccctgtgactaattgtaaatattgtgccttttagtaacttatggttgcagagtatctaagagcttctgtttatcctctccccaggaaatctatctcataacatgcatcgctttgtgtaaattgaactcttggaaaaatactttatccgtgtcaggcacaaatggatacttcaatttttgattagagtgaaaaatggttgctttaatcttgaatatagtaatggcaaaactttaaatattaagtaaaatatagtgaatcatttttttagcataggtaattactacatacaagccaggagtggaaagaaggcataagaaaagagctagcattagaaaatgtctataattaaatgtcattgttaaacactaatagtcaccataaagacaagtattttatttaaggcttatgaaactttgaagtaggtatttgctacctcaacatgttgaggaaaagtaggtaaaaactgaaataaatatggcagatacttatgtccatgctttgtaggtgagaaaactggggcttataaagatgaagtaacttgcttaccttaacatacagtaaggccaataatccaggtttttctgattctaaagcgtattctccctgctttatagttaagaataaaacaaatgagtgcagcttccctccctttcacttccaaatttacctttatattcacccatttgtactttattttctacctataaaaggagtctcaacttccccatactaatatctcttccttctagattctcttctttcctctgaatctcttttgcctcagtttacatatgtcatccagaattccccagttaatcctcaacttctctaccctgaattgtggattccacatccacattcaaaacacattgttgcttgttttgaatgttgtttttgaaaaacattcaaaaacaagcagatgaaacctagtttccaccttggactcttttgattatgcccacttatactcctatttgtgtaatgaaaagactggtcattagcatcttaactctgataccagttgtcttttttatttcgagacaggatctcactctgttgcccaggctagagtgtagtgaaataatcactgctcactccagcctcaacctctggggcttaagtgatccacccgcctcagcctccccagtacctgggactacagcatgtgctaccacacctggctaatttttaaatttttttgtagagatggtggtcttactgtggtgcacagactggtcttgaactcctgggcccaaatgatcctcctgccttgacctcccaaaatgttaggattacaggcgtgagccaccaacgctggcccagatgtctttttttattctcacaatacacaaactctcctgattgtatccttaaatatccttgcttgcttattttacccagtattttctgattcacactccctctgtggcttgcttttctcactttttctccctcttgattcattttgcctgtcctataaatatttgtaagccccagggtggataatgtgagccttcttctcttctttatctgtacttccttcttgtttttcctaatacatgttcttaacttcagctacagttacagtgttgtgttatcttccatctctctactaagctcctggctaatattttaataaactacatgaaagttttaacagggccagtctaattaaataggtaagcatttgtttcctttattggtttgtgagcctttttgattagactccattgcattgtctttgtgtccccactacatcatagcaaaacatcttgtaactagtgtatgctcaataagggtttatcaaatgatgggtttaaatatcaaaattgaactgcatataatagcaaccatatccagtctttcattcatttatttttttccagctagtattcattgagcattggaaattaaaagttgcataaaactcacatttacccttcaaggccttccagtcaagtagaaaactgggatacacagaaaacttgatagggaaaggatgtgaatattagtagtatgaattaattggtagtacttacaataataataaaagtaataacaattaactgcaataacaacaataaaaacagaagctttgcctgtaatctcagcactttgggaggccaaggcaggcagatcagttgaggtcaggagttcgagaccagcctgcccaacatagtgaaaccccatctctactaaaaatacaaaaattagccgagtatggtggtgggcgcctgtaatcccagctacttgggaggctgaaagaggagagtcatttgaacccaggaggcagcggttgcagtgagccgagatcgcgccactgcactccagcctgaacgacagagagagactctgtctcaaaaacaaacaaacaaacaaaaatcccggaagctttgatttgttgttctttcaatgtgccagtgctgttctaagcactatgctatatatactattataatacttactttgcaaataaagaaactagtcacagagaggttatttgttccaaatcacagtttataggtggcaaagctgggatatatagactttctgctcttaaccattgtgatatgctcattctgcataaggtttagtagtggtttatgtgaagccaaatggtgaatggtattgacaggaaacaggcaactggtttcaggtccatttatccagaaattgaggcctcttgaaattagttcaccaatagtataagcaataagaaaatatgtgagaacctcactaaatgattatgtacagtttgtattgctatttctgggtgcaaattttgattatgcaacaaggatagcaaaacttggatgtctatggctagatacatttaatctgttttgcaatttaagacacaataaacttcctcaaagaagtttgtaaagattattatagattgaccaagatgttaagtctgtgaaattctatggatttctttttgtgttccctaatacataaagtttcaagagattcagttaaggatcttgatattaccaaattgatgctttccacacatattaattttaagaaatagaattgcaaactagcctatatgctttatagaaatgaaatgagtaaggaaatagtattttgaacaggagtaaagtaataagatagttgagctgaaaggtcttgcagtgtatagttgggtcctggagtttcttgggcagtgctgattaaacttacacagagaagaactgattctcacagctaacctgaaggctgaaggtgtcaacttgaagatttcctgcagctccagttagtgtggtggctgggaaatggtattcgggttttaggaatgcatgactcagatttgtactttaatgtggcagttcatcagatgtgtctgatgaatcagctctttggattaggtttcatttatgtctttatgtaaacttaaggtctttggatagaaaacttaaacagattgtcatcccttaaaggtgccgccattaaaatagattattttccatgctattacaaattcactgattttctgaataaaatggtgatggtgacaccttgccacaggtgaatggattttgcttttgttttgtgaattaaaatgtgttttaacagacttattaatatgagtaaattaatcaattaaaaccattcagaagtatctgaatgaggctctgggagaacccaaaatgtgatagttttggcattttcatctttaataaagttatagtgattgagagctggattgatcagtcctcaagtgtcttgcaaagaaaggtgtcctgtcataagtttacaatatatttgaactgtgttctgatttcccactttttgaaagtcggtctttcagctccactatctcagtcttatacaaaaagaaaagaagcagagagtagaatggtggtggccaagggctgggacaggatggggaaaaatggggagatgttggtcagagggtacaaacttgcagatatacaatgagtacattctggggatctaatgtacagcatgttgactataattaatgatactacattgtatacttaaaattttttgagagtagatcttaagtcttaccacacacaaaaatataacaactgtatcagttgaagtatgtgttagctaactttatagtggtaatcatttcacaatatatatgcatatcaaaacacactgtacattttaaacatatccaactttgtgaattatacctcaataaagctgagacacagaaggatgattttctgaggaagacaatgttcgtttatttaatttcaaatgaaatatttctcctttagaaatccaaacacactaggttagtgtcccttcttatattcctctgcaagccttataatagaaagaaatgatttttgggtagtttcgttgagtgttgtttcttcttcttctttcttctttcttcttcttcctttgttgcttaggctgtagtacagtgacacaatctcagctcactgcagccttgacctcccaggctcaagccatcctcctacatcagcctcccaagtagctgggcctacaggtgcactccaccacgcccagctatttttttttttttttgtagtgatgggggttttgccatgttgcccaggctggtctcaaactcctgggctcaagggatctacccgcttcagcctcccaaagtgctgagattacagtcatgagccactgtgcctggccagagtatacattcttttaataaaaacaaaagtcttaaaattatcttacaatatcttttagaggtttttgaaagaaaattataaaatcacgattaaatattttgaggcagacagcttatgatttaatctctgttggaaagaatgacactgaataaaaccacattctattgcagcatggaatgttaaaaatgtcagtttggatgatttttattaagataaattgttagtgaaataattcttttgacgggattgtttccatttatttaaatacaactagggcgtttaaataaaaaatccaaaacctcaagtgaacataagattttaaagcattttgggggtgagggctatggaggcataattttggtattaccagtttcgatttaacttaggaaccacaacatatgggaaaatataatagaaatcctggttatattctttccttttgtgtaattcattgcaccgatcatgtttgatcaaagttatgaaactctaataatattgctatctatttttaaaacatgtatgtttttcttctttttaatctttgctttagggaacggcctttaagagctggaagatgaaagctccgattccacacttgattctcttatacgctacttttactcagagtttgaaggttgtgaccaaaagaggctccggtaagcagtattcctctattttttatgtgtttttatagcttaaagtgatagtgctacatctacacatgtgccattagtggaaaagttgagaatgatcagttatcaatattgtggagatattgtagatattatgagtaaataggtggagcacactcatagggaattaggaaagtgagagtggattcaaaagaatgtggcttattttatcgattactatgaattggcatggattcaatagcaaagccttgtatttagatttcattttgtggtaggattttaagtattcttatataaacagtgttatttaattttttgcatggaaatattattgtatctttgatgttaacttttattgttaccattttgatgtcagctatacttagggaagattcttttcagggttgtactccagctgatttgatgaattgcttggaagtatataaagaaaatactagtgttattgaagaaaatgtcatgaggaagcactaatattttaataggaaatatagaggtaaagtaggatggtaatgaaaggaactactaaatagattaatgttggcatttatgaaaaactttacatgttatcaggcatcttggtttgtagtggactgttgatagttcaattgtatgggacaattgaataaataccattatcaatgtgaagttgtatcttgtctagtaagtcactaataatataaagccttgccatgctcacactatgtggagtcacataatttttgaagttatagcttttaggtatgaaggaagatgaagggtattgtgttttgttgctagaattagaatgtattgtctgttagttctagagagcctgtgggaaaaagaagatgagataatgtacaagaggttgcagtgttgtgatataagcaattgcatggacaaaagcatctttggagttcagaaaggaaagggaatgaaagggctgagatggggctgtgaagcaaacatcttaaccatgaggttaaaaggcttcaaactcactttgatgatataacgaaaaagcccacatgcaggggaaatagggagcagctctgctctcgtgagcccctcctggggataaagtctgaagggaaactggggagggcattgtgcatggacaaaggtttggtgcatggttgaaagttaaaaaaaaatactgagactgttggttctagcatatttggttattatacagctgttgtatctgccattgatgtggttataggcaacgtgaaaaaaatactgttgttatgtctacacattatttcatctcttcttctcagtggatcttctgaatgagataaaaccctagggcaggattatgatgttgtggtttatgtaattcaaatgggttaatgggaaataacatatatcttgatttctttaattgtactatgctcaagtacaattgagcataaccaagagagttagagtaggtagaaagaggggtaaatagtgatgaaagctgataatttttacaacactgatgttttctggaatagaaatttacattaaaatcacttaagataggtttttgagatagtagctatatataagagaaacactcatttgtgtaagtattataacaaaatgacaatagttcatccaaaatagaaatattgattaattctttaaaactttatttttctggttattaccactaattatataaaatctgtttttttttcagttctttctgtgtatgtcagatctatgatttatttattcaaatagaaatgttactcctttttaatcataaagtaatggtgataggtccattctatataacctctaatttgggggcaagaaattttatcaaactgggacttactttgtgtgtttgagaagcatgagagcagagctagaaacatggggcagttggaaaatgcaaatttaatataaatgcaaatattaaaatgtctcaaaaatctatattaagtgattttaatgtaaattcctattctagaaaacgtcattgttgtaaaaattttctgctctaaagacctgagaaaactcaagaatctgtctcaaattcagttttattttaattttgtaattatttgagaagaatggtaataagatgctgtgctaagctaagcagaagttctgagacctttctctcttcagtttatgaatgcagttgtcacgtaattatataataccttctaaaccaaatgtgttttctatattataatgtaaaaatgacaaggcaggtactgggattttgcagcatgcctgatttgtttacttttctatatgatgtgaattaacataccttccttcccctagtgtctatattaagatccagatggatggaggcttgtttgtttgtttgatttttggatattaagtgtgcactttgggaaggaataatattattctatccacatactttcatagcttggactgatttcagctgatgtctgttcctgtggcacctttgtttgaaggaagcagatatgtagcttactgaatagtgtcattactcatctccatacatcaagtagaagaggagtgtagttggcatcttttccttgaaagattaatagctcaatcttcatacccagcccaacctataaaaccagcagcaccatggccaggggataaaaatcaatttttgatgtttgattttacgtattaaccaagaggacttcttatctttcttcttttgtcttatcatttaattctcttttgattctttattttattcatctttttgaaaggtcagtaaacatgactcaaaacccaatgcttttcatgtgtcttttactagaatattatttttagttcactgtgaccactagaaaaccagaactagatattttaataattaggaacatatacaatattatattacacagagaaatattgatttttaatggcatgttaattttgtagagtgtttactttagattaacacatatggtcattccataaaagtagatattgttttctcattaacagaactaatttgaaagcaataggaggtcttattacacaagctggaaatgcattatttttatcacattggcttacagtcccatcgctgttaatttaaggaacagattaaatataataaggcaggccgggcgcgttggctcacgcctgtaatcccagcactttgggaggccgaggcgggcagatcacgaggtcaggagatcgagaccatcctggctaacacagtgaaaccccgtctctactaaaaatacaaaaaaattagccgggcgtggtggcgggtgcttgtagtcccagctacttgggaggctgaggcaggagaatggcgtgaacccgggaggtggagctcgcagtgagtcgagatcacgccactgcactccagcctgggcgacagagcaagactccatctcaaaaaaaaaaaaaaaaaaaaaaaaaaaaaatatatatatatatatatatatatatatatatataaaaaataaggcaattatatcattataacattcttgattgaaatattaaaatgcaactttataacattttgttttaaatatcacttcagatatgtacaatatgtatgacaactaaggactatatctggtctctcaggtaaagtcctaaagttgtgcctacatttagaatgaagacttttaatatctatggaagcacatattcagcattcgttacacaatagattttatcctgggacaatttcatacctattttttttagtttttataagtagcacttgatgaaagaggctaagatgaccaatattaccaatccccgtcaagcatgtgaaatattatagcaattcagtaagtaaacatctcggttgctgtcatttttagaattctgaaaaaaaatcccccacatgtaaagcaaacgcttgcttggagaatctttgtatctcaaccagttgaggaaatttagctttacattcttgtttgttggtccctttcttcattccttcctcccttctttccctttttgttctttccttccttccttcctttcttcctcccttccttcttctctgctagtatatttatctgcaaataaaaataatttattttcatattcccactgtgtcttggtaggacttttcaaactataaaaatattattattactttgtctgcatggttgaagtatttgaaatattctatctttacaaggccattcaaagaggttagcatagtctttgttaataatagctattcttaaatatatacattttaaaatggtgtataagaaaatctgcagtaagatttgggagcagggaaatagtataaatagttgaaggactgttatggacaaagtatgactatagcactttgcggggactaaagtgtgagttgtaatttgcctgaaaagtttgggatactgaagaaaaatgaagctagaggggtctggatgtagaaattaggtaagagaaggggttccatgatgtttttctctcaaaaacatcctcagaatataagatggtgagtgcaaggaccatgattaatgtatgcttataatctctacagtgccaaatatgctgtttcagagtcagggttcaaggaaatgtcttaatgacttaatgacttaatgactgcatgaatggttgagtgagtggttttaataatcagagttacatcagtgaggatgctacaggaccaaaacgatattagaaagataaaggtaaaattaaatagaggcatttaagaaaaatgatttttttttcttaaagagcaatcagtataatgtataatgtgagactactgaagcaaaagatataacccggaataagcaatatctaggacataataagggtttagatgaagacaatgaacctttacaaatggggagtgttttcatgggcttgaaatgcagttcaaaatctgttaaagggtaaggaaaatgattcttcgagtatttttctattggaattctactacgtttagtgccgctttaaagaagtactaatgtcattgtgcagaattttgaatttaatggtattgttccataatggccattatgaaaaggctgtagctcatgattactaatacaggataaataagcaagtgacttcagtataggaaaaaagtattcacagttattagaccatatggagaagagtaagtggctgcattaccaaaaagcacgttattttaggaggaatttcatctatataaaagctccctaaagcatccagctattagagagtaaaagggttaccaaaaggagttgatcttctcttcattctagaacctgacaggggacacctgtttgtgtaaatgatttagatgcaattcttctagacagcaagaggaaggcaagcctcaaaaggttttcctaaacttgtgactctaggcccaaataatttataaaaggtaagagtagtcaaataaccaaagacacagtttcagttctaatttttgtgttgttatgtatggatattcatttaagtaaaagaaattatactactgtgtaaagaaagcgagatttaactgaataggaatgagaaagtctagtgggggtacttccatctcatgtcaatgtgatttatgtgcagctgctctcttgagcattcctgtaagtcaatgagcttaatttcacatgattaagagacaacctagtcccccagcatctgccttttattatgttaccatgtgtttattctcagtttgtcaaatatgtcaaaaaagataaggtgtttctccttattttcctttggggtagcttataagaccaaacttctgggactttgtttctttaccttttgaagttaaaaaaaatgcactttaattttttctcaggaaaaaaaattctcctatttattgtaatttttacaaattttgaaattagatctagagtaattttaatattcctttgaaattatgtccttaaataaaataataagtctaataaaaatggaacttgcacctaacaaacaaaataaaattagccaatgtctttgtttagttatatctatgttctgttatacctatattctgttatacctatgaatttccccacaaacttacccattcagttttagttgtcagtataattttatatagagttggcacagatgaataccaattgtggaaaatgatgcctgcttcatggtgagttaaggataaaaggcagtatgaatgaatcttccaagttgactaagacttcaatgaggaggagaatattccaagttaataagtatagtattccaagttaatccaacttattaacttggaattcaaactaattaacttggaatattattattattagttgtattagtattccaacttattaacttgtattccaacttattacttattattgcttataataagtaataatattcaaagtatcataagtatataagtgtggtactgtattatgagggtacaaaataatatattgttctatgtatttgatgggagaggtgaggaatagagggaagcagtatagaagctggcaaatggtaggcaatataagtttgttagagaaatgatgttcgtattattccattttcatgctgctgataaagacatacctgagactgggcaatttataaaataaagaggtttaattgggctttccatatggctggggaagcctcacaatcatggcggaaggcaaggagaagcaagtcatgtcttacatggatggcagcaggcaaaaagagagcttgtgcagggaaattcccgttttcaaaaccatcagatcttgtaggactcattcactctcatgagaacagtgcaggaaaggtctgcccccataatttaatcacctcccactgggttcctcccatgacaggtgggaattgtgggagttacagtttaaggtgagagttgggtggggacacaaccaaaccatatcattccaccccggcccctcccagatttcatgtcctcacatttcaaaaccagtcatgccatcacaacagtcccccaaagtcttcactcatttcagcattaactcagaagtccacagtccaatgtctcatttgagacaagtcaagtcccttcggcctatgagcctgtaaaatcaaaaacaagttagttacttcctagatacaatgggggtacaagcattgggtaaatacaggcattccaaatgggagaaattggccaaaacaaagggactacaggccccatgcaagtccaaaatctagcagggcagtcaaatcttaaagcttcaaaatgatctcttttgactccatgtcttgctcatctgggtcatgctgatggaagaggtgggttcccatggtcttgacagctctacccccgtggctttgcagggtacagcctccctcccagctgctttcacgggctagtgttgagtgtctgtggcttttccaggcacacaatgcaagctgtcggtgggtctaccattctggagtcttgaggatggtggcccccttcttacagctccactaggcagtgccccagtagggactctgtgcgggggctctggccccacatttctcttctgcattgccctagcaatgattctccatgagagccccacccttacaccaaacttctgcctgggcatccaggcatttccatacattttctgaaatctaggtggaggtcaccaaacttcaattcttgacttccgtgcactgccaggctcaacaccatgtggaagccaccaaggcttggggcttgtaccctctgaagcaacagcctgagctctgtgttggtccctttcagccacagctggagcagctgggacatagggcaccaggtccctagactgcacacagcaggaggaccctgggcccagcccatgaaatcacattttcctcctaaacctctgggcctatgatggtgggggactgctatgaaaacctctgacataccctggagacattttccccactgtctcggggattaacattcggttcctcattacttatgcaaatttctgcagccagcttgaatttctcctcaaaaaatgggattttcttttctatcacattgtcaggctgcaaattttccaaacttttatgctctgcttccctcataaaactgaatgcctttaacagcacccaagtcacctcttgaacactttgctgcttagaaatttcttccgctagataccctaaatcatctctctcaagttcaaagttctacaaatctctagggcaggggcaaaatgctgccagtctctttgctaaaacataacaagagtcacctttgctccagttcccaacaagttcctcatctccatctcagaacgcctcagcccggaccttattgttcatatcactgtcagcatttttgtcaaagtcattcagcaagtctctaggaagttctaaactttcccaccttttcctgtcttcttctgaatcctccaaactgttccaacctctgcctgttacccagttccaaagtcgcttctgcattttccggtatcttttcagcaatgccctactcctggtaccaatttactgtgttagcctgttttcatgctgctgataaggacatacctgagaccaagaagaaaaaaaggtttaattggacttacagttccacatggctggggaagcctcacaatcgtggtggaaggcaaggagtatgtcacatcttacatggatggcagcaggcaaaaagagagcttgtgtagggaaattcccatttttaaaaccatcagatctcatgtgactcattcactgtcagaagaacagtgcaggaaagacccacccccataattccatcacgtcccaccagattcctcccatgacaggtgggaattgtgggagttacaattcaagatgagatttgggtggggacacagccaaaccatatcaatgtttattgtagagatagcatacaggcattcactgctaggaccagaggattaacccctgatccactggtggtcaactataggcttgcacgtgatccataaggtggcttggaaattagggacactggtgtatcagtatcttactgatgttttaacaaattgctacaaatatagtgacttaaagcaacacaaatttattatcttacagttcttgaggttctttatcatcacatctcctctgactctgacccttctacctctctctttcccttataagggtcttcattattatattgggcatcctcagataacccaggacaatcatttcatcttaaaatcatgaatttaatcaaattggaaacgtaccttttgccatgtaatatgacatagtcatatgcttcagggatgaggcagtagacatctttctagagaacattatttagcttactgcaactggcaattagccaattcaaacaaactgtctattgaatgcgttgaagactagagcaagaattgtcagccaggagccagatgggaatggaagagaaaagaacagggaagttgaaaacttttgctgaagggcctgtgcaatccatggtgcatgataaaaggtgcagagggtttgtagcaaaagaagaaaagggaaagaaaacagggcagagggaaaggaaggatgagagatgcggaaggagaaagaggaaactgatactagtgatgctttggatcttaagaacattttaagattaatctgcactccacacatatactttcaaaaatacccccttttctttgtggtaggctaaaggcgtctgtgttcctttcaacaaagtaatacctgacctgaaaatgatttccagacgtaaagtaatagcagtgagaatagtgaagacagaagagagagcaattttaaagttagactcaattgaaatagatgatcaattagatgtgagaggttataaagaaagaggtaaagaaaaacattctgtaatgagaggattgggataccatccatcatattaaaggtccccaaagcacagaaacttgaaatgactacttattgaaggaaaatagtaaggtctttgtgactaagatgaagccccaaatgtagattgaggatagaatatgagggattttgaatatcttgcaaggaattttagattttatcttgagaacaaaatattttggctgagatatttaataactttgcaaatccctttagtagaaaattcagtctgggtggttgggcctctgatttgatagatctgttcattgtggtgtcttctctacaccataaagatgaaacttcttgctttgtgtatgatggtgttacacacatttgtgagtccatcagtaaagctgcctttgcagagaagggaagacacacaatcaaactatgtaggatcatacatgaaaatggcatggtcaaacctggtgtttgacatgtaacactccctgtagaaaagactagggtgggattccagaatgaccagtaagggactcgataaaaatcgtatttacatatactgagggcctgaaaagcaatcaaaggcactgaaaataaatttctgaagaatatataggatctagtgagtgtttggagatgaattgtgaaataattcgaggagaggttatattgatggtgtcgccaattacagagagaagatgaatggcaatttttgcggggagagtggatggaatgaagtcaattcggaacatacaagctgtggtagtcactggaagtattgagctaatggatttattggtctggaattgtactagtttcctgtggcttctgtaacaaattgtcacaaactgggtgacctaaaacaataaaatttattgtctcacagttctggaggccagaagcccgaaatcaaagtataagcagggctacacttcttctgaaggctctgtgacagaaaacttccttgcctcttccaccttctggtggcttcagttttccttgggttgtagctgctaccatcttcacatggccttcccctctgtgtctttaatctccttctgcttttctcttataaggacacctgtcattggatttaggatccactgggaaaatccagcatgatctcattttgagatctgtaaccttaattacatccacaaagattctttatccaaataaattcatatgcacaggtcttggcggacatatcttttgggggaccactgttcacactgcaaatgtcaaagcaagaggtatggattttgaaattgtcctcatattgagagcaacatgatggaatgagattatccagggaaaacatgcagagagagaagaggaaaagaaaagggaaagggtgaggatcaaggattctgtggaacactagccctgaagaggctggcagagaaagagcagccagtcagggaaagagactaagggaaagctaagggaggaagaaagagaccttacttgttttggttcctgcaaaccaagagtggagaaagtttcaaaatgaaagaatgatcatgttacattctttggaaagttgtgtcagataactgaaaatacgtcattaaatgaagattcaggaaaatgtaggggtggagagacaacggagtctgaaagaagttgatgtcaggttttaaaaagtatatattgtacaaaatcagtatattaaagggcctttgcatattaaagggattttatttatttatttatttatttatttatttatttatttatttatttattttgagacagagtcttgccctgtcgcccaggctggagtgcaatggtgtgacctcggctcactgcaacctccacctccagagttcaaatgattctcctacctcagcctcctgagtagctgagattacaggcacccgccaccatgcccagctaatttttgtattcttagtagagacagggtttcaccatgttggccagggtggtctcgaactcctgacctcgtaatccgcccctgcttggcctcccaaagtgctgggattacaggcgtgagccaccacacctggccagggattttactttttaaagtttgtttaactgtttagaaattatgctttttctatttaggtaaaacgagtataaaacttgtggtcatccatgctaatgaaaagaattgtacattagtacagatataatagtatagataaaattttttccaatcaaaaacttctttttttttccaatcaaaaacttcttttagcaagaattaaaacatgttttgccatagataaacctcctgaaggaagggtgatactgatttaattttcgttttttcatttcataaatacagatatggaagatagcttacaagtgtattataattttccacggttaatcttcatgttaagtatcgtaagttccaggaaaggtctacagacagctaatatttacactccaactttcattcacagtgatgatcacaaaaattacatctttttagttagtatctcagaagtggcttacattaatctgatgagtattatattaggttggtgcaaaagtaattgcaatttttgccattactttcaatggcaaaaaccgcaattagttttgcacctaccttataatacccacagcagtggaaattaaaacacttgggtttcaatgcagctgctaacgagccttgttgattgggaacatgtccctaactgaagctgtcatatctttggtttcctttttcataaagttttgcactacaacattgtccatacaaataatagttcatctttttgttcctttcacaaatatttattgagcactttcaatgcatactaagtatatacctgacacttttttctgtaacttattttacatgtttgcaaattgatcacacgtttaaaaaggcagagtttgtgaccagagtacctgaggcccattgttagctacatttaactttgtgctatacagtttgagtcagcactacagagtggaggatgttattagcttaaaacaaaggttctgttaagagaaaaaaaaattagtttttatttctttttaaatagcacacagtatatcattagaaagccaaattaaaaataagatacttctccttgcatgtggtgatgtgattaagtaaaatttggtttgtcagtttcaaataccaaaccatgttttagtctatttttgcttatttaaggcaaatttctttttgtagagttatggtctcttaagacatctatgcaagacaccttgcatgggaaatgttgccttaaggcgatgacagtgaataactttgccaagttttaaaatctctgagggttatatataaatatttcttcaaaaaatgtcagtgagcctcttgtgagtattctcaacactattcaattgtcatttatgttttactaactgtactaaaatatttccaaattagttttgctaccttgagctcaataaagtactgccattggcatcttactttaagttcttaatgcatattccacttattttgtattccaaatattatgttgtaaatagtaaagaaaaattattcttatcaatgatgaagaaagattttcatactctggtgcattaatatttttctgaaatatattgtcatatcagaaaaaatgcaactatctgaaaagaggattcttccaattttttctataaatatgttctataaagcaattgtactctccaatgccatcttgtggctttttaggattgatgaaaatgcggtaataaacacagaacacagggagaaataaacatgggaagaaaacttctgatgaattattgctcagtgattattttacttgatcttaatactgttcaaacatttatttgccctgatttattgccttaggttttataaagagtatatatatatttctcctatattttgctacatttttataatagaaatgttcattgagatcttgtaaggagataaaaatatcgtatttttatgatcttagcatcatgtccatttgtagccctatattaccagaattcaaattattttgacaagtgcattgatattatagacttattaaaaatcctcttttaatacattgctgtcattaaggtcttgtcattttaataattcaggtgtcgaaaggagaaaaagtcattaaagattttagttgctcactattataaataagagctgctgagaagaatatggaagtgaagatcttgtgtggatagatgtgtgcttcacgacttaggttttcctgctggtctattggacaggccttggaataggagatgggagggcctaggtagaatcaagctaaatggaaagcactagtcatcaggcaaagttaccttgaaaaagcagttacttttatctgcatgtcccaaagaatgaagaccaagagaaattattggtcggcaatgttttgtttttttaaagtgaaaaattttcaaagggtcttaacagttataaatgcgttttcaaacgaaaggcatataatacaccccccacacacgaaaatattagcatgctaccaatgttttcaaactttgataagaatatttttcctgttatgagcactcatctaaaatatgtacaactgtacttgattacgtgtgtttcttttaggattttatgcatggaacctacttcttcttaaaggacaaagtaacaggttgtgtacaccaatgttaacaagcatttattgaattcctagtatataccaagtgcttgataacattgattcacatcagctatgcctgggcataaaaaaggttaaaatgtttagatatttgtttgtagaaacttgccttttgtattctttatttaaaaaacaaacttgtggaaaattttattaatagaaaccaaggcaatatgatttatctttattaatttgatcattcttagttttctatacctatgaatcatatcctgaaaattgtttatataatttcctcataactttgctgatttttttaagaaacatatggagtgcttatttttgtaactgcatgcctttttactttataaaatccatgtatctgtcatgtctttggaactggtggtgctataggcattgtcctttcatattcactagtcagttctaatttattctttgtatttagcaaatgttttcagacaaaacatactgtaaacaagcaactggactgaattctctgggggattaaaaaagatgaacaatctaccacctctgctattaaataccttgcaaaaaataagtgatatgagatatcatacatgtatagtatattactttcctattgtagctgtaacagatcaccacaaatttagtgtcttaaaacaacacaaatttattatcttatggtgatgaaggtcagaagttctaaaatccaggtatcagcagggatgcattcctttaggaggctccagggaagaatctgttttcttgctgttcccagcttctagaaaccacctgtattacttgtcttgttgctccttcctgaactcaaaatcatcagcatagcatcttccagtctctgtaacctttacttctactgtcacatctccttctctgactctgactttcctgcctccctcctgtaaatatccttgtgattacattgggcccaccactttaatccagaatgatctctccatctcatgatccttaacttaatcataccttctaggttccttttgccacttaacagtcacaggttctaggaattaagatatggacatctttggagagtcattattctgtcaatcacagtggtatattagagtagcttttacataaaatagtttgatatggatggaatacatctatatcagggcacagtacagaataagtgatgagggagtgtcaggagaaaaggtggaaaaagatagatgggagccatatcacaaggactttgtatgacatgacaagaaatgctaatattatgctctaggaagtcaggaaccattgaagaaattgcagcagagcttagtaggaataacctgaccagatagattggaaagagctctaagacaagagagtgggaaatgaggccagtagtccaggtaagaaagtcatgaactgagccagtaacagcaggaataaaagaaagagagatggatttgattgctagtaaaaactggaagtaataaaaactagcaggtgattgtacagtgaagagagggaggtggaaggtaattccagctgcttttattaagttaaaaattctgttgagaactagtagctaatgttatatttctagtctatatttttcctggtcaaatacatttttgggttttcaaaatgatgtatcttttgcagtgtggattccgactgacaaattgtacatctgaaataaaaatctgcgtttgggtccactgtagggttctttcaaatgtcttctacccttgtgcctataatgaagtattgtatcaatgggtcttgccttgataatctcagtgaagaacttcaagttaacacagggagaagctttttatttttttaagatgtcaagtttcttttagtatgtagtgctaaattgtggtatacctacatgcatacacacatatgcacatgtatccactcaaatatacacacagttaactattaattcacaaaacacacttgtattgcagctttcctatatgccagttgctgaggattcaaaaacaataagaatatatgatcgctgcattttaaaaatatctgttttatttacctaactaaatagtataagctcgttgagtataaaaacatctttatccgtttttatatgtatacatatatgtatgtatatatatatatatcttttgtaatcgctatgcttaaaagagtcattgcataatcagtactcagtacatctttgtatttcatttctggatttaagaacactgaaaaatctcatcacagcactctctattttcctgtggcaatgtacatgcatgtcataactcttctctgataccagaaactccttgaggaatgatctctatataggttaagttcattaatgaggctttacacatagcattatttgaccaattgttatataagcaaatgaataattttaacttacatgaaatgaatagtttcattagagtttacatttctctgaaaaggaggaattaaagctttatttttagttggcagggtgacctgaccattcatggttattgtgtataatcccctgctgaaattgtaatagctgaagctgaaagcactgagactatactggaaagtgaatcttgagatggcactccttctttagctccaaagggcaaattttcagttactttgttataataggaattgtgcagcttttgcctccttcttatctttgagagattttgccatgtctgtacatatgaaggtcattccatgaaggaagagcagatacacaaaaggactcctgcatggaagcgtggctggaaggagtaaggcattagccaaagcagctgctcaatgtctccatgtctctcagaacggatcataacaaaccctaggaatgctggtgaatagaagtggcctacaacattgagggtgtttaattttaattcagaacataaattagttcaatttggcaacttgcgcattcattctgccactctaactgacatgctgctccgtgatgaacagtgatgacttactgtttgtttcaaaggcatgttttcgctttctttgggagacgtgcttggtttgttttgttcaatttttaatgatacatgattttattttaaatttctttggaaactgctttgtatcctagggtttccggcttcctgtgaattgaggagaggttattaccttctaagttttcaattaggaaaacaaagcaagtttggaagctccgttgggaccttgtaaaccctctcaaagcatgttctgaaagagacaatttttgtgcaactagctctaattgtctgagatgagactatctacagaagctaattggagagtgtctcattctgcagcatgtatggagtcagcagaatagtaattttgctttcttgggttgtttttcctttttgttgttgttattttgttttgtccacacttcctttcagtacctagcattttaagataaatctttctcaatttaaaattacttatctctaatggtaaggctcaggatttccatatagacccttcccaaactctgtgtaataatgttcctaaatcctcaaccattctttagacctaatatggaattagtaagcctttgatggacttgtattcccttttgctttacctggatgtgatattaaattctgtttcaattttaatgtttgtgttctgaattacagctggtaggtacagaatagtatttatcacattttctttcttatgatcaccacctgagtgattacgttgttgacatattctgaattagacaagaacatatgctcaactaaattgatgccttacatagaaacttgcatataatgaatttcatttgtgcagttattttaatttttgattacactttttggttttagttttatgttttctcatgcttctctaaagctgttccatcatgacttaaaaactaagacttctctgaaacttggaaatttattatgcagatctcataattatcctaactagaaaccaggttcaatataattaaggaaaaatatttaaactttatagatgtacgccatttgttctcctattcatcctacatttgatttttagtttatagtctttaataagtggggaaaacagaattacattgacactttttggatttaattggaaggttttcagaaaagctcttttgcatcagactatctcttctacaaatgttctagtgatgactgatgactctagaagaaaactccatcaaatggaaggtagaagaggagtcccaagtaggaggcagctgagaatgcagagtaggagaagcttctgaggcagtgtatcaagtaatatgtaaggacagagtagagacttgtgtcttcctccttcttctttctgtgtccaaggctacactttgccattatatgattttgacatcaaataaaaccagttttcctcgcagtagattgaggcaggtattatgaagaaaaggatggacaatgccagtggattaatggcttaactcagacacgtttctgttgtgaagaaaccttgagacaaagtttaagactgggaaaaataacattaaaatcagatgttttgagttaagaaaaaacatatagatgctgtttgagatcattttaaatggaaacacttagtttatgccaccatgtggttataccacaccatctgtaaattagtgttcaatgacacattattaaaacttatacattcaaactcatggttaattttaatctagatgcctacatctctgcgaattgcaagcatgtaaaactgaactcaacttgcattaatacatgaagagttaatgagaaactgttttcctgtgtatatgaatataaatgcatgttttactatttcatatagataatttatacattctttacatgctttatgggattatgtagttacatatttatatgttataatacttgaattggaatgggtattaaacaagacgtaggcttttaatatgaaaatattaatatgctttaatataaataagttaaatattttttggaaaacaaattaggtattcattgccagcttataaatatgaagccttttaaatttatacctcactttagccaaaagaggttacgttactctttgcaattattatttttaggagaaggagggtatttttctactattgttgcttttttctcagcatttttgagtcaatgggtgaaatgcttttactcagtgctgtttttgcaccaagtacattgttattttacccattgtaaattattctctcaatggtttaacaggctaaacccttaaataagaggtgtctttttttaaagaaaatatttggaaacgtgcaaatgaaaagagtaaatctatttttggtcgggttgtccaaactcttcttaggatcttatagctagtatttgcttttttaatggctgtttgaggtgtgtttaatttaacaagaatatgccagggatttactaaattatataagacagttctttttttcaaaaagtagatctagtaattttatttttcatttaatactcattcaacatataatattttgagttgtctactatgtgatacctactattctaggaacttaggataaaatgatacatgcatttctcatgaagagtacagcctagtgggcttaaataaacaagataatttcataataattcatgctatgaataaaataaaacaagttagcatgatagtgattggcaaaggtagttacttcagatagggaggtctctttgcaaagatatcatttgagttgagacttgactctgaaaaaagagcccattaagtgagaacatgggaaaagctcattccaagcaggatagtgagtaccaaagatatgcagcagtagcaaacaagacacatttaagaaatagaaagatggtcattatggatgacaggtagtgacgaagaatcatgcagtgagtcaaattgtaaagttttcaaagggtgcagagcaatgattggaggagtaaaatggaaggaaatgttggagaattagccgtggccccttaggtcatggtttagagtatgcattttattctcagtgtaatgcaaagccattggaatctagcaaatggaagactgagtatatgatttacattttttccaaagaatctttttttttggctgtggagtaagaagctatttaaatcatcctagcaacagatgacagttaccagatcttgggtattaagtggaagatggagagataaagactggttcgggtacagtttggaagtaaaaccaaacaggacttgatggcatactggatataggggatgaggaatatgtaagggatatataccatataaagaagcacagatgacttctaagttttatgagtaactgtattgatggtgggactatttcctgagatggggaaaattagaggagggagaggttcctgttttcgaaatgtagaattaagttcgagattcctattcagtcttcgagtggctttgtcaaggagtctgcaggcagctcagtggacaggttaataatggatatttaagtggaaggagccattggcatgtaaattgtattgaaaaccatttgcctggatgagatcactcaagctaagtctaagtagatataaaaagtagaggttgcaggacagaaccctaggatacttcaacatttccgtagttagtaaagaagtgagataccagaaaagtgagagagaaaatatgagtgtgatttcatgggagctcagaatgattcaataatacgtaattaaatgtattgcatagagctgagaagtgaaataagatgaagatagaagattgctcattggatttggacacaggtataactatcaataatgtaaagcaatcaatgaatatcacagaaaagcatagaatggtgggtaggcagaagtcaagggagcaagcccagaagtcttatttgcaatatgggcatgacactgcagcaaatttaaaatcttctattgaatgtaaaatgcatatgaattttttttgtatgccactagatagctaaaggtgaacatgtaggccaaatggaaaagcaaaaagaacagaagcatagagatcaaactattttagggaacaaaaactagttaacatcaaattgattgaaatttgcttcacaaccccatatttctcatgcccactgtcctatgagatctattatgctgttatgtaatgaagagctgtgttaattattcctgccacctgcatctaatgaaattagatgtgaaatttctgataggtacagatggccacttgaaaaaaacaatccagtttttcttttttttctatcagctggtcaaatctcataagttagaaatgttcagactataaaattaaccccagcattcttcatttgtatagatactaagtataaatgacaacttcctcaagcccaaataacttgtttggatttagagtttaaatactatccaattaagtgtatcatgctgacacattgtcatttaatactccctttggtagagggttaagcttgttgaattatttcaacttaaataatctgataaccctctcccagtttagttcagttaattttatacaaataaaattaaatctcaaaatgcatataaagtaagagcataatacagtatgtaatggggcataataaagttgccaatattataatgaagcgcatagaaaaagtgtgacctattgtaattagtaatgtgcacctctgacaaattgtaaagcatgaattttcctggtaaggaaaaagagaatgtgtggtaatggtagctaaaatcctattcgttttgcatagattgctatcaatattctgaagctgagggttgttgaagttggaatttagatggttgaatgaagatgtgctctggaaattaggagtacagatagacccacatggtcagataaaggaaggctgacagaataaagaagcaagacatgggttggttacttgagttgtggagatgaatgtgaaataaattgaataagatacaatgattagaaattgatacattaagcctggagatgaatacaatgattacgaatatgttcagacccacatatgtaccaaatgcaatggatgtcagacatctcactgtgaaagcaggtgttgagatgtgcaagacttaaggtaaccacaagctgagagaggagcagaaacatattaagaattctctaaataacagtattaaacaaaataatgttgaagcccagaacgtcagagattttctttataactccctcatatgaggtgaaataacctacttaaggttgttcaactggttgtgtggcctactaggttagaccatcagagacagtgtggtcctccttggatgagttgtttaggagaattatacatgatataaagaaaggtcacagccatgtgttagaaaccgacctttgtgcattactccttctgcaggattccaggggaagaaaaatcaattgctgactaaatagcatatttgaattacagagatcagcaacagtataaatattgcaggaaaatttatatataaagaaacttctatgtgcctttattagttttgtccacacaaaatgaaacaatgtgtgtatatatatatttttttcaggcaagcacccaattgaatttcagaaatcagaaaacaaataatttaacctttctttttaattcaattatattgatttgccaaagaatcactctctgataaataattttaaagtgtcaactctctgaatattgtaaaatatgtaattttgggtaaatttaactacatattcttggatccttaccattttcttctcttgaatataaaagatttagaatatgtcttgatgattttttgcttgttgtaattaaaatgtcaaacttaaagttgttaaaatgtacatctctctgatactagtaattcttttctcttttaaaaaacatacttatccagtatttaatttcatatgtctagatttgcttaggcaaaaggtagaagtgcctgctcttcagtttgcacataagctaatatagtttaatatatataaatgaatgtgtataatagaagtatattcataagttagaacgtgacatattacctaacataaaacaaataaaacagataactcagtagtttgaaagggaagcttaagggtaatactatacatatagtgtcataacactatcatgaaaatctctgttaaacgctgtctcctcaggcacattctgttaactcttcctaccacacttgtcacattacccagtttcattttcttgacatcacccagggccctctgaaagaattttctgtattaacatacttgtttaatgttccactgtccatataagaatgtaaactcagtcatagaagatttttttttcttgttcacttctatatcccgagcatctcagaacaatacctggcatatgaaagatgtttgataaataccaatgaaattaatgtttgaatgaatgatagcatttctgtttcgttgtatttttcattaaaaaattcaagtttctctcaactgatttcagatattccttcttttctaacatatgcatgcagcactatgaatttccctctaggtgctgctttcactgatccccaaaactttgattattgtcatttgttcaaaagattttaacattttttggaaatgtcttttttgagtgtggattatttagaaatgtgttatttaattgcaaatacttggagattttccaggtatctttctgttgttgatttccaatttaattccattgtggtctgagataatacattgaatgatttctatccttttaaatttgttaggttatgctttattgcccagaatgtggtctatcttcatcagtgttccatgtgagcttgagacaaatatgtattctgccattgttagatggagtattctataatgtcaatgagttaaaaatgattgataatgtgactcaggtcatatatgtccttaatgattttctgccattttaatctactcattactgatgtaggagatgtttaagtcttcagctataatagtggatttgcctgttttcagttctatcagttttggcccgtggagcttgatgtgctgttcttaggtgtaggcatgtttaggattgtaatgtcttcttgggaaattggcccctttattaagtaatatacctctttattactgataactttgcacatttggaagtctgaaatgtcttaatacattaatgatcttaaataaactaaaactccagcttgcctttcgagcactgcacagtacagtagtttctgatctttctgttttgcctctcttagtgtggaatctctgccctgcaaatgagctgagtcccgagtgaatcaggacccacgtattctgtcctatgaaggctgagtgcaagaggagattacctcaacttcttggttgcactcacagtgattttgcttcttgaaattggaattagaaagaaagagaaatgctagcaaattgctcctcctaatgagttacggtaatctttgattgggaaataaagctagagagtgccccatcttcttagccatatccattagtaattgagcttttgcctagttgagctgtgtggaaggttgtaggaggaaaggagcagataatggttcaaatgccacagactcccactattctaactgaattttagtatgttttcttgaataaatgtttcgttcacttactatattcctttggggcaattttcaggtttgtgtgtgtgtgtgtgtgtgtgtgtgtgtgtgtgtgtgtatgtgtatgtgtgtgtgtgtagtttttaaaaaactgatttcacaagttttgcttgtttcactagggaatggtccatagagctcatcatgctgtcatctcaaaagtggatctttccaactttcctttgattagtgttagtatggtatatctttcttaatcattttgtgtgtaacatataggaatattcatgtttaaggtgggtttcttgtacacagcacatccttgtgtcttgattgtcttaatccattctgaccatctctattttttaattggtatatttagactaggcccatttattgtgattattgaaatagttgggttaatatgtacatgtttgcaactgttttctatgcatttgttctttgtatatttttatttcccctctttttctggcttttctggctttgattgagcatttatatgatccattttatcttctctcttagcatatcaattatacttctattttaaaaaatcttggtggttgccctagtatttgaaatatacattattagctaatctaagtttatcttcaaataacagtatactgctatatgcatgctgctggtactttataatacagtgatctcaaatttttcttgtattacctatgacactgatattattcacataatttaccctcatactatatttacctaatacattgttactattattaaaattagcagttatataatataagaataataaaaacaaaatactttaccttcatttatttcctcccttgatgctcttcctttatgtagagccagatttataacctatattattttacctctgcctgaaaaaacatttcacatttcttgcagggcagatctgctatgatgaaatccctcaagttttgtttgccagagaaatgctttatttcttcttcacttctgaagtataatttcagtgaataatgaattctagattgatgttttttctttttttattgttacatgatagatgtatacattttaggggcacatgtgatgatttgaatacattcatagaatcaaatcaggataattgggatatccatcaccttaaatatttatcctttctttacagtaggaacattagcattattcttctctagatattttgaaatgtataatagattaatgttaactgtagtcaccctactaatttatcaaacaccaggccttatttcttctatttatctgtgtatttgtacccattaatcaacctcgcttcatcccctcttaccccaccctgcttggcctctgacaaccattaatctaccctctatcttcatgagattcaattttagctcccacatatgagtgaaaacatgtgatatttgtcttcctatgcttgtcttattttacttcatttgatgacttccatttccatccatgttgttgcaagtgacaagatttcattcttttttatggcagaatattaatctattgtgtatgtatgtgtgtttatgtatatatatatatatatatatatatatatatatatatatatatataatttttttcttaaccattcatccattcatggaacttagattgaatccatattttggctattgtgaatagtgctacaataaacataggagtgcagatatgtctttgatatattgattttatttctttggggtgtatgcccagtagtggaatgctggattatatgatagttctatatttagttttttgaggaaactccatgctgttttccgtagtggctgtactaatttacattctcacaaacagtatatgaggttttcgcttccttcgtatcctcgccagcatctgttagtccctgtcttctggacaaaagctattctaactggtttgagatgatatctcattgtggtgtttttaaagtaattttaacctttattttagattcagggggcacgtttgaaggtttgttatatgggtatattgtatgatgctaaggtgtggggtacaaatgatcccatcacccagttactgagcatagtacccaacagttagtttttaacacttgccctccttcctccctccttcctcgagtagtccccagtgtcttttgttgccatctttatgttcatgagtatccagtgtttagctcccacttaaaaatgagagcatgcagtttttggttttctgttcctgtgttattttgcttaagataatggccgccagctgcctctacattgctgaaaaggacatgattttattcttttttaatggctgcatattatgccatggtatgtaacattttctttatccaatccaccattgatgggcacctaggttgtttccatgtcattgctataatgaatagtgctgcaatgaacatacaagtgcaaatgtccttttggtagaacaacttattttccttggggtatatacccagtaatggaattgctgggttgaatggcagttctgcttgaagttctttgagatatatccacaagctgctttccacagtggctgaactaatttacatttccaccaacagtatataagcattcccttttctctgcagtcttgccaccatccattgttttttgactttctaataatagccattctgactggtgtgagatggatgtatctcactgatgcctgttcagttctcaataaatctcagctattgtattgttaacagtaacaataatgtaattatgaatcccagtgtaaattatttgatatataaacctaagataaagacatttattcaattatacatatatgaaatttgacctgatagctcttcatgaaacttataacctcttatctggaattattgtgatggtaaagggatcaccattttaaaatatatactcagtgatattttctagaaatatattataagcaacaattgtataaggaagacacaggaaaaaaaatcaagtttttcttatgaccaatgtcttcccactctaccatttctaagacctcagatactggatttcatgtactgtaacctatgagtcagtaaccatcaactcccaatatcatttcatttgtagtaggtccaccatgtatcaggcagacctttcacagtgatagatagtatacagaagctaccatgctgagatagcaacagtttgccataatctcatgaaacaccactaataggagactgctggcagagtcaatataatgcataatgtgcttagagacatttctgaaccaattgtaccagtcatacatctagcacagaatagataagtaaatggaaatattgactttgacacaggagacatgttttaaacaagaatacccaagctggataagatttgaggtcaattttggtaacttttaaaaatatccctgtctaagtattgtgacttttgtcccaagtgcacattactagtcactttatcttaggatacaggcaggtagctaagtaattaattcttaccaggcaggttctgctaagcctcctctggaagatgacctttttaaaatgttgacctcacatatagctgaatgatggatgtgtcacttactggcaagctcttttctgttttgatggggagtgtttaagatcattggacttgtagtccacctggtaaatggtgacaggattgtgagtctggatatgattgagcagtttagtaatatatataattttcatgactgtctgaaatctctagacaccttttcacttttgatcatgatttcaactgctgccgcctgaattacaaatcaaatgttagaacaatacatcatgatgctagaggcatagcttaggcatgccagcaagccaaatattgagttttgtgaggggggttgtgaaagacaactttttacctatttggaactaacttgaaagcatagctttagatttacaaaaatttaaggacacggggattgctattttgttaaggcttgtttagggacattgaaccttaaaagtctcaattttgaagaagtagtgattaatatcatttgggacaaacaaagattttagagatgaaatggtaggtgaccttgaatttgtaatttgtttgcagtgtatcccaattaagagcgtggaaaatctctggttaatatcaaatgtaagtactctacattgtaaaactggcagtaaagatgggaacatctctgtaaaatagttttatcaaatgagtggcttagtgtaagaatttgatttaatttatatatatacattatattttatatggaaatacaacaacataaatacatcaaatgtgctttcatcttagactctgaaaattggttaatgcctgaaaatttctgaagtcctggttgaggtttgctgtttctcaggtgacttagggctaaggatttataacttgattctaataaattctgtatgtaaaataggttaactttatttaaaaggtctcatgaaatttttaagtgattataggacttacacttaagttcctgagctaaatttcttctgtcttataatctgactgatgtcttcagtatgacctctagcttctgaacgtccattattttttctcccgtacactctagtttctctagtactatcttgagaaattacagaacaggtatttgtgaaatattggaagcatgtacatagttcctgtgttattcatattggggatcagtaaaagtattttaaagctagatgtcatagttttattcctctgtctcctcgatatttactccaaaaatgcaggaactctacaagaaccatggaagcatgctactatgtttgtgtttatatgtgagttacaagtcagtccctccaaacacccactccccaggaaatatacctggacatgttcatcatcttaaaactactctgatattatactataaaaataatgaattattcccttaaagaagtatagatgtgtctgagaaaataaaaacccatgaatcttcggatcctttaagaattatttttttggaatcttgatatgtcaagtgattcaaaatgtttgttatatatgtgcatgtttgtgtgttgcagacaagataattatatggagcaagctaattaatttattttttcttattaacaatttcttcatttactgaagggtgttttaaggtaaatatctttattacaactaaaaatgtactgaagaatatgtcgtaatattagcaagatttgcctaagcctgtataaccaaattggctaaaacaaatatatacactcttaagataaactaaagtgaagtttaagccatacacatattgttatgaagtctaaatttttgtaataagaaataggaattcatcactggcaagagatttttagttgtaaatgcttataaacattttgcaggtatttaaaatcccatttagttatataaatcattctgtggaaaataataaaattgtgtaagatcagaattgttccagaaacctaggatgcaggttactttttaaggataactccagaggcaaaattaaatatactcattatcaggttttatatactcattaatatatgtatatgtaacattaagaattgcatagttttttccatttataccaagggaaacaaattggagcttttaaataaagtctttgatttattatattttctccccacagataaagaacttttgttctatttttacctttgtgattactgcataaacatagtgatatatatatatatatatatatatatatatatatatatatatatatacatgtactgtatctacaaatgaaagaacatttaatggaattaagatactttatcagagaacagtctatgtttactctataaaatactacctactcaaattatccttttatattctcaatataaaaatgatgaaaacaaaatctacaaaatgtatgaagataaccatttgggggttttgtttttagtttgttcaaatggatactttactccactgtggaaccagtgggttttgtccctgatgtaacagtgatatttatataattaaatgactatttttgaaaatgaccctcaagataatctatacctgcttcttccttataagtgaggaaactgatgtctgtgacgatgaagtgactgacttaacggtatgcatctaattggttgcagagcctggattaccacttttgatgtttctcacttacctgagcatcagtgacatatatcatttggtgcaatgctggtttacaccactcactgcttcatctacctgccttgttattcaaataggaacaacacattatatcatgggattaatacaaatagtaaatgtacatattagtcaggaaatcagaaatcatttcaggttttttaagtcggaagagtttcaacttaagaaattagagaactacataaccaatggaaaaactgaaaacagagaggtcagggaagctagcatttgagttcacgaaatcagaatgttggatgatcaggaagccattgctggctatatgtgcaccaaagtgggtggttcacaggaggagctcactcaggagctgccacggactcctcatctgtcatctgattttgctacagctgcccttggaaactaatggcccatttttctctcaacccccaaggaaagtacaaatgcttcgagttggctgaaacagttctggaatatacaaggaaaggagttacagaaaatgtagttacaggtttccccttgtgatagagagtacaaaggggccgtaatgatgctgagttgacaataggcaacatataaaccagcatgaaataataacaccggacgctgtcaagcacagagaggtgtttggtaaaaaatattaaaagaaatataactaaagccaatgcctgcatttttaaaagaacaaatttaggacaaattgaaacattttaacttgatttgaaattatctaaccaggaatggttaggcatttacttgaatttagatttaattaatacatgcacatgtatacatataaaagttggagaagtttcatgatagttcttcttgtttgtggggtgtttgtctgaacattatctatatttactttgttcctagatttttttaatggagaatatccattcagtataacattcaaaggttcttgggattaggatgtggacaaaattgagggtccattactcagcctacagcagaaattgtagttccagtaacagtatgtaaaattacaaaaatcttttaagtttcccaaagacatttctcagtgtactagaacactttctaagcagtattgtcagtgtacacagaaatgcagatatgtatggtaaagcagtacattgtgatgtgggttatttggacttgagtcattttgcctagacaaaaagaaacttttttcctttgcaagtaatattaccaaaatatttcctagcctcatttgatctctaagcttcaccacacccctggctttcttcagccctagtgtaaggtgagtaatgggttgtgcatgtaaagataatgcgtaccacggtgtaagggccagaaattgggtgaagtttactgatggaaggggttatttcttacacattgcttcagttagcatccttttggtcagaagaaacaaaatctaaatcaaattggcctaaattatgacagagatgaatatgtttattatttaaccaatatacacagacacagggtcggctttaagcgtggttcatagtttgagttagaggttttgatagcattaggtctccagcttgattcctctgtgattatgttggctctgttccctgctttcccctcccaccatccacttagtttgttttggggtgatatacgattgacttggaagatactaaactgtacacaggaagggttccctcaaagagctcctcatcatgtacattccagaactctcctaaaaaggattcatctgcagtctcatagtaccttgtctgcagtttttccttaacctcctttaaatcaaattttatattagttctctgtgtacacattgataatgacttgttaaaccagggtttagaaagcagttgcctgtggaacacatgtggcccacagcgtgtttttgtgcagcccacaagctaagaaaagtttttccagtttttaaaaggggtgtagaaacaaaaggaaaggaataagtgactcagacctcatgtggcctgaaaatcctaaaatatttgctatctgaccttttatagcaaaaggttgccaacccctgtgttagactatcagatacaaggaactgtcttattcctgacacattgctgttgtgcctaatgcagttgtttccacatagtgctgtcatccttaaattgttcttcccatctaccctccttggtcaagcttttctgtttcattcggggaggacatgttgccatgggatatcttattaattcaggaggggaagacttgtgggagatggctggtggacatagatgagataaaaattctcaccaatgataaagtatctgggaactaaaaggaccttgaacaatgccctgtccaactgcatcttgctacagaagaagaaataaggacaagggatggaaggggtgtacccaaggccataggtcataatcagctgctaaggcatcatcaggaccctgcatcttggtccagtaccacttccaccaacccctgttattttttgtgacacaacatcttttccttataaccaactcagatatataccaagctgctgtatccatgcgaggaccatccgagactgttcttttaacccaagagtttcccagaattccatagttactgctgaaaagagtgagagtgatcaagaactttcttaaaaggattttctctttcattgtgtttcattttcttcaacccatctcataatacctcttgagatttctatagtcctttaatgctatgtccttgttccttcccggtagttatatttcaatggccctagcttcaagatgtctttggctgctttctaggagatctcgttgatattatctcatttatttattgaataaaggtggtgacaaaaatgtaccagatcttgacggtaacttatgtgattgttcattcaaagattgctaatggcctgttaaagcccttagatttattaatttcctcatatctcattctccttgattgccctctcattccaactattaactggctttgtaactatagctattatggtacttcagtctccaacttgccttccgatttttctgatagctccttcccccttcttagttctaattttttcttccaccacctaagtatgataactcttagtatatttatttcctattactgctgtaagcattatggctaagtgacttaaaacaacagaaatttattgtcctagatttctagaggtcagaagtccaaaatggggtatatgggttaaaattaaggtgtcagcacaactgtgtacttttggaagctctagggaaaaattaatttccttgtcttttctagcttctaagagaggcctgctttttttgccttgtggctccttcctccctcactccaagctctgtttctgtaatcacatctcctttttctgactttgaccttcttgcctccctgatcacattgggaacactggaagaatccagaataatcttcccatctcaagttccttaacttaatcacatcagccatgtcctttttgccatgtaaggtaacatgttcacatattctaaggattaagatgtgtacactttgggggccactattctgcctagtctacttagattgccaccattggatctcagttgcattttatttttcaatcttactggtaccctctgcctgtttaaaaatgtaaattgttttacaaaagtatgccttgattcataaaggttatttatttgcatttcaaacttgttttctgtaaaattattccaatcgattcttactttaatttacctacacctcaatttaagctcctattaccacttgaattgattccattcaaataatatcatttgaccccctgatttcatcatctggaccatctgggtactccaaaagagtaacctaaattacttttcaaagtttttccctttactttatgtattctcaacatactttattctctcccattgctatgctttttctttggtgtctgaaattccttctttgaaaactctagtcagaatttcttatcattattcaaggtctgtatctcaatggtgacttcttcaaattaataattatttataccacaaatcctatgtgtctcaaccccttttaaattctgcccttccccctattgaattttgttattgtatctggcagtagtcatttttctttgctttgtgttttatgtaactgtgtagtgttctgtcctatcctcctaccacaccacccagggaagagaaaacacatcctgcccagattcatatctcctaagtcctgctccgatgttttgtacatcaaagtataaataatagcattactgtgatgttatttaaaattacactgtatgtggctgtgctgatttaagatatgtgttgaagaattcacctgccagccaactatacctaaatgactgtctcctgaatttatttcattaggagactttttctgattttaagaaacaccttctggcatagcttctgagttatttttgaaaaccctattatagttatgttggatagatcaagtaatccagggtatgttatgcaacataccctttctgtatttgtgtattcattagttgcattcatattgactgagaaacactgtgccaatgttatgaagggtatgcagatgtgtatgccaaggtggctgtcttctaaaagcttccaggaggatatgttccactgtgacttttccaactacacaacagcagaattctagcatttagcatgtttgtgaaactcctagaggcaattaacacattatgtgacagaacctagctccttaatggtattaaaaatgcttttttgaggccaatgagaacttgatatacagcaggataattctttagaagtatcttttatttgacatttattagaaatgaagttgtcatgaaaaggcatggatgtttatatgctgctataagatagtcatctcagcaggcattttgatcagtcattacctttgacagagaatggcacaatagcatgagagcctgcagagctttctttaaagatggttcatataataggggcatcgtgatacttggagtattaatccaatattgagggaaattccgtgcccctaatgcttgaatatctatgcagattttggaatatgtcattttcagtagctttgacagatatgtaaataaccatttccccaaacttcataattgcccatgtcattaatttttctttttactgttgcagaacattttcctctttacactcaagaggataaattattattgtggttccatttcattggaaagcatacacctgcatatttgagaatctttaacatttgaatgtataatatataatataattaagtaaatcttcaggtattgaaaatgtacttttgaataatcacgttggcctcctgataataagcagtgaatagtaattgattagattagtatgctatttttttgaatatagtagcagtgactcaataaggtttaattgcattcctgtaaacatatggatggttcaagaattacttctttgtaaataatataaattggtaagactctgaagtgaatgacacagatttgatatagtaagacatttgaatttcagcttctctgagcactgatactatttcatcattgaaatacaaaattatggaaatgctgaggaagaatgaatgcttatttataggcacaaatcaccaatattaagctgttatcaaaatctttacctaaatttgttggttgcaaagttctgtaataggcttaaaaatgtgcagtgttcagaaagtaaattcttatttgatttgccagatgcaaataatgtatttgttacgttcattcaattattaaagaaaatttatatcattcttcctatcttgtagggttgatatatattacttggaaatgtgagacaaacgaaatgagtgtaaaccctaagaatatccattggtggactaaaatgtaaattttaatttctgtattctcatgtagcttaactagcatttagcatgtttgtgaaactcctagaggcagtttccacattatgtgacagaacctacctccttaatggtattaaaaatgcttttatgaggccaatgatgtacaatgtacaataatgtacaatgtttatatacattgacttgctaatttattaagtatccacattttagcctcttagacctactctgaagttgacttaactttcaagatgaacagtcatttttgacaccctgccatccccttgcaacagagaaaggtatcctgatttttgtgattctctggcacctaatagatgcctcagtgatatagtgttcttatgggaaggttatattgtattttaaaacatgaaaataccagaacagagtcaggatcatgaagccaactctttaggggggtacattagctggttctaaaaccttttacctgtagaatccctattcttgctcccagatgctatattgttattgcagacatggatgttttagctccgttagcactggagacaagcttccctacaccatagtagtaatatagggagagagaaccagtacatcttgtgtgaaagtttctttgcatattcaagtagtttcagaggcagcccaattataagaattaggtctataatcttaaatatgctgtaaagatcattaattatctgtgtaaatattggagaggatcagcatggataattaaattgaatttatttgaacataggcagttttcacattggctgttgaagttgctatttgtgcaaaatatataatttactataattaggacactttctgagaagttttttttgatgtgccatattttcatgctcagcagaaatacatataaagcataaatattttcttcagctacatatttttatttaaataatctccattattttaaattcctaaacatttatattatttaaaaacctgaactaatctcattcttaactaggtttgtaggctgggagtgtcagagctatgtataggaaaatttgctgtctttttactcattagtctaatcaagactagaatagactacgttgagtgtttactcatattacagatgggactaaaaatagaagatttccaaattacacatttaatatgaaacaggaagtgattttgatgtagactatgtaaaagttttcttctgactttattaggttattttttaattcataaaaagaacccccaattgtcttgatcttttttctaaaatttgaacaattaaattttacctttacctacagtggctgtgaagaggatctatattacgtggtagttatttgtacatttaattaatttctcctgtcagtaggactgaaaagttttattcatttatttgtacttacagcaaagataaagttagagaagtaattaaaatgtgggttgttttgctttcccacaaatattgaatgtcattgacatttttgtatctcttctgttagcttaattaagagttgaattattttaagcaacagttgtatgttttagtcattctaaaagtttaatctacctgtgaaaatccacttttcacctgcggtattatgtcaaattgttttctctaataacacttttataagtacagtttatctctccttagcagtataattttgcaaatgtcttgaaagtttctgatttgtatgtgtctccactagtttactcttcttttttttgacctgggactagatcttagaatggtctgtacatttagtaatactcatcattttgctacttttagagctacatcctggtttcattgtcgtaaattgaaagataaatttagaattcatcttgccaatgagttcagacaagaagaacatcaaagtcaacatttaatgtgaggaaattgaatataaactagtacttttcatgaaatcgttatatgtgaacatcagtctatatgaagtcccatctcagtgaaatatctaacaaagtatggcctgttaatagtttcactatcatttcaagtaattttaaaatataacacgtttctagcattataaaataatttagaatataaaaggctcctttccatgtgcttattgccatttgtatattttctttggataaatttcttttcaaattctttccccatattttaatttggttgacttgagagttttttttagttgtccctagactatttgttgaaaagattattatttcccacattgaattgtcttgttagccatatcaaaaatcagttgactgggatttctattacctcaaacattaatcgtttacttgtgttgggaacattccaaatcttctcttctagctattttgaaatataaatatgtacaactattatttatcaataaaaaatcaattgactataaatgtgagggtttattttaggaccaccgatgtctgttcttttgttcataccacacactcttgattactgttgctttccagtaagttttgaaattgggaaatatgagtcctccagttttgttcgggttttcaagattgtttttgctattcttggtcgctggtaattccagatgaattttaggcacatcttgtcagttttggccaaagcgatgctgagatgttgaaaaggattgccttttgatagggattgctttgtcaatcaatatgaagggtatttccactgtaatagtgttaaatcctttgatccatgaaagtggatttatttaggtctttaatttctgttaacaatgttttgcagttttcagtatacaacttttgcacttcttttttaaaatttatccataagtgatttattatttttgatattattgtaaattaatttgttttcttaatttcattttcagattgctcattgtaagtgtatggaaatcaaattattctatattaattttgaatgctgtatccttgctgaacttggtttttagctctaataggtttttcatgtatatgtatagattccttagtattttctgtatataaaatgatgtcatctgttaatgcctatagtttttcttcttttccattatagttgcctcttatttctttttcttatctaatttccttggctaacgtctctggtacagtgttgaatggaaatggtgagtgtggaaactcttgtcttcttcctgatcttaggatccagccctttaccatttagtatgatgttagttatggttttatcatagatgccctttatcaagttgaggaagttcccttctgattccaatttattgaatgctttatcatgaaagggtgctggaatttttttttttttttttttgagatggagtcttgctctgttgcccaggctggagtgcagtggcacaatctcggctcacttcaacctctgcctcccaggttcaagcgattctcctacctcagcctccggagtagctgggattacaggcacccgccaccatgcccagctaatttttgtatttttagtagagacagggtttcaccatgttggccgggctggtctcgagctcctgacctcatgatcctcccacctcggcctcccaaagtgttgggattacaggcgtgagccaccgtgcccggcctggaattttttcagattttttttttcatcttttgagatggtcatgtggttttggtttcttattcttttaatatggtgtatgacattgattgaattttagatattaaataagccttgcactcttgggaaatattcctgttggtcataatatatgctttttatatactgctggattctatttcctattattttcttgaggaatttgcatttatatttattagggatattggtcagtagtttttacttcttgaattgtctctgtctggttttggtatcagagtagtactggcctcatggaatgaggtaggaagtttatcatcatctttgatgttttggaagaatctttgaaaggttgatgttaattcttttttaaatgcttggtagaatagaccagtgaggtgtgggaggtttaaattttatttgtgtcaagttttaagttactgatgcaatgcctttacttgttacaggtctatttacattttttgtttttgttcttcagactgaataagttgaattaatctattttcatgtttgcagattctttcttcttccagctcaaattggccatggtgtatctctggagaattttttgctttagttgttatactttacaactccagaatttaaatttgcttcctttatttaatttttatctctttattaatattctctggttgatgagatacaattattaagctgtcctttatttctttaactatggttttctttagttatgtgcatattcttgcaatcgctgatttcaagtctgtctagtaggttcagtacttgggctccctctgcaacagttattattgatggcctttttcttgtgtatgggctatacttttctattttgtgtgtatgtgtctcaaattttttttgttcaacatgggacactttagatcatataacatggctactttggaaatcaagtctgtcctcctccctgaagctccagggtttgtgtagttgtttatttgtttagcaactttccttaactaattttgcagagtctgtattcttttttaaggcacagccactgaaatatcttcttggctaattcattgctcaggtaatgattgagaatttttaaaaatgccttgaaccagtaattctcccaacctttgcccagggtttctctctctctctctctctctctctctctctctctgtgtgtgtgtgtgtgtgtgtgtgtgtgtgtgtgtgtgtgtgtgtgtgtgtctgtatgtgtaagcacattttcaatattctggcaatttacaactctgccttagccttttcttccaacttgtgtagaggtgggagattaaggtgatctcacgtcttttctgggcatgactatagctctgaacttactcacagcctactagatccccagaaatatttcagagctttgcaaggcctcctatgaccatctcattttatagatttttcttttacattttttgtctatcttcttgtttgtcccatgtggcttcaccacctaaggcagctgcaaggctaaataattgagactgatagtttttgccatattagggatagaactttcctcattgagcaaattctgagtcaggtgaaataaagagaaattcttgaatggggtttttcagccagctaccagagagataaaatagtagtagttctctggggatggagctttgtgacgagctccaaaccagtttgtcctctttattggctcctaggctattgtttttttcaaggctaatacagacttggggaaagagggatggaaatagggaaagttaaaatataacagtgtttgttatttttactaaaagtcagccatttttcttgaataaatgctgttcagattgttgctagattttgtttaattttcagagttctgaaaaagttgattttgataattttctggatttttttatttcatggaaacaagaatttcagagtttcatactccactattccagaagtacttctcattttaatatttttgttttctttatgatataatattttgacaatttttgattactttgtacttaactttttaaaaaagctattaatggtttcagttttttaaataattacaatagtgcttcatatgcttgaagtacttattcttttttattattattttatattgatataataattgtacgcatttattgggtatagtatgatattttgatacatgtgtacaaggtgtaatgatcgtcagcgtaattagcaaattcatcaccacaaacatttatttctttatgttaggagcattcaaaatctttcttctagccatttgaaaatatacagtaaattgttaattctagtcaccctgcagtgctatagaacactggaacttattcctcctatatcaccgtatttttgtatctattaacaaacctctccatatcctccctccctcctacccttcccaacctttggtaatcactattctcctctctacttctatgagatcaatgtctttatttactcgaagtactcttaaaagtttaggacttaagtatttgaagaaattcacttgctttttgtttttattctactcaatactttttaatataaagatttacagtcccccaaattctcttttcagaatcttaatataattattcatttcgtcctgaaaactgtttctttccaaaattaaacatttgttgtcatttaataaaaataaaccagaagtagaagagctggaaaatccctccaagttcatctgaactggagaaaaatcaagtctaaattactaaatattttgaaaagtacagagttttattacagtaaactttgacaagttgcctttatttggaaaagaaataacctatttttctatattctattttagagaattaaaatacatttaaagccttatattgggttggtcaaggttttttttttttaaaaccttagtagtttatttttgtattcaaagtatcttccagcatgtctgttaaatttcttatttttttcaattttttttttttttttttagattcagggggtacatttgcaggtttgttgcctggctatattgtgtgatgctgagatttgggatacaaatgatcatgtcatccaggtactgagcatagtacccaacagttagtttttcaaccctccctacccccttagtaggctctagtgtttattgttaccatctttatgttcatgagtacccaatgtttaacttccacttataagcgagaacatgtggtacttggttttctgttcctgcattaattgacttaggatgatggcctctagctgcatccatgttgctgcaaaggacatgatttcgttattgtataaaaaaccatacagctgcatagtattccatggtgtataggtgccacatattccttatccagtccaccattgatggggcacccaggctgattccatgtctttgctattgtgaatagtgctgtgaagaacatgagggtgcatgtgtctttttggtagaatgaattgttttcttttgggtatatactcagtaatgagattgctgggtcaagtggtagttctgttttaagatctttaagaaatctacaaacagctttccacagtggctgagctaatttacattcccaccaacagtgtgtaagtgttcatttttctttgcaaccttgccaacatgtgttctttcttgacattttaataatagccattctgactggtgtgagatggtatctcattgtggttttgacttgtgttcctctggtgattagtgatgatagcacatccctttagatcaataccaattcaatataattcaaatatctatatttactgaatgttatgatgtaattgagtttcttcacaatctccacaatcctttagaaaatttctaagctttaactaccttctatagatttcatgtacaacatgtaacataataagggatagcagatgaatggacataaaaagcaattgggccttttccccgatatttcatgtgcaactaatgaaggagaaatagactttgatttaaaatctactggtgacttttatgtaatgtagtgggcttgagaaactttcagtatttatgggttcaaatatcattttataattttaataatgcatttatgtaaacattaagttaatgttttctgaaaagtacagcatgtatttaatgcaataaccactttcaaattatttattgaggtgaagttttcttgtaatgaaatgtagatcttgagtgagtaattcgttaagttttaataaatgtatgcatatgtgtaactcacatcctgattaaaagattacatttctatcactccacatctttacttcatgctccttccagccatttcctaggtacacaccaaaggtaaactacattctgatttctattaccatcaattaattttaactgctctagaacttcatataaatggaattataccgtaggcaatttttgtgtgtatcttcatttattaaatttaatgtttaaaaaattcatccctcttgttaggtatgttggtttttcatttttatttctttattgagttttttcacataaatacacagtaattttttattcattcttttggaatggagatttttttggatatggcttcaaatttgggactattatgaagaacattcaggctatgatttttcaaaaggggcatgaagtttaaacaaaaagccttcttataattctgtagaaagtgggtaatgtgtgagtgtgtatattatgcattaatatgcttacaaaaatgatatatatacacacatgctaaatgtctaataataatagtaattataatgacaagtaacatttgtttatgttcgctttgagctgggctcttgcataagtactgtacatgtttcattccatttactcctcacaacaatttgtaaagtaggtaaattaccatattatctctgacaagtagactgtgcattttggaggataagtgatttgcctaagatcatgcgcctagggagcggccaactggggatttgaaatctagttcttacactgtcaggcattgtactatgcctgctacttcctaatagttaacattatttgagctccactgtgtgccaaatatctgcatgacacacacaaacacacacaccgataatacagtgtagaaagataatctatgtaaagattagcaagggtgcagtggaagaataccccacatagaggtcatttcctcttcagaggattaaggcaaaggccaccaaagtgacttattagaggcagaagccagtcagaagaggtataatgtttgacctacaaagggcttaaaacttatattctgtttgttgccaacatttaaaaattaggatatcacgttaatatctggatttctggcatcctcctacacatcatgatatctgaaaaccttgcccattgccatggtctgaagctgaccctcaactacttcccttgggcctgcagccagccttgatggcttatgctttctgaagagaggaatatgagtttatgaatattaaataattttttgaggagtggctttaagctttaccttaaagaatttcaatagagatttccaggctgtgtgagggaatagtacaatgcaaggaaagaatggcacttgctgggtgagctgaaggaataggaattaggtgggaactatctcgattgcccaaaatccagcacagtggggggaactaatcagaacataagatctgaccttaatatcttaggaaattctatgttttgaaagcttttatagaggaatgacaaaatcagagctttaattttctaacaggccaaatgcagcctaaacattgcttattccagaaactgtcatttaagtgtggttatttgaattgaacatataggctgaaatgcaataaaccgccatttttgtaggttaaaaggaataaagtatcaagtacatgcagtttggcattacaagtttgcctagtagcactttaaatgagtcactaatttaatatattatttcttttataaagttcatttatactttctgaaccaagacagtggagctggtacaaatatacactgtaatgcctccctatttgttgtttcctttaaatctttaaaatgtgtttttatatttgttttttgagatgctgaatttccataatatttattagaatattatatgtattgagatgatatttccctatgttagggagaaaccatttgtgttatataaacaaacaataaagttgtctaaaaatagaagatccttttggaaatgttgatgcctaaaagacaaaattatgtggatgaacatacgtaagcttcagtgagcttttcttgtactaggcatttagctgtcttgcaactgttaatcagcacaggccttaaaacagctgctatcagattaattagagggaatccaggaaataattcaactgaatgtagcattcatgtaagtgtgttgaaggcaattaagagtaactatagtcattactgagacttccaggaagtatgccaaagggcttgaaagttataaaatgccttttgcttcccaattttatatatatatatatatatatatatatgacagagagagagagagagagagacagacagacagagagagagagtccatatataaacacacactaatagcaattaaaaataaataaaattgaaaagcttgaattacagggtgttaactcacttctctctttgaaattaaggggccaagggaaaacaagaccatttgtctaaattcatttagaaagaaaaggatttatttaaagatgctgtggcagataaaattacgtttcatttttgtaatcctagttttcatagccaatgaaaggcttaaaataaaggaagttgatatttcaccaaggtcacacgatctacgagaaggaaacttaagaaagtttcctaatgcgggatttaaatccttaaaaacttgctgtggtcatcatcggcatcatcatcgtcatcatcatcaccaccaccaccaccaccactgctgccattaattattattattatcatgacacaaaggttgattacctggcatctcatctcatttctactgttcttaggtttcttgcctgtcttactgaatgacagtatgttactcaaaactcagcatggcaaaaaatctgggttttttaaaaccaattttgcctgtggttggcaccttgaaaaaaaacgagagaccaagaaagagggagccgaggatgggagtggaagataaagatttaaaagaataagtattgatattcttttctctttatttttaagtgacaaaacttatatatatttatggcattaaatatcatgttttgatatgcgtatacattgtggaatggttaaatcacactaatataggcattacctcacatacttaatatcattgttttgctatttaataggtctaaaagctgaagtcagagaactcatttatttatgagaattttggtgtgcaactgcattttgctatgtgttacagtcttttaacctacttccaaatctcttcttaaggatgagctagaaggagagactggctgacactcctcatttttgaagccttggcttttataaaaggggccttcagtgtagcaaaaggcctacttataattctgtaaaaagatgttcatgtttttcaggaacgtttgtctctatttagaaaaaataaaatgtagtttgggaatagcggaaatgattgattagagtgttacacatgagacaaaaagatagatgggcaataccgttcctgtgttttcatgccctgttcctcataagcaacagggcaagagatgataattcccaggagaagcaggagaggcttctggatcatgaggtgctattctcttacagaggtgctaccacagttactaggtactcattccacttcttttttttttttttttttttttttttgagacttattttgattaccaggcctctggtttaccaagtgtcaagcccaccacggtcccatcttttccttatctccctcttcaatattcctgtctaccaccacccttccctcacccacatagcaataccacataccatcatttttctccaagccccatctcttaccccttgcaaactctgccattgttttcatcccagttcaaatttcctccacacaataaaatgttctccccatactgtgacttccttgaccttacgttttcctaggtgttattatcttcaccaaatcactaagtgtagattatgtatctttgagtgttcatggattcatgtggttagctctactttagcacgagaaacaaatgccctggaatcactctaggaagaacgttagttgctatgtggaaataaggagaaagaaatattttagggatggaaactgtatcacagaacttcagtttttgaaaaactggaaggagtcttagaatccatcccgtctaaacccctcatttgagagttctagaatctgagagccagagggcttgcacatctggtaagtaatggagtatattcttttgacagtaagtactaaaaattaggtcttgtaattccctggccagtatactttccacaacactacacagaatctaagctttggcttatattatttgaacaacttgaacaaaaatgaggtaccagattttgacagctggaaataaccggaagtaaaaggggttagtattccccaaacaagaaatagacgaaacaaagatgcagaaaagagaaatgagtgtggtcctgttagggaagaacatatgggtcagtacaccatatagtaccaaggctgggtaaaaggagtcttggtgaaggcaataaaaggaaatgtttttctgctaaagaaattaaaagtaatattaaaacaaactcgggtttttgtcttccttttttttgttatcaccatgacctggcaattgcaaacaataccagtgataaactattcctccttgaaaaaaatactttataatctaaattctaaatagtatctgctgttataatcagtatttaataatatatgtataagcattaaattaacccatatttattatatgcttgaataaacattgaattctacttggaagtttactaggggaattcctaattgtaatggtgtctctgacacatgcacactgaaatacgcacattaattttgagagtaaatttataaaaatttcaaatgattggagcttgcttcagaaggacttcatgtctccagctcctatggcactacataatcctgcatttaaacagaagctttgaaataaaccatgtgaacacattgattataaaggtgaggaaaaagaacttgagttagaactcaaattagaacttcgttctattgtgttattctgtgcgaacacttggaatttttatatgtgcttaaagtttaaaacgatgaaacagtgcaaatgagttataatgtttttggtaaatgcaaatttcaggttataaattttccagaattttagtaatatctctaacattgaaatttgaccttcttgatgctagaacctataccaaactgtggtggacagaatttactgtatcctaagcaaaatatgcttagaagtaaaattaatattacctatgttttttcttatatttataattttataaatctgttgataattaaaattaatgaaatgtatttcatgatttagatggactttaaaatatgactataaagcatcatttgtttagtgaaacaaaatataagtaattggacactattttgaaatgatattttaaaataataattacttttaattatatgtgataccaaatttttaaataaaatgtctattgaacagctagtgttcaaggcattgagcaaatgcatgttgacagtgagagctacaagccacatctaaacatcaaggattaatccatcatgatgatgaaaaatagatagcaactattatcagtacatatttttaaaaaatttatgactatttaaatgggaaataatttgtttaagtttttacattgcatatttcaacaacttgtcttgataaaggaaactcaggatgtaagcctgacacccaaagagagttggagggaattcattcattaggaaaatataaggaagaaatcatgacatcagttacctctgttaataaaaaaaatcagaaaagaacaagtaagtaaagtggcattttagaatatatagtagagtttaaaactgttaaatatttgagcataagtattttgctttgagagagaagaaaaaaatactacaccaagtaagaagtgctagttgcgtctcttagagtgtaccaaaacgatattggacattggagcctcgttatttgtcacctgaagatgactcatgggaatagaattctaaagcaatggaaacaggcactttatataggagtaaatatcacaaaacacatttttaaactcattattttgaaatatatacttaaagaatttgcaaaaatactagagttcacccatcttcctctgatagtggcatttcgtataaccgtagtacatgaacaaaatcagaaaattgacattggcacaatactgttaccttaatatagaccttattcagatttcaccagcaagcacattttttaacactaaaactttaaaaggatttaaaatatatatcctgtttttaaatcttattttttgtgagtccatagtaggtgcatatatttatgggttatgtgaaatattttgatataggcatgcaatgcataataattacatcagggtaaatggggtatctatcacctcaagcatttatcctttgtattacaaacaatgtaattatactattttagttatttaaacatgtacaattaatttaattgatttaattttacatttaaatattttttgtggataaaagtatttaaactaaatttaacttaataataagtatatatttctatactcattttctgaatatgagttataagatggttggactttatctctttattctatgtcttaaaagacttaagcttccgtgtctaagttgtacttcccaatggagtcagaatcactgagactagaacccctggaagctagaatgagacagatacagtagtaactggagctgtggggaaaccttaggttatatcctccaaatcatcttaacagcaacaagtatggaacctaatttccaatggaaatatgttttatatgtggtcttgtaaaatagtcctgtttatgaacaattctatttcagtacgacaatagacatactgaatattaaaccttaaattccagcagagaatttcagaggaaaatatttttttcaatataatatgaaaaatagtgtcaatgtttgtcaaaatgtgactctttgaatattctaatatactaagcttgaaggaaaactataaatctttttgaaatgtcttttccattttttattttagcaaagtatgcaatacttaatattccagtagtctaccagtagacaaatttacacttattatgttcaccacaaagtcttttatgactaggagattcagaacttcttataaatcttataccataatgcataacttagaataatttacataagaaaaattcaactcaaagactaaacagataccaagaataacatattacatatctaaaattagaaagcacacagacacattttagagataatagcaaaagctttttagtgcacaaataaagttagtagaagaaaaacaaggtaaaatgatacatatttttaacattacagaacattactaagaatacattgcctaaaattgatttataaacagagaaaagtcttatgctcacaacccctctattttaatataaatttaaaaagagagaaattgcaatgaaattgataatcatcatataagccatgatttgcacctttggtacacatcataattgcttggggagtgattttggaatacaccagaataaaacctggtaagtggtagtttgagataaatcaaataaaacacatttttttttctataacaaacaaaaggccaagtctggaatcattggtttctgtatggtgtattttatccaggactggcttatagattatttaagagttaaaattatgattacatggtcacatatatttgactttagacacttttaaatttagctatatattttaagtagagattcttatgaatatggaaataaaataatgtacaatggtatgataatctgatttatctaaattctgagttctagacatgccagtgagctacactggtagtaggactcaaaagtgcattatgtagggaaaaacatgatgaattgatttcttaaatctttctcagctagtggtcccttagtggcttaccctggtttgtcacctctcccatgatatttatcaatacttatgaacattttagaacctttctagccataatttggaacctaaaatgtttacctatgcatgtacttcaaggataaatatgttatgattatgttatttgaaggacctggctagagtggagcctacagctgaagtaaccagagttgggagggtatgttacgatataaatttcaaaaaaaaaatagttttaaaatatggctatgtaaaaataacttctattacttgtattttatgaacgattcaacctgtataaaaaatatagttctgtggaaaaagtttgatattagagagttctgttctttaatctctgccacattttcgctaaacatcttttctttgacctcggccaaattccttaactgttgaatctcctggggtgcctgtgagaattcaaaatgcacctcaaaacagcctaatacatggcagacattcagcaaatgttccattctcctatcccctaattatcacacaagacaattacttttaatctgtacatattgaggagctttgcatgttgtggacactttgtcaatattcgttgaaggaatgaaattgtggattaaatttgctgtattataaaactgatatcttttacttaataaaagcttggcagtatgaattgatagaaaatgagtaagtctatttatttggtggtaatgaagattactgggataagtttccaaagcaagttataaaatattgttccattaaacttttaaaatgggatttgttttcctgctttttgcctcatacagaataagtatggctctgtttcaagattctggtgtgttcatgatgacctctcaagatcaattctgaatcacagggagaaaacgttgaaatgataaagacatggatactagaaatgcaagcaagttatagaccattttatttacccatttttttttttagctcaagcaatttcgtgtcttatatttatggataaagttgaaataaaatttccctttttttctgttaaatattaagagtctggggattagttatgcagcatctatttatttatttctgtcttataaaaattatcttaaagggcttggcttaatttctataccataaagaaaaaatgtgtaagataatccctcgctatcgggatcattttcttatataattaatgagctgaacgtaaaagataggtgaatctacaaatttatttattttctgtcttataaaaattgtcttaaagggcttggcttaatttctataccataaagaaaaaatgtgtaagataatccctagctagtcgggatcattttctcatataattaatgagctgaacgtaaaagataggtgaatctacaaagaaaatgccccaggtaccatccattaaagcatgttgctgctatatgtgcaagatgtccagggtatggcttccataattataaacaatttactatgtctcaattattatttcaattgttaattcccttgtctctggattgatgctttagtgcatcatttattgtggatattttggataaaatgaatctttggattttgtaaaaacaatatttcaaatttgtatgcatctttgaagtctaaatagcatgttatacaaattgaaaattgactgtaagagttgctacagattcaaattttatgtagtttattttttatatcttgatttgtgaagaaacaaaaaccttaactttgcttggtggcaagaacaaggggattagaacatgaacacacaggatattcagagcagtgcgtttgtaaggcatgccttatttgagtttcaggtgcttgctcattaagatgaaatttttgtcaggcagtgtgtattgggagtttgctacttgaaaatcaatagtctgcattctctgccttattgtttcaatagcctcttaactgatctccctgctttcgctattgagctccctgctgcctagctctttgagctcatctcctaacacttcccctctctccagccttagtaaatgcccccacccacatccatttgtgatatcttttcattttctcccaccaagaggtggagtttaagctccccctttttgaatggcatatgaccttggaaattcatatggtcggaaattcaaatttcccaccaaattcccaccaaagttcccaaaaaaggtgggaacggaacgtaaacccccaccaaatttgaatttgaaattcaaatttggtgggggtttacgttcccaccttttgaatgccatgtgaccttggtaatttgccttgacaaatacaatgtggtaagattgacatcatgccatttctaggtttagaccttaggagaccttgaatgcttccatttattctcttggaaccctgctatcaacagatgatgaaagacttaacgttttactcaccccattcgacaggtggccaatcatcagacatgagcgaggccattgtagaacaagaaatcccctaatcttggctaggtttcctcataggtctgggttagctgttgtgggtactcatgtcttactttaaaatatggttatttaatacctctgtattgttattcctctaagaagatgtaataagtcctctggaagatatgacattaatggacttcgctgaagttttctgtgactctttatgtctcttgacataaaagacaagaatctctttaatagaaacaaagtatttgtctctatatttttatggttgaaaatgtgacttaaactagctacaatgaggaaagaacatgttacttgattgagatatggtgtttcctttagaaaagagaaatgcagttcttattgatattgtcttactggcattgtgtacagtttgatagcattcagtattgagtcttttgtgtcacagttcttgaaaaagctttgattcttgttttaagattacctatatcttgagtgattttgaaagcaagtgccaagaaaagatgttctattgatgtatacatgacaggtgaaatatcacaccttttcagaaggcttctctggtgaatttaattccaaagacaaccagagtggaggtggaagtaaaagatacgatttgtcatgttattataagtgcattacaaaagtaaagaatcatagcccatgcaggaggaatgatgtagggtcttgtttattagacatttttccccagggtttacatagcttagggattatgcaaacaaaaacaaaatatatatagtccaagataaacaagccatattgaaattgatatgtatgtatggtattaaatattgttagatttttctgaaattctcattttttatatattcaacacacattactttaattgtacgtattaaaaaaatttatcaaaataatcaatgatataaaatctctccttatatgatttaaaataatctagctatgtcagattaaaggaaactattctgtacctctatatctggtcaactcaggatttaaccaatagggcccagggtatttttagtctaaataatatacatttatgtttaaatcattgatttgaatctaatggcagcttgttgaaacatcaactgagtgcttgactttcacagacaagtaacacatttttgactgtagcatttcatctgaacaatacaaggtcaatcctcatataaagtataaataaatcaggggattctattgtatacttataacacatattcatatattagaattttatgaagttaaaaagattttattttcttaaagattatttttagagcagtttcaggttcccaacaaagttgagaagaaggtacagggatttattttacaccctctacccctacatatgcatagcctctctcattatcaacatcccccaccaaagtggtgcctttgttacaatggatgagcttattgtgttgacacatcattatcacctaaagtccatagttttcactagaattcactcttggtgttatacattctatgctttgggacaaatgcatccaccattatagtatcatatgtattttccctgacctaaaaatcctctttagttctcctattcatctttccatctgcctagcccctagcaaatactgatattttcctgtctccacagttgtgccttttccagaatgtcatatagttggaatcactcagtatgtaaccttttcacattggcttctgtaacttagtgatatgcatttaagtttcctccatgactttttatgacttgatagctgatttatttttagcactcaataatattctattgtcgggatgtacccaggtttatttatgtgttcacctactgaaagacatattggttgcatctgagtttttgcaattatgaataaaggtgctataaatattcacgggcgggtttttatgtcaaaatacagttccaactcctttgggtaaattccgaggagtgtgactactgagtcatatggtaagagcatgttcagttttgtaagaaactgccaaactgtcttttagtgtggctgtactattttgcattccaaactacagtgaataaaagttcctgttgctccgtattcttgccagcattttgttgtcagtgttctgaattttggctattctaataggtgtgtagtgatatctcattgttgttgaagatttcatttttagtcacaaaaatcatatagcattggaaggaatgttagatagcatctggttaaaatcaccacttaatgtataaacttactctgcaatatttcgttttaagcaatcatctcatccagaatccttttaagaccatctatggaatgcttcttgtcatgagatgcagaaaagctgtatgctaccaaacattagaaggccccagggctcagtccttggacatctttgctttgtgcacttactgccttggagatctcttccagtatcatggctttaaataccatttttatgctggcaattcccaaattttcatcaccaacctggacctctcccctgaactccagacacatgtatcaatctgcttagttgacatctttattttttgtctaaatgggtatgtcacacttagcgaccccaaacaaattccttactttttctcccacacctgacccttcacattcttcctcagtagtaactttatcctttcagatgatcatgccataaccttcattccttttagctcttctttttcatgcactccagtctatcagcaaattctttcaactcttccttgaaaagaagagttgaatggactcaaaatttgactaattctcaccacacctgctgcatcttagcccagtgccccttgtctctcacctgttttatttcaatagtcttgttactgttttctctgctttctcccttgctccctttaactgttttattctgaatatggcagccagcgtgattccttcacttaccaattgtatgatattcttctctattcagcctctacttataatggtcttttatctctctcagaataaaatcccaagtccccacagttgctcacaaggttctcatgcataaacatctggctccccaatgcctcttagtatatccattagtgttttccccttgtttgctcgactccagggcacaaggctcctctgttacatcagacacaccccctcccacgtcagtgccttgcacttgctgttccttttgcctgggatgctttccacacagctatctcatgagtcattcccgctcccctgcctgtcacagtcagctccttcaggtcttttctcaaacacctctgcttagtgagtccttctctagccacctgattaaacttgcaacctacttcttaactcttttcaccaatgactttttatatatatttaaataatttcttattgtctgtctcccttcacttcagatgtcagctccatgaggagagagttttgtctgttttgttcactattatatcctgcatgcctacaaaaggccctgctttatatacaccatagaatactatgcagccataaaaagaacgagttcacgtcctttgcagggacttggatgaagctggaaaccatcattctcagcaaactaacacataaacagaaaaccaaacactgcatgttctcactcataaatgggagttgaacaatgagaacacatggacacagggaggggaacatcacacactgggacctgtcggggatggggggaaaggggagggagagcattaggacaaatacctaatgcatgcagggcttaaaacctagatgacaggttggtagatgcagcaagccaccatggcacatgtatacctatgtaacaaacctgcacgttctgcacatgtatcccagaacttaaagtaaaataaataaataaataaaatgaaataaaaattaagtcccctgcttagtaagtattgattgacagaatgaattattttttatacattctaaatattagggaattctgtacttgtagggttttttttttctcaactgtgtattttaaaggagagaaagcaatcaacaactcctttgtttttaatttgggttttctatatttaacagatttatcattttattttttccctcagtgaacttgtttattaaaaagaaatctgtcactagccaaaagctgtctaccttttagctactcggcaatattggtgcataatcatgggttcttgggatgcttccaactttggtttgacctttacagattagctctgaattagggaccactgctgggtgagaagtaaggtgtaggaagaagacagatattccaacacaatctggaataattagaaggacgaagacaacaaggaaaggagactattttcagtgcttcaggcctcatttttataactgctgacacaagcctgctattaaaatagtcacatttcctcaaatattggactttcagatgcaaacggcgcagtcaaatagttctgttaacatgacctaattttcagagctaggtgttatatgtgctttcattctgagtctgtaaacctttagacctctgattctttcagccctaagctgatagtattattgtctaaaacctagcaattttctctgtaaactttatcattttgcattttataaaatcctttatacttacctatgtagagcttggagtttactatcctagggagaaggagtacaaggcaattaaaaaaaaaaaaagccccgtattcaaagcagaatgtttcaaaaagactctacttctgaaaaggggaaaaaatcaccattgttctgttggctgaatgtgttggaagtatctcaaagaagtacaattgaattaattatattttcatctctgtgtacccattcaagtctgagaacatgcacttcactgtagttttacctccttctggattacacgagaagctgcaagattatcaagatgtcagacattcctattgggataacatgacatctttactaaggacttctgtgggtctgatgttcttcttcctagaaaatcatatgaaagatactttaaaagtgccatgtacccacttgagcttattttttaattctgatttttaaaaatattttactacttaaagtgacatttaaaaagcatattaaacaacgatataagactctgacttcacaaattagtttttctaagaacatctaattagacaacttggattgtgtcttaccagggtgcatagatgtaaccaacctaagccagcccttttgacaatctgcagtatcaaagcaaaatggaactctcgtcttatacttacattagtacataggtggtctttcttgctcatctttatcccctttttaaaaaccatagcatagtgagtaacacatcttatatactgcgtattagacacatttctgtttatctttgtccctgtcttatgaatcttcattttgattatctgagcagtgttgctgatttgctctactggctttattcaactaatgccagtactcccttattggactaaggtcttaaaactaccgtgtgcttatgtgtactaaaggtagttactgtctgcaagtgaggaatacatttgatggaactgattaattagggtgattttctgtttttgtggtcaattgaaatcttttgttaattttagctttgctaattttagctgaattttctacagtaatttttatttatccataagtatttgatttctgcaaattggaagtaaaatcactcatgtttgtttacctagttggagctcagatttttattaaaatattgttaaaattttattaaaatatgcctataaaagcatagtgactggctgaatgcattgtgatgctcacgaaaatgccctctcacatctcctaccgcaagaaacacaactgagtactgggctcgagatgctgctttctggatccatcacagctttggtgctgaggccccactcttcttaggagctgcttctagtcagtgacagagtgcagcagcaggggtactaaaacgggcccattgctgagggatgtgggaactccactgatggcaatgtgagctcaagaatccccatgaactttacactgcactacagtgtaaagcttgttttccttcctccctctcttccccctattcttcaaagaggttagacccacatcgaggtgagatcggtctcttggcctcctctggcttcctcctgttttctttcataggtgttcctctctgaccctgcctctgataactcttgggtttgtctaatcttatctttgtgtctgcttttccaggaggagaacctggattaccacatgcaaaaaagatgcttttgtccaaataatttcatgtttgggccccttattcgtatttggccacaagttttaaaaacctgatctgtagtcctaaacttatatacccctatggttttttttttttttttggaagctgttaaataagtctgaatattctcttcatttatgttgttgaacctagcattcacttcttttcaatttgaactccgccaaccagtatggaaaagtatagtctcttctgtgtctgccagtcaaaggtagtttgtttaccccatttagcaaatcatgacaacttgatgactctttactaggtccactacaatgttgatatgtcggaaaacactttcacaggctactagatcctattatgcaattttgtaacagaggctcaggctggagttaaggactcacacttgccttggaagacgtgacaccctgctatttagaatgagtggtgctttgttttgttgtgcctgttatccaggatcaagacaatgagacatttaccatccccctgcatatcattttggcatgtatccttgtgaagggttgtaggaggcagcagttattaactccttaactgcacacatattttgcaaaaatagaaattttgcttgtggatagcctcccagagttgttatggtgactcatcaacaatcatttctaacacctggatatcaatacaaattatttgggaactttggcggttaagtattacctaaatcttggtgaaaattccttccttattaaagtattatcggcatactaacagcttgctccatacatccacaattaatatttcaattttattaaaaacatctgagaatgctgattttataatgtcaactttaaatctggagaatctctgagcatgaaatggtacagtagttaccatcgaaggagcagctgaaggtcagcctctgaggtgcattaattcttccaacattaactcttgtaaaaatgtcactttattgttattaagtagaggttcttaaaaggcccattaactctggtggctacaaagtggcacatcaattataaatttgttttatgtaaacggaacccccaaatgacaccatcaacatattgctttgtacttaggatcaaaataatcaaagccactatttgaaaatgtatttgcttgatttctcagacagaatctggggatagctgagcaatcatatctcatgcattgaagacaaattgcctcagtgaaatttctattatagtttaagaaaattatcttcctgaatttgacacactgaggtggctgggaatgtagttatccagcaacacctgcttaaaatgccaataggaggtatgtggtaactttgttccactcagttgctacacatgacctttggaattgccacagctaccttacagcagagaacagggacgcacacagggattttcagagaagcactaaggaaaatttgaaatgaagctaaattcaagaagtaaatgatacttagaccttttgcaaagaaaacccagagattttaaaatagacaatagcatgacaatttataaaaatgaagctatttaaacagtatgatgtatagtattcacaatagcttaaaatattttattcccaggagcaacctaatccataactttttttttttttgctaaatgttagatgttgatatttgcaatgcattgccttaaattggaagattataacaaatttgtgtattttatggtgtactgtctatgtattgtctcacagcagctttgattcacttccatattaaccttgataatttgcttctttcaacattcaggatgaaaactacttaatataattaagttggcaaagcctgcattttggcattttatcccactctacattttcttggtactgctttttctaccctcttaatttttacacatggaaataactcatgtgcctcattgtaagtcagtgtgttatttgccaagagatattctgcatgaggtctctaataagatattgaaagaatgaaaggcattttcttattggacttgcagtcatcagaatccacagaaggggtaaattacggccaaagctttacagggtaatggttaagcatgcagaattggtgcctgaatgctcgccttcagatatttgctgtatgatttggggcaagttccttaatctctttgtgctttcctttttttttttacttctaaaaagtgatgtataaatagcatttagcacaatccatctagtacactgagaactctttattattatgggcttctcaatatcctgatatagatagacataaatgcaaaccaatcacagaacagtgcttggcacataggaagtgctcaataaataacagctaccattaaaaatagaggcatgggattgatctggattttctaaatccttgaagttctaatagttttgtacagcatggggtggaaatgagcagagcagtttacaaaagagaaaacaaaattatgaatgcagactgtctacagcaacttcaatgcaattgcataaaataaattataaatataaatgcctgcagtttccacggggaaagctcaggttagtgaagggggcctaaaatgtaggtatcattggtgtcgaaataaatatacctttgaaaacgaccttttccaaccccattgaagttatctacctctcttatgaattaagtgtagaaacattgtgaggagcagggccaaggttaataagcaaagatttcggaccaagtttttatacctttttatcctgtttccccattgcaatcccctcagtgcatgtgtgtgcgcgcgcacacacacacacacacactctcactcatgcttctaacaaaaatatgttgttacagtacagattctcagtaaacatttcttaaataaaggcagccataatgtatgtttgttagcctatattagtgtgaggaaataaagtagggctactttataaccaaaatgaggaaaataaacagtaaaagaaaaataacgccaaaacaaatatgatttatttatttatccaggaatcacttatcaactacctacagatatatagatcattaagatagggtagctgcctttgggaagtttatagcttaaaaagaattataagatgtataaaagtttcaaagtgtggttaaggactgtcatagaaactctgtaagatgagagtgtttaattttactgactgtggttatgaggaaagttttaaagagaaggtacaatttgataatatcatcatagtgaggttttcattgagtaggcaatggaagggcacaaacagaagatatagaagtgtgaaacatggaggaacactcagagaactccaaatattttgaaataagtaaatcattgggctttcccagaggtatcacaagagatatggtcagaccagagtcagattatataccttaccaaggaatactgattttctagattgagtagtgtgaaaccagagacataaaggcaattcaattggatgtatactttagtaagatcacactaggaatatagtgaagaggaccagaggaggaaagacaaattaagaaaacaccagcatgtcaggtgagagaaaatgagtagtagcaatagggatggggaatgaggaatgcataaaaagaggaagaataaacaggatttgatcatcaattggacttcaggatgaaggagagaaaggaatctaagatacccctaggttttttggtttagagaatatagatgtgaaatttaggaagatgtgaaatttaggaagatgtgaagtttaggaagatgtgaaatataggtttgattatgctgtatttaaggaacctgtgggatgtctaggcatagatatcagagttggagggtgggatcagggaatgtggctagaaagatatatttcagcaaataattagtaggtaaaatcactggaatgcatgtgatgacacaccagtaatgtgtggagtgggaagagaccaaacgcaaaatcctaggaatccaatttaaagagcaggaacaattggggcaggggaaggggagagaaagagaattgttaggaaagtaagacaaaactcaggataagagagctgtgttgtggaaatcaaagatagagttgtgctatggagagattaaataaaatgaggtcatcagtgaccttggcaagaccagttcctgggaacagaatgcacacaaatctgatgattgttcttgaaaagggacagacatgagtaactggagtcagcaagagtaaatggttgtattaagcaaatgaatgaagttgtctcagatcctcttatcttgtagtgttgtgcctagcatatttgacatgcacagcatcttttttgtttgtttatttgtttgtttttgagacagggtctcactctgtcacccaggttggagtgcagtggcgcgatctcagctcactgcaacttccgcctcccaagttcaagtaattctcgtgctttatcctcccaagtagctgggattacaggtgtgcaccaccatgcctggctgatttttgtatttttactagagatggggttttgccatgttggctaggctggtctcgaactcctgacctcaggtgatctactgccttagcctcccaaagtgccaagattacaggcatgagccactgtgcccagcccagtgtatcatttttaattacttccgtcctgtctgcaacattagttttggaaataagtactaataatggctagaaaagaaaaaaaagatcatataatcattccaagaaaataaattaatgaataaattaaatattacagtacaccaaagaagggggaagtaatggaataataccttttatttttcctttaaatttatttttaatttttgtgggtacatagattaatatatttatggggtacatgagatgttgaaataataccttttagtttcattaatatgttttctgaataaagacaaaaaacttatatgcacttattgatctgttgcagtcatttctagttgtttctagtttcagtttctttacagttcattataatgcatttacttctagtgcaccatagttttctagtttagagccttaacgcctacaaagttgccaatgactttgtctggagagccctttttattaagtttcattttgaaaagtttctttcacatcagcaagcagatatacaaataggaaaaatcttaattataaggtaagattggaagagatttttaaaaatcctactctacagtaaattctggaaattgcaatatagtccatatctttgtttctttgggataaattctaggggctttcaaatgtctctatgtcaaagaatatttaatacaaaatctccaagtggtcatataaattgttagcagtgaagaaactcaagttctgtttcttggtcttcataatcatggtgagattattgtttattttaaatctacctttaaaagtgaaattatgtaatacctgtgctttggagatagcagctgcatccaaagagaccttcaatgactttgagacattaggaactcctgttgaaatgaacctatgtaggcaaatctgtgtttgtctgggttagaatatgtgactgagagttctcccgataaacttccaggtagaattcaatgtttactcaaggataagtcataaaaatgagttaatttgaagcttatgcaaatgttgttaaaactcaacaggaaccacagcaaattgcttaaaacttggaacaaaggagttttttttccaagagtactattttgacacagatacaccgtgttttattgtgctctactttattgtactttgcagatattgtatttttaacaaattgaaggtttgtgtcaatcctgttgtacagtacgtctatcaatgccattttttcaacgcatttgctcactttgtgtctccgtgtcacattggtaactctcacaatatttcatactttttcattgtgattatgtctgtcatggtgatctgtgatcagtaatctttgatgttattatgaaattgttttggggcaccacaaaccatgcccacataggaacttaataaatgtgtgtgttctgaccactctatcgactagccactcccctatctttctccctcttcttgggcctccctactccccaagacacaaaaatactgaaattaagtcaattaataatcccacaatgtcttccatgtgttcaagtgaaagaaatagtaacaggtctctcactttaaatcaaaagctagaaatgattaagtttagtgaagaaagcatggtgaaagctgagataaggtgaaatctaggcctcttttgccaaacagccaagttatgaatgcaaaagaaaagtgcttagaagaaattaaaaatgctactcagtgaacacacaaatgttaagaaagcaaaacagccttattgatgaaatggagaaagcttgtgtaatctggatagaaaatcaaaccggctacaacattcccttacgccaaagcctaatccagagcaagatcctaagtctgcaattctaagaagtgaggaagctgcagaagaaaagtataaaggtagcagatgttggttcatgaggtttaaggaaaaaaagctgtctttataacataaaagtgtgaggtgaagcagcaagagctgttgtagaagctgcagcaagttgtctggatctaggtaaaattattgatgttggtgactacactaaacaatagatttttggtgtatacaaagcagccctctattggaagaatatgccgtctagaacttttcatagctagagaggagaaattagtgcctggcttcaaagcttcaaaggacaggctgcctttcttgtcaggtgctaatacagctgatgattttaagttgaagcaaatggtcatttaccattctgaaaatcctagggcctttaataattatgctaaatctattctgcttgtgctctatacatgcaagaacagagcctggatgacagcacatgtgtttatagcatgggttgctgagtattctgcatccattgttgagacctattgctcagaaaaatatatttctttcaaaatattactgcttattgacaatgtacctggtcactcaagagctgccatggagatgtacaaggagaataatgttttcatgcttactaacacaatatccattctgcagcccatggataaaggtgtgatttttcaagtattatcatttaagaaatacatttcataaggctatagctgctatagatctgctatagctgtgatagatctaagcaaagtaatttgaaaatcttctagaaagaatttaccattctagatgccattaagaacatctgtgattcatgggaggaggtcaaaatatccacattatcaggagtttggaagaagttgattccaactcttgcagatgattttgaattcttaagacttcagtggattaagtaactgtagatgtgttgaaaatagccaaagatctacagtgaggattggagcctgaagatatgactgaattgttataatatcatgataacattttaacaaataaggagtcacctcttatggatgagcaatgaaagtggtttcttaagatgaaatctactcctggtgaggacgccatgaacattgttgaaatgacaacaaaagattcagactattacatagacttagttgattaagcagtgacagagttgtagaggattgactccaaattttaaagaagttctatgggtaaaatcttatcaaacagcattgcatgctacaaataatcctttataaaaggaagagtcagtgcagcagacttcattgttgtcttattttaagaaattgccagtcacctcaaccttcagtaaccaccaccatagttagtcagcagccaccaacattgaggcaagaccctccaccagcaaaaagattaagatttgtggaaggctcagatgatcattaacatttttagcaaaaatgtacttttaaaattaagttatgtacattgttttcagacacaatgctattgcaagctttatagactacaatatagaatacacataacttttatatgcaccgaggaaccaaaaaaatttgcgcaactcgcgttattgaggcatttgttttattgcagtggtctggaactgaatctgcaatatctccaaggtatgcttgtattatttagaactgccagcacatggtgataacggaaagcaattgactttaagtgaattttattattactttaaaaaattatctgcagaagatacatttgtttgttgtctgctccctatgcctggtctttggaaaaagcctctttttaagcaattaacatcctttttcaaagttaaactttttctttgataaaatttaaatgataaatatgttaaggatcacctatttcttaaaatattgaatgatttcaaacatatatgtcatctttactaagattacttacccatgttttccaattctgctagaaaaccagtggatcattctttgaagggtagacagtgtaccttataggttagatattatttcttatgcaacttatagtacacagaaatctatttttaaacgtacagtaaaagttaaacatacatgcagttataatatgcaatgatggtctcctacaaaaaagatcttagctattgattgattgattgattgagacggagtctcactttgtctccaggctggagtgcagtggcgcaatcttggctcactgcagcctccgcctcctgggttcaagcgattcttctgcctcaagcttcccgaggagttgggactacaggtgcgtgccactacgcacagctaatttttatatttttagtagagactgggtttcaccatgttggcgaggatagtctggatctcttgacctcgtgatctgcctgcctcggcctcctaaagtgctgggattacaggagtgagccaccgcgcctgggcaagatcttagctatttaaaatacgtatttcaaaatctctccttacctagtatctatctttgtttacttaagacgttgtaatataaatttgaactaggttatggtatttatgtttttaaatcatttaatttttccattgagtaccactctatggaaaaattattattattgatatacaataatatataattgtgtaataattatataatattgatatacaataataatatttattactattattgtatatcaattatttattgatatgcaatggtggtctcttacaaaaaagatcttagccatttaaaagatatatttcaaaatctctacttagtattcatctttgtttacttaagattattgttataatataaatttgaaataagttatggcatttatgtttttaaatcatttagtttttccattgaaggtaccactcacttcatattagtaagatttctgtgtgtttcttttgaagaattattcagaagcagacttcattgttgtcttattttaagaaattgctgatactagctagatatttacataaattgctttgactaaactataattaccttgtcactgttttctagtcaattgtaatgcagaaaaaaataattcaaactattaatatcatggtgaaaagcatgggctctcataggacattatcaagctaaaattccatatgtgctactaatcatgttaattaatttctatgcctaattctcttcatctgttaaatggggctaataatactacatagctcattactttgttttgagggttaagagtaaaaacacacagaaagttcttataataatatctagcatattgtaagcactcaacatgtataagttattttaggagataatatataataattatgtatttatttcattttcttttctttttttttttttgatggagtttttgctcttgtttccaggctggagtacagtggtgcaatctgggctcactgcaacctccacctcctgggttcaagcaattctcctgcctcagactcccgagtagctgggattacaggcacacaccaccacacccggctaattttttgtatttgtagtagagacggggtttcaccatgttggccaggctggtctcgaactcctgacctcaggtgatccgcccccccgcttagcctcccaaagtgctgggattacatgcatgagccaccgcactgcgcctggcctatttccttttctttgcttatgttgcaaagtgagaaatgcctcatatttaaccaagttgtccctaggactttaccaatctaagaatttttttttctgagaaaggcattctgaaagtcaaatctagatatactttaaatcaatatcactttaaacatttacgttagccatgttttttacagtgtaaaagactatcatataaattctgttaactatgttttattgttccctgttgtaaatttttatttatttaataaatctgtttataagaatttttttctcaataatactactgaaaaaatagatttcatccaagcacagtgttaactagataagaaaccaacccaccctattttaatagcagcattaatacttttccttaagaaaacaagacagccacttatagtataagtaagctaagaatgtcaaaagggcgctcaatatgtctttcttcaacataaaaagtgatgacaatcgatcagtctgactttcacaagaggctccctaggagagaacagcatactgataatagtaagggcaggaagcctatttagttgttttatattctgtagctctctgactgtcccagtagttacaaggcagcatgtttgacacatagctaaaattcaagatgaacgcaacacacaaaaagagggcaaaacatgatgggaccaataaggagagatcatttcttattataaaggcattaacttttttcaagatgagtgacttggagttttgagctgaagggttggctagaagaacacttcggtttacaaagagaaatgcaccctgtaatgaactgcagtggactctaaaatgaaattgctggaggctacataagaaatagaaaaaacctagaagcacaatgaaaaacatcccgatttacagcatccctaaaggcagctgagggttgaccccattactttcattgagcaatttgttccatctctcctcacacataccctcactaggacttctaaaatagaaagatgcacaacatcccttagccctttccactgtctcaaaaaggtccccaaactttgtttactaaagttttagaactttatgttttactgtgtttagtatttatttaattttctattttttttttccccttgacctagatcatagaataatatacttagaggacatttttctaaatgcaagttgctagaaatgacttggcaaagattagtacaattcacagtgtcctgcagcaatagaattaacgaggagtttttttaaagagagactgatttaattttttgatgattttgaaatataaatgctaagaagaaaatttgaaggaataattttagataatttatatctaaagtgttacaagcattttatgaaacactagctatcagattagtcaacagctttggttttaccgtcaacagatattctttaaaacattcatacaatttattgtgtgcttatgtatatctttatgcaatctttatgtgaacactcataggggactattgtataatgctatcattgttagcaacatttgtgctttgtttctgaagtcttttactgtactagtaatttttttctttgcagaaactaaagttttctattagaaaaactttagttggatcctgatttataagcagatataacaaacatcatgagagtcctagagaatatcatgtaatcttcagttgttcaatctgatgattaaattgggcagagaaaagagttccagttatgtgaaaagtatttaccgtgttaatgaatctgtgccaaaacgttcatagaggctcaacttcaggccactccctgtgttaattgctggggtaagatgtgtaacgtagacacttgcctctggatgggtcaggctccagtgggaccaggtgcattgcaggaggaatgcattactttgcccaagcgcttattaggactttgaaaagaaatgctttcattatattatttgatgttttgtacatttcagtgtcctggctagctttgaagatttcagagtaaaaagccacaatttggagattgatatttaatatttagaaacaactatgcttctgtttctctctctgatactactaaaagcaataaaccaaatatttattaaataattagttcatgggaaattatgccatttttttttttttagttggagtctcactctgttgcccagtctggagtgcagtgggaatgatcttggctcacggcaacatccgcctccccggttcaagtgattctctcacacagcttcccaagtaactgggattacaggcacatgctaccacacccagctaatttttgtatttttagtagagatggggtttcaccatgttggccaggctgtctcgaactcacgacctcaggtgatccacccttcttggcctcccaaagtgctgggattgcaggtgtgagccactgcgcctggtctcaaaccttgtattattagattaaattggggacctgcaaactttttatacaaagagccagatagaaaatatgtttggctttgcaggccgcatagtatctcttgcaactactcagatctacctttgtagcatgaaagcagtaatagacaatatgtttaaaaaaaaaaaatgagtgtggttgtgttccaataaaccttgatttacagaaacagatgcttggaatgatttggcctacgggccttttttttttttttttcttgtcaatccttgaattaagtaaagaaagtgacaggtttcctgctagaaaagggtttgttatgaggattatgtgatttaatatatgtgagatacgtagagccatgtctgcatgtagtgaatgctgtaaatgtgttatttattataataactgttagagaaatgtagaaacacatctaaaccatttataaggattacatcttgaatatatatttctttaaaacctggatcagtgactactactatacctagatttcaatttatcaaccaaccaaatacactgtgaaggattttgtggatgaaaaccttcagatgattgagtgtttcgattgcatattgcatatataagggttttctctaatagtagatatgaatagattcaataatatatgcttttttcatttgccattcatatattctttaaacttctaaccatttccccaaacttggctcattaaactgatatacattggtttactgtttatactcctgccttattttttgcatattataaatataatacaggtgtttctcagcaagaaagacaattgaataccaatgttctgaaatattcttgtttctgtcaaagacatgttcatcacaactctaccacatacactatacacatatatactattttttattttaccagatttttagaaatatccaaaacctaaaatattccagttgggggacaattatgttctactgggataagagaaagacagaaaaatgtggctttagaagcctagaaaagcagtgatttagttaagcatattcaaattttagtaatgcacagtcctgactgacacttaggactttttaatgtatctttttatttgtaggtaagattaaatagaaaataccatatttaaatctgtgaattcaaaacgatattttttgagtgcctataccatgtccaggttaagtttttctactctaatggagctaacattttataaaataacatttataaagtaagataacaaatgagtttttaaaacttggatataatttttactagagaaatactctcataaaaaccagagagactaagggaaagagttatgaaaaatagagtgaataactattttagatagggtggtattgaaagactgtttagagaaggaggcatttgaacagagagagttctaaatgaagtgagagagcaagtcatgtgaagatctagtagtagagtgtttggacagtgggaactacagtgtgaaaggccctgagatgagaaaaaagctgggatatttttagaaaagaaggaggctagtgttgggcatgaaggaaagtgatctgaaataaagtcagtgatcatttagggcctcgtgggctgtttttagatcagtgtagctctctgaggcagacatgagatggctgtgggtagggcagtgctgtgaacatcattaaagttttcccaagacccttctggtccatccagtggtagtagatataccagtagggaagctattatagcatttccctgggaaatgatggttgttagactaaagtggcagcagtgacaagggtgggaagaggtgattcaggatacatgccaaggtagagctaataggaattgctgttgagttgaatgtagagtgttggaaaaagagctgagtcaaggatgttttctatttgcgtcaggtagattctggtgtcatttactaagatgggaaggtttatgttgacagggagttgttaagaatcacaagttcaggccagatgcagtggctcatgcctgtaatcccagcactttgggaggtcaaggcgggcagatcacctgaggtcagaagttcgagaccagcctgaccaatatgatgaaacctcgtctctactaaaaatacaaaaattagccgggctgtggtggcatgtgcctataatcccagctactcaggaggctgaggtgggagaatcacttgaacctgggaggcagaggtcacagtgagccgagatcatgccacggtactccagcctgggtgacagaaggagaccctgtctcaaaaaaaaaaaaaaaattaagagttcagttttaactgtgttaggtttgtgaggctttctctatattcaaatggagctgttgagtaggcaattaaacattggaatctagagttcatggaagagatctgaattgcagatatacatttgagaggactcggtatgtaaatggtatttaaaaccatgagtctgtataaatatcatcaagatagtgagtgtagacagagaagtccaaatactaaatcttgaggtatttaaattttagttgtttggcagaagagatgaaccttcacagaagaccaagacgtgcaaagcaagttacaaggaaagctaggaaagtgtcacagccctcaagccaagtgaaatatgcctcaagatgaaatgtgtgatcaattggcaaaagctgtatagaaattgagtaagatgagaactgtcaaaattgctcattggatttggcaagatgcaagagaatgttggccttgaaaagaagagtttcaacagagaaattaaaaactgcagttaatgaaaaaaataggtgaggaagtggaaacaaagagtataaacaaatatttgactgagtttgctataaaaggagcagagaaatgctcttgtagctgactaaagacacgggacttaggaaggttattttttaaatggatgacattataatacgtttgtttgctaataggaatgttccaaagaaagagggagaaatttatgatgctgcagagaaaaggaaatattcaaatagtaaattctgccataaaaaggaatgaattaatggcatttgcagcaacctggatggaactggagactattattctaagcaaagtaattcagaatggaaaaccacacattgtatgttctcactcataagtgggagctaagctgtgaggatgcaaaggcataagaatgatacagtggaccttggggactctggaggaaatggtgggaaggaggtaaaggacaaaaggctacaaattgggttcagtgtatactgctcgggtaatgagtgcatcagaatctcacaaatcaccactaaagaagttactctgtaaccaaatgccacttgttccccccaaaaactatggaaataataaataaataaataaatagcaaattatttgagtaggcatgaagaaatggaatccattgcactagtggagggcttggactcagataatgacaataatggccatcattttttatgagtcatttacatatattaactcatttaattctaaaaataaccctgtaagctgtattttattaccacctctattttacatggacagaaaaataaacacagcaggttaagctagtaattggtagaggtggtttccaaactcaagttatctcattccagagtaccactctagagagttatatgttatacagtagatgtacatattataactgggaaaaaaggcagactacacagataaagttagggaattttttacatgtcttcataacaagatgatatagtatagtttttattctatttttcactaaagttaagtgcaagattatcatctgagaataagaaggagggatgggccactgagggatggacaatatgagagttgaagaagggatgggcaatgtagggaaagagcaaaaggtatgaaatatttgtcaagtacaggagtaaaatggccatggaaaatgacctgcaaaatctgccagtgccaaggtctcttgaagatttttgtcattattttaaagtgagatgcatcatcatgtgaggcagagagctaatttctatccatctttgcttcaaggtgtcaccagtgaaatatcgatggtgggactgacaggtaatctagaggaatagagcatgcctttcgttttcatatctgtcatccttttatctggcatggaggtgtgatggctagaactttgctagtcataattgaccatggagataagtaccacactctaggggtggtaggatattgagccaggcggcagaagtttgttctctgatgacttcattgaagtgccacagcagtcctggacttttcgcctgcagacatctctaatgggagtcagaaataaatgtgtatcttgtctaagcctgtttaggagtctcttcttcttatagtcagacttaatcctaacttattccagaatttgttttcagaagcgggttgctaaagggacaaaacctaaaaatatgactttggttaaatggaggcaaacaggtggttagcagcaagactcagatgttgcagtttctctcaacataggccactgttctgatggacacatggcatatagggagaattattttaaatatactttgggttttttttcaggtgagtaaaatggagagagaaaaggagattccacaatttcctttagtaacaaatttcactgtctagcaaactttactttcagggattgctttcaggtatgtcacttaatatttgtaccacttcatctaatttccattttcttatatactaaactcaagagacacatttagttaaaatttttaataaaatcttacacttgtcagatatttcaaatattttactttactcctgtctattataggaaatccaaaactgacttatatttaccttcttaaaccttgatatgttctcacaatctttttatttttcaaagatttatatcagtttatgacagtataactacaaaaaaaagtatagtcaccaaagtaaacaatgacatactccttgtcaaatcttagggcctatttccacgctcttggcccttatttcttatcttgcctttttcccctaaactgagagccaacatcatcatgggcgtatcaagtagagacagatcaatttgtgttggaatccagttagtcatttactagttagttatgtacctttagctagtcagaatttctttctaatcctcagttttcatccacaaaatgaactgtgttaaagactgaataaactaattttgtttactcacatttagtttatactttttttttaaaaccttcctttctttggttcaatttacaccatgcaccacctacattagtacctattgatatttgcgagggttttatgtctttgccccttctccatttctataaccatttctcaagccttcaacatggtactccttgccagcaatcattctttgctacctgtgttcctacccattctctagtttcttccagaggttccttgtccctcagcaggtctgccttcttactgcctcctgcataccgcccacttgcaccattttctatatattttctcttgcatcaattttccattgcatataataatctctagttcacaaacctgtatttgtaactctattttaaagacaatatttagtcttacttcatcccagaaatcattgactaacttcaccacaattgagacatcacttacatgaagttcctctttgtatgtgtataatttatcctcttataccattaaatttcttgtattgatcgttgattttattttaggcttgtcttaattatccatttaggatgtaaaatcttccttgtcttcatgatccgctgatggtataaaacttcctttgtttaaagaaagataaaactatctctgctgttccctgtcccatgctttgcagtgctatcactatgaggagaatttattaatttatgcatgctgcatttaatatgtaaaagcctttaaatacatgaagattggtactacaatgtcctcgatctttgctttcttaaactcaaatagtcttagttactttaaaacattttgcctagtgttatttttgtgtgtgtgtttcctctaaattcaagtgtttatattcttctttagttgagatccagaatcggcctcactgccatcatataatcaaattcatgcagagtggattggggagtttaattcctagcatctcctcttacctttgcttccatttaaaaatttaattatttctaaaattcaactaaaggccctcatttattataatttatatcattgttgaattattaattggttatttatttgctatacattatagtcaagcctgtagctgaataaagtataccttgatacattggaatacttatataaactgcataggcactaaggggctaaaagaaagtaaagtgggatatgataataaatgaaaacttattggagtagaaaatgaaaaaaatttaggttatattttatttcttttaattaagatggaattcatataacataaaattgaccactttaaagtgaacgccaatggcatttagtgtagattttattttactttatttttaacagctttattgaggtataatttacataccatacaattcaccctcttaaagtttaaaatttaatagcttttcatatatttacaacattgtgcagccatcgtcacagccaattttagaatattttatttaacccccaaaaaaccccatacctattagcagtcattccttattttcctgtatccactatacctaggcaaccattaacctactttttgtctctatagatttgcctattctggacatttcatatgaatgaaatcatatatggccttttgtatctggtttcttccatttagcataatgttttcaagattcatccgtggtatagcatgtatcactactttgttcctttttattgctgaataatattccatattgtgggtataccatgttttattatccatattatgccatattatggatatacattcatcagttgatgttcatttctgttgcttccatcttttggttattatgagtagtgctgctataaacatttgtatgcaagttttacttttaatacctgttgtcagttcttctgggtatatacctagaagtgtagttgttggattatgtttaatatgtaaacatattctatgtttaacattttgaggatctgccaaacagatcctttcctgatttctaaaatggaatatttatttttttaactgtaggctttacattccttatatatctgaccactagtttattgtaccataacaggtatttcctgatttcttttgtgctttgctttcatcaccaaataacaacttccttgaacttttaaaattacatcatttatagaatagaaatatgaaaagagttttgtgattcttagacatgaacacttccataattaaagatattcttacccctatggtaacacatggaatgaaaaggaaaatttgattcctaacattctattaattttattttctttatatatctcttccatgatgctgccaaaataattgggctcaatttaaatgcccttgtctgcttgccagtgggatgcatctgagaattcaactgtgctacattttgtttgaccacctatgtgttctactaacccctctattaactaaatgcctttttgatatagtcagtgttacttaattccaagggaaatctggggaaaatattgtaatttactgtgtacagtggagataaccacagtatgtaatatccattattgtatgggaattgtactcaagttagtccaatatggagtgatggttttaaaccttttagttaggaattaagtaaacaaatatttgtgaagcacccacccactaaatcatacaagtcactgaattaaggagagaaagtgaaaatattaatttgtggcttaattattaatagcatattaaaaatgtaaaggtttattatggttttagtcggagtttatccttcattacatatacaagtatgaaaggaaagaattatagcactaagccggtaagagaaaagcagcttgattctcttcagagtgaatagaaggaacataaccgtaaaaggaatataaacaataattccgagtgggagagaaataaattatttttaaaataattcaaggacatggcttaatgcaatgagataacatagacctgctaacctcattccagttaacaaagcacatttggttatattgtatcttttacagtttcatagtttgctgttttatagtaggaacaggataagctttaactgccttgttttcctttattcttccttttttgaccctgttaaatttaggaaagcacacacttggctcataagtgcttgttcagataaaacagtgtgcttccaaatgtagcagcaacccaccttcatcagaatctcctaagagggatgtgattgcaaaaatatcatttttcttagccctacatcatggctcttagatcagaacctctaagagttctgagctgagttatgatatagggctaagggagggcccaggaatgtacattttatcagtaaccccaggtgattagggtagggtccaggaatgtacgttttatcagcatttccaggtgattctcacatatgctaaagtttgagaaccactatactgtactgtattccctgctgtagtgactatgattgagcagaatggttaaaagcatggactttggtgtcaggcttatttgaatttaagttctgattctgttacttcattgtgatcaaaacttggataagcctcttaaattctttcagcctccactgtattcagctataaagtttaagataaaaggtgattataatctctatttacctaaagaataaagacttattaacataattctgccttatcattcttactattattagagatagggtcttgctctgtcacccaggctggagtgtagtggcatgaccatggctcactgcagcctcgacctcttggactcaagcaatcctcctgcctcagcctcctgattagctgggactacaggggggaaaccaccaccatgcctggctatttaaaaacaattttttttttttgtaatgacagaatgtccctatgttgcccagaatggtctcaaacccctggggtcaagcatcctcccaccttggcttcccaaagtgctgggattacaggcatgatccactgcacccagctgctgcccaattattaatagaatcttcctttattcttaaaactatcccactttagaggataaattatgtgatctagcatagctatgtaatcatttactgtgatgattatatgacatcacttatttgatttgatacagttggcacataatacatattttttaaatgttcttataattaatgctatttttaaaaatcaggccaactctgggcccactgcctaggagttagcccttctccataaggagcagtaaaagcaaacaaacaaacaaatttgattttttttttattttaacagagtactcaggattatctactgctttaattgcttttaaaaattgatttccatggaaaagaggtcactgattattgattgttggctagttttgtcctccatgggtacaggtctttaagtcattttgtcctcattgtttttactagcttggccatgccagttggcattgtcttgtgctaaaaggcattttgtagtagagactttggggaaaagacattcaagagaaggataataaaagtctgtacagtggaactatagtattacacaaatattattgtctataagccctattacctacaaaagataaatatgacattttccttctcttattagcttcatgatgaaacaccttgctattctgccttcagtttgcttttcacttccaagtaagtatattctagccatgggagagaggtatttaggtgtttttcttgtagttagatgggaatcctagactctctactcagactgctctgagcctaagttttttttttcactttttttttttttttttttttgagatggagtctcgctcttgtcgtccaggcaggagcacagtggcacgatctcggctcactgcaacgtccgcctcccgggttcaagcgattctcgttactcagcctcccaagtagctggaattacaggcactcgcgaccatgcctagctgatatttgtatttttattagagatggggtttcaccacgttggccagactggtcttgaactccttacctcaggtgatccgacctccttggcgtcccaaagtgctgggattacaggcgcgagccaccgagcccggcctctgagcctaagtttatcagtaatctcctaagtggtgccataaggatatgagttaatgtacatagagttcgtagcagcacatctttgttctcaattattgttttctttctttcttttttttttttttttttttttttttgagacggagtctcgctctgtcgcccaggctggagtgcagtggctcaatctcggctcactgcaagttccgcctccggggttcacgccattctcctgcctcagcctcccaagtagctgggactacaggagcccgccaccacagccggctaattttttgtatttttagtagagacggggtttcactgtgttagccaggatggtctggatctcctgacctcgtgatccgcccgccttggcctcccaaagtgctgggattacaagcatgagccaccgcacctggcctattgttttctaataccattattaagaagaatattggtggtcttaaaattgagcgagcagcagattttagggtaatatgggacttatttggctcattggcttctttcagccaccttgttcagattttttgcttctccagtaaaaaaaaaaaaaaaaaaattgttcttctttgtgagatggatgggggaaaaagaagtcatatagtttaaggagaataaggaaatcccaatatctgaacatttgagggagaagaactcaataatcaagggccaagtgacatagcagatatattgtgttttgcagtgtctgactgtcaacacgtaacaataagtggttgagattttcatactcaaggccttattcattgctttttagaaagtgtttttgttccacttccaatgaaggcataattctcaatgaaatatggaaagtgttgtagtcaacatgaaaatacatatattcaaaatagcatagcattaagcctgaagtatccaccatcatttttattcacatactactggtatttaaaatatagaaaataaatagaaatatagaaatataaacttctacagctattgccttcataaattacaaccttcatggctatcatatgtcccaaatatatgtttcagatatgtgcaaatgatgataaagaaacattcaatcatcagttatctaggagacaatgatacacactaggttatcttgagttaattatttcatgccaaacttaagtgactatgtgagaaccatatgtttggtgtgtaattcacactttcaataatgtttgtatcaactgaaatatttttcaatgaaccagcatccttataatgaacatggtgttattataaggaagctggcagtacaagtggtactttgtgttttctcatttcatgctttcatttagatttaagatgttcttggtttcatttccaagttggcatgagttagcagtaaataggaatctgctggcttgtgttacatttgcttttctgatacctctaaagaaagaatgggaagaattcagaacagtaatcagttttaattgaggttatccagatagaagtctttgttctatctaaatatcaagccaaatttcttggtatataatcagaaggaaccatgttgatttctctacttattgatgggtgtatgctttgattaaggagtcacagggaaagaagatggtaatattctcatagattaatgattgtggattttcagcagttaagaattgtattcaacctagaaaacaacttctaagaatcattaatagtgcaattcatagaagtagggttgattaaaattatgaataatttataaaatgtaatatatggatagaaagagcacattggctttatttaactcatgattaggcatacatgattattccattttcttcctttagcattgacttttagattatggaaggagaatgcctctagagagttaaagaataggcacagcacaaaagtaaaaatgaatgctccaaaagtagatatatgttgtgcttctgatgactttgcattttgtaatggatttccatcaaactgccttgctgtatcagtcagaatagtctaggttacattgtagtaatgaacagccccgaatatgaatgggctaaaactgaaaaaacaaaagatgtgtttgcatttagctcttgctatatgtctatttcaggatggagttgctggctgatatggtttggatatttgtctgctccacatctcatgttcaaatgtgatctccaatattggagatggggcttggtgggatgggaggtctttggattatgggggtggatttcttatgaatagcttggtggcttggtggcatcctcatggtaatgagtaaattctcattctattattttcttgagaaactcatatttaaaacaagagaaatgtaggtatctctaaagactgtagtaacccaattttattgatgatcagaggccaaaaaagccttgtaaccttacatgttgcttaatcctgatcatgtaacagaatcgtttggcaagagtttgaaatgcgtgaattcttggctcctattttcaatgttcctaatttaggaggtttagggtgagacccaagcatctatatttattcccttaagaactggttgttaaaaagagcctggcacctctctctttcttcttctcttgccatgtaatgtctgctcccctttgccatctaccatgaatggaagctccctgaagccctggtcagaagaagatgctggcttcatgcttcttgtacagcctacagagccaggagccaaataaatctgtgttctttgtaaattaacccagcctctggtattcctttatagggccacaaaatggactaagacgggacatgggctgtgttgcatgctatcccagactcaggcctgaggaagactccaagtggaatgctcctggtcactgtggcaggaggaaggggagtgctagaaaatcttgcaatttaattaaatgctgtcgtccagaagtgatgtacagcatttctgtccacaactctttggccagaattattctcatgaccctgccaagggcaaggtggcaaagaagtaccattctttcatgtggctgggagggaaaaaagaaccagatttagaagagcattagatatctctgtcacatctgaggaacaaattagccatcagagcaaaggtccaggcatcccatctcggcaaacaaagcatgattaaccctagagctgctgattctgagctcaccctaacttgattccctccactggccccaagctggcagctgtagctttgcaaacatgataatgcttctcttgttagaactgaatttagaattggcagcaacagaaacctgcaagctgcagttcatttgtgtatccatgcttaatttaattcttattgaatgaaatgcaccctcattttattcttgctggaaaaaaaaaaaactaacaacataaaagccagtccaactattaaatcaagattttctacaagatttgtgttaattattctctctgtcctttcacaagaataaaactgattttatttatcagttttgattcatttttgatacttgaaggaatgaggagtacagaccagctatggactatgtttattttcctgagaaactcatatttaaggcaagagaaatgtaggtagctctaaagactgtagtaatccaattttattatcagaggccaaaaaggctttgtagccttacatgttgcttaatcctgaccatgtaacaaaatcacttggcaaaagtttgaaatacgtaaattcttggcctctactttcaatgtttctaatttaggaggtttagggtgaggcccaagcatctatatttatatttaaatctcaccaggtgattccgatgggcagccagaagtgagaactgtcctggaatgttatgtaaaagaaagttattatttttgaacttgttttctaaatcaaataactatccaaacctaattttccaactttaagaataaggccatctatttagcagtacagaatccatgcttacaatgtttctggttcacttcttatgtgaaaacactgaagttgttaaataattcatagattattttgcaatcctgccagtctttatgtgtttcatgttcttgtttataagtcagtgagtagggaatacatccattttgagaatgccactctgttgtagttaatagatacagatcccattatcatagttattctaatatatgattcaccaaaataatggacaaaatgatgtaactaacaattgatttgcctgctctaatacctttctttaaaacactgtaataaaacaggaaatggttttttttaaatcatatattttgagtcaggagactagagttaaaatgaatcctagagatggaggatagtaaacgccaattgtgaagccagtaattacaggaatccatgtagtaataaacttattgtttctgtcttcaaagtacctttacttcatcctgtttaaagcttctgttgcaagcatgtcattttgaaagtaaattagactaaacatcattctgatgtccatagttcaataaagtagataaaatgcatattctatgaaagactgtcaaataaatattatgcttattcatctctctgtttgctttaaaatatactttaatttatgtaaatgagcatttaatagaaataaatagtaatgaagccacataatgcagatattgtcaagcttaaacaatccagacataggtaaggagaggcactattcaaaaggattattttaagagctgggagagggactattgcagtagaaagaatgctctagctatgagatctgtattttcaaagtcagataaaaatcttttctttgcctggccctcacctgagcactgcatatgcttactttatctcaaccctaggtggtatgaattactatccatttttagctgtcaaaattgagacacagagaagccaaatatgtcactgatattttggtttatgggggtagtgagcaaagttaggaagaactaggtgtagggaaatggtattgaaagggtggcatgacggcatgatcatacagttgattagggaatgctttttcctaacgtaagtcaatggtccagaaggcctcttaaggagaggttgtatgccgactcaggcggtgtgcatgtgtcacagttcagagacctgaaggaaagagagaagctttagttaaatttggtgaagccaaactggtaggtattttatccagattagtcagaggtataaacagttcatctaatcatttatggggtaaagactgggaatttggagggtctgtgtctggccttgtctaagtaaacaagaggggcatctgtgagtcttatctaagtcatacaggaaagacagtaagcctccagaagtaaaagggtgggaagacatctttaaccatcattgtttttcaggatcagagggctctgggaaagttcatggttcatataaagcaatagggtctagctaagtctcatccaataataggtatcatttagtgattgcctggccctcagttgagcactgcacatgatcactttatctcaaccctatgtggtatgaattattatccagttttaggtgttgaaattgagacttggaaaggccaaatatgtcactgaaatttagtggttaatctagaattcaaacttgaatgtccatagtaaaaaaatcaaactcatagtcatttatactatgacatcaaactgaagtagaaggtgcaatagtttgtttttataatttataacaaagtcattaacatttttaattattaaaagctaatgaatttttatggttcttttatttttctcttgcattttcatagatgagttccattcagacagtttgacaattaaccatgaaatctaaaaatcagaaatgattagtgccttgagttatacaatgagaccccatattgcttaacagttagaatctattgaattaaaaattaagagaaatataaaatattcttcaaagctactgagttatgcttaggatactggtctttgtaaaggaagaggaatgcaaaatgagtcatgttttattcaaggatttaaagtccagtgggaaagctatgacaatacctaatatataaataattataataataaaccacattgtcaaaagagaggtataaataagaaaggaaggtaaataaagattaatttacatttggtcaggagtatttttaagaaattgaaaaatcatacataaaaactaaaaatattggtagttttattaatgtggaatagatgattgctaagttagcttaactagatttagtaattctgtgaatgcatgatatatgtcaaatatagtacagtctttcagagaaaaaagtcatctttcaaaatgtgaaaatgctttcctattattcccaagtttcagtcattttagtgagaagtattagtaggttgtggaatacatatttcaagaaaaatgcactcaacttttaatattactcttggatttaacattgaggcagagaaaaatgctctatacagtttcaaacagatatgtattttgtgttctgaaatatagagattgaatgagagacaggaatgaacaggaccctaaggctgaaatctttacaaaagcataactgtggaggaattcacctcccaagtgaacttctctgattctcttgcttttaaacattatggcaggctctgttctttttctttggaccttgctgcgagatcctgctgagaagttctctctgcagtctgctaacagacatgtacagtgaaaattaaaattattcaattcatatatgaatgagcatattatatccagaacctacagattgtatttttgtcaatgtatggttttaaactgtttgaatttaaaaagcaatggaaattaaaatgtgactaggactttaagctaaattgttttaaaggagagtaatctgtgaaattaggacatctagagttgaaccatagagtttagaattgcaagaggacttaaaggtcatggaatccaacctcccacacagtgcaggaattcccttgtaagaaattcttagtaactagtcagctaagctctgtttgaatatccttagtgttgggaatctcactacaggggcagacatgccacttttgaatagctctaattgttaagaattttctgaactcagaaataactacctagcaaaagaggagtacttaatttgcatcagtgctttgaaaatttaaaaccaaagaaatggaaaatatcaaataatttctaaattgaataccagctccaaggggcagaattagtctcaatcattgtttggtaacttttaatactgtttccctcatgactcataatttcataaatttttgctattttgtttactaatataggggaaaatatgtgtttcagtggaagagcatgcattgtcacatatagcacaggcttgtggattattagattctagtctatcattgcctttcagctattttataactataaattttgtcttatttcacaaaatttccaatgacttctctcccaatcatgggtaagctagctttgcctccatttgcaattcagttcccttactcccagaaatgtgtgctttttaattttcctttgaactggttataacatctatctggttttcttattgaatgaataaaaataatatttttaatacatgctcattttcatttttatatctgtattagtcattattttaccttttctgaaaattatcttttaatatttgtggaggtattcccaccaagatgcccaatgatttgcttactagagccagatatactttctcatcagagaagggcacctattgagcagtttaaacctaggcttctacctaggatttctgactaaataattttgttgactgtctttcttatttttattttccactctactaattttgtgttttgcttttggtttgttttcagccagtaagttatttctgattgctggcaggaaatgttgggaatttggttttatggtctgaccatttggtgaagttattgcacatcactggcaagagtagttggaaatttggcctcaacgtcttatcatttgatgagttctgtaaatgcagtaatggtttaaagagttattttctctgtcgggtgtaagacgacagagaatcttgtttggtagggttttctatttgtcttatttgtctagtttgagctcaagtcagtgaagaatttcatgcccaccagaaagtagatatctagactaatgagtttttatttctgtgttcgtgttgaaattttagaattaaagataaccattttaaagatgctcgatgagctaagagagaaaacagataattaagcaaaatcaggaaaatgaacaaaatgaaaatatcactgaagacatacaaactataaaaaaagaacaaaaattttggacttgaagaatataatagctgaattgaaaaaaatcaccggaagggtttaccagcagacttgattgactaagtggaagaaagaatcaatgaacttcaagacatgttatttaaaattatcaggtcagaggggcaaaaagtaaaaagaatgaacatatatgaagagagactacgggacttatgggacatcaggtgggccaatatgtgtattatggatgtgccaaaaggagaagagagagatggacggacagagagctcaattaagaaaaaatggctaaaacatcccaaaatggaggaaagaaatacaaatataaattcaagaaattcaatgaactctatgtaggagaaaccccaaaagatccacacagagacacactataattacattttagaaagtcaggtacaaagagagaatcttaaaaattaaaaaaatatatatatatatcttgaaataagtcatactatatctttaaaaaatcaagagaaaaatgacttatcctgtacaaggtagctttgacaagttatcagtgaatttcttagcagaaaccttgcagaccggaagggagtgggatgatatattcaacatactgaacaaaaaagaacagccaaactagaatactatatctggcaaaattgtccttccaaaatgaaagagaggccgggcatggtggctcacgcctgtaatcccagctttgggaggctgaggtgggcggatcacttgaggtcaggagtttgagaccagcctggccaacatggtgaaaccctatctctactaaaaatacaaaaattagctgggtgtggtggtgcacacctgtaatcccagctactcaggaggctgaggcaggagaattgcttgaacctgaaaggtggaggttgcggtgagccaaaatcatgccattgcactccagcgtgggtcacaagagtgaaactccagctgagcccccgccactgcaaaaaaaaggagaaattaagattttcccaggtaaataaaagctgcaggaattcatcaccagtagacctgccctacatgaaatgctaaagagtatcctgtaagttgaaatgaaaggatgctagacaacaacatgaaaccatataaaaatattaaaatttttgataaaagtgaatatatagacgaatatagaatcctgcagtattgtaatgttaatatgtaaatcacttttaattctggtatataatttaaaatacaaaaccattttaaaaacctataaatccataataatagaaacataatataaaaagatgtcatttgcaacatcagtagcatacagtgtgtgtatgggagagatgtaaaggggtagagatcttttatgtgattgaagttatcagtttaaaatagactcctataactttatttaatccccataataaccacaaataaaatacctatagaaaataatcctatgaactggttacaacatgtgccagtttcctcactgaataagaagaaataaaatcttcggcatgtattcatatcttttaataaaagcctatgcaaacctctctttttttgtataaatgaagtagtattggataaatagatatttataataaaaatactggcttttgtcaatcttgttaaagttgaatattgataatatagtgtgatctaatatagctctgtccaatagaaatttttgtgatgttgaaactttatctattgtccaatagggtaatgactagctatgtggagctataaagcatttgaaatatggccattgctactgaaaaatataattcatttaatttaacttaaatttaaatagtcacttgtgatcacatattgtacagatctatggagtgagacttgtaagtattgccagtggcaaggaagtaacaagcctaaccatgaagagtttttgctatgtttctgtagtagaaactttcaaaccaacttacattctttttgcctgcttatatatgagttaagtaaataaaaatgaaggtttttagaaaagatcctttaaaaataatgactttgtgtattttagcatataaaaatttattttaaaatcttataccaacacttttaatcatataaaataaaatgtaacagacatctttcattatttgtaactaatatgtgtatttaattcagtttaaactgatagcattccttggaaaccaaatgcttttcaaatgataattcttagaatttttacatatcttagaagtgtttcttttgttctttgtttttttgtttgtttgtttataaaataaagacatgttacacttttgtgctagtgatctaaatgatgcaagacatgtaatcttgggagaaactagatttggaattttggtgttaaactaataatatgaacatatagcattgggagatatacctaatgctagatgacgagttagtgggtgcagcgcacaagcatggcacatgtatacatatgtaactaacctgcacaatgtgcacatgtaccctaaaacttaaagtataatttaaaaaataaataaataatatgaacatataggtaattaaatgacagtcagaaattgtcatctagaagtagatgtattggtcatctcagaaaataaccatacacaaaatacagaaatacataaaaatgcctgggatcaactaaaatttttataaagttatttttgattatcctacaaatagggatttgatgaatactaaggtatagaactttggaaactttatacttgggaaggtgttgaattatggcttctgggaaattataccaaaatagcctgctgttgaagtgaagctaagtttattgcttattgtgataatgaggattattagccttgacagaatctcattctagagaaggaaggacatagactgtctgtcatcttcctctctttcacaaacagtgccaggaataatatcacagaatcccagagtatctatattcgaaaatatatttgaaattattttggcaaatctccttttataaacaagcttttgaattctgagattgattactaaactaacatgcattgtttcatctaggtttgtatgactgatcagataacataccttattattttatcattcagacttgaacttaaaggcagagaaaggacaaaaaataaaatatttatagattatttggcaaagtataagtatctcacatctgtaaaattttaataaaattctgcaaagtttttgtgtcatgcttgcctaatgtgatttatctgtcaattggtatatagattccattaaaattcatttttaaaaaggtggaattatgactgtcataaatgtaaaataaaatggttaaaaattttatttagctcaacagttaatgaggaaaccaataagatgttacaactggtaaaaagagaattttaaaaaatacaaaacacacagatacagccaattaggaactgtgaaatgaatgtacaaatagatgcaaaaaaaatgcttcgtatccacaagacagtaatcagttgcatctacaggaggcacaattcatttacatatctatggacaataatcattataattattataatcagttttctacaatttacagagatgtaaaataactcaaagacgatgaaaggcggatatgactcagaagggtgctctagagagcacatccaattaactttttgcctatttcaaggactttcgcagtgtttttcttataaccccaatgaaaatgagaaatggtttccactttaccctactctccatcacgtcatattagtgttgcctatttgactcattagtgttatttgcctgactcctgcagccattttaatataaaaatttgaaattcctactctcaagttgaacatagaagatagtcaatattctaaatttaaaaggttaaaaacttaacgtatttgtttttaattttaacatatgtttaataaaataagaaacttgaacaccgtagtatttatggtctgcataatctgttggatttacctaattcatggattttaatacacatgttgtctttaggttacccctgagggcaattgtttttggcatacctagcataaagcaggtattccctgtaagattttttcccatttcatgtaaaaaggttaaatgctggtttggtggatcctgcttcaacattatgaagatagcatttgaactacatgtctttcgggaaattatatatggatatatctacagatgtagatataatagatacaaaccagtaagaaaggaaatctaactttttagtgatttcctttttacttttaaaaaattgctattgaattttttcagttaaatagtaacaaaaataactaacaacataggctccatacaaaatttaatttgccactttataactttttcaattcctttatactgtataaaccacagattttttgtttctagcctatagtttctgcctaaaatacaggaaatgatacttacaataccaaaatgaaaccattaaaagttttggatgctggattaagtgatataccacttaaataatgatccaactttgtctaaattcttcaagaactagaatatatataattttattatattatctcctttttacattgtttttttttcctttggatctgatttttcaaaactttagtctaataatgtatcactctgtaaagtaacattccttgtaagatttttaaagtagaaaatcttttcacatgaagatatatatgtactatatacatatatgtatatatttctaaaccctgtgttctttgtgtaattgatggaggattggtctgtagagaacaaccaaagttgcaaatcatggagaaaatctctctgaagtgcaagtaagataaagaataaaataattggagcattgttgttttaaaaaaaaaagcttctcttggaaaatgtccttaagtatacgtggttagaaaaataatgaatcctagctttaaatttgtgtgatttaacttagtttacgaatgtttatgtttttcattaatggaaaaacgtttaccaatgaagaataacatgaattgatttataataattagcatgtttaatttcaaggatactgcctcaaaacactgaattaagttttaaattattatgcatttgaccacagagagtctataccaagctattatgatgtagttatgtttgttttaatacttcagtctccacataaatggcataagataacctcatattcataatactctaagtacgtgcatgaaaaaatcaaaactgttatttgaataacaaagctcatgggacaaggaaatgatgccaaactatcttttaggaaattacagagtaaaataagttatttactttaggtacagtatttaacttgtacctagtacattgatttaacattcacatctctgataaagagttacctactagtgtcagaaatcccatatatctccaaggttttactatggctcgaatgcctcctccacacattcaggtgttaccaatgtggttgtattgagaggtggagcctttaaacaatgattaggccatgaaggctcctcctgtgtgaatgagattaaggcccttattaaagaggttacactcagtgttcagcgatcttgctcttcctccttccgccatgtgagaactcagccttccttccctccagaagacagagtaagaaggccctcacctgacatcaaaatgccagcgccttgatgttggacttcctagcctccagaactgtaagaaataagtttttgttctttataagttaaaaatatataaatacataagttatttatcatgcaatatttaaggaatacctaagcacatgcgtgctcaccatctagcttaagtaataaaacattgccaaagcagcgaaatcccctcctctttgtctgttcccttccttccctgatcatctctcctgtcttccagatatacttaccattctgaatatagtgacaatcatcctatgcatttgttatttctttttttaaatatagctgtctatccccaagcaatatatagtattgttttacagtttttaactctgcataaatagtgtgataaaatatgtgttctgaaacacacttttgttttgctcattgtacttgtgaaattcatttgatatgtgtagctctggttcattctttatcagtgacataatatttcactgtttggtctacattatcaaatggtggcctactcagaaaagaatgtggttaaaaaaaacccctaagttggacaatattctgattattatgattaatttcagatttattaaactaaagtttattttgaatcaactagcaatgaaaaaataaatattcatatttaatatgaccataaatcagcttttctattgcctttgcatcaataattaaaaaataagtaaataatgcactgattcaatagtcaggtgctatttatcccaattctacctaatttagaggtaatatattaggtaggaaacctaagagtatcagtactgattagtgatttgaggcagaaaacttgcaaattaggctgggaattgctagtaaggttctggattcaatcatgatgaagtgacttggttttatgtgcctaaggaccctgtctaatgagttgtatcgtcttaataggccacgtactggtaaaaaaaaaaaaacaaaaacataaaagcaagcaaatgttaatgatatctcaaaagagctcattaattaggcagtcggcacctcaacacagaaaaaatttctggccatgtggccctcaccccactttagccttagcaggtagaaaaactaaatgcttgaggagtatttgttactaattacctctgattggtatgccatgtctggtctcgttttgatatagagggcaaaaaacatgaaagccaatgaacattaaattgccaaagtgagtgtaacacagcaagaacatttaccatttccaccatgtttcatcataaatgggagaaataatactggagttgtggaggcaggggttttggagatatcacagatttgagtcatggacagctatgtagtgctatccattatcttaaaaaaaaaagtccttttaaaacagtattagtcatgtctacaggatattttctcagttttgcataaaatgcttcctgacattttcatgctaatataacattaaatatttctgttgtataacaatctcactagaacttggttttccttttttttaagacgtgaattttaagtggtggtcattatgatatcattgaaaggaaaccagaactaacaataattaccaaatacagcccttttattacctgtttcccaaagaatctccattttatgtaccatttgacaaatgcaacctattgtgtaagtagcaaaaactctgcaggcagagtgcatttttaatactttattacattaagactcaggtttaaaaaagtaagttatttctgttagctttagtatttttcacttcatagaaaaagcttttgtctgaattgtcctattttggggttcctggatttagtaagatgatataaaatactatactattttaagatattattaatactccactactaagaatataatattaggatttaattattttttcttgcctatacatattagactatatatttgactttgcatttgcataaagagcatattattacaatccctaacatttcttagatcgtaaggcaaacctatattcaaatgagaatatatattgaagattccatatctataagcctgagataaatgtatgatttggtgagagggagaagagaatttataataatgataaaagctattaacactaaaatattttaggatttttagcacagtgtcattatctacatgaagaaattgttatacttgcaagtgaaatagttccacgtgaattcgaatggctgggctagaaattaggaagttggtactatttggaatgaagcacttatcatttttctttttctgaagacatattttttcactcatctcttctctccaacatctttcaacttattaagcaggtcgcctaaaggagaaaccatctccagaaaaattgcaataacttctttagggctttcgtatttggcttcagtttctcctaccttccgtaatagattcaccctctttgttcacctttctaaaggaggcattgtaaggaagctttcttacagcgaatttacaatatctggtgacgtctgactcctttttttttcttaggctagacactttctcactgaaagaagccttttgtcggcatctattatgctactttcccaccgttataaatcctctatattttcttaaataggacagatgatattaggtatccagttccaatgccatagcacttgaatttaaatgtagacagtgttttattctcctaatctctgtaaactctgatagttgctttaacagaacgtgccttttttgtttgctttgttcagtggttgagctttaatagtaagtgaggagggaacatagataaaagaatgtctttaaaggccatgaaatcttccctcagtttggaacaaacaccttagcttcaatgtctctgccacttagcatatttaatttctttggacaacattgtccacagtgttgaaatgaatctgacttgaaaagctcaggcatttttaggatatatattggcattaataaatagtgtgttttgacttcagagctgtgaattacccctagttccctgataaaatatttgtaattggattttttttggtcagtattaaagtgtgtttgagtttcaagagagacatgaggagtttttaatatagaacaatttattttacttaatatcttacatttatttttggaaagtgattcattgtatttaaatttctcaaatattcaaagcaccaaggaaaattatagacaatagtttctattattatttgcttatttttctattggaaaaacttttgtttttttctcactatacaaataagttttttcaattagcttaataactttgaacaacacatttatttgacactacatttaactgttgtcaaaaatgttattggatcatggttgaataattaataaaccattgggtactttctacagaaccattttagttattttataataaagtccctcataggagatattagttgaggtgaaaattgttcctatcagtataagcccaagaactcttgtctgacaattaagcaacaaataattattgtgccctcatagaaaccactggtagctctttcatgaatgaatgacaatatttcactttgtagttaataatgtatgaagacagatgaaggtgtttgtgacagataatactccttcgtgaaatacagaatcactgctctgcaaatagtattcattaagggtgtggtatttgtctggattaagtagtttttggtggcatgtatgtataaccaattcaaaaatgcttaatgaaaatttatcactatgatagttataaggttgttttatagaatacaaagtttgcaaatgcagacaggattcataaaggagagaaagtagaataggcatgctatcaggaactcaggcagaactctcaatgtagtctctgagtttacttggtctcttgatttaattaattaattcagtcagtcaattggtcatgtgtctatttactcaacaggtgtttattaaggaccgtgtgtctaatccagtcactggaactatgtataatacagacttgacttaaaaataatatataattcacaaaccatgctactgacccatttaaattgtataatttgatgatttctaataataaccatagagttgcataagcatcactacaaacacttttagaacattttctttactccattaacagtcaatccctatccccctttcccctgctactagcaaccactagtcttctttctgttgctatggatctgcctgttttggatatttcatatgaaatgaatcatgtaatatgtggtatttcatgactggcctacttcacttagcacactataatccaaagtacttcttcctttttttgcagaataatataccgttgtatggatgcagcacattttatttatcctttcatcagctggtagacatttaggttgtttccacctcttggttattatgaataatactgctatgaacgttcacttgcaagtttttgtgtggagatattggtggtttgtgtttaaagtattgaggaaccagatttaccaaaacagctgcatcatttttcactccagctaatagtatctgagggtgccagttcctccacatccttaccaatacttgttattggtctttttcattatggccatcctagtaagtatgaaataaaatatcattatagttttaatttattatctctctaatgactaatgatacagaacatattttcatatacctattggatattcatatatcttctgtggagatataaatctttatagcgtttggtaatttttaaattgggttttctgtgctattattgaattataagagttctttatatattctagatgcaagttttcactcgcgtccgagtgaagagaccaccaaacaggctttgtgtgagcaataaagctttttaatcacctgggtgcaggcaggccgagtcctaaaagagagtcagcgaagggagttggggtggggctgttttataagatttgggtaggtaaaggaaaattacagtcaaaggggggttgttctctggcgggcaggagtgggggtcagaaggtgctcagtgggggagctttttgagccaggatgagccaggagagggaatttcacaaggtaatgtcatcagttaaggcaaggaccggccattttcacttcttttgtggtggaatgtcctcaggtaaggcaggaacaggccatttaaattttacttcttttgtgattcttcagttacttcaggccatccggatgtatatgtgtaggtcacaggggatatgatggcttagcttgggctcagaggcctgacattcctgtcttcttatattaataagaaaaataaaacaaaacagtgttgaagtgttggggcggcgaaaattttcgtggtggtgtggagagataatgggtgatgtttctcagggctgcttcgaggtggattaggggcggcgtgggaacctagagtgggagggattaagctgaaggaagattttgtggtaaggggtgatattgtggggttgttagaagaaacatttgttgtgtagaattattggtgacggcctggatacggttttgtatgaattgaaaaactaaatggaataagagaaggagaaaaacaggtattaaaggcctaagaattgggaggacctaggacgtttaattagagaatgcctaaggaggttcagcatagccttgccagcaaagattatttactttaagagttaagagtggcggtttggggatagcaccaggaagtatcagctgtgatgtcttggagaagcagtgtaaacaagagcagggcatttatgagtagttgagactggtgaataggagtatgactagacagaagatagcagggatgacaagttttttggggtgcagtctaagttggtctggtgtctggaatgagactggggccgaataaaaaggagcgtctatacaggagcttaaatgggctgtaccttgtagcattctgaggacaggcctgaattctgagaagggcaagtggtaaaagtattgtccagtcctttttaagttggtggctgagcttggtgagttgtgtttttaaaagaccattagttcactgaatactaagagcctgagaaactgcttgggtgatttgactaataaaggccggtccattataggactgtatagaggtgggaaggccaaacccacgaattatgtctgccagaaaggaagaaatgaccgtggtggccttcttagaccctgtgggaaaggcctctaactatccagtgaaagtgtctacctagaccaagaggtattttagtttcctgactcggggcatgttgagtaaagccaatttgccagtcctgggcgggggcaaatccctgagcttgatgtgtagggaagggaggaggcctgaataatccctgagaagtagtagaatagcagatggaacactgagaagttacttccttgaggatagatttccatgatggaaaggaaatgagaggttctaagagacgggctagcggcttgtaacctacacagaagaggttatgaaatgatgacagaacagaatgggcctatgaggctggaaggagatattttccttggtctaagaaccatttgccttgtgtgggaagagattgataggtggaagtttcagcgggggagtaggtgggagtgaccgatgtgaaggagaaaaactggccatgagggacagaagttggaaggctagctgcttgtctagccaccttatcagcataagcgttgcctagagcaatgggatctgacgccttttgttgccccttgcagtgaatgactccggcttcctttggaagtaaagcggctttgagaagcgtttttttattaaagaggtattaatgatagaggacccttgtgtagtgaggaaacctcttgcatggtggtgcaggatatggaaggcatatttagagtcagtataaatattgatgtgtagtacctttgcaagagtgcgggcttgacttaaggcaatgagttcagcttgttgagaggtagtggaggagggcagagctgtagcctcaatgatagatgtggaaggtactgtggcacagcctgcctttgctggtgagtggcgattaggcctggtggaactgccatcaataaaccaagtgtgttcagggtgaggaacaggaaagaaggaaatatggggaaatggggtgaatgtcaggtgtatcagagagatacagtcatgggggtcaggtgtggtatcccgaataatgtgggaggccagattgaagtctgggccaggaacaatggtaattgtgggagactcaacaaagagtgaatatagctgaaggagccggggagcagaaagtatatgcgtcaggtgggaggaagaagatagattttaggagttatgagaactgtagagagtgagttgagcatagtttgtgatttttagggcctctaaaagtattaaagcagtggcagccgctgcacgcagacatgagggctaggctaaaacagtaaggtcaagttgtttggacagaaaggctacagggtgcggtcctggctcttgtgtaagaattctgaccgcactaaccatgcctaggaaagaaaggagttgttttgtagaagggattggggtttgggagattagccggacacgatcagcagggagagcacatgtgtttttatgagaattatgccgagataggtaacagatgaggatgaaatttgggcttgactgaagtaatgggggctgtctgtgaagctttgcggcagtacagcccaggtgatttgctgagcctgatgggtgtcagggtcagtccaagtgcaagtgaagagaggctgggatgaagggtgcaaaggaatagtaaagaaagcacgtttgagatctagaacagaataatgggttgtggagggaggtattgaggataggagagtatatgggttcggcaccacggggtgggtaggcaaaacaatttggttgataaggcgcagatcttgaactaacctgtaaggcttgtctggttttaggacaggtaaaatgggggaattgtaaggggagttataggctttaaaaggccatgctgtagcaggtgagtgataacaggctttaatcttttcaaagcgtgctgtgggatgggatattggcattgaggggggtaagggtgattaggttttaatgagatggtaaggggtgcatgatcggtctccaaggagggagtagaggcatcttatacttgtgggttaaggtggggggatacgagagggggatgcaaaggaggctttgaactggggaaaagggcagcaatgaggcgtggctgtagtccaggaacagtcagggaagcagataataagggaactgggcaggtggggataactaaaaaagagtgtttaaaagaatgttttctaagttggcaccagagttggggagttttaagaggtttagaagcctggctgtcaatacctaccacagttatggagttaagggaaacaggcccttgaaaagaaggtaatgtggagtgggtagcctctgtattgattaagaaggggacggacttaccctccactgtgggagttacccagagcgtctgtgatggtcctgtaggcttccgaggcaatcaggcaatgtcagtcttcagctgctaagccgagaagatctgggaaggagtcagtcagagagcctcgggccagagttccacgggctctgggagtggctcccaggtgagttgaacagtctgattttcagtggggtcccacacagatggcacgcggcttaggaggaatcccgggctgtgggcattacttggcctggtggccagatttccggcacttgtagcaagctcctgggggaggaggttctggaggaacccctggcagctgcggttcgggcatttggagttcttctgtgctggagatgtggctggggtttgtctcacagtggaggcaaggaattgcaactcagaaatacattgctacttggctgcctctactctattattgtacaccttgaaggtgaggttaattaagtcctgttgtggggtttgagggctggaatttaatttttggagttttatttaatgtcaggagcggattgggtaataaaatgtatattgagaataagacggccttttgaccctttagggtctagggctctaaagtgtctcagggttgctgccgaatgagccatgaactaggctgggtttttcatatttgatgaaagaacctaaacgctaactgatttgggagaggtcggataaagaaaaaggagcattagccttgactatgcctttagcttcagccacctttttaagaggaaattgctgggcaggtggtggagggctagtctcggaacaaaactgtaagctggaccgggtgtcaggaggggaggtgataaaaggattatagggttggggagtagaggctgaggaagaattgggacctggctcggcctggcgaggagcagcctggggaggaggggagaggtcagatgggtctgtagaaaaggaagattagaaagactcagcaatgcttggggttgagactgagagaacaagcgggagggaaagaaggaagatttgggacgagttgcattgggaacaaagagtagggagggaacaatgtgtgaaagaatgcctggacgtcaggcacctcagaccgtttgcccattttacgacaagaattatctagatcttgtaggatggaaaaatcaaaagtgccattttctggctatttggaaccactgtcgagtttgtattggggtcaagcggcattgtagaagaaaataaggcgtttaggttttaagtcaggtgtgagttgaagaggttttaagttcttgagaacacaggctaagggagaagagggaggaatggagggtggaaggttgcccatagtgaaggaggcaagcccagaaaaaagagagtagagacacggagagaaggggttgggggggttcttgccctccagaaaagcagagaaggggtagagacacggagagaaggggtcgggggggttcttgccccctagaaaagctgtacttgccgctaagggtgaaggaccaaggcaggcgtccctgcgtggccagagacctctgaaacgtgggtgaataatcaggcaggcgtccctgcgtgattaaacaccaagggaagactgtcttcccgagcccgtgaccagcacgggagttttgggtccacggataaaacgcgtctcctgtctctaccagaaaaggaaaggaactgaaattaagagaagggagagattgaagtgtggcgccaagattgaaaggagaaagaggttgagggatagtgagagaggttggagaagagaataaaaagaggccacttaccggacttaaaattggtgagatgttccttgggctggtgggtctgaggaccagaggtcgtaggtggatctttctcatggagcaaaaagtaggaggacaggggattgatctcccaagggagttcccccctccccgatctgagtcacggcaccaaatttcactcgcgtctgtgtgaagagaccaccaaacaggttttgtgtgagcaataaagctttttaatcacctgggtgcaggtgggccgagtctgaaaagaaagtcagggaagggagttggggtggggctgttttataagatttgggtaggtaaaggaaaattacagtcaaaggggagttgttctctggcgggcaggagtgggggtcagaaggtgctcagtgggggagctttttgagccaggatgagccaggagagggaatttcacaaggtaatgtcatcagttaaggcaaggaccggccattttcacttcttttgtggtggaatgtcattagttaaggcaggaacaggccatttacatttcacttcttttgtgattcttcagttacttcaggccatctggatgtatatgtgtaggtcacaggggatatgatggcttagcttgggctcagaggcctgacacaaatcccttatacatatgatttgaaagtattttttctcattccttgggttccctttttactatctggacagtgtcctttgaaacacaagatttttaaattttgataacctctaatatatctattttttgtcttttttgttttaagtgaataactagtaagtctgcctaacttaagatcacaaaaatttctcctgtattttcttcaaagagttttatagatttagctcttacattgaggtctgtgatttattttgaggtaatgtttgtgtgtggtgtgaggatggagtccaatttcattcttcaaacttctttttttcccccttttttttagagcaaggttttgctatgttgcccaggctgatctcaaactcctgggctcaagcagtcctaccgcctctgcctccctatgtgcctggcgaatttcattattttacatgtggatattcagtttttctagcttgatacctatttttataatctaatagaaaggactggtgctcctcaaacttaaatgttagtaagaatcacctgaggttcttgttaaaatgcagattttgttatggtagtgggacctgagagtctactttcttacaaacttcctaggtgatgctgctgattctggtactgggactttttttttgtttatttttgagactgtcgcccaggctagagtgcagtgttgtgatcatggctcactacagacttgacctcctgggctcaagagatcctaccacttcagcctccagagtagctgggactataggcatgctccaccatgcctggtgtattagtccattttcacactgctataaagaactggctgagactgggtaatttataaaggaaagaggtttaatgactcacagttcagcctgtctggggaggcctcaggaaagttacaattatggtggaaggcaaaggggaagcaggtaccttcttcccaaggtggcaggaaggagagtgaacacaggaggaactaccaaacacttacaagaccattagatctcatgagaactcactacaagagaacagcatgggggaagcagcccccatgatccaattacctctacccggtctctcctttcacatgtggggattataattcaagatgatatttggctggggacataaaacctaaccatatcaccaggctaatttttgtattttttgtagagacagggtttcaccatgttgcctgggctggttttgaactcccgggctcaaatgagctgccttccttggcctcccaaagtgctgggattgcaagcatgaaccgtgcctggccattcctgggacattttgaatagcaaggaaatagacaagtactaaacaaagaattataagtgcattctaactgtgcatctgttttattttcacctgtctgacaactggctttctttgctgcttcccgtatgtgggagactataacctctatactgcttccaagatcacatcccattaggtcaagccataaacttaggagttgcaaaatggcattgctaagcctgagtttttaattcccagcagagatgagccaattggctaccttagacctatcagctcttaggtgttcagttcttagttctatcagctgtggctaggggtctggcttgtagagggctcagtgggtcagtggcagctcagagagaagagagttgtgggctggccagaaactgaatgcttttctacagatgtacaattgaccttctgtgtcatttcacagaagtgtgggcatctttgactttaaattgaaaattgttaaaggcatggtaattagcaggagtcaggaattctccaaatgactgttactgaccaattctgggcagaggagggggaaaaagaattttccttgattaccagctaaactgtgtttcatatttagcaacatgaatgatttgtgtgacttcactaaggactccgattggaacacaggcagtcctagtgcagactattgagtgggcagtcatgggtaaggtactgagcctttgtggaagctttctcatttatagactgaggaataatagctgttctgcaaagacatttttaatcattttgtttctggaacaatgtgtaggtgctgaatctgttagttttcctctctttccccgccttcctacttccagaaaagattttctgtgatttacatataaatgatcaagtataatagggccattaaattacggataaaacaagagccctctaatggaaagagaacatagtttttctacaaaaatcaaggctaagatggttactctaactgaataaaaatttaactatgagctttctggcacacatcataaaaacagaatagatgaaactgtttttaatatataaaaatcttaaaataccagttaggagagagaaaatgtttttttctaacattaaaatcatgtttacatagaataactaataagaaaaatggaatgacataattgacaatgttttaaaagtatcaaatgataaaacctttttctagtatgctccttgaattctagcctctgcacactgtctagtttctcatttttaggtatttgttacattagcatcccacttccaggtatttttatttggaagtatttttatttggaagactgggatttttattttagaagcatttaaacaaccagctttaccttatctattgaatgtctctgttctagctccccctttctttgtcccttataaagggaaaccagtagtctgttagtgaagagtgggaaaatcactaacttactgtaaggatattaactcttatatatcacataaaacatatactaggtccattacatagtacaaagaataagttgctacagtgccaataagcatgcaaataaatttgataattaacagctggtaggatttatgcatttattcactcatcatctattgagcatctattgaatattggaattatagcgagtaacaaaacaatggaccatagattatatcagaaatcttcatggttgcatgcaaatgaaagaaaaaaatagaatgaggatttatgtgcttagggcaaacactaacatagagccatttcttaggcacacatcaactaattttatactatataattacagtgcttaggtgaaaacaaataatacaatgatggttttaataaaattaaatttaactccctcttgtttcactgttactgtttttcaattaggaagcatcatgccatttgaaatttgggtaatacatatattattttcaatatttagatagcatgtatgttaaaaatattttaacttttccattttgcttttcacttcatgttatcaccctatttggacatttaatttttcttgcttgtattgttgcctgtgctgtacaatctctttattgctgcttttcttcaatccttcctgcatattgccattagactcttttcctaaagaatagtctttgttgtgagagtctcttgcccaccatctgaaatgctgatggctgaaattcaaggctttctaagagatggcagaaactaacttttttgcctcttattttgtatcactacattcatgaaagtttgaggtataataattcacacaaattcatcacataaaactttaatttgttttcatttgcggtattctccatgagtaggatagcgatttccatcctcactcgctcaaatattactcagcctttcttgtatagctcaaaggtcacttttgtgaagctttccaagttgacttcagctttcaggaatttccttcatctaactctttaagtaatttgggttagtttatatataacccagaaataatggctatgtgactcccactctatagagtaacattttttaaatctgcatctaatgatcttaaataataaggtgtactttttgctagattataccatgacatgcacacatttctccagaaatcgtcagtaagaccttcccaaagttctatattcatgtcagccacaaaattatctctctggcttcctcccattcatgtttgttcattgcctagattaagccacttcaccttccttatcctttttttttttctttaattactacagtttggttctgttgcccaggctggagtacagtggcatgacctcagctcactgcaacctccacctccctggctcaagccatcttcctacctcagcctcccaagtagctgggaccacaggtgcatgccaccatgccttcctcctccattttatcacatcatgacactctgtcttcttgctggaagttgtcattggaacttctgctgtttcctacttcctagggaacccagaattttcataccttactctcaacccatcagttcccctgagagttcaagaaacttccaggtaatagcagttcttctctcactctaaccgatttttgttgtgagacatccttgtggagactttctggtaaataaaactttctactactgtcttttctatatcattttcaacaagtactttctacacctggtaatagtgcatgttttatctactcttcaaaactaagggaaaaaatgaggacaggaagtacttttttattactcatggcttaactcagaggtccccaaacgtcgggccacagaccagtaccagtatatggcctgttaggaactgggacacacagcagagttgtgcagtgggtgagtgagcattactgcctgagctctgcctcctatcagatcagcagtggcattagattctcataggagcaggaaccctattgtgaattgtgcatgccagggagtgagggatttaggttgtgtgcttcttatgagaatctaatgcctgatgatctgaggtgaaacagtttcatcctgaaaccctccccaccgtctgcgggaaaattggcttccatgaaactgatcccttgtgccaaaaagattgagggccactggcttaacctttagcaagttctcttctttgggtgaaatacaagtaggaaatgaagcttcagtcacatattttctttccttttttttgtttgtttgtttttttgagatggagtcttgttctgtcacccaggctggagtgtagtggcgctatctcggctcactgcaacctctgactcctgggttcaagtgattctcctgcctcatcctcccaagtagctgaggttacaggcacgtgccaccatgccctgcgaatttttgtatttttagtagagatggggttttgccatgttggccaggctggtctcgaactactactgacctcaagtaatcctcctgccttggcctcccaaagtagtaggataagcttcagtcatgtattttctttctttcttttttttttttttttgttttgatcacaggcatgagccaccatgcccggcccagtcatgtattttcgatacaagccgggtgtcattgacatctaccacatgtccacacggcatttcgttcttctgcatgtagtgttaaagaaggtgtagataaaattcctgtcattccttccttttctaagcttgcatttcttttcctcctcctaaaaagaaatgataatagcttaaccaaataaagcaatttctgattatgcatgatataatagattatgttatcaggactaggtaagacaatcaacaactaaccaaatatcttaatgttggaatttattatgcgctacctatatgcatatattctatgggcaaaatattatattcatataatgcatacatatgtgtattttaagatactttgtggtttttctaaataattgtattatatttaaattatgagaaaagttaaaatattaactaatgaataaaattacatgtgtatatatgtatctgatatatataaccatatatattatatatttatatatgtgtgtaatatataacctatagtcttccctctttctccattacaagatagacctacagttatagtttttttaacacaaacttctactgaagatgcagagtattagaatttcctttcttgctatcaaactcaaacattatcatcctcatggaaacattaataatagctgtttactgtaccattagtaggtaccaagtactactctaggagatttataaaaattaaattgtttaatcataaataaataattgtgaagtgaattttgagaacatggaagctcaaggacacactgtaagtgcaggagatggaaaaaagggtatataaaattggtctgaatatccagattaaaatttctagcattcttagttggaatggtatatataacgaaatactgtgtggaactcaaaacaactactattcatcgtaagcatatttctcacagtagcatcagccacagcgtcactgagcaaagtagagaaagtggttgtgaatctgacaggccgtagcttaacatctggcacaataaatcattattatcacattcttaaggttagaaaggagtgataatttaaatgtttacataaaagaagtcacgttttaaatttctgttttcttggtaagttatacttcttagccacagtttccttgttcataaaatgggggcatttgttagatctgtaaggatccttcaagccttacaatttctacaaatttgtgattcctttcaattaacattttatcaccaaactaaattatcttaaaggttgaaagaatatgagatttaaacccaatgagttattctattgcattagattcagaagaccaatggagaaaaaagtataaaacaaatatatgcaatagagaaatatcaaaagttttccataatatttctacatgtatgtatacattgaaataacaattttaatacttaccatttaagtaaaatcatatatcgtaacttagagaataaaagcttttctaaggaattcaataattagagactttcatggtatgttgccttatgattctcttttgatttgctttgaggtatctgttacttctttgaagtttatgtttttcttacatttagttttggatattttctcccattacatttttcttccataatctctaagataaacacatttattattaaaatgcagtagatttcactagatctttaaaactcagtaacaaagtatcattttctatgcattattattatcactactaatctgtaattttatagtattgtatatacttatattattttcaggtttttggatcacatttcctagacaataatgagaaataagggcttctatttaaatggatattcaaaaagtatcatatatttgctgtggaccttcatctcagtgaatttgtgaatgtattatttataatgaaaataaaataagtgaatgctaaaaaagtttttccttttgccaggggatttaccagaaagagaacaaaatggatcatggtatgatacttttctgtgtaaatatatagagaagaaaatctaccaaagatttaacaatgattttcctacaattggggtgggaatggaatggtgagattcagaacaggttcaactctctatgtggtatctttctgaattagaacattttgaatgaatttgtatttctttaataactactaaaatatgttgttatattaagatagtcatatttagagtatttatactaattcttgaaatcacaacaatttatttcatatgtaaagaacaattgcaaaaacctctgccttgatggagtttacggttcagtgggggagagggtgataataagaaagtaaaagatggtatgtagaaaaataaaaacacagaagggcagtaggaagtgtgtatgtgtgagatataattcttagtaagagaaagaaggcctgtaactgaaaaattaacatttgagtgaaaactgaaagaaggcaagtatattattagtccagacgttctcacactgctataaagaaatacccaagactgggtagtttataaaagtaagaggtttaattgacttacagttccacatggctgcggaggcctcaggaaactcacaatcatgatggaaggcaagagggaatccatgaccttcttcacgtggcggcaggagagagaagagtgaggagtgaaggggaaagagccatttataaaaccattatatctcatgagaactcactcattatcacaagaacaggatggaggaaaccacccccgtgatctgatcacctcccatgaggggtctccctagacatgttgggattatggggagtacagttcaagatgagatttgggtggggacatagccaaaccatatcagcaagggaagaaaccacgcagttgtctgtaataggaatttcaggatgaaggaactgctaggacaaaggctctgagtcagaagcacatttggatagtcacagtaagtgggagtgtggtaggagatcaagtcagagacgtaatgaggtaataggaaacttgggccatggtgagaaattttatattggctagatgagttaagagtgaaataagcattaagaaggaagtaagtggttgggtaattgagtaaaatatggtttgagtgcctcaaaacaaagagcaaatatgaatagagaaaatactatttccccagctagcaaagtatttttggaaaaattaatatcttctcactagacatatgtatatatccaagctatttaggtaaataatttgatttaaactgataaataaattaagatattttacaatctttcattcttttcatttttttcatttatttcttgagtatctattatgtatcagaagacaaaatcacatcatactctcaagtttacagtctaagtctacaacgtaagtctaatatatccagccaaagttagatttgcatttattttgcatgataatgttagaatggtttcaagtaacacttggaaagataacctaaaatgaaaaagtttagagagtgaaatgcatattattttttatgtgggaaacatgaatcttagttgtgaaaaatagccttgatgatactctgaggaaaagtaaccaggttttttttttaaccattaagtgtgatgttagctgtaaattttttgtgaatattctttgtcttgttggggaagtccacttttattccaaattttctgacagtttttattatgaatgagtgctggattctgccaagtctttctttacatgaattcatatgattatatgatttttctttagtctcttgttgtagcggattgcattaattgatgttttattatttttatttttattagtattttttgagacagagtctcactctgtcacccaggctggagtgcaatggcacgatcttggctcactgcaacctctgcctcccgggtttgagcgattcttgtgcttcagcctccctagcagctgagattacagacatgcaccaccacatctggctaatttttgtatttttagtagagacggggttttgccatgttgaccagggctgtctcaaactcctgacctcaagtgatgcgtacacctcaacctcccaaagtgctgggattacaggcgcaagccactgtgcccaacctaattgatgttttaaatatcgaaccagcattgcatacctggtataaatcccacttgttcatggtgtatgtaattttttatgctttgttggattagattatttaatagttcattgaagatttatgcatatatatttatgagagatagcttttatttgttgtaatgtctattagggtttggtactaagttaatactggcctcttggaaaaagataggaacaattttctttacttctgttttatgaaatatattggaagattaatatttcttccttaaatgtttggtagaatttcctggtgaaataatcaggtccttgttcttttgttcttagaaggttattagtaattaattcattgtatttaatagacatagacctattgagattatctgtttctccttgtatgagtttgtgtctttcaaggaactggtttatttaatataatttatccaactattgaccatagagttatttctactgttgctttattaccatctaatatctgtgggatcaatattttacttttgatattggtaatttttgtctctctcattttttcttggctagcatggctagtggtttgtcaaatttattgatctttccagagaaccagcttttgatgtctttttttctattttccttctttcagtttcactgttttctgctctaaattttgatgtttatattcttttttagatataaagtgttgttttttctctggtttcctagggtgaaagcttagagtttcagatcttttcttcttttgcagtacatgtacctaatactatacatttcccttaagtagtatgttcactgcatcccataagttttggtcagttgtattttcattttcatttagtaatattctagaatttctcttgagaattctccttgactcgtgatttatttggaagtatgtttaactttcaaatatttggagattttcaaactgtctttctgttattgatttttagtttaattccattgtggtctggaagcatacttcatgttatttctattcctttatatttgttaaagtgtgctttatgggccagaatgtggtctatattggtgaatgtcccatgtgagcttgagaagaatgtgtattctgctgttgttggataaggtactctataaatgtcgaatatatcaagttaattgatgatgctgttcagttcaactgtatcctaacaaattttctgcctacttgatctatcagttactgaaagaggagggttgaaatctccaactttaatagtggatttatctatttttcttttcatgtttatcagcttttgcctcgtgtattttgatactctcattaggtgcttacatatttaagatgttatgtctacttgaagaatttacccttttttgttatgtagcgtccttccttatccttgatacttttcttgatctgaggtctactttatctgacattgatatggctattccagctgtttttttaaaataatgttagcatgcgatatcattctttattcttttattttcaacctatctgtctttgatacttaaagtggtttcttgtaaacaacatcaagttcagtcttgtcttctcatttactcttacagtctgttttttaattggtgtattttgaccattcacatttcaagtaaatattgatacagatggattaatgactgtcatatttgtaactgttttctatttattgcatctgttctttggggaaaggaagttaaagtcactaggtttattattccttgcaacataaattaatggctctggggggatatatgcaggtctctctgaaagtgtctattgtgaacttctagttttctttttttcgaaagccttgaccatgcagaaacatgaaactgttcatatagcattgtttcctgacagtttatagccaatctatgtcagttccataatttttaaacttagaacatttcattaacctccttatttcctttttataaacatcttcatttttcaggcattgcatttaacttgattctgaaccttactcagatgattaactcaatcctttaagaagatattgaatttctgaagaactttctcaataatgttgatttaaaatgattaatgatagtccctttacttcccattcatgcttaaattttataaaatacaatcctttttatttagaatttaaagaattttccttaaatattgtgaggtgtagcagtaacagctttttgttttgagcaaaacttttctctggttatagtaaaaactggtttattccccttcgcaaatttgcaaactcaccaaaagccctcaatctgttcttccacaaagatgtaataaagcaatttgctgttgaattctcaaaatacaagtatggctttaaaaacaacttcttctggatatattttgtgcaacagcattttaaaattcttgtttattcttttgaccacctgtgaaatttggagtattgtattttagccaggctaatataatcaattctgccaactctatgtcaactacaaggaaatattcttacttaaaacaaataaataccactaattagctcttcatttcgtgaagtctgagaatgtgaggctcagatagtaaccattgaaaaaagacaactcagaatgttgttatttgagcataattctattggttctctgacatgaaaggaagcctttctcccccaaacttcaagggattttctttatttgatctgagaatcactgataacttttgccattctcaacccaacctgattccttgtttgttatgattttaacagtgacaacaaggaaaaacatttgatgttagtaatatgtgaaatcttaggattctgtgtcattccctttattttataggtcaatacatatttaatacatttctactgcatatatagaaaaggaaagtgagatttatatactaaagcatgaagtacagtgtcacaaaagcagaagaggaaagaatttcaagaaggctgaaactgtcatcagtgttaggttcagcactatgttttcattaaaaaaagaagaaataattttcatttgaaaagttaaaaaaaaaaaacgttttgtaaagcttttggaatgagtcttactatactacacttgtttttgtaagactgcctgaccctaggaattctaagatagatgactaatatagataatggttgctgcttaagtgtgcttatgtgtaaccctaattcatcactgtccaatggttaatagatttagagtagctgcattaaaaaaaaaaacacgtgaggtctttttttaaaacataatctgtcttgtctttgtcattttggcaatagaaaatgtagttttattttgataaaggttgaagaatttattgggagaagatatctgatggcattaaaaatgtctccctcaaagcaatttaagatatcaaagttacttattgaggctcaatctgttgacacagtcatacaccaataatttcctaaaagcagtacagaatactaatgggtgattattttttagcaaagaaaatgcaaatatattctgaattgaatgaatgttatattaaaattagatgacgaatatttgaaatgaaggagaaaaagttcattagcagaaaaatctcatgaatcattaatatttccactatagagcaagttgattttttattttagtacagtaatgcatagtatcacatcaagtcatcttttgtttatacggttaaaaggaatttttcaggaaagtatttacttcataaataaagcttttttttctggaagtaattgaggttgcatagcagtgtcttcagtacggttaatgttcaaagtgaaaagaaaatatacacaaactttgggtggagaataatacagatttcaaacacatcaataattcatttgacatgaagcaaggaggggcggtgtgtcctacatgctctgccattttctctgctagaattccacttcccccattgtatcctctcaactcccacaactcctctttaaattttagttcaaatatcacttcctcaggaaggcattctcagattctcagatattgtcagtacctactctatacttatttataccaagtacttatcacatatagaattaaagattggtcgtttaatggtgttatctgtcactaaaaagaaagttcttattgtcatggaacatgaccacattgttcacagttgtattcctatgtccagaaatggcactttgaacataatgtccactcaataaatgtttgcttggatgactaaaaaaggagattttttaaatggggctagaaggtatattgcttccaatcgtcagggactttggatttgtgtttgtgtgtttaggctactagggagccatgaagagtttttatcagtagattgacaaaaggaaagcaatactcttgtcaggttgtaatgtgtagagagctttaagtgtagcaaaactgcagggaaggacactatcagagtactgatggcagttcaccttgaagacagtatggtaacaataacatacgagatggtagcattgggaaaatattcatgatacattccaagggaagaatttatagcactttgcctttgattccatgtggaggaggagtatcctagataattttaaggttttgagccaatggataagatgaatggtaatggcattactgaagaaaaggcaattcaagaaaaagagcatgtttggggagggataacagtagcaacaaaggcaacaaattgcctcttaatgagaacatgctgtcttatatcatagtagatactacacacattctttctaatttgtgcagtaattcagtgttactcttccatttgaaccgttatggaaggtaaggctcttagaggttaagaaacttgcttaaagtcaaacagttaggatgtggcagaatttggattttattccggattttatgctggctccattatgccatttttgagaggataagatgttaaattaagatagagaaatgatagaaaaaatatgtgtatatatacacatatacaaacatccatgtatataatgtctgtatatataactatagatgtatgagtgtgtgtgtctccgtgtgtatatttgttgtgtatgagaaattgaaacacatttatgtatggatatttagcaagtggtgaggaactttgagatgaggattctgcagtgatattgatgttggaaatgggcaatttattcccatatcaggttctaacatttaaaatgcacctgaatttgtattaagaaacttgtcttgctaaattttaattctatcagattaataatagccacagagcttgtaaagggaatcattattctaaccttttgaaaaaatttttttgtagctcagtttaaaaaaatggaatcatcagcaaaagtttatggttgttttgtcatccagagtgtttccattaaaaaggttttgtgattattttattcagttatattaataataaaattcgttttaatttatatttattgtgttccatcagattcttctatttgtggtgacaggtaacttaacacccttgaaaacagctgtttacaagatgccattctgtaatgtgggtttctttctcttctaatgggaggtcctaatgagcaatgtaatgatccaggaagatgagcaaaaggacttaataattgaagattgagtgcaagaagtgttctgtagaagtttattaaaaataatcattgggtattttggagataattatttcacattagaatggagaatatgattgtaccagaaaggaacatgggcaatcattctgtctatccttgtaaattcttgatctgcacctctagaattttggttctggccagtttatgctgactacatccatttttgaattacatacataattttagattgtacttcatagtcttatgcttaacagtgtgttgcctttgaaaggtatttcagtttcaatgtaagcatttcttagctcctcaaattgatggcaagctcctcctttaaggtcagcatatgttttctggagatttttatatcctttaaactgcctaatggtgagctgaatacaaaataaaaaataatacgtaggccaactatttggaaggctgaggcagaaaaatcacttgagcccaggagttcaaggctgcaatgagctatgattgcatcattgcactccagcctgggtgacagagcaagacgctgtttctaaaaataaaataaaataaaataaacttagggaattagatacagcatctcttatggcatagaaacatgaagatatttgtttctgtcaactcagggtgaaaataatctgatgaaatggaacaatctagttgaagttcagctctggctatatgacttccgctttctcacctataaaatagtgataatcaaagcatttaccagttgtatgttatcagaaattgaattttaggtactcctgtgagcatttggaatcttgttaatgttatcatttttcctaataccatcatgtgatatataatactgagaacttggaaatactaccttgtgtttttatacccagaaaactcaagtagatacaaataattagggtaatttgaatgagataaatttcagaaattaaactagtcaaaaatttcaatatttctacattttttatgtgctaagtgaagacctaggaaactcagtgggatgacagcaaatacctagacattgtgctggatcggtacagaaagataaatgaggtatttacctcatttatggactctatacttaggactctatacttaggaaatatggactctatacttaggaaacttagggaattaacataagcacaggaaatataacacacatatcaaatgtagagtcatcaattatttgaaaaatgtaaaatgttcatcatatagccatctaccattgaataattttagatgatctcaagtctcattattgtaagtcacttcccctcctcccacaaatgaccttaaattattccaccaactctgtatcttattacttcttttgtcaaagcgaatatttggtaagtaaaattttaagtaaattgcttcagaatgtcaccatcttatttcagactttcatgtacacttcaacatttgaacctttttttttgtacttaatgggactaaaaatatctgcactacctgtacgacacattgttatttgaatactttgaaactgtaaaacactttgcaaatactgagtatcattatttaactccagctaaacaaacaaggttgatatagatgttttcaatgttgctgcctgacagcaaaacatgtgttagctcagcaagagatattctgtatatactctatgaaaatactcgcagatgaactttccattaataaaaactaatcgcttggtaaagaggatattatttgtttcttcttctatcccatttgttacaaatttaggcatatgaactacaggcatatgaaaatccaggttttacagtgaaaactgtagatcagtggcccccaacctttttggcaccagggaccagttttgtggaagacaatttttccatggacagatgatggggggcaggggcaatggtttggggttgaaagtgttccacctcagatcttcaggcattagttagattctcataaggagcatgcagcctagatcccttgcatgcacagtttacaatagggtttgtgctcctgtgagaatctaatgccactgctgatctgacgaggcagagctcaggcggtaatgcttgcttgcccaccactcacctcctgctctgcagcccagttcctaataggccatagaccagtaccagtccacagcctgggggtcggggaaccctgctctggattcttgcttcattctctgatattttaccatgttttaagaagagttagggaagattataggtctaggcaatataatgtaatggcaagtcctcaggctccaaagtcatagatttccctttgtatcttggccccaatgctaatgatgtttctttagaaaagttgcttaaaaataacgtttattgaatgcgtataacatctcaggtactgttgcacatactttacatgtatgggttatttactattcccagaaacactagaagtacattattattattgtttctatttgatagattaggtagctcaggtattaaagagttgacgcgagatttgatcccaacagtgttttccagagcctgttatttttttacaccatgcttctcaggctctgtttattatctataaatgagattaaaaggtgatctactttatcagtttttgagaattaaatgagacaataggtgatgaataaattacaattcaacagcacctgtaaatgctcttgatatattccaaacatctgttggccaacatattcattttttttaacttgggtagcagtgttaacactagcatagcttctaaatagtgaaaaagaaaaaacaaatatatctatctatctatatatgtatgtgtatatatatatatatatatgcttgttaatttgaaatagctaataaagaactaagtgaaatcagctacttacaagtagaatgaaaacattaaaactaagtacaatttaagaggatgtagtgcattttgatgggctgattgttagtgtggaagagactttatttcttccctactaacattcactgttaaattggattaagttcctaattttagtcagtcaagcatataaaacctagaataaccacagagagtaggagcaaatgtagcctacaccttggcccccagcatccctaatgagggcacataactcccagaaacactgtttccccattcttaggtcaattcttgctgggacactggctttttattctcccagcttacgtcatcattcaggaagttgtaaataacaatctatgaacatgcattcaaagggaatggttacaagctcagaatcaaccagggtcacatcttcatttgggtttaacatattcaagaactagtgtaccccaagcctaaaggtagagactacctccagcgctctagcccagaatagctgtgtattgtcaagccctaacagtttatgaatagatgctctgcatgtgttctttagagctgtgctagaattgtgtgtttgaaactttaatttgtgtaggaagcacctgcagagattgttaaggggatggtgatctggttggcctgacttggggagtgagttttctgcatatccaccagattatcagaggatgcccatgcagctggtcattggagcaaacttggaataccaagcctgtaaagcacagatgatgcattacctaggtgagcttcacacatttgtaaggaagttttaagatcgatcttgtcagatacccagagccagatgactgcattttaaatctgtgtgctgctctgttttttaaaactaacatttctattctaggaatcttttattataatttagatctggaatgacttttttctaaatggctcccaatgtaatgactgtgtcttcagattcagcaaccatgttttcattatcctctgaatcacagagtataattgtgcattacagtttggggtttgtttttcctactaagaaactccttttccttgcgtcctttctgataaatatcattaatttttccactatggaataattctacttcacttttgaaacataacctcatttgaatgtattttaactgggacttcattgcctgagggaagatggattattagtgacatgtgtcttgcttcttgatacagaaaagataatataaaagtagtgtttctactatatcttaaaaaaagcttcatataagccaattttctttaatgatattgtagcaagggaaaatattgtacaactcatttaccttcatttttacatatttttcaacctcaatgataattctggagatattcatgtgccttatcttgaaatcaaattaaatcattcttttgtgatatgacacgcaatttgtgacattttgagccaacagtatattaagatttaattttcagttcattatagacctagtgcctaaatgaaatttattgagactaagtaactctgcagtgattgtgggctgatggttcaagtacagtgattcagtgattcttagtaggggagaagataggccatgtaattgaacttatctctggatttttgaaaggttgaggcaatacctgttcttccaacccctcactggctccacatttcaaacacactatacctgagttggaaatatcagcaaatgtgtttctagatggatatgtgaaaataaataattattggcttactgtgttttttaaaattgtggtataccatacgtaacatttactgctttaaacattttaagtgtacagttctgtggcattaggtacattcacattgttatgcagccatcatcaccatccatgtatagaactgagctactattttttaagatgtattttttcccttagattcttctcttctgagtttgttaatgatgtccaattaaatgtatgcttattttatatgtatgaggttactttttaaatgggaaagttgagctccatctgcctgagggcactgtaaaaatttaactttcaaaatataattcctgttttgctgttgttgttcctcatgatttccttttttatatgaatattttctttaaacatattgacagtcaatttgacaagctgtcacttctggcaaatgccactttttccattagtaacttccttctttcaagaaacactattagtcactatatcttattatattaaacatctccttttaacactggtaacataaaaatgttttactaacagttctcacacaaaaatatcatattgaaacaaaaattagaggaccagaggcatttactcagaaagaacaaactttttcttagtaatgacagtgacccaaccaatcaaataaattgaagaagtaataaaatgaatgcatttttatctgaaacggatgccaccagtaacattttgggaattccaatttaaaaggcccaatgccccccatgcaagattagtttttcaagatacttttacagggctaggacattaaaatatttgcttctctattggagcagctctttcaacaagttggaggactgatcacatccctttgccaattgcagttcagataggctctgggaaggcaaagtacaggatgtcatgcaagtgaaaacagaagtgattaatcttatggatagatcaaggaaatttatctgaactttagaagtgagacttgatgctaaataggtgtttggtgtatgaaaactaaggatgaagcattcctggtaaatagaaaggcctgattgaaagctctgagctgggaacacagcagagggaagcctactttggaaggagggattggtctggcaaagtgctggataacacaggttgtaggtcatataaaaccttgtagggggtttgagcttcttgaagcctatgagtgcaatgagaagccactgaaaggtttttagcaggaaattaacattgtttctaatttttatttttaggaaaataacttgctactaagtggtgaatgggagacaagagtgtctgtgaggctaaaggctgttcttgctgaagccccaaaatacttatttactctttcttggtgtaaatgagatgaaagatactacaggaacatcacatgtgttcaataactgcgcgagtgatatacttccctacggggacatgaacagtacttgaacagctgttaatgtctgttgcccttaggaaatttatttcatcaagcatacagtgtttcaacccttattaacttatttcataaggcataatatatctgactgtgatctgttcacttaatgctactctgctctttgcacgagcatgggacaaccagttgctctctgtagtcgtagtttattaacgtgcaattaaagacatttatcatatctctgaaaatgtctcttctcccataaaattaacatcatctcctcaaaaagatgcttacgatatatgctggattatagttactgttaaaatgtattcagaaacaaaaatagaattgaaaactatagaggaatttttttaaagcatgggctttggaatcaaacttgtgtttgaattctagttctgccacttaccagtcatttgcacttgagtaaggtacttatcccttctgaacttcagtttttcatctggaaataggcataatgacatctactttatgaagttgttggttatgtaaagccatctatgaaaaatggttagaccagtgactgacacatacgcattccataagtgatagatacataaataatataaataaaaaatgaatgctatagctgacaaatgtgattaaaaagtctacaatgcaaattatttttataaagtataaaatccatgtgaccatataatatactaggacaagaatgcctgttagatttcagattcaagacaacatactaagtttaagtgtagttatctttgctaggttagctttatgtatttgcatgaataattgtttaaatttgtctgattgtactacggactggcaggcaataaatttcattatctagtcttaaaatgtgaagagaagacagctcaaagttcatttctcatgcctgatctttctgggggatacaatgtacaacatcagataattcttttgccttcttttcttttgtgcatccagtaacagttatatcatttttttctgaatcagccttttcacaaaaccattatgtgataagctcttgtcttggaaaacctcaacagcttcctcaacacctatattttaaatcctgcttaaatgagattaaaatacggcactctgttaagctgtaaaactggctttttgcttctcagttgagtgttggtttgaatgtgtcatttgacctatattgctgctctgaatcttcctcggttgccccaatgatgacagtttcaatgatgtgggtgtttgcagcagagttgttcctaataaggaagtaacgctattgtctttcagacatcattcagcctgaaaagtactatttttcccacctagagctataaatgtctgtaaaatcttttcttcttttggtagcatttgcagcagcagcaggaaaaaaaaatagtcctagtagatttgcagcttttgtagttttggggtgttgtggttccaggctaagattcactcacccttcttcaaaagttgtatacaaagggttgatagctaaatggtgactgaagtacttgatttattagtatctggcagtcatccaatatgtactagaatacaagactctctgtcaacaatagctgcataaagagcaaactgctctgcctgaacctaaaataaggccttctgctgtctgcccgttaattgaagacaagtgggccaggagtggctgaggaaaaacgaacaaagaataggcaattgtcatgcacatggaggcactacctgtgcctctttgagaaacagaaatcccctgacctggttcttacattgagagaagctaacccagcccagtaatacattttagctccttgcatgtataattatgaccattgaaaaataggatactacctttttattgggtcaggtaagatgcaggaggagggagagcaaagtgccctacttgagggtgggattgagattagaatgtgaagagaagagcagaaagcttccttcttacacaaataaaggttctgtggattcatctagaaaaatgagttaaaaaaaaaacgagtggaactatagtttctaaagtctgtggagttgggacaaatggtaattataaagactaaatgtgaatactcatagttctttaatttgattgtattaccacttaattcatagttttgaaggaaatagccattatattagatggcacattaattttaagatgcaacccaattttcaaaatgttaaaatggaaaagaaagttaaagggtgattgttaggacaagcatctccaaatactctgtgtggaggcattttaattccatgctcttgcaaaattaaactcaaaaatgtttcaaattactgggtgttatatgcccttctggtggaagccacattttctctttcctttctttccctgtctaccctccctcttccccttcctccccaaatctatcagtaaagaccaccttgctgtgggcagctagctgaaagagaccatctgccttaggaatagcctacactagattcaaactacaaagaagcaggttgggggaaagaggaagtgaggatttcaagtcaagaaagcatcctgcctactctggcaaagtattctgccagcagcatatttggattcacactgtgggtttaattctttccgtttaatactttttgttgaccttataaagccaaaaaataaaggaacacccatggcactgctggaaagaggtaactgatttctgatgaaccggtaggcattttagccactaaccaacgtatcaaagtgggcacaactaacacatgttaacagttttcccaaagtaagaagcttggtttggagtgaacaggccttgtacttttgagattttattttatgattttgtgaattgatgttctgtggggaaaaaacttgccttagttttaatataatggtcaatgactaagaaaaatcaaggagttgggctgggtgcggtggctctcgcctgttgagaaatttacatgtccatcagtttcttgtattgtagtttgaaatcaagaaactacctcagtttcttgtacaagtagtttgaaatcaggcggtcaagtttcattctaccctgctagaatatacaagaatccaaagcaataatgtaatttatacatttcaaaaggctaatgccaaattttatcagcaaattggtcataagtctccaactggaacaaagtgagtgattgttgggcaatgtagtcctgcaatgtgaaattcttgtatgcattccttcttaaaaggaagcaaaataagcctttcctatagaatttccacttcaagattccatcatcggcacatatcaaatactgttggcaatgctgaaagtaaaagcaaggactcacataaagtcttttgttgctgaaattaaaaatagttgtcactattttcaatatcaaaatcctatggtttttgacaggtttaaattctctgttgattcatttcagaacagggtcatctttttatacttctttgacattttaaaaaataagtagtttggctagaaattgagtgtttcaagccatcttggccctttgcaccctaaaatttcagtagcactgtcaagcgaatcagttcttaagagctggaaacacaaagaagacaaatatcaaagaattaattaaaatcttttcttgaatgacaaaattgacattatctactacttatataaggagactacattgtggattaaccctgaaatcagtacttggaaagtttattccagtgtgtttcactgaaatttaaattcatgacatttgaaaaatgtaagttataattaaacactgagagtaattcttgtggttattgtatatttgttaagtattccatggtaaatgtgacctgtaaatctgttaaattaaatacttgggagtaaatttacttttactttctgtggaaacatttggattaccccaacagtaaaagtaacagattaaaaatataatattctttattttcaacttttatttcaatatatatgccagtcaaatgccagtgaataataatcacatttgattgtcaaagctcatggaatggtacacctaagatttgtacgtttctttttctttcttttctttttttttgagaaggagtttcgctcttattgcccaggctggagtgcgatggtgcgttctcggctcactgcaacctctgcctcccgggttcaagcgattctccagcctcagcctcccaagtagctgggattacaggcaagcaccaccacacccagctactttgtagttttagtggagacggggtttctccatgttggtcaggctggtctcgaactcccaacctcaggtaatccacccacctcagcctcccaaagtgctggaattacaggtgtgagctatcgtgcccagcctgtacgtttctttatatatgaagtttgcattaagagatcatgaatattgaactctagtgaatgatatgcctgctgaagtgttttaagggtgaagagtactgatgtctgcaacttacactgaaataaaatggagtgatatttggattaaacgatgaatagatgggtgggtatgtaataaagcacatataatacaatttattattgaacctagatggcgggtatatgggtgttcactgtaaaattcttccaacttttctgtgtgtttgaaaatttttcataataagatgcgaggaaaaagcttaaaacatgcttgaattataattctataatatattaatattaaaatactggaagtactcttgcttcatcaaagttactttcaaaaatattggtttttgtcatcttcaaagcatgtaataagaattttttaaattaagtattaaaataaaacttttaatgtttgaaacttaaatctcacatggcactgttcctattatggattttgggggttagacctgtagctacccatggtatcttctttcagtggctcatatatacaagatttcaatttgtagttccctcactaaaaacaaacagcctctgatgaaatttatcttgatagggacatctgaaagtgttgatgaatgccaaggactctaatggaaaacaaacaaacaaacgataatttaaaaaatactgtttgctttaaaattctactaaaatggagttagtctacatgataacattaatcccatttgctgtgccaacatttaagaaggaatctgtggtttatcatctggtttgccaattttttgttaaatatgaggaatattttagtaataattttttaaagattacatgcaataatagcttaaactttaatacccattaatgagtatccataaagaaaacaattcagtaccacttaaaaataatttgaatatcagtcatcataatacgatgaacacatttgatagagaatatgtgaatagaagtacattgaatcagttttattctatctacagatgctgaatggcatagggaattgtgggtctcatgaaattttctcagaagtacccggaggatcttcactaccagactgataaacacaattttttggttctttgcccacacaggaaacttttctagaaaagtttcaaagaatacatgccgaaacatgaatcctggaaaagaaaagtgatcttctaaatttgaaaatgaaagatttatgtggctctcacgtgaaacatcctctggcaagggagtaggtacatgatggaaatacatggattttcactgaagaaatgaaaatataagtggcaaagtaaacttcatttatactattgaaatattcaactgaggaaagtacattacttttaaattggaagaagcaagggcacatgatttttttacaggccatgtcattctctcatttctttcatattgaaattagttggacttttctttatcataacgagtgttgccacagtttacacctgccattctgacttttcgtataccacctgttgagaggaatttttttttcattctgttatctacatcattgaaaaacttaacacaatccatgtaaagaagaaacaaaaatatacttgtaatgttcacataaatatagaaatataacttaggagtccacctaatgctagaatttttatcgcattttaagtgttatggagttttaaaatttccatgtgacttaatagctggaaggaagcattaatatttaaatattaatttcaataaagataaaacaaattaatacttttaaatgaatattttaaattccctaacgagaagacaattgcataaaattaagtatgtattttagtttgaagaactaaatcattcgtgatacatgaccgtactacctgccggattcatctttttgccaaatatttcaatagtaattcttgaagtcaattctcagcacatatcaacttttactgttgtggtgggtgagagagtggagaatcaggctttaaggtgaatttataatttactatgtgaatattgccaggagttagaatgacctttaaacattttgtgaattgcctatttcaatacttaaggattttgtatacgcaaccctgtacagtaattatcaagcatactaaagttttagaactaccaagttaaacttaagaaccaaaggggccaggtgcggtggctcacgcctgtaaagcactttgggaggctgaggcgggcggatcacaaggtcaggagtttgagaccatcctggccgacagggtgaaaccctgtctctactaaaaatacaaaatttagctgggtgtggtggtgcgtgtctgtagtcccagctactcgggaggctgaggcaggagaattgcttgaaccagggagtcggaggttgcagtgagccaagatcgtgctattgcactccagcctggcgacagagtgagactctgtctcacacacacacacgaaaagaaccaaaggacgtctgttttgcagatatttagacattctattatttgctttacaaataactaagaaatacctagtgatgaataagagttggatgggtgattctgtagctaagctgttcagtaccgtagccattagccacctgtggctacttaaatttaagttcattataattaaacaaaatagaaaatttggttcttcagtcacagccgccagatttcaagtactaacagccaaatgtgcctagcagcttcgtattgagcagcacagaaagacatttctatcattgcagaaagttctactgaagagtattgttctcaactgttcatctccctgggattttatctattttgttaaaagatcagacttctaaaaacataacaacttgttttgagaattatagaagctatttgagattcaagttatctcatagaaaaagttgattgtacattttaggtgttgtattttctgaaaatatctagtattgttaaaacaagagtacttagtaagaattattgatatggcactgtacattccttgtcattaaaaaagtggtcagcacaaggaaaaaaaaaacatatatagtttaactaaaaatcacttttcctctcctaaaattattctttaagttgtggtttacaggcttgattatagcaaaccatctcaatgcctgcatgcaaatagctaaatattattgactaatctcattttgaattcatagccacaacaattctcaaaggagattcagcctctccaagcaccaaacatcctattccatttccacttcttattctctaaactgattttcacaccttcttctctctcttcaaacctccctctcacaacagttatgtcttctttttacttcattgaggaaaagaaatatgacaccccatttccctcattttttcatctgcaaatctaccagctcatctggatccaaatctacattctcctcttcccaccttttttttagagatggaatctccctctgttgcccaggctggagttcagtgtgtgatcatagcttaattactacagccttgaaatcctaggttcaataaatcctcccacctcagcttcctaagtatctaggactacaagtgcatgccaccacgcctgggtaatttttaaatttttttgcagagacagggtctcactgtgttgcccaggctggtctcagctcttggcctcaagtgattctcctgcttcagcctcccaaagaactgggattacaggtgtgagccactgtgtccagcctaaatctacactcttggcctgcctttcagttttactggaattgacaagtttacctgttctcatatcatgtccagcctttccacttggactctggatttcatttacttttaacttattcatgcatgttcttttgaaattatctctctcctccttcaatatcaatttttttgtgtgtgcctataaatatgttctgctgttttctaactttaaacccatataaaaatacgctcttttgattctcttttctctttcggatattaccttgtttttctactctccttgctacatgcaaacacacatcaaaatctagaaggaattattcatactttttattgcaattatttacctcgtattctcttttcaaattagttcatcagggcttccctgacataggctggttttctttcctcctttccttccttttttttttttctttcttgtttttgtatcctatggtcacatgactattgcattgtcaaattgaatggccatgtctctgttcttcccatacttgatccctccacagaatttggcacagttgactacttgctccttctggaaaactgtcttcttttgtactgagccacataaaatcatcctggtttcctcccctctcagtttccttttctcatcatttctgtatccccaaatgttagtgccagttctagcttcatacttttttttggattaagtcatccaatctaatgtctttaaaatgctaactatatgcaaatcacccttaatatgtttttatatttaattctaacttatctcgtgaacatgaggcttttttcccctcaaacagcttacttgacatacccatgggagtacgtatctaatatgaatgtcaaacttaacataaacagaccttttgatttttttccatcagacctcccagcataaacaacaaacaaacctgctgagccctcactgattaactggttccattatgacccgatgactaaagtcaaatttataaatgcttttataaacttcatatctaatcatcagtgaatcttgtctcctgtacctcgcatcccccaaatctggccacttttctgtttcttcattatcactaccttatctcaacccttattacttctcacctagactgttacaattatttcctgtcatgttttttttcttttgtcaccatacaattaaatctcccttcttcctctacagatacaataatctttgaaaaggtagaccaggtaattttactccactgacttcctataaccctaaggcaaagatctgaatattttaacctggtctacaaaatccttcatgtcctaacctctgcctagctttttaccccacgtcattccctttcccacttgcatctcaggccaactcctacattagcatctttatgtagttagtagatgtttctctgcatgaaatgttcttacttcagatcatctctatgtgggcttctcccttaattgatactttctcagaaatcttaattaagtgatactttctcagaaatgcctttcctgacctaacgaaagtaggaacagtcactctcaatcacttcaacctattacagttgtcagtgtggaacttatgctctctaaaatctttcttattttacttatttactgattaattatgtatctttatctgcacaaaataatctccattttatccccactgtctggagctttgcctgttctagaatctgaactctttgtatgaattaaataaggatgaagtcaaaacaaactgtactgttttttgtttcaagtatcaggcgatatttaactatttgaagttatgggactaccaaagttactccttctggttgacactttactgagacaaacaccagtgatatgaaatttccatatagtcatgcatcacttaacaacaggcatatgttctaaatgcattcttagacaattttttgttgtggaaacatcagagtgtacttacagaaacctagatagtatagcctactacaaacctaagctatatggtagagcctgttactcctacaaacatgttactgtactgaatacttaggcaatttgaacacaaaggtaagtaattgtgtatctaaacatttcttaacatagaaaaggtacaattcaaatacaatattataaccttatgctaccactatcatattatgtggcctgttattgacagatacattgttattctgttcatgactgtattagtaccaggttgtggctgtttctaatatatcctctcccactcctctcattccttactgaagtcaccagggtagtagcaaatcactggaaccagacctataatatatctgacttggtatctgtaactgttctgagaaacatgtgttgaaaggcagccaggctgcctgatgattatttagtagctgtctttctttactgaacaacagtgaataatatctttgatctctgccactgagaaataaacagaacccatcaggaatttaatccctgggaatgattttcacatttcctggtatagacgtttgattttgaagctcatatggtttgcacaataaatatttacctatttatgtcaaaatgcatgttaaatcatttttatggttggtgtgaggaatttgtgaaacaatcccatccttttgttattactgtgtttttgtaagaggacttctcacaccttaacctcatcaatagtttttcctgtgtgttaatgcaacaaaatggaagcaaaaagatatattttgttttcatttattttattcacctgaatctatccagagggaaagcactggaagtgttttctttttaagagtgttaacttgtattcttggtaagatctcatcaaaagcttaaataacgaaggtaagagtcagtattctgtggacagcttagctctacacaagaccttctgtccatcttgctagttattttccagttaatggaaatcttatagacagaaaagctcatgttagcttctcccgcatagtattatgtcaacaatccttactctaatccttgatgcagctctttacctaaatgttatagagatggagaatcacagctgccagcaattcaaaatataacatgcagtagctattttttaaaaaaaattttatttgctctcataaaaataccatcttaaagggtttttgaaaatttacttgtgattttgtctttttttaaagtattgagaaaactattgagtctgaagtaaagtctctaaaatacatcttgtcttattgtaaagtaatatgactgatattttgtgtgaattttagaattagttttttcactttatagattcattacatagtggcacttgatttaaacattgcatcagtactgtagcccttgggcatcgtgtatagagtgtctattagctttaactcatttctaaaaaattaacttctaagaataagaaaaatattgaaaactcttgaaagtaagttagaaacgaccatgattttatttttatttttaatttttatttatttatttttttgagacggagtctcactctgttacccaggctggagttcagtggcacaatcttggctcgctgcaagctctgcctccgaggttcaagccattctcctgcctcagtctcccgagtagctgggactacaggcacctgccaccacgcccggctaattttttgtatttttggtagagacggggtttcaccgtgttagccaggatggtctcgatctactgacctcgtgatctgctcgccttggcctcccaaattgctgggattacaagcgtgagccaccgcgcccagccgattttttttttttcctgcaaaaccatctaagggaggtgtttgggttttcaaggaaataccggctataagcatcattggatgttttggtggggtgggttttttgaaaatgtgtatgcagataacagtgagtgatattgcataagtattttaactacttagattgtttaaatttggttaacataaaatcaaggaaatggcttgcattattctatcttttcttttctaaacagtgtttccttaacaattaattctaacaagtcttggaaccatgggcactttctttcctcctgtcaccatgattgatccctattttgttggaaagtgaaaattgagcagttttaactctaaaggctaacattatggaaaaaaatttcaactgaatttgctagtaaatgctttgtatgaaaatatttagaatttaagtacttctctttacagacaaaatcatttattttcagtgtattatgaacatagttcctagtagggtatgtaaatgattcacttttaaattatgaatattttcttccaaattccattgttaaaattagtaagtgtaaagtatgacttttaagcaatatttcattagctatcattaacaagtatttaaccaccttgtttcaaattagttagctaatgaggtataaattattaaatctgaaaattttatttggacaagtattgtatcattaatttaaaatgattacaatgtagttgaattgttattcagtatttaatattttattgcctataaaaataaataatagccatgcaaacttatttttcaaatggtgttatctgtgctatatttaaaataggccaggtgcggtggctcacgcctgtaatcccagcactttgggaggccgaggcgggtggatcacgaggtcaggagatcgagaccatccttgctaacgtggtgaaaccccgtctctactaaaaatacaaaaaaaaaaattagctgggcgtggtggtgggcacctgtagtcccagctactggggaggctgaggcaggagaatgtcatgaacccgggaggcagagcttgcagtgagccaagatcacaccactgcactccagtctgggtgacagagcgagactccatctcaaaaaaaaaataaaaaataaataaataaataaataaataaagttaggtttgcatatatgagcatatgcatttataactagatggaaacttccttaaatatttaacatttctccttaaattttatattttatagtacttttttatggttagattctaagttctacttacattcagtgtgtatacaaattgagataggggttgtaatggaatatataacttgaatatttctatttgcattgccatagcatcattttattttgctcttagcaaaatctttctatagaggctttttctcctttcagttgtaaagaatctcttatctttaaaaaatatgtctcattattttcttacaatgtaatagtaaaaacaaaaataccatcaggtttttctcgatccttcctattttcctggatgtgtgcttttgtgtttttattgatatggataaatacatcttcaaattcaagtactagcgtttcagagaagtaatatgcttcttttgttctggttcctcttaaatgttagtaataaagaaacaattaacctagatatagaacaactcagtgaagggaaaatgtcttcatgggtcccttgagaaagacctatttagctttttatgtttctaatttttaacattgagtatagagtatatagctgtctttacacttttttttttttacattttagcttatttgtaatgctaacaggtaaagtagaaaaaaaaaatcactaaaaaaatggggatttagtagaaaaagaaaactcagtccctaaataatatcctacacatttacattatttccttatgatattttaagtgttccctatgaatatttttattttcaaaatgccaaagttatcagtaattttaaagctaatactgccaatcttactcttccaattctactcctaatcttttcctcctaaatgcttgatccaagtacctccctttgggacaagtaccaaatgtctttctccatatgattttttgaatgaattctgagtgagttaattaattaattctaggaattaatatttctttgatttctagcaagccagagcattttcttcaaatgtgcattaaccatgtgttaattatatctttatgtatacactgtagacattgtgtatgtgtctgtagatttccagcttggatttatacattttaattttcattggtttgcttttactgtcttaggcccctcaatccgtgggtagaccttggaggagcaagctttcagatcttttccactggagttctctcccccattgcagctcagtggccatcatgatatctaccagaacattcagttttctgaaactgtgtaaacactcttgtaaaaacacagtgtagagtcactgtgggagagtgtcttcaaccaccattcctatcctgtaactgaacatagctgataatatgtcagtagttttatttttgtccatcattcaaatagagttccacagtaattgtttcctcttggaagataacttgcttagcagtggggaaaaaaatggattagacagggtaaaatgttatcggaaatgggccctgatccagaaccctagagagggttcttagacctcacacaagaaagtattcggggagagtccgtacagtaaagtgaacaccagtttattaggaaagtaaaggattgaagaatggctaccccataggcagagcagcggcatgggctgcttgactgagtatacctatagttatttcttgattatatgctaaataaagggtggattattcatgagttttctgggaaaagggcaggcaattcctggaactgagggatcctcccccttttaaaccatgtagggtaacttttggatgttgccatggcatttgtaaactgtcatggtgctgatgggagtgtattttagcatgctaatgcataataattagcatataataaacagtgaggacgaccagaagtcattttcattgccatcttcggtttggtgggtgttggccagcttctttactccatccttttctgtcagcaaggtctttgtgacctgtatcttgtacaaacctcctatctcatcctgtgactaagaatgcctgacctcatggagatgcagcccagtaggtctcagcctcattttacccagctcctagtcaaaatggagtcactctggttcgaacacctctgacaaaaatattctaagtataaatacatcaaaccacattgaaaaattcatcaccaagttactttcagtacagttcattaccccatatctaaaagcgatcttgaaatctgcttggttgttagtggagacgtttcacttccttgttattaaaaaccttttcgctaactgccttattaagatattattcatataccatacagttcatgcctttaaagtgtacaattaaattttttttagtatatttacatagttgtgcaattatcaccataatcaattttacaatattttcatcacccccaaatgaaacaatgtacccattaacagttaccactcatattgctcctaacccttccccctcagccataggcaactactaatttatttcctgtctgtatgagcttgcctattctgcacaatttatataaacagaataatacaatttgttgtttcgtgactgatttcttccactcagcacaatgtttttaagattcatccatattaaaacatttatcagtacttcattctttcttattgttgaattacattccattgaatggatataccacattttatttatctgttcataatttaattgtcatttaggttgtttctagtttttgcctgttataatgctactatgaacatcatttacaagttattgatgtgtttttctgtctttatgaatagaaatgctgtgtcatatagtaactctatatttaacttcctggggaacggtcatactttccaaagaggatgcaccattttatattctcattatctaatgtatgatggttccaattcttccatctttctcaacaatacttgttgttatctgtcttttttattatagccataactgttttcagcagttctgtggatttatttcactttcttgatagtgtcctttgaagcacaatagtttttaattttttataaagtctactttatttttttttagtttttatttttggtgttatttctaagagatcattgtctaatccaaggtcacaaatttgatcctatgttttcttgcaggttttgctatagttatagcccttacatttagttaatcgatcgatttacaattaaatttttacaaagcgtaaggcagagttccagcctccttccttggttatatatatatatggatatccagttgtctcagcaccatttgttgaaaaaactatttttttctccctttaaataacctggcacctttgttaaaaaataatggatcataaaagtaagttttatttctggactctcagttctactcgttgacttatgtgtccatctttacaccagtaccacactattttgattatcagcactgagagaactttaaatggtttatggggagagagtagctttgggcttccctgagggttatgtcttgcaaaactggaagctcagccatgctactgttacaggaattattggctcttgtatgatgtgagacttgtaatccagggtgactcccacgtctatcaaatgtggacactggtttatcttctggagggtcaaggagaataatttatgaattaacatattgactgttgaacgtattctcattgaagaggaatacctaatgctgccccgctaagatgctgttcttctgccttctgttctcagaatggatctgatgccaagtatagactatagtgatcttgtgagtctcagtgttcagcagagccaaagatgaagactaggtttgtgcctagacatagaaacggggtgtaaaagggtttaagctacttggcatttgtctgtgaggaagtgtatttcacacatattggcagagtatgtttgtaattaggcaaatataggtcactggaattgatctgctgtgaactaattgatctaccttgaacaaaccctgtaaccactgagccacagcctcttcaactgtaaaatttaaagactagtaattgatagtctctatccctcatgctgaatcgagcatcctatgacttgtctaagattgttcacactgtagtttgatactttcttacattcctgaaaatgtgagttttgaggttttttcagatgattttctctatgggaaaaaatagcatacagaacattctcatgacctcagactagataataaatgactgagcaatggaactgtaactgtgaatattgaaaattataaaaaaaaattagccagacatggtggcacgtgcctgtagttgtaactacttgggaggccgaggtgagaggattgcttgagctcaagcttttgaggctgcagtgagctacgattatgctagtgtactccagcctgggcaacaaagtgacaccctatctcaaaaagtgagcccctgagtgtactgtaatgatataataaccatttctatatacttatgtgtgtatatatatatgtatgtatgtatgcataatatgatataaatcatattatggtgatgcttttgattgaaagacaaggagatcttagagtgagtggttttaactctgattatgctgctccctgatataccacaatgggtgataacacttccatgagcttcaggttcctcctcttcacaataaaagttttgtgtcacttgagttcagattttcctttcaactctaaaattatatgattaatgacatgatattcttcatatacatccatgcttctttgactatttaggccatagtgtctctctctaatacaaattttcagataatttgccaaactgaattttcaagacattccttctcagaaacatggcctccaataaacaggttttacatattttttccttttcctgttggccctaacgctgtcaatcttagcctcatcgtctagcatagtcatttatgcaggatcctgtgtaaagttgatgaaaaattctgtcaatatgaaatatattgaagattgccagtttacctttttattcatttattgtcatgtcacttgaaagatattaacgtttatatctgtctaaaaatttactctctgaaaacaataaataacatttggccttttgtgttaccgtttctattgaataattattctgaggtcccctttcacccatgaaagcacagtaacttgtactctaaagtcctacaaagtattagatatataatatctaggcataaggtaaaatctattattatgcttgggtccttaggctgtgagagtgaccagtttttactttcctacctacttgattaaggtaactccagtgaggtagaaaataagggaactgagtcaagaacacaaagtgtggtatgtaattgccattttagatatcattagtagtcacactcccgaaacattaaaaattaatgacagagtcaggaagaggagagaaggtgtcttttgcattgccataatttttacaatgtctacatgctgtcctatagcctggaatatgagatttttaaaatcatggttactatcatcactcaagtgtcttaggctgaaaaggacattttccatatttcataaattcaagtcccagccagagtaatcaggcaagagaaacaaataaaggacatccaaataggaagagaggaagtcaaattatcctgttggagacaacatgattctatatctagaaaaccctatagttttgtccccaaagctccttcacctgataacttcagcaaagtttcaggatacaaaatcaatgtacaaaaatcattagcattcctatacaccaacagcccagctgagagccaaatcaggaatgtaatccgtgtcacagttgccacaaaaataatgaaatacctaggaatacagctaactagtgacatgaaagatctctacaatgagagctacaaaacactgctcaaagaaatcagagatgacacagacaaatgggaaaacattccatgctaagggatgggaagaatcaatattattaaaatggcaatactatccaaagcaatttacagattcaatgctattcctatcaaactaacaatgatgtttttcacagaagtacaaaaaataattttaaaattcatatggaaccaaaaaagagtccaaatagccaagacaatcctaagcaaaagtacaaagctggaggcatcatgttaactgacttcaagctatacaacagagctacagtaatcaaaacagcatggtactggtacaaaaacaggcacataaaccaatgaaacagaatagagagctcagaaataaggctatatacctaaaaccatctgatcttcaaacaaagctgacaaaaacaagcaatggtgaaaagactccccagttattcaataaacggtgctgagataactggctagccacatccagaagattgaaactggaccccctccttataccatatacaaaaatcagctcaagatgcattaatgacttaaatgtaaaacttgaagctataaaaaccttggaaaataacccaggcaataccattctggacgtaggaataggcaaatatatatttcatgacaaagatgccaaaagcaattgcgacaaaagcaaaaaattgaaaaacggtatctaattaaacttaagagcttctgcacagcaaaagaaactatcaacagagtaaacagacagcctacagaatgggagaaaacatttgcaaactatatatctgacaaagatataatatccagcatctatgaggaacttaaaaaaatttgaagcaaaaaacagtcccattaaaaagtgggcaagggcatgaacagatacttttcaaaagaagacatacatgtggccaacaagtatatgaaaaaaaggtcactatcattgatcattagagaaatgcaaatcaaaaccacaatgagataccatctcgtaccagtcagaatggctattattattaataaacagtaaaaaaaaaaaaataacagatgctggctggttgtagagaaaagagaacacttacacactgttagtaggaatataaattagtttagccattgtggaaagcagtgtgacgattcctcaaagacctaaaaacagaactaccattcactcagcaattccattactgggtatatgcccaaaggaatataaattattctaccataaagacacatgcatgcatatgttcattgcagcagtattcacaatagcaaagacatagaataaatctaactgtccatcaatgacagactggataaagaaaatctggtgcatatacaccatggaatactatgcagccataaaaagagtgatatcatgtcttttgcagaaactaggatggagatgaaggccattatccttagcaagctaacacaggaatagaaaaccaaataccgcatgttttcacttataagtgagagttaaatgatgagaactcacggacacaaagaaggtaacaacagacacaggggcctacttcagggtggagggtgggaagagaggattacaaaaaaataacgattgtttactacgtttagtacctgggccatgaaataatctgtataaaaacctcctgtgacatgagtgcacctatataataaactccacatgtacccctgtacctaaaataaaagtttttaaaaataagtcaaagatgtaatcttttctctcatgtttttatatctctgaaatcaagacatattttacaattgattgggagcaattttcttgcttgaacataaaataacattgaatctcgtcatcagagtatcttggattagacaaatttagtatgttcagaggcaactttaggtagggaatgacagacctcaaattccagtgtgtcacagacttattaaataggaatatggtatgcaaaaatttgctgattaatcagcccatcataactgaggcttgactctatgcctatgtgcatttttactttgtctttcacttcaaagcaggtgcagctgcacagtatgaattcaatacccatggtaaagagtccctttaaaaggctatatttttatatttaatatgtggatacagaaataacagaaaaagataaataagctatccaaatgcaaagaaaattacattcatagacatacctcttattaccttttcctctcaactctgcagaaaatatgaagcaggttggaatgttcattttatgtggctctcaaggtactattctcataaaggtaaaatgagaaacagtaaattattgtgaagtttagtaataagagcaaaaaagacatatatttatgagagcaaaaatattgagtagcatttggccaaaggatcttgaaactgatttgaattgatttaaccagtgtaaataaaaatgatttatcaataaaagcttatttctagaagtgtttttttcctgtttttactgttcttttcagaagcgttcctttgcttatgaacagtttagaatatgatctttttgtcaaataaaatttccagcaccttgcaatatcagagacgattttctttctagaagttttagaagacgtcattatgtgtcattctagacaaataagatgtgtttggctgaaatgttttagaagtctctaaggaaagaaataacctgttgattatattttgacttacttggggaaatggaaagtcacagccaagataatgctaagtctccaccaatcacattttattatgtggtgtgcttgcctttggccctctctctaccccttggaggaacaggtaaatattggcacaagtcagatgaaccctacccatcactttttggatatatctacatgtcataagaattatgacatgatcaatcaatgtaccagctaattttcataaatgctgtacctcatgaatggagaattgagttgagcatgagtgaaaattggattttccccactcagaaaaaaataagccactatatatattttttgtttagttctttttattttggttattcttcttttcctttatattattacttaaatttatttatgatactgcttcaagcaatatttaacgtatcaacattttgaacagttttaagtataaaaaaatttgaaattctgttctagtgtgaaaatacaccagtgagtgacatatttgaatgaacatttgtagaagtatgttgaccttaaaaagcaaaaggatttatttttccttttattcaacagatattcatatttgtaccagtcattgtgtaaagctctggggaatgtttcacattttcaaaagggtagagattagcgtttcattttgtttttgacttatctctcttgttacaagctctctgcaagatatttacttaagagttggatgaaatgggtaaataaaaagaaatttatgaggcagaagaaaatgtggaaccttcagacatccctttttggtaccacttttatgacactttcatctaatctagctccatctcaattgacctccatctaattagtcataaaagagaatcaagttctatactgagcaagcatgcctgtgcttcatcagtaacatttaagaaggggcagaaatgagtcaaacacttaaagatgctgctttaaaaattttaatgtgttcttcaaagatgcaagcttattaaaattttagttctgaagaagtaagcacagtatctagtttggctccactgatccttttagacatatgtcacacactttcttctcatgctcaagagggtgattacatcatttgcatagatgtccgttttatctctaatagattatgaattccttcagggaaatacttgttttaaggggaataccatgtttttaaaatctttattttgcagagagtaactatgccatcaccttgcatgtaataggtttttaataaatctaattaagtaaaagtaccattgacttctgttcttggtggtctcaaagataatacttgagtctgctaaatttggaggactaccatgtagaaaagaaaagaaaagaaatgcttctaaagattccgagtaaagctagaaacatagttccgtagttcctagtctctccgtagagagaatacgataactgaagagggctttatatgctgagatgaaatttagtttgttcaaatccgtaatgaattgccatcgggaagtactggactgcttgccactataagtgttcaatcagtctggacaagattttgagaggaattttctagagagatcttagtcatctaatttgcggctggcctacttgacctttttcttctttactcctgaatcttgtttataaaaaatgcaatgtaataaaatataatttatattgtatgtaatataaattatttatacctctgtgaatatatatgataaacaaatgaatatatacaatgtaatgttatattacatcatgggtcattttcttcctaaactataatcatttttacagttttaaaccaaaaaggtagtgaaaataagcgagcccatattaaatttctaggaagtatccctaaattgtttcctcagtcttttgacttatttcacatggaatcctaacatacgtggttgtctgtttttcatgtctcaataaaaaaagttgaccataatataaaggataattggaacttggccacatataggaatataagacatctaatagtaaaaaaaaaaaaaaaaaaagtttataattaaagagaatcgtaagttttataatgacttagaggcatcagatgaaagagaaaacttgttctgtgcaatcccaggggaaagaattaggaaaaatgaggtcaaagctgaaagaagtacaggtttctgtttaatataaggaagatatttttaacatttttctgaaaacggacaattttgcctcaagtagtttcatcttaacagataatatattttcaagcacaaaatgaaaaaccatgtaataaagatattgcagaatacatccaagaatccgatgagacattatcttagttttctactttaaatatgcaagctccttaaaacttctatagatcaacacattatgtgatggtttcaatatgcctaaggtttgatcgtgtagtatagcgttgacttagaagttgtaaatggaagaattaccttttatttctcagccagcggaacctatttatctctttattccagatacgttatgtgatatataatgggcaatgaaaaggttggtcattagagcagctttaaaaaaaaaaaaaaaaaactcatcacagcaagtggaatctgtgttgaatgtttaactgattgtaactgaaaccttggcagggggatagagagacagaaatgagattaaggtagggacagttaaagaaatagcaagagtgtcattttgaagaatttgaatttgatagcaagcattattgtgagctgttgatgaggacaatatggttatgaacataagaataatctatcagtaatgtatatgaacccttaaaatgagagaagtagatgtcatggaggaagaattgtaattttatgatttactatgctgtgatgaggagtaggatggggaattgaggggtggatacgtaacatttttttttttactcattaaaatttccccagcccctaaataggttgtcatattttaaaactctttattattttatccttgattgtctggagttgccaagtatattagtaagtacaaaaagtaatggtattaagttttaatgacaaaaaaatgaatccactgggtataattagtataccaaactagaaagggcctattcaaagatctaatgaaatgcactcagtactttaatttaaattccacaaagtgctgaaatgctggtttatcttcccaattccctttagtgtcattggtataccacctttactattgtttccttaatgtattttttctgagtttgattcgacattcacctcaacatagatttgtaaatctacttttgtgaaagttatgcaactgctgcatttggacaagtcagctcatctatgaaataaaattctccttagtcactgtgaaggtaaaataaactaactcatgtggacgtattttgtaaatataagtcaatttagttatttttatttttagttatggaagccaaagatcgaatattattatttttaataatcacaaattagttgtttttatatttattatgggggcagaagctcataatattatttaaaaaattatcgtggagaaaattttaaaaatcacatattcctcaggataaattaagatttggtaagttctccctaacaatttatggtagtttcttaaccttgcatttgatatcaacagtattcaaatattagggtaatgatttgtaagttatcttttaaggagttgtctttgtattctattttaaattttctaagaaaatcgcacgttacttgctctccccacaccatttttatgaaccgatctcatatccactgggtatgcagttgaagtttaaatgatttcacaatacacgtttcctggcttttagacagtgtattatgtgtttagattacaaatagttagaaatctatttgcataaaattttaaattatttttataatgtcagtgatttaaaattattgataatttcttggattttgttctgttcacaattttttaaaataatgattgtaactgaaagagtaaaaatatccgacatgaaaaaagctacattaaataattagcatgttttaagttacagttgaagaaaaaagtgaaaatagactaaatgagatttttatcacatttccaagtgcaaaaagaatcatccagtgttggggataggaagtttttttttttaagataagaaaaaagatcattttaaaatttgactatggttttccatcttgctcaattaaaaaaagtcatagcatgtcactttcactgttaattacctaatcatattcaaagtcagtgattgacattttcacgaatccttatgtggcataaacacgcacacacacactgtgtgtgtgtatatatatgtttgtagaggtcccttgcttacctgtagcttttgacttagtgtattaataattcattttatgcaaatcaaaaccacaatgagataccatctcacgccagtcagaatgacgattattaaaaagtcaaggaacaataaattctggcgaggctatggagaaataggaatgcttttacactgttggttggaatgtaaattagttcaatcattgtggaagacagtgtggcgattcctccaggatctagaaccagaaataccatttgacccagcaatcccattactgggtgtatacccaaaaagtatgaatcattctgctataaagacacattcacacgtatgtttattacagcactgtttacaatagcaaagacatggaaccaatccaaatgcccatcaatgatagactggataaagaaaatgcggtacatatacaccatggaatactatgcagccataaaaaggaaggagatcatgtcctttgcagggacatggatgaagctggaagccataatcctcagcaaactatcacaggaacagaaagccaaataacacatgttctcactcataaatgggagttgaacaatgagaacacatgacacagggaggggagcaacacacaccagggccagttggagggttggggatgaggagagaaagagcattaggacaaattgctaatgtatccagggcttaaaacctagttgatggcttgataggtgcagcaaagcaccatggcacacgtatacctatgtaacaaacctacacattctgcacttgtatcccggaacgtaaagtaaaatttaaaataataataataataactcattttagttagttgtttaatgagggtatgtttttacccaagttctgcttttatgggagtactggatactaattatggtttactgttatatatgtatgtatatatatatatatatgtgtgtgtgtgtgtgtgtgtgtatacactcaattaactattttcaaatatttaaaaggatatatttaatccagtacatagaaaagcaaataacaatgtctagcataattttaaatgaagggcatttatgaataacacatacagtgtgatacaaatatatagtgagcctaccaattaagatctgataaaaaaagaggtacatggttaatattatcaacaaatggttactacagaatactagatgagggttaaaataaaatcattaatttgtatctgacgcaaaaataaagcagtcaaatttctaaagactgatttatgcatgtgtaacacagtcattcggttatctttctgtctacaataacttcaatcatttattttacttcatttaatattaagcaaaactctttgtgtgtggtagtttgtaggggaaagcaataggggtagtattttaaagtaaggcctctgaaaatgatgctgcttaatttgtcatctaggcactgccattattaggtatataattatagaaaacttactttctcaacccctcactttctcattcatattatgaagattaaaatatgcaaaaatattgtgagataacttatacaaaccactccagagactgcctggtaccttttaagcattcaaatgagccataattattaaaaagaataaacttatcctccagtgtatggtaattctgaaacactagatgtctaatagattttctcatttcaatccaaacaatatttattgggcccttggtatgtttaaggcattgtgcttgattagggacataaaaatgagtaagacagggtttccactctcaatttctcccaatttagtatgctccttgaaggcagtgtccatatgttttgatcatctgcagcatttgatgtagtaaagcgtatagccatgacatcacttaataaaaagcacagtgctatttgtttatatttattacaatgtcttcttcctcctgaagagttcaatgagtattttatcagtgtcaattctattatctacttaacaaatttgaacactgaggaaacagtaagggaaaaactgaatgctaataagcactcacagtctttgacaaatttgtgtctgcaactgcaggccaaggaagcatgagtcagagccacagtaatcaagttgttccatttttcttttgaccatgcaatgttggataccgttgctttcttgacttttccttttggtctgttttaggtgtctcagactcgaagtttgtgtgatgagaggagcacagtcccatagcaatgctaaaagatgtgtgtgtatgtatgtacatgtgtatgtttgtgtatccgtgtgtccaagcacacacacatatatgtgtttggaaaattgggttttgattttcatcattctgaagtttaattccccattagagttgattcactacataccaaaggatatactggtttattcacgtattcaaattgtactgagtggctggtatggtaagtgccatgagaggtacaaagatgaggatactgtggtccatttcttggaaagcccttaaaaacttactgtttagccactgcatgttctcactcataggtgggaattgaacaatgagaacagttggacacaggaaggggaacatcacacaccggggcctgtcgtggggtgggaggatgggggagggatagcattaggagaaatacctaatgtaaatgatgagtattaacccattagggtgcagcacaccaacacggcacatgtgtacgtatgtaacaaacctgcacgttgtgcacatgtaccttagaacttaaaaagtataataaaaaataacttactgtttagcatgtaatacatcaggaaaacaagtagttatatgtactacttatatgaaataataaaaatatatagagaaatattctcagtaagaatgtggaaattttatatttgtttttggtgctcactgaaagcttcgagaaatgtagcacttatgctaaaaattcaaggatgtgataggctttagaaatggaaaaatcgtgtagaaggacgttttggcaagagggaagaacatggctgaaacattaaagaggctattaatgtttcttccaacactctgcttattgtgagacctagcaggcactaaataattaatagcttgagttaatcagcttgtagttaactgaaaaagactgttctacagaagaaatatgacttctgactgactagaagtctactattaaggcctgaagacagctgtagaattcataatgccttcttcagttcaaaaaatgaaaaatttggttatgattcagcatcccatatattgaagttattatgtaaaattatttaatgaatttactttcttcatttaattcttctaatattaataaagtgcctacttctggatacatcagctgtgaaacactggtttcattctgccttttacctccttagatatgagggtgggtgaatttgctctttttgaccctcttctttagacccattcactgtccctgatctgatctgaacctagaagtctctccccagtcctcaggagacagacaggattgaaccccatgcagagagaaggtagtatgatggaattgaattcccggacagatgtggcattgaactctggcactttatctgagtgccactggtcataatgctgtaggttaatttcctcccttaaaaaaggatggaatagcagtctccttgaagtgttataagaattttagatggtacatgtaaagcacctgtaacattcagcacctttaacattaatgcagtaagcattcaacacatgtctaaatggaaggtgatggaaaagtagtccctccttatctgcatgatacatgttctaagaccttcagtggatgcttgaaaccacagatagtactgtgccctatatatactgtttttccctatgcctatgcctatgtacctatgataaagtttaatttataaagtaagcacagtaagacattaacaataatagctaataatgaaatagaacaattatagcaatatactgtaatgaaagttattttccttctgaaaatatcttgttgtacattcccacgggcaactgaaaccacggaaaatgaagctgtggatggaggatcactactatattattgttattattattattatttgaatctaattattagtctctaacaatagtgtttggtaaacatatctttattaactagtagagtgctttaggttaggaatgaacacaattaacacttcagacagtctccaaaatgttcttttaaaaaaatccactttatttcagctatattttgtgtactcatcttgctgtatgaaaattcttcaaagataactgcagaaaaatgttaaattgagaaaaggtgttttttgttttttttttttgtttctcaacataaatgagccttgtgtgctttcatttgcacatacctttaccaaggtaaaagtgtttatatattgtcaacaatgtattgatagactctgccaaggactggcttgtggatccctttggctcaatgcctgtttttgtaaagttttattggaacgcagatattggttaatatactgtctgtggctattttcacactacaacagagttgacaagaggccttatggcctgtaaagctgaaaatgcttactatctggtcctttgtagaaaaaatttgtccctatttctccacatcctctccagcacctgttgtttcctgactttttaatgattgtcattctaactggtgtgagatggtatctcattgtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtacattctggatattagccctttgtcagatgagtaggttgcgaaaattttctcccattttgtaggttgcccgttcactctgatggtagtttcttttgctgtgcagaagctctttagtttaattagatcccatttgtcaattttgtcttttgttgccattgcttttggtgttatagacatgaaatccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatagggctagccagttttcccagcaccatttattaaatagggaatcctttccccattgcttgtttttctcaggtttgtcaaagatcagatagttgtaggtatgtggcgttatttctgagggctctgttctgttccattgatctatatctctgttttggtaccagtaccatgctgttttggttactgtagccttgtagtatagtttgaagtcaggtagcatgatgcctccagctttgttcttttggcttaggattgacttggcgatgcgggctcttttttggttccatatgaactttaaagtagttttttccaattctgtgaagaaaggcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacatgtatgtttattgcggcactattcacaatagcaaagacttggaaccaacccacatgtccaacagtgatagaatggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagaacacatggacacaggaaggggaacatcacactctggggactgttgtggggtggggggaggggggagggatagcattgggagatatacctaatgctagatgacgagttagtgggtgcagcgcaccagcatggcacatgtatacatatgtaactaatctgcacaatgtgcacatgtaccctaaaacttaaagtataaaaaaaaatgttcaaggatgcaaatttgaagggaattctcaccaaaatttatagacttgtagaagcataaagactggaaggaattttttatccttcaattattctaacttcatataaatgtattggaatccatgataaatggtaaaaaaaaaaaaaaaaaattgtcaactacacttttacatttagtgtgccatagaaaattgttttacaatttagggttttatttttatagaatatcagccttttatgactagtatttataattgtgaatattaaaaatatagtacacatttattcaaatttgatggatttgaataattagggaacagaattgatatctgcttagcctcattagagtgaatattatggtaggtttcagaaatacagtttctacttttattttatcatttacagccccaattaaattctcttgcctttctttctaggacaattgagaaaaataaaaaagtgcgattgacaaagacaatgtagttcactatagtggagcatctgagcttcctgacaggctagatggaaaaggaaacacagataaatacttttttaatcatgagaaaataggaagtgtatcaattactacagtaaaataaactttatcttgatgctggcttttaatgaccttaattatatgagctattgtgaggcagtatatggtagatgttaagaaggataaaattggcatcagggagatataagactgcagtcctcatatactctctggccgtgggcaagttacttattcttttagaaattcagttatgtccagttatactataactacaataaataggtaccgtagagaatttccccatacacactttcatttgtcttaatttatggtgagactatctataaaaacagaaagcattaattttaaatattaatatatttaaggattacttaaagttaaaaacacatttccaaaaatttatatttttagtttaaagtatgcacttattaagttgttaaatatcctgggcttgatgtatatttaaaaacaaagaatttaaggaaaccaggtatttggaataattaatgggcatttaaaaaagttatgtttataaattgtagggttatatgtacacacaaaaagaaatttaaatgtaacatacataaggacaacgtaaaagtttatttcttaaccttcttaatctacttaaaacttttagaaaagctcttctttcagacataaagatcagccttctgccattagcaaaaaattggaaaaatagaatacacattttctcatctaagcaagtatttttagagtcattatttttatgttttttttccaattgaagaaaatatagggtgcatatcaggaaatacaatctgctagtatcactaagaataaggaaactaatgttgacatatttgactcgaagaaaacaaaaccattattgatgacatccatgtttgaaaagaaaggaaaagtgtttttatggaaatatgtagtgtttaacatccttagaataaagtacatttggtgatatttttaaaaggttaaacaaaggcagatcttcaatataatgatatttatctccattttatttctggcttttactttgatattaacagaaatatatgcacagacatattagcaggataaaacaagggtcatgataaaactgaatttatttttgtttgaattataagtagttttacacattaatgaaagtccattgttatggttaatcccctggcaacttgatctgtgtaatgggttttcattttctttataaataattactcgctgtttaatatttcaaaaaactatagtgtaggcatattgacttgttcaataaagctcatttgtattcattgtggactcttgaatatggactatagcagccagtgaaattggtggtgttttcttgttacgaataatacaaggaaaaacccaaatctattcaattaaatttttgtgtgcaaaatttcagctatagtctaaaaacgctacataatttatattacaatcattttggctaatcagatacccaatcatattttaatagatttccctgggagaagaaatgggatttaagcttattaatctgtatggcatgcaattaagctaacattaagatgaccaaaccagtatgttttattccatttggaataggatcacttctccagagtagtagatatttcggaatttacaaagaccaagaaaatgtgtattcctttatgatttttactgcatgcttaactatttattattccatcttgttcttgaaagatttttaagttctttataaaaatacatacattacaaagtaataatacgtagaggagggaattgggacagtgttgggaagaaaagctgtgccagaagtgaggctgtccagaggtggatcataaatttgtgtctaaactttttagtactcattgcaaaaaaacatgatatcaacataattccacctttatgaattgtaactttttttacattaattactggagctcagatcttccattctagatacaaacaaaagtttagttttaatgccagatcatttaaaggcagttactttaaaatggcatcctacaagactactttctgtcagctgcctatttccacacatctataggttaaataaaccaatattgaataccattggcattacattttttcaagatttgaaagtgactcatgaatcattaaggagaggttgaattacgtcaagtgtagtttcactactacatttaactgatacttttaaaaatgtactcactttcatatggtgcataaagctctgttaactcaaatattttcattgtccttgatatttaatacctcagttattgatagcagtcaattgctcataaccaaagaaatgcaattgacatagtgtaaaagttcaatttcagtgttctttctttaaaaacccttcaaaatgagttttaaaataaagtaataaaatttctaagtcaacacttagaaatctagataagccaatagtttcatatagcgtcttcaatgttacaagatttgtgagtactggcatgtgggtcagaaaacaaggggtttgaattccagctctgctccatttttattgcaatttcagttatcattttagcacttcagaataaaaaagagatttatttaatttctaattttttttctacctctcagctttttttcaacctgtgtgtgactggattgcccccactttagttaggttatcataatatacctgtattatttaaacatacacaatctcattgtcacttccccacaaaattaaaggaaaagctctctaaaaaatggaaaatttttagcacttcagaataagagatttgtttaatttctaaatttttttctatctttcagcttttgtctatctgtgtgtgactgaattgcctccactttaggttatcataacatgcatgtattatttaaatatatacaatctcattgtcaccttccccacaatattaaaagaaatctcttcaaacaaaatggaaaagattctgaacaacgtgaacctaagaggcctaaaaatgactaggcaaaacaagtgaagttagaagtgataaaggatattgggagaaatacagtaaagacataaaaatatctattctcctttcctcatttacccccacattcatgtcatttgcctggtttatttacctgaagatatatgcccattgcagtgaaactgtatcatgtcattttatgctacacgtaaacagtaatggatatattaccatttaaagcatattaacctattcatgatgtgaaagatataattgatctttaaatgttttatgcagaaatccttgatggattattagttgttagactattttgattggggctctgggtgcactggaaataaattattgtttttatcatttaaaataatgaaatatagactcctactagccaaaacattttatcaaacacgtgacaggaatggattacattgatataatgacggatatatgtaactgagataatctcttcatgtatggccatagttagagataagatttgtgctatttttttgtttttcttgataagttgttttttcttccttcttttgtgataatttagagagttcacttttggctctttaaaagcacttcacacatactagagtctttacctaataaactagatcttcaaatacattaggtcgaatcattaaaaattactaatcttgtataaggtataaggaagggatccagtttcagctttctacatagggctagccagttttcccagcaccatttattaaatagggaatcctttccccattgcttgtttttctcaggtttgtcaaagatcagatagttgtagatatgcggcgttatttctgagggctctgttctgttccattgatctagatctctgttttggtaccagtaacatgctgttttggttactgtagccttgcagtatagtttgaagtcaggtagtgtgatgcctccagctttgttcttttggcttaggattgacttggtgatgcgggctcttttttggtttcatatgaactttaaagtagttttttccaattctgtgaagaaaggcattggtagcttgatggggatggcattgaatcttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagctcactcatgatttggctgtttgtggttggtgtataagaatgcttgtgatttttgtacattgattttgtatcctgagactttgctgaagttgcttatcagcttaaggagattttgggctgagacagtggggttttctagatatacaatcatgtcatctgcaaagagggacaatttgactccctcttttcctaattgaataccctttatttccttctcctgcctaattgccctggccagaacttccaacactatgttgaataggagtggtgagagagggcatccctgtcttgtgccagttttcagagggaatgcttccagtttttgcccattcagtatgatattggctgtgggtttgtcatagatagctgttattattttgagatatgtcccatcaatacctaatttattgagagtttttagcatgaagggttgctgaattttgtcaaaggccttttctgcatctattgagataatcatgtggtttttgtctttggctctgtttatatgctggattacatttattgatttgcatatattgaaccagccttgcatcccagggatgaagcccacttgatcatggtggataagctttttgatgtgctgctggattcggtttgccagtattttattgaggatttttgcatcaatgttcatcaaggatattggtctaaagttctcttttttggttgtgtctctgcctggctttggtatcagaatgatgctggcctcataaaatgagttagggaggattccctctttttctattgattggaatagtttcagaaggaatggtaccagttcctccttgtacctctggtagaattcgactgtgaatccatctggtcctggactctttttggttggtaagctattgattattgccacaatttcagatcctgttattggtctattcagagattcaacttcttcctggtttagtcttgggagggtgtatgtgtcgaggaatgtatccatttcttctagattttctagtttatttgcgtagaggtgtttgtagtattctctgatggtagtttgtatttctgtgggatcggtggtgatatcccctttatcattttttattgtatctatttgattcttctctcttttttagcattgggagatatacctaatgctagatgacgagttagtgggtgcagcgcaccagcatggcacatgtatacatatgtaactaacctgcacaatgtgcacatgtaccctaaaacttaaagtataataataaaagaaaaaaaattactaatctttaactcatttgacacataagaatgacaatttcatatattttatttcccacctttcattttatttttagtctccatttaatgataactaaattttaaatattttaagaattttaatcaagcgcttctcaagatatgattaacttctataattttattatgtatgtatatgtgttaaatatgtaattattatttgcacatattttacctattccaatgtctcttactgccttcaacattcatttctgtttcttttacacaacaccagcctcaatttgttagtgtttttttgttcgtatatcactgattttgagtttatctctgatcacttgtagaacgggatttagtttttttttaatgttttaaaatattggccaggctcggtggctcacgcctgtaatcccagcactttgggaggccgaggggggtggatcacgaggtcaggagctcaagaccatcctgaccaacatggtgaaaccctgtctctactaaaatataaaaattagctgggtgtggtggtgggcgcctgtaatcccagctactcaggaggctgaggcaggagaatcgcttgaacccgggaagtggaggttgcagtgagctgagatagcaccactgctctgcagcctgggtgacagagcaagacttcctctcaaaaaataaaataaaaataaaatattatttatttatttgtaattgataaatattgtatatatttattgtggacaacacgatgttttgaaatatgcatacatttttgaatggccaatggagccagttatcatatgcgtcacctcacatacataccatctttttgtgatgagaacacttgaaatctattttttttagtaattttaaagaatatattgatattaactgtagtcatgatgttgcacaatagatctcttgagcttgttcctcctatctatctgaaaatttgtatcctttaagcaacatatcttcaaccctgcccagtcaccctctggtaaccaccattctactatctacttctatgagttcaactttagtagaacatgaatttgaatggcttcactcctaacgctgtacacatctgattatgagggtcttttcatttcctatgggtgtgattgaaagcctgaatgtatgtaaatttgggggtcataacgttttcttgcaatgtactatagacatgcatgcaaatccatactggggcaagtaagctatggagtgtctgtgtgataggctttagacattaagaagaggaagtgataagtagtagaagaggccagcatgattccttcaaggattatgaaggaagatagtaaaagtcattttttaaacagtttgtctactttagatggtaaggcagctaaagaattttgcaaaactcctctaacttcaaaccttctagaaagggttagaggatctcatgtcatcaaacagacccccaccaacaggagcagatggggctgaatgtagtttctccacttccgtagagttttaagtaaatacagctctaattacaatttgtattggacattgattctaataatccataataatgaattaaggaaagctttagtaaaataaagagaaatgtctctgacaaaaaaaagtttttctaagtaattagatgggaataaaatgtttactgtcatttttcttttgttacagagaaaaaagatctgaagataaatatcttcagctctttttaaaataacctatattttcctctttgatgtttatcaagatacgtgacgatcagcatattttaactataaagaaatgtaacatcatttttgaaatgaaaaagtaaggacaaataattaaagaaaattacttataatcttactaccccgatatttgtttagattgacactttattgtgtatctaatttttaatacatatttcttatttaaaataaaatgcagatcgttcagtacaaactattcataacttgctctttttacatgcaaggaaacattccttaatatccttacatattttaacactctcatttataatggtgcatgtggccttttatcctagtgctgtatttttaaaatcaattataaatggaaattcattggaatgtagttaataattttatttcttctcaaatatcttttcataaaaattgtgccaatttatactctccagtataagagagtgtttgtttcatccacttatcaccaatattatttaagcctttgccaatttggtaggtgaaaaatagtaatgtaattataattccaaattatttagcaattcatttgaattttatcatattttcatacttaatacaaatatgtttctcttatgtagaattcaggattatgttatttgcatatttttattaatgttttcttactgatttgtaagatgtttatgtagcaaggacattcatattttgcattctgtaaatatttggaaattttcttttagagatgttaaacattattcacttttactgtattttggatattttttcctaaatttctgaatcactgatttgattttctgcagtactaaatctgagttgtattgcttgtagcacatattttatttcaaccattgcagtctcatttctttttactttaatttcactctacatttatttaataaatgaaatgtgctcttttctgtccctgaacatgatgtaatgtaactacatatgtttataccatggctcaaatggagagaagaggacccaggtaacaaaggagaaagataaaagatagataaagatacagttgcatattggataaagtcactaatttgcaaaggtcagaagatatttctgtgcagaaaaggaattggccattaggtaggatgaggcacgtgtatacctatgtgttaaattatgtgttaaatatttgtcattttacagatgatcgtagattcctgctaaaatctcacatgacctcagttcctattactcattaatttttctcctgaatataacttcattatcatgacgtcatgataagttcaaaaagcattaggaaaagggggtttagcatttttatttacttcaacattttaaagtatttcccagtatgtgtctttaaaataatctcttatggaatatcaaaagacagagggactgataatagttacggcttgagtcaaccaaactgttcaataggaaatagcatcagtatattttctgaaaatcctgccttttgcttgaatattatggccattttgttcaaaataaaaatactcagcaaaacccttaagagaaaccttcaaaaggacaagtacatgccaagtaatctatattgtaagtgcaagggcaaagatacttctccatccttatattgaagcggttgaaaatttgctacacattgctagagttctccaaaattgtttagagtttattattattgttgttgctgttattgcagttgtttctgttaagaaaatgtgggtaaagggccgggcgccgtggctcacgcctgtaatcccagcactttgggaggccaagatgggcggattccgaggtcaggagatcgagaccatcctggataacacagtgaaaccccgtctctactaaaaaaatacaaaaaattagccaggcgtggtggcgggcgcctgtagtcccagctactcgggagtctgaggcaggagaatggtgtgaacccaggagacggagcttgcagtgagctgagatcgcaccgctgcactccagcctgggcgacagagcgagactccgtctcaaaaaaaaaaaaaaaaaaaaaaaaaaagtgtgggtaataagaggaaatatttatgaaatcgggataaatattgcgagtaatgtaacaaacagatagcttatgcccataaaatgctacattttactagctacggaagggtttgagtccactaagaatatacagaaagtacttcttgtacatcctcatttgatactgttgttgctctgatagggaccacatagcaatgtaagcacaccacagttaaagaatggttgaaaatagaacttaaggacaactgtaaatgacgtttggggagctattttctctctgtattttattttatttcatctcattttattttactttaagttctgggatacatgtgctgatcatgcaggtttgttacataggtatacacgtgccatggtggtttgctgcatctatcaacccatcatctaggttttaagccccgcatgcattaggtatttgtcctaatgctctcccaccccttggtccccaccacctgacaggccccggtgtgtgatgttcccttccctgtgtccatgtgttctcactgttcaactcccacttatgagtgagaacatacggtgtttggttttctgttcctgtattagtttgctgaggatgatggtttccagcttcatccatgtccctgcaaaggacatgaactcattctttttatggctgcatagtattggggagctattttctatggctgactttgttacccatgtgactgttcattccccctctcccaaattaattataattgctttggcttcatatttaaatgttccatatattgccagttgtctcctgggaagcaaaattgccactctttgagaaatattggtctagataaatagataccatttaatttttttgagacaatagtatgaacttttctatctgtatagacatttgattcagccaaagaataaactagattgttaaatcttatgtttcttatataaggtgttactctcacgttaagagcacccaaactatctaaattcacatatttacatcattttagcccttaagacatagcctgggaggaaaaagtatagcttaagaatggcataagaagatatatatttgttcttttctgaaatttaggaacatcaaatattttgctatgagacctgtcttctttggaagaaaaattatcagatttgattttgataatctggttctctattggaaaacataaacattcaaatgactaagcttcatatagggctctctagcaatgttttgttttctagtccgcttacacattatgagtataatctttaataatgttgaagatcctttggcttaaaattcaaactacctcttcttatgtttagcttatttttctggcagtaccactgtggtttcagataattttcttttccttttactctctcatttccaagtttcagttattaaattttggcatttgagacccagaatcctggtagtaagacttttgtttaatttttttctcccaaaaattacatttgattttaattatgtcacatgcacagagagcgctccttatccatgtgttctacatccatgtattaaccgactgtagattgaaaatattcagaaaaaaataataagtagttatataccaataaaaatattataaataaaacaatataacacagcatgtgttatactgcacagtatttacattctattaggtgttataagtaatttagagatgatttaaaagtatatgggaatatgtgcatagattatatacaaatactacaacattttatttaagaaatttgagaatcctcagaatttggtatccgtggggggggtcctggaaccaatcccctgtggatactgagagatgattgtgtgtctgtgtgtatgtgtgtgtgtgtgtgtgtgtgtgtgtgtgtgtatgacatgttgcttgttggctttattagctactatcaagtttttatactgcagcattttttaattcatgattttgataactccctcacttacttagagtgctttttgaaagattttgttcaagaaaaatacatgggtaatatgttttctaggattctctaaattggaagatatattccacttctgtaatttcttggctgaaaattcaattattgaatcacaaccattctttgaaaaaaatctgtgggcactgcctcaacgttatttgacttttaatgttgcaaaggaaaatgacaatttggatttttattcttttgagtgcaacttgtttttgctgcctagaagtatattatacttttttctttgcctttgtcgtttaaatctgtggccagaatatgttcatttttggttgtatttcataaatattgccttaataaagatgatctctattttacattatatattcctctgcatacccccaatatatctatatcaatttatgaatcaattgcatgttttactcttacaatatatctgtaattgatatcaataattaatacatagaaattaataaatatatatacaagtagatgaagttaaaattaatgaaaattgaacttctgatatattcttttatgctgcaagggattaatcaatgcgatgtctaggaaggtgcccatcctcctttgaagactatggtcctggaacaccgaggatccttaaatatgcatgtttgggtgttattacttccctggaaagttttcagaagttgtgtgtttaattctggcgttgattttaactgctcttgttccatcattccagaacctctataattcttaggtgggcttgtttttctgtgcaaacttccatcatcttctctctcttatttcttcttttcctaaaattttaattgtggtaaaatacacaatataccctatttcaccttacttccctcaccctaccccaccttcttgcagaaacttattcctttcacaattcattatatttttatatgtatcattctactcaattttctctgtgtattgtgcttatatatgtttgcataaattatactctatattgttttctgtgcttcgtaattgtgacttaatcatatatctaggaaattgtttatgagtgtatatttaaatatgacatcatttaaagtaatccttgaaaatattttaatacttcttttagttttataaatagatgtgagtggttaaaaattcatcagtgtagaatggtataacataagaagaagccatcaaatgcttccacttccatctggcaccaccatttttatttccaggaataaacacatttgagacttgcctatccacttttaacataaagtatctacgcatatacagacatatgtctattaagtaactggcttcttttttttacataaatcatatcaatgtgtctctgcacatatagatttctttatttccctttatttgctgcatagtattccatacgatggatatattttccacttaatcacgaaattaaccattcattttgttatgggtggttggctcatatacaaattttgttattaagatgcatgatatggtgcttattcatttacacctatttttgcatattggtaggaatttagcagtggaataaatttctagtagccaagttccttgggcaaaaggtatgtgcagtttgtttctagatatttccaaattattcccccaatttttacactatttgatgcagcataaatttgcttctttgctctttaagtgcaagttttaatttttccattttatttttctttctggattttttctcatttcttggcatctcaaaatgttctccttttgtgagacctaggtcttctcttacatcctatttgggtaagcaagtagtcttgaaataatttccataattcttttttttctctaaggtttgggatcagagtcacagtttatggttttgaagtagttttttaattgcgtacatgcatgtgtgaatttttcttttgactatttctggaatatacaccttagtttagttctcactaaagataacttgtttgtcttgttcttggctttgtatactctccacttgtgtagaattgtaaaagaatgttatacacacacacacatagacacaaagctcaatctcatattacattagctcagaagtcaaagtcctttaagaaatgggtgaaatggtggtaaacaatttatttttcatccatacttaggaaatgctcattccccatactacaggttgaaaaagaacttcaaatttctcttttaaacatcccatataatagaattgaaccttaatagtaagataattattaatgtgcatatgagtaagtttattatttaatatccttaaattagcacctgcatttcaaggtacagaatttgggttaggttccagtttgatcatttatttaagaacatgttgagcttatagaaggaaagtgagccttttttctctctcagaagacaggcaacaacattaaaggtctgaaaaaaatgctttttgcataaaatagtttacttaattgaacagttttttgctccccttaattcagttcttttacctagtagagaaaataaaccttaggaattaagttatagtctctaaggacagcttcaaaacttcacaactcattgaactggcataatatcagagagacttgcacttgattttattttaaatcctctagttctttgcctataagattggcattgatttcagcgtagctttcaaatgggcccaggttgcaatatctgtctatcagggatacaagtactaatgtgataaaaataataaagcaatctgtgcgctcttagtgattgtgtccttatgagatttcattttcctttataccatgaaattatttagtaaagccatctatcataaagagtgctgttagaaatacaattttctcgtgacgaatgatgtaaaagtaacctttttcaggacaatttattgattaatttgataaacatgtattttgtgccttttattcttggggcaccatattaggcatgtactaaaaaatactcacgaagcccttttaattctttgaaatgggttagatggtggggctgcataatggcaccaatattaaatagacattaagttaattaaggtgcgttaccttagttttcaaacatatatacacataggtccccaatttagagcaaaacagaaattttacaattagacttctaatgaaacttgcaatttttgttagaataagccaatctttagcatttataattgccaaattatgtttctctgcttttctgaggaaatacatggttatgctttgttttctgaagcataaatggatgtttttacttattagtcacttgtgagcagaaggtattactctcgttccttttatttcctcttcttccaattagctgacagatcaagaattcgaaagatgagaatgccttgaggtattcagatgtcatctacaacagggaagaagggtgactgtgagagtgccaaactttgctgctggaaggcagtgttatttcttgaccaactcatgtgcattctaatagtcagtgattttgcttccttatgtggctttgcaaaatgatcgtcctctgccaactctcccccctcctcttgttgttgcttttggtttcagtctgtatgacacaggagcgattttaaagcctttcatggccagtattgtatataaagaacttagtggttgcaatgtatcaattaagcaaacccaaaagttatctttatacagctgtagatattgaatgctaaaacactgttttatcaaatatttggttctaatatcatcatctaaattttaatgtaaacgtctacattaaacttttactggaacagttacagctgatttgaggtctactcctctagattagtgacattttctattaagcatgatttattttttctttacctgtaatcatttaggcaccacaaaggaaaccattgttattatagtctagagactagagcttgttggaagctttctgaatgtttttccacaagaggtggccaactcaattaggactggttcaatttttgtcaggtttagtttggttgcaaattccaccttttggtttgtaaattgattgctgctgtgatataacacaatgaccaatgggcaaaagctaggccaaaacagtgaccaaacagttgagcttgtggaactggtctcctttgcccagttacatgaacactgcaatagtttctaacttctgccactcaaaatatgtgaagcttctctaccaaagacaaggctccctttgcaaagatcacttggtagctccatcctgctggagttggtgtaaccgttcatgatttaagtcatataaaataggcactgaagctttatatactattggccacaatcagtttcataagtcttatattactctttcagcctcataaatgttcaatctcaaatctagtatttagatttatatataacttcctttccttctttacccttatatctacatactgttctaaatcagaactctttaatttagtccccttggccaatgagaaagttaagccattaaaaaaaaattctactttcaatacataacaaattttcttcttattctttaaattaaagatctccccctaaccctttacctttaaatcttttgtctttctaggctcactactttggtgatttacctattcccatgaccttactcatcattacaagcacttgacatttaaatacctagatcaaaccattcctgagttgcacatcccaacttctaacttccttatgaacatcactagttgcctgactatatattgacatgcacaattgagagtgttacagtgcaggcatgcacagcctaacaagcaagatacactcactgaatgaatgttaaagtggaaaaagtcttccaccttaaagattattttaaataatccctaaggggtgtaaaaatcatctttacttacattttaatttgtaaagaggagaaaaatattgatgaagcagttagaaatcttgtgcctgagagagagcgtccctcacttttggtccctgtagtgtgtctcttttcagttacagtaagtggcttcccacattcttttctcataagggcagtgcggccagatggcatgctacttacttattgagaaacaaaagagaatttcttccttacaaatgttatctaaaatgtagttttgaaagtctcttaggtaaagatctcctttataaaatgtaatatataattataagctggtggacttctttttgatctctaagattattttgggtatacttagattactgacaacccttagtcaagagccattagttccgtagccattagttaattattactgtatataattattagttagctaatgaagtgtaggttattattaatttggggggctgagatacaaagtaacatcaggtataaggagtttatggaagttcaaaaatgcaaattgtgagttatttcatactcatgacttatcatatggaagttctggtcccgccacttccagactctatgatctcaggcaggcaaataatttatgtccctcagcctctttaacccaagcgcaaagtggaataataagattggcctcacaaaactactttgaggaaaacattagaaaatacatttgtaagatgattctataataaccaagggaaattgttaataaatcacagtattcccataaaataacatgagttaagcattgtgtagaaggaaaataaatttcaaatatataataaatatggaagcaatgctcaaaattcaattttatgtgaaaaatgcaggaatcaaaattctacagaggttatgcaaatttatgtgtatactcacatatgtgcacatttgtgtgcatgtgtgtgcacatacacatatagagatgggatgagtgcagaggcaataacaaaccaggaacagtggtgggaatacatgttattttctttatatgtttctttagaagtgattagtagtcagacttattaggtgttgtatacactttttagactaatttattgaataaaaacaaaagccatttttaacaatggaacaattggaatttgttgttttctatagtaaaagctgtctatcttatcattcattcagccctcattctttgacatctgtatcaaacccgtatgctgtatggttaagccaactaatggacagtacatccttcaataaggaggaagtctaaaacacatagcttccaacttgctttaaaccagatcttgttggtgtgaagccactgtatagttatttttatttatttattcatttaaaaggatttccaagctggggttttggttacttattaaaacctacagagacaaacatgtgtttgaaattaattgtgttattccagatttttcttataccattacatcatgctctttcccaatctggcttcctgaattttcttcttaaagttacatgatttttagtctcattctcaagagacttggaaatgtaaattgagttattcaggcaaaacactgaatttcaagacattgttagaagccagcttcccattatatagaaagctttttttttttttcagtgtaggcatttttgctcagtttttagaagatttagaatgtaatacttgaatagccaaatactgatttcttaatcctatctattcatgtacattaattcctatgatgatgtttgttaggtttacaatcttggctggtcttggtaaggtagattaaaatattataggttttagactctcacagcagtaatgtccaccgtttttctccctagtgttaattttttttaatactaagaaattgtattcttagatattcgggaatgcaaattttatactgtagcactatatatttcggtctttggatagacaatattttggcttatttttttcaattcatctttagaaacatatatatgtttctaaacatatatgtttctaaacacatatatatatgtttctaaacacatatatatgtttctaaacacacatatatatgtttctaaacacatatatatgtttctaaacacatatatatgtttctaaacacatatatatgtttctaaacacatatatatgtttagaaacatatatatataaagataaagttttgctcttgttgcccaggctggagtgcaatggtgcaacctcggctcactgcaacctccacctcccgggttcaagtgattctcctgcctcagcctcccgagcagctgggattgcaggcaactgccatcacacccagctaattttttgtatttgtagtacagatggggtttcaccatgttggccaggctagtctcaaactcctgacctcaggtgatccacctatcttggcttccctaagtgctgggattacaggcgtgagccactgcgcccagccaaaacttttacatctttatgttgacataaaattctaaactatgtaagcaagcttcactttttttataaggatttagaaatgaacaaaatgggtacacaaagaacagattctttatttaacaaacattaattcattgaacaaatattgaagtgtatactttgtatcagttatcatgtcaatcatactagaagaaataagttccaattgtgtcaattggatgttctaactgttcttaacttctatgattcataagtttataactccctaataaatctttacatataattacgttggagtatcacaataatgaataataccattttgcttatataagctttgtgaatgtgaaacaaaaagcaacaacagcattgaagttagaaactcttgaaataattttctacaaaaatttatcctttttaaaaaaactaactttttaagctaagcagagttcggcctggttagtacttggatgtgagaccacctgggaatactgcgtgctataggctttaataaaacagaaagaaaaccctaacttaaaatatatatgtaagttcttaaaaagcatatcttgccataatttatgaaaacccttatatatataatttttattgtttttcagccacataataccagtctaaaaaagcacatgtagaatatttatatgtagtatatatatacattcaactaccttgcatatccagtctcatgaaaaacaaatcaaaagggaaagagaagtatagaattttcagtgtagttaagccacactgctttccctgattttgaaaaatcacttaagacataggttttacttgtttccttggccagggtatgatggattacctgtttcacaaccatctcagtaactaacaactgccaactacagaaccgtattgttctaccaaaggaaaaccatcatgagaagataagatgtttttcccctaccccattgaaacttctaaattacctataaaattgtcataatgtattagtaattggaaaattctgaatgatttttgtttatagtcttaaaatatatggatgaaaaaagaagaaacagttttggcaaaacaagctcagaattcttgatgaagctgttccttggagtcaaagggagtgtgatgccattgccactcaaggttctccttcgtaatctctagcagataatctataaatcccaatgacctataagagcaagacaaggactgcaggtgctcaggcaccatgatatcattagcaataatcaatgcatggctgtgttttctcactaatacatgggtagagtaccaaattattgagcaatactagatctctcttttatcgagctcattagtcttggaagaattcattaatcttttaagcttagaagaaaaatgtaacctaggatttggcagaacgatcaatgagacatacgtgagagagtgtgtgtgttcaagaggaaggtaaggagaattgaaagttttagcattggatttagcataggatttaagtggacccatctgtatttggggatgagggggaggtcatacacggggctgccaacatgggtggagacagaaaacaaataactctgaaaattgtgtgtgtgtgtgtgtgtgtgtgtgtgtgtgtgtgtgtgtatttctgtaacagtttagggttttaatttttttccagaaaccctaatcaacataattaactttctagcctcagatctaattggtcactacatcctgtcatggccaccaccaaattatatcttatttacttccttcttttatgcctactgccggaaacttatttcaaagatacctgtattttcatctgaactgttgtaataacctactgactggcttctctattattttcccgtgttcatcacttatattgacttccttatttaaaagcagtccagatctattcattgcctacccatgaaatccaaactttttggcatgaatttgaaacaataataattattattatcatttattaagaaacttacattgctagacataaaacatgagtatctccaactcccaaactgagctttgaagatagggtattgttatgtcttgctttgcagcagaagaccttgatatacagaaagattaaagatctttccaagttcaaggagctggtgtaagagacggaactaaaattcaaaacatgtgctgtgggtcgggcgcggtggctcacgcctgtaatcccagcactttgggaggctgaggcgggcggatcacaaggtcaggagatcgagaccatcctggctaatacagtgaaaccccgtctccactaaaaatacaaaaaaattagccgggcgtggtggcgggtgcctgtagtcccagctacttgggaggctgaggcgggagaatggcgtgaacctaggaggcggagcttggagtgagccgagatcgtgccactgccctccagcctgagcaacagagcaagactctgtctcaaaaaacaaaacaacaacatcaacaacaaaaaaacaaaaacatgtgctgtgactgcagagttcgggcattttccattacacctggttctgtttaaacctgacccatttcacctttatagattcagcaactaccagtctcaccttctcgtacatcttatacatatttagctttacccacccgccatgatttaaatctctcatactttttcccatcctcatcctgttggtcatgcccttcctgctgttgtttccttgatctttagtaattttcatttagataacatctactaatctctccaggttctgtgcaaatgtctcttcttctctgaagtctcttttaacctattgagttttccccttacccatgcaatatttccagagcatgtgatacatacttctattgctgcaccaatctcatttttgtagttatttatttgtgtatccataagtcaccatgactgcttgaaaacagagcacttttcttcttactttgttgtttatgacacagtgattgtcccatcaaacatgctcatacatattgaatgagtgaattctctacccatctcaaaccaatgcgttatggcaatggcacacaccattagtttttgtaagtaacttttgaaagttaagccaaaagtatcttcatgttaattaatagtgcaattttgcacgtgttggaatagttgagaattggttattcttaagatttatttcctgcccaaacaccacagctccatatttcacgattttccaatataacttatcatcttggctgtaaagaataccttaattttggccttaggtaggatagatatgtttgattggactttctctgactgattaggttaatttgtcagctggactcacggttcttctttagttttcttctattctacacttatgataactctgtgtttggatatttctttgtttattacagatattaaacttgtaaatttaatgattctctgtaatttttcagagcccatcagcccaggtgtctttccacatactgatgtagtaactgtgagtgcctttaaagctcttgtatctaaaccatagctctgttatggttagcctctgcttcattcatttaaaacctattttgtgtagtcactatttgcaaagtgtttagctaagataaaccacgtactttccctgttcttgagaaattcatagtgtatcctttggtttatgatctagcctaggactcaattagaacattaattttgaaaagttaaaggagacctctttggagattatgcgtttgttttagttgtgctattagtgagtttaatcatataattttgctcaaacaaatttcttaagggtctactacgggcctgcagagggggaccaagggctcagaataaattgatgtagtggttacagatgctggcactggattaaacctggatgtgactcctggcttcccccatacttgctgtgtgatgccctgcaagttacagtaactatctgagttttctctttgacatatgaaaaatgtaaataatagtatttcccatataggtatttggtgacaattaaatgagataattaaaataagcataggacattatatgacctttgctaaacgtccaatttttgttgtttaattattgagttttcaataaatatttgccaaataaaaaacttaaggaaaataaacactgaagttattgtcatgactttcatgtatatctccattcttgaagttttgacagagttataaaaattgaactccgagttttggctcaagaaacctctgttaatctgatatgcataaatcttgaattaaggtttcctttactactgttactattcctactgataatatctttttatagcatttatattttaatgtatatttcccattacctcctaaaatccttagagcaatccctgtgagggctggtattattttcctttatagatgaatagactaacatgtgcagggattaagagtcttgatctacgccatttggctcataaatggccagctcagtcctggaactcccaggtgtcctactcctgtacttcttgcctctcttccctaaattttggttagttgaaaagtggacaattatcatcttctggaatcttctgtatgtaatgtaatatagttacagtgtgtttatatagagtggaatataaggagatggagattactggcctaaggatatgtatagatataaatggaatgtgcacacacattttaaatgcatgctaagtggaacatggaagtttttcatattgactcaaagtgtggtttatttgaagacattcaattataaatgtcaagtcaacttgcattcaagtaaattattatgtccctactcctaaaatttttaatacaaagtcatctggccaatgcttatctcttcagactcataccccgtcatttgttctttttttcagaatcaccatatgattcagctgtatagaagtattgtggtgaatacttgtttcatacttctgtcttattatattccctctatcagtgtactccctgccccttctgcaactcttgtttatcctgggaaatgctggatgatctttgaagatagcaaatgcttgccccctctgtgataccatctttcaactctgtagattgaacattttctggcacttatagcactttaactgtcctatcacattaaacaatgttgatctaagtcaatctgggattccttagctctagtacaaaacctggtacaaatgtggaaacaattaatatttgaattgggctaaaaaactaggatacatgtttctttgggaatttgctgaaggaaaattagaagtaaaaaaattgagcaactttctaactgttttctttcaactccaagtgttcattcaatctgcacatgttcctgaacacctatgaagtctcttctcctaaccagggatccagcagtaaatagaacatataacaatcctaccctcatggaaaatgttttctaatgtaaagagatatacagtaagtaagataaatatatgaaatatcttacatggtgataaatgttttagagaaagataaagcaggaaggtagaatatacaatactgagaggaacttgcagttttaaataggatgggcaaggaagactctgctgaataggtgatatttgagaaagaggggaaggagataaaggattgaggtattaggatgtctcagggaagagcatcccaaatgtaacagcaaatgcaaacaacaagagaaatgaacacgtatgtcatgttcaaagaagagctcagaggccagagtggctggagcacagtaaagaatggaggagaaaaagaagacaagttcataaaaatccataaaaatcatgtaatgtcttgtaagttaaaagattgatagttaatatgagtaaaatgggatgtgaatggaaggttttgaaaaaggcttaatgtcatctaacttagtattttgaaaggataactctggcttttatattgagaatgaaatgaaagagggttggcacagaagattgaggataggaacaagggaaagaacagggagaccagttatgaatccattgaaatagttcaggccagaaatgatgatgacttggtttatgatggtagcagtagagataatgacaggtggtgggttgtgaatatattttgaagataaagataagagaatttcctaagagagcatatatatgtgaaagagtcaagtatgaatccaagatttttgttttaagcttttgagaggatagagttgccatttactgagatgggaaaaactgcagaaggaacagataagggggaaggtcaggaattcagtttttgacaaattaattttgagatatgtttagtcatcaaagtgaagtttccaaataggcagtttgtcattaaatctggggttcaaggaatcattccaggaaagatgaaatttaatgctatgggcctggattaggttacccaggaagtgagtataaacagaggagagaagagatccaaagactgaatcttggggcatttccacattaagaggcttgggagatgaaaaggaactggttaaagagcctaaaaagagagtgaacagtgaggtgaaaggaagacaaggatagaagtcaagaagaagttagggatcactggcaaacttcttctgtaaagtgccagatagtaaatattttaggcttcataggccaaaaggtctctgttggaagaatacaactctgctcttttagcaggaaaacagctatagatatcaggtaagcaaatgaacatggttatgttctgttacaactttacttaaaaatgaggcagcagacttgatttgatccataggctataatttgctgattcctgttcaagaaaccaaacaaataaactgtttccaggaggaaagaattattgattgtatcaacttctgcttatttgtcaaaggtgaaactgaggaattgaccattagatttaacagcttggtagctgtattagtccattctcacactgttataaagaaatacctgagactgggtaatttacaaagaaaaaaggtttaattggttcacagttctgcaggctgtacaggaagcatagcagcttctgcttctggggaggcctcaggaagcttataatcatggcagaaggcaagggcaaacaaggttgtcttacatggccagagcaggagcaagagagagagtggggaggagccacacacttttaaacaaccagatctcataagaactcactcactatacagtaccaagaggggatggtgctaacccattcatgagaactctgccccatgatccagtcaacttccaccaggcccgacctccaacaccgggggttacaattgaacatgagatttatgtgaggacacagatccaaaccatatcagcagcctttagtgaccttgatgagtagtttcaaaaggtgttgagaggaaaggcaaaattgaaagagggatttgggttaagagagaattaaggagagaaataagaggtaagaacaagtcagcactttgggaggccaaggcaggtggatcacaaggtcaggagttcaaggccagcctggccaacatggtgaaaccctgtctctactaaaaatacaaaaattagctgtgcatggtgatgcgtgcctgtaatcccagctactctggaggctgaggcaggagaattgctcgaaccaggacccggggggtggaggttgcagtgagccgaggtcacgccattgcactccagcctggggctacagagtgagactctgtctcaaaaaagaggtaagagaacaagtgttaaaaagtgaacgcgtttcagtttcacatttgaggggaacaaagaaatggagctgaaactgtaagtgggaaatacggtcaagagaggatgtttttaagatgggaaaataatagcgtagaatacacacaggaatgacccagaagagaggaagaaattggtgatgcaggagagagtggagctaattgctggagccatgtccttgagtaggtgagagggaatgagatctagagcacacagggtggggtccgtcatcggaacaaagactggtgatccacagtgttggtcaccaacgcaggcccatgggaagatatgttgacatgaggctagggagcaactgtttactgattacttcaattttctcagataaatgagaaacaaggtcattgactgagagtggggaaggaggtgttggaggtgtgaggaaaggggagagaataaaatagccattcagactggaggttctcaaacgttgctacatactaaaatgacctcagagagcatttaaaaattccaaaggccagattgtaaccaagacaactttactcagaattttggggtgatgccttgctttagtactttttaaagattccccaatattcaggtaaatttgagattgagtaagattactgagtcatactaggagccaacttgaatctagtgttcatgaattcaaaatgtgactagtcagattatgtgttttcctccagaagtttccatagcatgagagtgaacagtgaatgagtggagagttggtggtaaccggggtttaagatttatcaagtgggcaccagatttgagagggagcagagcaatttaaagatgtattcaaaaaagtgtttacaatacactgtagagtttatgcttgataaaaagagaagtgatgccacgaagggcataaggaatagtgaaaagccagtagaatgaatgcattggagggcctggtaatatcaaagtgttgttggaatggggtactagatggaatcatctggagacttagaaggtggaggtcagaaagtgtgatgtttataactgagtttctaacaacatctatcgtatgaccacagaaccaagtggccaaggcagggtggaggacaaggtctctggagtcaaaaagttcagtgaattactagggcaagatggtgagagaattgttttcaacagacatttaaagtaccagaagttatgacaagcatcatatgttggagagggtaacagttaggcaggagctaaaatcttcaggtagtgagggaatgataccacccatacttagatagctcctcattttcctactttcacagatactgattccatctttagacattttgaacaatgcaacaatgttaattttcttatactttgttcaatatactttcatgtgtagtcaggtactagcgttttcctttttgccccgttttattctggttattagtaattcactagtttctaaagctaattgtatcatcattgctttttacacttgaaatatccagtcactatttgtgcagagccaattcaatttttcttcttgaaagaatataactcttagctacaagaatggtccagcaatggtaatagaattattctccatggagaatacctttttgcttctctagctctcccttttaacattagccttaatctgatagcaaaatcagcagtcctaaaacaaaaggaaaaataatgatgtttctgaaaagagagagtcagaagaattaccagcacactgaatatgtatttcagtctcttgtgtaacaagtttgttgttgtgatggttgttttttgttttccctttggcaatggcaatgtattctggggaaaaaatgcagtatgttgattttttaaaaagcctattaaaaatttccaaagataaaaatgcctgaagcccttaatctaccacatgaaattgtaaatgatccccagtggtggagttctctgtgatgcaagttcatcatagttgactgatggatattttcagatcattcctgaagttgtagtgcatttgaacaatgagtattgtaggtatagtgtagaaatgttcatctttctatgactgagatggcagagccttttagctaagactcagtgtgatttattacctctatctacatcaatcaccaaacatgcaaatcatcttgactctcaggagagccatgactcattcactgatatagaatgtttctccgtcacttggctggagctctcttctctcacctccagtgttttacacagtctgtttcacaaatgtgaacaaactgatttctctgccatcccagttttctcatctcttcaaattgatggttttttccagcacatctttactgattaagctagatcatattcccactccattaaatcttactgaccattcttacctgctcatatttatatatcaagtcaaacgtctgttaacgtgtgaagtttattataatcagtctgtgttctctgtttaaattatcctacctcatttttatattaatttcttacataattcttttgtcaaacatgtataacttggagttgaaatagccttgtgtaaatcttgaatcttactccccgcaccttctgccacattgtccatttatgatgcttgtaattagtttgtagatttgactttttaagtgaaatattccagagcaagagttttctgtcaagagggagtttgcagttaggttgaggacaaatgcatatatgggtcacctggctaatttttttttattttgtacagcatatacattccttatttctagcctacttccacaaacaagtctgttaaggctcaagggtcaagtatctcaaatctgataaaatattatgcttaggtcagacacggttgctcacacctgtaatcccagcactttgggaggtcaaagcaggaggatctcttgagcgcaagagtttgagtccagtctgggcaacatagcaagatcatgtctctactaaaaattaaaaaaaattagttgggcatggtggtgcatgcctgtagtcccagctactcaggagactgaggcaggaggatcacttgagcctgggagattgagagtgccgtgaactatggttgtgccactgcactccagcctgagggacagagtgagaccctgtctcaaaaaaaaaaaaaaaaaaaaaaaaaaaaaaaaaaaaaaggaaagaaagaaagaaaagaaaaaaattctgcttagtcccatgctgtaggtagaatgactctggcttttaatggcctgccttgataagaggtcaggtgcactttctcacacatcatgccatgtccctcaaaggaggactccttattaacattgatactaaataactgataagctaatcatggagtttaacttaatacacctgaaaacgatcctaaaatgatctaaaaatctcctgggtttttttcttttcacagagaaggaaattgaaacagtcctctttcaggacccctgaaccaatattttttctattatgccatactacctctaaaataattgtttgctaatagccagctatatgcaaagaaatatattaaggcattaaaaatgtttgaagatatgatttattcctcaaggcccttaacatccctttggcaagataatgcaaactacctgtgcctctcttacacttcttagcaagatatctgtattttgtgatggtctatattgtgttttcttctcttctcctcccagccttgtcttcctgtttaccatctgaatgtggtaaaaatgcagatctacctttcttcccaatgctgaaatagggcctggctcatagttggcattcacggcagttaggagaaggactgaagagaagcctgcactttctcgtttttgtacatgctctgcacaaatcctgaagtatcctaactcaacccctaattatccccagctctttaagccctacttatctccctttaacctttgcctgcctcactgttcataccccctctcccatcgctgcttttgggtttgcatctacctcctgtccctgttttatcctattgtatttatgcatatgagtattaaaatcttaaaatataccagtaccttaaataagaactgagggataaagcagatatccctccaatttgagggtactttttttctattttattctccagaactgatcagtgccacaaaatatgatgagagagcaaggtgtctgttttctctttcagtttcattgttctaaagacaacactttcagtgtaggtgctgtgtatccattgcctgtttgaatttacagttgttttccagtggtgctgcctaactctttgctaatatctatatttgacattaggtcatctgggcagcttgctgtaatcatctgtgagaaagctcctctggaacccaccaatgggcactagaatcaaaactttggttcagtcttataatttcctcatttataatgtggggataattatagtaccttccttgtggagttcttgtgaggattaactgagtcattgaatgtaaagcacttagaatacgggaagcactcagtaaatattgttcatatggcgctcttcagtagccaaaatataacaccacactatttgcatttagtacctttctgttgtggaagcttctattcaaacaagggtatgtatttcatttatttttaacgttttgcttttgagaaagcttgagatatatttcatagttgcctacaggcaaagggagacaccaataaattgaattctgcatcctggatcataaggtaagtgccgaatctgaccacaggatcagtgcttctgccactaaacccgagtatcatcaaccttactggttctttgcttagatactcttgtccaaagttcttaaacgtatcagcaataccatcatgcatctttcttttattattatttttatttaaataaaaagcctacagcacccggtattcccaggcactctcccattcaagtactaaccaggcccaaccctgcttagcttctgagatcagatgagaccagccatgttcagagtggtatggccatagactcatgaatcattcttaactagagagcaatacattttagctaggaaaactcctgcattcaactataatttcatataatgtaaatatgttttaactatattaaataacttctccaaatatgaaacacacatatatatcatttggtctagatggatccttgactgtaatttactttgctgaagtgtccatctctctatccacatttggattatttaaattacttggagagccaaggtggctcccagactaaaatttccccaattgtccttccactgctacttgttcatgtaggaaatttctccatcctgtacacagacatcagagtactctactccaaagaggccctaggatttttatctcttcccctttcccagtccttctgacaactctccctccactgtttaaagcagtattaaaattatccaaatgttcatcattgcctctttctactttcaatattcctctagcagtgccactaatctaaagcatatgctgatttctcttccctcatgaattatgatttataatggattagcatgagcctaggaacaatgtacttcctcttgtcccagacatgtttagagctttccaatttacgctaacattggagtttgtcatgggggcatttttgcccatctatttttattatattttagtcaatactgtgttatatttccatatcatattattctgatataaacaaaaatcacaaggtaaaatacaagtattcattattttcttagtatttatcttatccactgagtagctttgactatacttaaaaaaattctcagcttatttaatagattaaaaattataatctgtaatgaattaattggaaataaccaattaatatagtgagggaatgaaagtatgtcacaaaaatctttctgaaaatgtttcaacgacataagtacaaacaactctgagaagtacaaacaactacagagaaggcataacaaatatgtcatgattgtcaatattttaaattcaccacttcaggtaggacaaaggatgttaaaatatttttctttgaatatttaatatcactaataggaccaaaaacattggaatagcatgtgtgtgacataagctcaaagttctagagcagtgctattcaatagaattttctgcagtaatggaaattttcaatatctgcactttccaatatggaagcaactagctacatgtggccattgagcaccagaaatgtggttagtgtaactgacctgatgctgaattttaaattgtctataaattttattttaattaaattataaatttaatgataaatagctacatggggctatttgtctgcaatattggatgaacagtaaaactttagagacttccaggcttctgttaagactgtaattcacacaaggctgggtcatcttgtggtcactattaggccagtgtcacactacaaagcaacacaaatcctacattaaaacaaccacataaaacgacctataagaaactaccacatcacactgaaaaataattttgatatttactgttttgcaagcgtgtcaaaatatttaaggatccttttcacacatctttctccttgaaaacctctcactatgcttcttcagtgctttcttcttgtttctcctccaaatattttccccaaacttacctatatatctcaggcatccttcctttctctcatcctcatctcttctctacaccttttaagatctgtctctttatccattatccccacacatcaacaggtccctgaccatgcacactaaacacaaaatcctcatccccagagaagagacttgctatccgtcacaagaataaatatttgtaaaggctaaattgggggctatatattagaatcatttctagatgtcacccttttttcatcctctaggcaagattatttctaatacgaatttcatgaggcctctagagtttaagaaaaaagctaatgcttattgaatgctttgagtagtaggagcacctcaaggcaataagaacatctcaaggtctcttccacctctttgatctgatgaaaaattgaataataaatataaactgggtatgatacaaaccaatgagcaaatcactttttatgtaaaagtaattaacaggggaaaagatttaaaaaggatgcccttcatcttccctagattgggagcttatcctttagactttaggttttgttcatttgggatacagtcaacaaatatttgttgagccttgactgagtgttaggcagttttaaaattattttatttgtattggtaataaaaacatggtggtccttgcccatatagagcttacaaatgttaaaggaggcagagagaaaacaagaaaatctataacctaaatataaaattatcaattgtgatcactgtaattaagaaattgatggggttgaataatagaatagcaggatgggaatgccatactaacgcatggccattagaaactaagtgatcctacataacacatgtgcacagagatgttctttatggtttcatagatttgatgttagtgtaacccatccttttacatgttatatgttgccatccttaaatggtctttggtaaaccacatctgaatttttgattagcaaatgtgaaataaagacttcagcttattccgtgtaggtgctgaataccaattaacaattcagtatgaataacatttccatctttacctaacgagcacattttttttttttttttttttgagacggagtctcgctctgtcgcccaggctggagtgcattggcgcgatctcggctcactacaagctccgcctcccgggttcacgccattctcctgcctcagcctcccgagtagctgggactacaggcgcccgccacctcgcccggctaattttttgtatttttagtagagacggggtttcactgtgttagccaggatggtctcgatctcctgaccttgtgatccgcctgcctcggcctcccagagtgctgggattacaggcgtgagccaccgcgcccggcccctaacgagcacattttttaaaaggttgtccattttatgaaaatgagtagaaatcgaaaaatgcagtgctgataatgctaagaaggatagactcatggagattattatgcatattgtattagcatcaggtggctgtaaatgcattagatataagctggtagatggtgggctacatgaggaagaaaaataaaatcaaagaagacataaaacttgctgacactacaacaacctcaaagttgtgcctaaaagatgagatttaatcgagtatttttaaaaactagatgctagatcttatggaatagaaacttgtttcctatcatgtaagtctattaaaatttttcccattaagaatttatttaaaaattcgtaactgcattatgtagaaattacatggaatatgtcttatactttgtcttttccccaaaagtgttatttcttcccattttatacctaatagagtagaggttaagtaaatggaggaacataatagaactagaaagttgcatagataggattaaaatgtagaatgttttggcttcaaagtctctgttctttctagttcatgacttctttataaaaatatatttatcagtgtttttggttggatcatcacaaaagtgggttcttccttcacttgtgtagacagaaataaagagtgaaattataacatacaagggagtaatttgaaacatgctcatttttcttgctgttgtcgaaaatgagtattttatattgttttctttttaaaacacaatttgctcccctgcacagaaaaatatacccgtttttctttagaaatttactaaatttttaatttgctaatcccaagggaaggattattttcttaggattaagtatagtcaattggtattatgatgttgggaagtaaagtgcagaattctattaaggacttagtgatttggatttgtcaaagaagagccactccgtgatgtaatttgcatggtcatatatatatgcaaagttctgtttcagcttggagactttatctttgaattttcactgagaagatattggcttattcctattttagaatctgtttagccatgactctggacacacatgtatagaaagagtaactcctttgtacatgtgcttttgaaatattgcctatgatcggtgcctccttagggaaagtgagttttttgttaagagtctgaaagtctatttaggaaagttgttttcaaagagtgtcctgaaggttacttggtctgacttaacagcaaagtcaatttaacagtagtctgccttgcagaatcctggatctatcagagattgagttctccatgctgtgtgggaaaattatactggctgattttgggagaagttactgtgggaacacattttggcacatttctgctgaagccagaaacctgaatgctttgttctttgtgaggtatcaaaaataaaaattcctgaaattctgacatcctgcctgctcccttatctgggttaaatgctgtggtaaacttctcttttggttgaaatatttaaaaaggaaagcaatacatatgaacagacacatatttatacacacacacacacatacacacacacacttgcatttctttacttgaactatcttgttgaatcctaattactaaactcacatactgcttcttcccagggaatatagaatattactgttatcaagatacgccacacctatcctcattggcgacctaccccctcaattctccttgctggtttattggattaaaatagagaagcagaaatcttatgtaggaggaatatgttgacaaatggtgggttttgtcttgataatttcaccaaatatgtgaattgactttgtcagtcattaaagtaagtgtgctgaatgccctctgtgtgtgtatcaggataagtggtctaatcaagttcaaatgttctgtgtctatttggctcagcttaattaaaattcagccctgcttttgagcaagccacagtgggttggcagaccttcaaagggctatattgcagcaaacaataaaagtgataaaggcacacaatagcaatcaatacaatgcaaatgcccctgttactcaaaaatccagtggaaagtgattgcttgaaacatgcttatccacttctcatcataaaattaaagtttttgcatcactttatttgtaagtttgcctacactctccttgtcaatgggcttgctttttttttaactacgaatggagtgaaagaaaatgatagtaagataaatcagctcaatacaaatcaaatactgtttaaatttttacagcttttgttttatttgttacacatatgggtgaaaacttactcaaaggatttttacctgtatgaggaagacagccgtaattcatcctccattcatttgtagtggaggtggtatattcttggtgatcatcctttttttttcttccagtccactgtttttggctggctgccatggtcccagattttctcacaaactgccatctggcattcttgctgtccctcacatatagctttgtcaggacctcctccaagcaggctggagaatttcacagcttgggggcatgggagtatacacgaagttgcagccacttcagggttgatttctcacctacaacccacatatctgtcactgctagatgtttagtggaaagagctgctagggcactggagattaggggacctggaaagaagtacccactcacctctgatgagctgtatttttagtcactctgtatttgaagaatagagatttttaaaacctgatctctgtattttacataatcatcgtggaacatcactgtgggtaaattattatgaaagatacttctagaaattcaagatggagatattgatattacaatatctcttatagcacacatgattgttgtatcatctcaaagttttcaatgaatgcttttatctgtaagcattcattgtaagactgaatctgtatatataattccacaatgtaactaaaatataagagaaggaaagtttcacatctcatccaagttaggtacatgaggccaccaattgcagaactctagaagtatttttgttacagtttttcaacccagtgaaacactatctcttctgtgtgtatgctttaagtttcattttggcttctaggctttaatcaagcactgagataattattataaaggtatgcttcaccattgtattaactacatcactgacttcaatagctgaaagagaggcactgggatagcgccatcacaactgttcacaaaattctggccagtggaacagctagtcacaaggccaaggttttgtgaactgtgtctatggctgtatctcagtacatctcttatcttctgcagtggaagccaatgcttctcacttcttttatatttcatccattacctacttattgcccttaaatcatcctaaactttgattgttttgttattctgttaaaaccataaatggcagaaaataaatttgaaaactaattattaacatcagtaacatgctctcttaacatgctgaagaatatcatactttcaagtgagagcagccagatcaagtgttaatttttgttttagatgccatgttaagataatagcttttagaaaagacgtacacctctattgatacactgacgcatatacaaggttcaatgaaattcctactgtagagtattgactgtgacatttatattttgtgtcaaacaattatatagattctgaatgtctacgaagcaaaattgtaaacacaactaacatcacttctttcttagataatttaatcaagatttccctgtgaacataaaatatagaatagttagtggttaatatttttgggaaatttccatcatagtataataaatatttggggaagacaaacctatacttgtaaagaataaaattttcttaaaaagtgtcatgaatatattgctcaaatttattctaatatagtttatgatagaaaaattatttctaggtagttatgttaaatagttacgaaaaatgccaatgaatgtcaggttaaacaagtttgcagtactttcaagacatggagtaatttggtaaattattgtattttaacaacagatgtattttctgatttttttttatgttctgaattttaatgtgcagaacttacactatagtaaccaagcaaaaatctcaaagggtattctttttccaaagccaaaaacaaattaaaaattagatggaccagtggcccccaggtcggcacccctactctccaattgaacagttacttcattcctaagtgcatgtgaccataatctgctttgagcattatattcaaactttatcagtctttgtttcagtctgtccaacttctgagcccaatcctccagccttcctttgagaacatatctagaataagcttaccttgtattacatctcagaagtttcttaaaactaaatcggggatagtatcattggtaagtaagctttcgttgatctggataggagatatctgcctgaaatgtgaattaatctgaaatccttagacatactaaatagttctctatttcagtgaaacagacaagtattcaccgattcttttcagtttgttatctgaagcttaagtttcctacttagttttttcctgttgctcacttttgacctataactaagaatgaggccgaagatatataccatcaggttgccaaaggagaaacaaagtaggtaggttctggggccagccactctgccagtgaccgtctgttgagatctttctatatatagagtcaaccaactgcaaatatatatgagaccaggatgtctccagtatagaatcaaaatgccagatttgagcatcctgtgtggctcacccaacaatgatggtatccatatgttagatggttttattttgtactgctttcatataaactcttcggaggcctttgaatagggatttttttcttctataattttaaatacctcaatgccaatgagatatgaaactcatagctataacttctcctacaattagggacaacaatttaaatttggaaaagtagatgactaaacaaatgtatatgaacatatacatcttcaaatataaatgctttcttaatggaggcttgctcatagaaatcagaaatgtatagtttgtttgctgttgtatcaacctgcatttgactatgattctgttctaaatgtaagtcttgtctcaatttttgaatttgttatggagtcttttaaagagacaggaacatatcaatagaagaaacagattctactgtgtgtatacttgtgtttgtgtatgagagcattcacaaaatattcatacttttaaactaactcccacagaaaaatttaaaactaaaatcacttaaaacatatgattggcaagagcttcaacaacctgagaactctatgcttatcagatgaaagaagaagcagcattatgaaaatgtatctggataccataagataatttcagagtacatcaggtgaaaacagtgagaggggctctttgttcatctgaccttatattttataaaaactcaaccttcgattccatgataaatagaatatcaaaatcccataatgtcagatatgtatctcatctttgatcttctgaaatgttatgtatgtcaagttaaaaaatcttgaactttgatggtaataataacatgcaaatattttgatcaaaactggttactttgcaaagaccgaaatgatattgaagtacttgttttttcaagagtcatatagagacataaatatatttggatagcataaaacttaggaacaaattattgttaatgagagttctgagatagaattttatatttagatttaatacttttaaaataacatttttcaaaatgcaaattgaaatattatatggatgcataccatattatgcacaggtagcgtttatttaacttttgtttcacaattatttattgaatgtctttttttgtgggagatgctatagtaggcactagtaattatgtgaataataaaatagatgcaatccctgacattgtggacttactttcgagtttggtgctataaaacttggttctctttcagtcaaatctaggttgaattattggcttcagtttttactgactgaatccatttgaatttcaataccttatgagaaagctatggcttagatagaatataaaacttggtagtcaataatggaactaggaaataaagccaagcttgcctgactctcaattcaataatttccccgttattctagattagataataaatgtataagtgtgaatttaaaactgcaaagtatgggctgggtgcggtggctcacacctgtaatcctagcactttgggaggccaaggtggtggattacctgaagtcaggagtttgagaccagcctggccaacatggtgaaaccccatctctactaaaactacaaaaattagctgggcatggtggcacatgcctgtaatcccagctacttgggatgctgaggcaggagaattgcttgagcctgggagacggaggttgcagtgagctgagatcatgccactgtactccagcctggctgacagaacgagactctgtctcaaaaaaaaaaaagaaaaaaaaaaaaaaagaagaaaaaaaaaagaaaactgccaagtatggtagaaataacaattggctttataatagctatttaattttatttaatattccttggcaattttatttatataattaaccaatattcattgagtgcctactatttggcaaacatagtttgagatcttggggatattttcaggaacaagaaaataagtcccacttctcagagtactgaagttttagcatgaaaatatagacaataaacaaatacttgagaaaatgtttagtgctaaatgctatggtaaaaagtaaatcagggaaactagatgctcaggaaatctttcccaagtggacctgaatgactaaaagagccaaccatgctaacatgtggggaagaatgtttgagaaagaaggaaaatctagtgcaaagccctgagaatggaatgaggttggtatgatcaaaggtccaagagaaatcaagtgtggctagagcactagcttttaaaatgtgattaccagatcagcaacctcatcatccaagtatttatcagtattctaggcatgttaatttccttgatttgaaaattatgctgtgattcggtaagaccttaacattcagcgaaattgcgagtaaagggtatatggcaggatttcattgtcctattttttgcaattttttgacaaatttgaaaatatttgcaaatgaaaatttaaaaaagaaatgagcaattatacagcaaaaatgaaaggttttaagcagtgcaaccagtggaatactgtgatctagtttgggttttaagaaaaatattattgctatatgatataaaaaatgggttagaagagggaatttaatgcaagcgcaatgaccggtgaaggagctgttgccattgtccagaggagacatgatggtggctggcactggggtggcggcagtagagatgagctgtgaacaagtcgatccaagataatataatttgaagatacaattggcaaggcttactgatggattgattgtgagaaagagttaacagaaatagaaaagtcaaggatgcttaggttttagaccagagccactggcttgatgctagtgatatttatttattgagaaggcaaagattgaagtaggaggttgtcaaataatggcacttgattaatttttacaagtaaattattaaaggaaatctaaacggacaatttgcattatctttgagtatttgtgattattagctggtagtgacgaatttaacttgatgaatgccatattgtctgtaaataaattaactcacttgagtgttctcatatttttcccgattttttagttgaatgcagctttagaacattaaattgtgccatatattaaataaaataattaaacaataccaacaagcactcttaatttgctcttctaaattttatatccttatgtagtttattattttattcaacaaatacttgtggagtggctactttgtaccaggtactcttttcatcactggaaatataacactgaacaaataggctgaaatctctgccctgatagagctttcattctggtacattctagaatgaggcattttaagaaaaaaaaaagtatgatatgtgggtgaaatagacagtttaaacaagaagtaaaatgactattaagccagttaataccaaggatatggaccaaattgaagccaataaggagcattgataatatgagaaaggaagggtttgggtctggagggggttttaacttaaaataaggtcatttggaaagacctctttgattaagagttaagggatggagttacaaagtgctaagaagagaggtcataaaagtgggggaataggcagatataggaagctttgtatgcttatttcaaagacgaccctgtgattgccggaatgactggaaggatggcattgccatttatcgaaatggagaagacagccgaaagagtgggtctggattgtgggcatgtttgggaggtcattttggacctgataaatttgatatgccctttagacttccaagtagagattccagtggctggtaggatctaagagatcatagatcacatgagaggcccatacctctgaatagcaaatgttgtatcaaattaagaagttatatttcagggttttttgtgtttgttgttgttgccaaggaattgatatacaggaataagttcctgataggtttaaatgcagtgaagagtgattttctcaattctcgtgagaatttggatcagaataattttatttcaatgaaaaatctgaaatatcaaatgcagcttaattgcattgacattattaaaagaatgaggacttaagcatatggcaaatttaattaaaatattactcttatagaagagtgatcatagtagaggacttttttctttcttaaagcaaattatatgccttcagcagtacttatttttacaaaatgcagaagactgtatttaagatgatttctagttcatgttattatgtggtgaaataaggaaatgcatgaagctgtgttatgttagtttgggttatcttcgaagcctttgattgggaattgactactaaacactgtaaataatatataagtactaagttctgaatgtgaatgtgatcttacatagtcatcaagccattatgtgtcctttgttttcctatcaaatgtagggggcaataatgtcagctattatatatttattttaaaaaatattttgaaaatgagaacaaggctatagatatacctataaatgtgaatatattttcaattcttcaataaaatatgttttaaaataagaaaacctgttctttttctcatcttcactaatctctttttagcaggaaagattattttttgtttgcaaataacaaggcttaggcattaagtaagcgctagggagaggaacaatagatctaccctagaacagattgaggaatcatacttaaaagacccatatattaacttggaaataagaggtagaagaaaaggaggaaaattaggagaaattactttgctagagattgttttgcattgatcatcaaatgataaaaatgtcttctttgaggttttcatttaggatctctgaactaatattcatattattgctgtagaggtattataaattcccagtcattagcataaggatttagtgacagatctgaggttctccaaaaacacctcaatgccaagcaaatgattctgctattagtcttcttaatgcacctggcaatttcctgtctttctactttgatcttctttctcttctcaggtttgcaacattaagaaaggggtagtggcaaaaagaaagaatgtcaacttagaaggctaactttgggggaaatcagtatagccgaggcatcccccaaaagcttcctttgcgttaatgcaaacttccacacaatatttaccaacttctatgaaccagaaaaggctcattcttaaaaaaaaaaaagacagctttattgagatataatttacatactatataatttacccatgcaaaatttaagatgcagtggattacaggatattcacggtgttgtgcaacctttaccaaaattaattttagaacattttcatcattccaaaaagaaaccccatgcccattagcagacagtcttcattttcctccaaatacaacccctcccttcctcagtcctgggcaactaccagtcgactttctgtctttatggatatgcttagtctggacagttaatataaatgaaatccagtcatatgtgtcctttgtgactggcttctttcatgtaatgtaatgtttttaaggttcacccatgttatggcatctatcggtacttcatttcttttgatttccacacatcgtccattatatggatttagaacattttatttatccactaatcatttgatgatcatttgggtagtttctattttgggctattacgaataatgttgccataaaattttttgtacaagtctttgtatgggcacttcttttgggtatgttcctaggaatggaattcctgggtcatatgataattctatgtttaatcttttgaggtactgccagaatgttttctaaagtggctgcactgttaacattccaaacagcagtgtattagggttctgatttctctgttgatctccaccaacaattgttattttgtgtgtgtgtgtgtgtgtgatacaatacactgaacataaaatgtaccattttacgtgtacaattaagtggccttaagtacattcacaacgttgtgcaaccatcaccattatctagttccagagctttttcacaatctgattgtagccgtcataggatgtgtgatatggtaactcattgtgattatgatttgcatttccctgattgctgataattctgagcatctttttgtgtgattattggccatttgtgtatttttaaagaaatatatattcaaatctgttgccaatttttaaactggcttttaaaattattgaattataatagtgaaaagactcattcttaagttaacaatgaatgtattacatgaaaaactcaaccaccccatggtttcagtttaaatgtattttccagggatcatggacttacccagtgcgcagataggacatctttatgacatcagaacattgatgtcaagtgcctattggttcagggtagtgtggaagaagttgtacaaaagcaggcacttttatacccttctctctgagaacattcatctctaaaaaacatacatgaaaaaactgccaaaaacctgatgcatttgtggtgtaatattaatttattggatatgaacttgttttgttgtaaactaccagagtgctttgaagaggaattttattaaatcatattcttaagaaaagtattaaatcagaaggtgcacatatggatatgcttattagtaagataactctatgttggtgatattcagtgtatagttttccagagctgaagtgagttttctgtttccacagtttaaatgaaatgtgtttcaaaatgacacttaggatatctgatggagatgttgtcccctgtcatgtttatcatttaatcttatatggcctcaaaaagagaaaatcatctttttggcatactggcatacttaatttatgcagcatactatataaatcctaaagggaggactgagccaagccagagaatggaataacctactttatttgcaaatggataaccatagacatgtccagttattattaagataaacaggaaatgatgacaaaaccaagatcttggctatgttaacaaatttcagtttctcagtctatttctgaaaatgttgagttccttccaagatcccatgttccccccacccccacaaccagatttattccaggcaatagtaaatacacctggtattcaagggaaaatattcacatattcacttttaaagccagttttgaaggagtctccaagacattgaagggaaccagatggtgtgcagaccattctacaaaggtttatgattagtttggctaaagcagctggtctctgcaatgaaagagttgtcatggcagaaaaatccccttttccctcagtgcagctgggcttgtccagggacgacttttcccaggcaagtgttctctctccattgggtgtttgcaaagtctgttgtacttagagaagttaaaccatttctgttgaaccaagttgacaaaaaacacaaataagccaatgttatttatttattttttttagctcaggatggtttaattgccttaaaaaaaaaagttttcacctctgagtgggccttttctgtccagtattagaaataacaactgagactattcaggaaaaaaaaaatggcactcttccaaaagagaaagtgaacttcaacacaattctcagattcaaaaggactgcaaaggaggattatttctgccagctttggtcatttgacagctacaattctccttcttcaatatgtcatcacaaatctctctcaacatattaatgggaatcctgcatttaattctttcatgtttatggagagggaggtggggtggagagggagactgagagagaactttcaccttctatatgtgataatatgtttaaatgtaattaactgttctgcttttgccgttaaaatgttattttgcattcccatcgtattgattttaaattgaaactcaatgcttttgcaaagacagtcttggggttataaaatgataggttttattgcaaagagaggaatatttatctgaacagatacatgagtgtttccataaagaatgggcctattttactttatcagcaactaaggggaaggttaatggctatgatgtatcttttctgttgtgtgtgaaacatgcagtgttcttgctgttgagatttatggtgtggaggacaaagcaggtgctattccaagccttctttcaacagcggagtataaactagggcctgaacttatctgtcaaaaagtaagttaaaataacgttagagaaagcctagaatttcacacttttccataccttcctgtctctagctcaggaatttaggcagggtgattaatgaccactgttatttgtgagctttccaagtccctacagacataatgaacttgacttttcagccacgtagaaggaaacaggctgttagagctctacaacatgacatgttcataattatgagctctctgcaattgggaagaaagaggaagaaaagagaataatcttctcatgtcccatagtctcaacttcaaacatcctctactccctctctttcttctttccccatcttcttcccgcctacacacacactcacacacacagaatgtatctatacttttattaatccagaaacaaagtctgactctacttaatcttgcctcttatttttccttcatatcaagcaagcaaatcatgcttactgatttctttgtcagaatatcgtatggatttgtccttccctctgttctattcaccctgtcgtcttgtgtttatgctagcccaatccctgagttaatttaggctccaggcactgtatgctttttgaggtaatacaacctcttcattttcctgtgtcttttattttaaccccagcagtttattttcttgcttttcaaaatcttttttattctgaccccacctccaaagattgtatatgctccctctttttgttatcgctaatgtaaatatctcttatccttttgaagttcaacattcatttccatcaagatgtactttaaatgcatcttcttgtataatccttttcagaccagcttcacctggtaaggtccattctgataaactgcttacaatgtttttaccccgtaatactaatcatatcttagactacttacttaaataaaatacaacttcttgcgcataggtatttgttctaaggatagttgctttgttatctatatagtcagtattcaatgccttttcaaatataattcaacaaggcctgttttcaacctcaaagaagtgaatgaagagtcactaactttaaagttccagcaatcccacagcattccccggctcctccagagtacctgtggaaattagattccttgtaagccactggtaattttaagagtctgctgctcttaaggaaagagtctgctgcttgctacaagatagcagaaattagtgtgttggttagttctgatcctgaaaaccttgcctttatcaaagacagaacatttcctgaatctcccgatgatatagtaaagtagtggggagaaattaatctccatcctccgccaatgtttttaccggatactgcatggcatccttcctattatggagtgttattttgactagaaaaaggattaggtggcaccatgggagaaaggcatagtctggttgaagcttatacgaattttcatttacatcctttctttttgtcttgcaaattactattctttttctctctcatttccaccctagaagtcccttagatgctctctttattctccattgctctctgatgctcttttattgaattctatgctccttgaatacaggtcttatgtcttgtttacctttgtattattacagttatctctgtgccttccacacaacaggtaatcaataacaatttgcttaatggaattgagtaattttagaagactagtctatattatagactctgataatttccttttattctacaaaaaagattttctatcccaatttttcttaccagtatcataccactcacaatacagcatgctgctattccatcagcccagagaatgtgtatgaacacagctactcaggtattccttatttttttcttttgaactaatcttaaagacactgattatatctctcttatgaagagcaattatacaattttgtggtagttctctttttacaagtttatcttcttagagaagtataactcttttttttttttttccaaaaaggagactatttctcagtatcctggggacatagcatgatgtgtgataaatagttattgctcttttttttttttcagagtgtgatcttcaggtgatcttttcatgctttttccatcctttcttcatattgtctttgacttgtcatagtttctgcctggcacagtgcctcctaaattcatctattactctcacctttctttccacttttctcatgtgagaaatacacatttatcttcatttaccctggaaggttttctccttaacaacagtgtcacacatgacatactatacattgcatgctctacaaaataaaacataacctatgagagaacaaattcataagttttattgtaatcaaaatatttttttgaaaaatcttacatacagtattaatttttcagttttctctgatacaaaagacaccctcacttaatgagaaaaaaagtcttagaatacgagagctggaaagtgtctttgggagattacttggcacataaatatgatgcatagaaggtaggaaattactgcataattacacaagtaatcagtgacacagtgtctagatagcccaagtcttctagtataattataaggccacatatccgtcatggtgactcatgtctttattcacactgaccctgtttttaattgtgtggattttcacagaggaaaaaaaatggtggtctttgtagagctggaatgagtgaatactttctggtagatacattcatttttcacatttaaatataatcttagtggattttagtttttactaaactacttaggaaaataaggttaaataagtatattttttaaagatttgaccttctaaaagttcatttaaaagaaagaaaaaatattttaattgatggaaaatgagcaaatttattcaaagtgacattagttgcaaattcattctgagatcatcagatattaaagcaatgcatttagaaacgttattcttcatattaccaaactgaagcaatttaaatgtctatcaatagtagaatggataagaaattgtggtaaattcacacaatgaagaactttttttttttttttttttaacggagtctggcttcgttgcccaggctggagtgcagtggtgtgatctcagctcactgcaacctcccccgccgagttcaagcaattctcctgcctcagcctcccgagtagctgggattacaggtgcatgccactatgtccggctaatttttttttgtatctttttagtagaaacggggtttcaccatgttggccatgctgctctcgaactcctgaccttgtgatctgcccaccttagcctcccaaagtgttggtattacaggcatgagccaccatgccaggccccaagaactattttatcatgaaaatgatagaacaaaactacatgctataacatggatgaagcttataatcataatcaaaagaagttagacccaaaggaatacttattatataaatctatttttataaagttataaagttcaaatctgtgagattagaaatcaaggtggtaattactgctggaaggagggaaggccagtgttttggatgaggcaggaaaggtgcttctaagtactggtaatatttcttgacctattgatggttacacaggcctgttcatgttgtgataattcagtaagcttgggatttatatacttttctatatgtatgtttttttaaagccaaaattaaaaaaaaaaagactaaaggggaaatttattgaataccattagcttttaaaatgtatttttgtttttacttaagagttttaaaaagtagtcatattttaaatttacatattgttgggaaaattctgccaatggtaggataaaacaatagatttcaattgaaatattgaaagcaacttgtgttggtaaaagatgagaagtgaaggtggaagactgattaaaactaccaaaaatatcatagtgataacacttttatttttctttttttgtgggggtggggatagtaccattataaaaatacaaacataagctgcttttgtacatcaccaaataattcattgaaatttaaggaaatcaaccagttatgtgtgtacacacacacacacacacacacacacgatctcatagagtgaagggttaattggaatactgactgagtgcaatgtacaagaaaatgtacacactgaatacaaacaagggaaaaaaatcaactttgcctaggagaataataaatataattataggaaggaggggggacagggtaggtgttaaaaaggagtttcctgggaaaataaggaagtgaagaaaggcattccaggcataaaatatgcttgctatgtgcaaaacaacagtgggaaatagcatagactcttccatgtacatactgcaagtgggtatgtgatggtggagctacagttggaaaggtaggtaggggtcgtatcatctagcccgatttactagagtttaactttatttactcatgaataggtagatcttgacagattttaatgaggggagggacatcaggtgccaagtacctacaaacatttaaacaagggaagggttttatggttgcagtgattaggacacgtttgaggaatatttagacaattaagttagtggaacttatatttttataggatgtaaatgaaggggcacagggaagccaccgaaggtgatttctgagattctgttttgcataacttggtacatgatatgccacagacataaaggggaaatgctttcaaagagatctgtgtttttctcaaattttacccaatatatttgcataaagctcaatgtagattggaactatggcaatttgattcagttccacagcttaagtaagtgttattttgttcagttaattgaaaatgaaactatacctgacaggaagctgattacttatatgctaatgtgacagtattatagatcataggacttataacacctattaatttggtaaatgggaaaaacaaaactgtatactgtgaaataagaatttacgttatgtatataagaaatagttgatttaggctgggtgtggtggctcacacctgtaatcccagcactttgggcagccaaggcagctggatcacctgaagtcaggagtttgagaccaacccggccaacatggcagaaccccgtctctactaaaactacaaaaattagccagatgtggtggtgtgtacctgtcgtcccagctacttgggaaactgaggcaggagaatcacttgaacccaggaggcagaggttgcagtaagcccaaatcgcaccactacattccagcactatactccagcctaggccacagagtgagactgtctagaaaaaaaaaagatgaagatacagttgatttaataaatggttatgatgaatgcatattatcatacttgcaagtaaaaatgcatatgcttataaaatatttttgaacagatattttaaaatcatagcaggttttagaaatcaaatttatggaaaacgtactagtttcatgtgtatactctaacaaagtagaaagagacaaaaatgtagtttgagatcctctgcaaatgccaaaatttagccagagtaggtaaaggacttgacagatgaaatgcactctgtctcttacactgagtttatacggagaaaagtaattttcgtaggcagtgaacacataaggaaactggtccaagtcttatgaatgtgaacattagtagaaaataagttatctttgagtatttagtagaaacaccaggaatactgcatagagggaagaaataatccaggaggtactactaataaacacatttttaattttagttcacatatttgggagaattcttacaaatttcatcggctatataccaaacctgaagaaaatattcctaatcaaattctgtggtaagccaggcacagtgtctcacacctgtaatcccagtgctttgggaggctgaggtggaaggaccacttgagccccggagtttgaggctgttttgaggcttgattgtgccactgccctccagctgggtgacagagtgagaccctgtctcaaaaattaaaaagtaaaacaaatcctgtggtggccactcctcatgatagtgacaggtacagacagtcttgttaatctgtggaaacactgaagtgagccaaatcatgttgtttaatggttcccatttggcattttgagcttgtttaagggtatagcaaatagagctataaatagtgcattgaactatgaattaatatggtctgtctgaaatcaatggaattttcaagccctttctgttaatatagagaaaaccaacttaaaaattatgactagcatgcagttaagaaacttggcaggccaaacatcttagaactaattaaacaaaagtgatacatttactcacatgatctactaattcattattattggtacgttagatgtttttcaaaaaaatactgttgtaaaaatttccctcaggtttgacaatgataaggagtgttgtgaaactactgtgattaaagcaccaaaggtacaatgggtcattttatatatacagcattccgttaagtgaagttgaatgcataatgactatattagcatagaatatatgagattagaattaggttttttttcctctgatttgaaattattggaaatcaaatagtgacaagaatgagtatattttccttcaaggcccttgaaaaacaagtcttctgtgtcacgttttatcggttcttttaaaaagagtaaacttttagcagcaagaaagatgtttgaacattattcgagtagctgccacttttaaaacctattgactagggaaaaatgaccccaatttttccccattatggtttgtctgtgtttgcgagtaaagacgtgtcttaattaaaatgttttaaatatgtacctaaaattaatatgagaaagtcataataaaaggccagatactctttagcatggttcttaaccatcaaactttcacttctggttctaaaattatacacctagaataaaatgaacatgtaaaaatattcatgtgtcttgacattggccttctgataaatctaatttgctaatataaaatcttgtaaaaagactataatctaccaaatgaatttactacaatatactcttctaaatagatcttacttataaacatatatgtgcaaaaagagagagaaaaggtttaatttatagtcttaaaaccaatatgctggctatcttagtgtatctccccagatctacatccaccttccagaacatgctctatgccatgggagggggatctgtaaagaatgcatcaatgggcttcctgtcctcctgccagctgggtgtggccagtgaggaacaccagaaaattaatgaaagggggagaattgggtggaggggtctttgttcttcttgttacatttttgtaagtgattcttgaggtgaactggagaacagatttaccacaccttcatcccagcactttgggaggctgaggcgggcgatcacctgaggtcaggagttcgagaccagcctggccaacatggtaaaaccctgtctctgctaaacatacaaaaattagccgggcatggtggcaggtgcctgtaatcccagctacttgggaggctgaggcaggagaatcacctgaacctgtaagagagaggttgcagtgagctgagatggcgccattgcactccaacatgggcaacaagagcaaaacgccgtctggaaaaaaaaaaaaaaaatcccacacctcctgtcagaaagccctctttatccatcttgccctcaatctctgggttctggtatccgttccatcctttagctttgtcttgcccacatttgtgtgtgtttatatatatgtgtgtgtgtgtgtgtgtgtgtgtgtgtgtgtgtgtgtgtgtgtgttattaaatattcctcaaatttcccaactcaagtatgctgtttgtttcctggaaacaggaagatatctagaatctacttctaactggctttgaaaatctggcagtgacagctgggggctcaattttgtatactttaaactttaaatttatatcatttatatatttataaaatgcatatattcattcattgttaatagtaataaaatatatagcaagcatttgggaggcagttttaaaagaaggccattaattttgctgctttagaaaatgttttatgtaaggtgtttcaaaatttggaatttgactctgcatgtagcaattggtatgtgttttactaaagaattatactctacctgtaaaagttcttttaggtaaagacctggaaattatattcaacatttgtgaattgtacactctttaatgcagtcaggattacaggcaaattttctagtagagtaaaaatatacatgaattgtaaaagtaataagaaaggaaatttgaattttgctatagttgttagagagaaggagttagatgatttttattcctgttgccagtaatactaagataaaatgattagagtcacatacacgttatatatgaaaacttataggaggtatgaagaccagaattgtttaggagtttataatctgaggacttatatgatgttctttaacattttttatgctgagaaagaatattattaaacaatgagttaagtcagaacataatgtgacagttaaatgtctgttaaaaaatacatttttgaaggcagaacttctggttatggtagaatatagagatcagcaaaccctttccccaaaaaagtaaaaataaagctggataacattgataaaaccatgagttcagttttttggaaattggccagaatcataaagtaatctggagagatttcatggctttgtagtataaattacaattattctaaaatatttaatctgaaggctatcatgagattttaaaatggaggggacatgctaagtaaaaaatgacaacaggtgattaagcaaaagtgaaaaatattaattttagtatatgattccagcaagtatgtttggactgttgaactattatgaatatttacctatcattatcatcttttaaaatgtctactcactagaacatctcactaattatgtatttctttatttctccccaatagttgtgctttgatagtttttgcaaatttatttaatcatactttatttgaatgtattacattcatattttattttttaacgcagacatttgatatattcagaatggtagaaaattaaatgtacttttttagtattattattatttgagacagcttctcactctgttgcccaggcggaagtgctgtggcacaatctcagctcactacaatctctcccttctgggttcaagcgagtctcctgcctcagcctcctgagtagctgagattacaggtgtgcagcaccaggcccggataattttttttttttttttattgagacggagtctcactctatcgcccaggctggagtgcagtggcgtgatctcggctcactgcaagctccgcctcccgggttcacaccattctcctgcctcagcctcccgagtagggtagctgggactacaggcgcccgccaccacgcttggctatttttttgtatttttagtagagatggagtttcaccgtgtgttagccaagatggtctcgatctcctgacctcgtgatctgcccgcctcggcctcccaaagtgttgggattacaggcgtgagccaccgcgcgtggcccgggccagataatttttgtacctttattttttgaatttgttaattagcttgatttaatcattttataacataaacatatatcataatattacattgtacccaacaaatacataaaattatttttcaattaaaagtacagttttttaaaatgtcaatttttctttttcaatgattcttttatttattcactttatttttttcagctcttgttttagattcatgtgtacatgtgcaggttttttacctgggtatattgtatgatgctgcagcttggagtaagaatgatctcatcactcaggtactgagcattgtacccaatagttagtttcaacccttacttcccttcctccctccccccacaatagtccccagtttctattctttccatctttatgctcatgagtacctaatgtttagctcccacttaaaagtgagaacatgctgtttttggctttctgttcctgcattagtttgcttaggataatggcttccagctgcatccatgttgctgcaatggtcatgatttcatactacatagccacaaaaaagaatgaaatcatgtcctctgcagcaacgtagatgtggctggaagccattagccaaagcaaactaatgcaggaacaaaaaagcaaataccgcatgttctcacttgtaagtggttgctaaacattgggtacacatagacaaaaagatgggaacaataaacacgagctccttcttgagggggtagggtggtaggaggatgagagtaaaaaacctgtctattgggtactatgctcactacctaggtgataaaatcatttgtacaccaaatcccagtggcacacaatttactcatgtaacaaacctgcacatgtaccccatgaaccaaaagtaaaagttggaaaaaaaagaaattacctatacataaagtttgaggtcttacatttaaatctctaatccatcttgagttaattttcatatatggtgaaagctaagggtccagtttctttcttttgcatatggttggccagctgtcccaacaccattggttgaatgggggtcctttctcttttatttatgccgactttgttgatgatcagattgctgtaggcatgtgactttatttctgagttttctattctgttccattggtctgtgtgtctctttttgtaccagtaccgtgctgttttgattactgtagccttgtagtatggtttcaaatcaggtaaagtgatgtgtctggctttgttctttttccttagttttgctttggctattcaggctctttttggttccatataaattctggaatagttttttctcattcagtgaaaagtgacattgttcatttgataggaatagcattgaatctatacattgctttgggcagtatggccattttaacaatattgattcttccaatccatgagtatgggatgtttttccatttgtttgtatcatctatgatattttacagcagtgttttgtagttctccttgtaaagatattttacctccttggttagatgtattcttaggtatttttatttatgtgtagctatagtaaatgggattgcattcttgatttggctctcagtttgaatgatattggtgtatagaaatgctacaaatttttgtacattgcttttgtatactgaagctttactgaagtcatttatcagtttcaggggccttttggcagagtcttctaggtagaggaccatatcatcagtgaaagagacagtttgacttcttcttttcctatttgaatgcctttattttgatctcttgccttgttgctctggctagcacttccagtactatgctgaacaggtgtggtaggagtgggcatccttgtcttgttctagttctcaaggcaaatggttccagcttttgacagtttagtatgatgttgactgtaggtttgtcatagatgtctcattattttgaagtatgttcctttgatgcctggtttccggagggtttttatcatgaagggatgttgaatttcatcgaaagctttttccatgtctcttgagatgatcatatggctttggtttttaattctgcttatacattcatatttttaaagtcacaaacatatagagttgcagttattaacatgatctctaatttttgtaaataaaattcaaatatcgattttagtgattgatgtaatctctaaataagatctaatgtgtattcaaaaaataaataaataatttgcaagtatttagtaatgtgtagatggtggaggggagtgtcatattgtaattaagagctgatcccttgggcttaaactgccagatcatgccaaagactggctttgtcacttattagttttgtgactatgggaaacttacttgtctcctcagcttcttcaccttttagattgattcagttttagaacctacttacatagggttgttgtaggtacttctatgatataatacatattaccaacttagaatacaagcagacacatggtaagcactcaaaaattgttagttgttcttatttttatattttccttcattataagctgttacttgtgagagggaagaaaaaaatctacttttatcattgtttagaatagtcaacttatgttccagttcttataaaatgacctcaccatatatcgtatatattgcacagtgaaaagatgcttctgtcttaataaatatacagatagcccatagggaccaactctttgtgcggatataaaatagtacagccacaatagaaaacagtctcttaaggcagttcctggaaaagttaaaaatgaacttaccatataacttagccattcaagacctatgtattgacccaagagaaacgaaagcatatgtctatccagagttgtacatgaatgaacatagcagctttgttcttaatagataaaaactagaagcaacccaaatatttatggaggtgaattgatgttttaaatggtggtttaactatagaatggaatataactcagtaataaaaaggaattaactattgttagcctgcgacagcatgtatgaatctcatgctgagtgaaagaagccaaaccaaaagagaatgcacattgtgtgattccatgtgtatgaaattctagaaactgcaaactaatctgtagtgacaaacaacagatcggtggttgcctaaagacagtgaaggtaaagtttgaagagacagattactaaggagcatgaggaaacttttaggtgtgatggatatattccttattttgattgtagcgatgatttcctgggtgtatacataagctaaaacttataaaattctacctattaaatatgtgtggcatttacatttgtatgtcaattataagtctacaaagctatttttaaaaatacatttctctcataaactaaataaatgcagaaatttaacattttggatgttgtattattgcatgttttaaataatgaattcaattggagttttctcattaaaatctaaagttgagtttaggttcacagtcaaatgatgtcctataatctataaaagttattattgcacagtgataaattggaaaccagagagaccgacattatataatatttcagttgagtgtgatgtgtctgttatgtacagattttggcaccacagtgcatggaaatatatacaaagagtcttcaaaaagttcatggaaaatgcatattatggaaaagcagttcagagaaatcaaattttgttgaaccaaaataaactcatactaacatttaaaaacacgtctagatagcatctagtttgaggtactaagatggataagtcatcagtttaaaaagaggccctggcggggtgaggtggctcacgcctgtaatcccagcactttgggaggctgaggcgggtagatcgcctgaggtcaggagttcaagaccagcctggccaacatagtgaaaccctgactctactaaaaatacaaaaaattagctgggcatggtggcggccatctgtaatcccagttactagagaggctgaggcaggagaatcacttgaacccaggaggcagaggttgcagtgagccgagatcatgccattgaactccagcctgggcaacaagagcgaagctgtgtctcaaaaaaaaatcagatttatggtgatgcttgagaggaagaatggtgaaattattgatgttttgcacaacatttatggggacaataccccaaagaaatcaacagtttacaaatggaaaactcattttgagaagggatgagacaatggagaagatgatgctcgctgcagcagactgtccacacagagcagaaaattaatcttttttatgccctgattcaagaggactgaccattcacagcagaaacaatagtgaacaccatagacatctcaattgcttcagcttacacaattctgactgaaaaattaaggttgagcaaactttccacttgataggtgccaaaaccattgaacccagattagtggagacaagagaagagctttcaatggaaaatttaaacaagtgggaccaagatcttaaagcatttcattaaagaattgtaacaggaaatgacatacaactttaacagtatgatcctgcagacttagcacaatcaaagcaaaggctaccaagagctgaaactggtcctgtcaaagcaaaagcatatgaaacaaacatgtgagaaaagttcaacatcactgatcattagagaaatgcaaatcaaaaccacaatgagataccatctcacaccagtcaggatggctattattaaaaagttaaaaaaaaaaaaaacaatagatgctagcaaggttatggaaaaaaaggaatgcttttacactgttggtgaaagtgtaaattagttcaaccactatggaagacagtgttgagaatcctcaaagacctagaggaagaaatgccatttaaccaagcaattgcattactgggtatatatccaaaagaatataaatcatcctgttataaagacacatgcctgtgtatattcattgcagcgctattcaccatagcaaagacatggaatcaatataaatgcccatcagtgatagactggataaagaaaatatggtacatatacaccatggaatactatgcagccatgaaaaggaatgagatcatgtcctttgctgggacatagagttggaaaccattatcctcagcaaactaatgcaggagcagaaaaccaaacaccacacgttcttacttgtaagtgggagctgaatgatgagaacacatggacacatggtggggaacgacacacactagggcctgttggaggtggatggtgggggagggagagcatcaagaagaatagctaatggatactgggcttaatacctaggtgatgggatgatctgtgcagcaaaccaccatggcacacagtttacctatgtaacaaacctgcacatcctgcacatgtacccctgaacttaaaagttgaaggaaaaaaaaaagcaaaagcagattagtcgagagaaaaggtcatagcaacaatttttgggtatgctcaaggcattttgcttgttaactttctggagggccaaagaacaataacagctgcttattatgagagtgtttaaagaaatttagctaaagctttaacagaaaaacatccagaaaacctgcaccagagaggccttttccaccacaacaatgctcctgctcattcctcacatcaaacaagggtaattttgtagatgtagaagttttgatggaaaatcattaggtatgcgccttacagtcctgcttcggcctcttcttactttttttgttttctaatcttaaaaagtctttaaagagtattcattggcctggttaaattccgagcatcttcagttttttaggagtaaactaaatggtatcattgtttacaaaaatgtcttaaacctattttgaaaaataaaatttatatttttaaatttttatcttttatttctatttttctaactttttgaagtcccctagggtgtgtgtgtgcacacatgtatatttgtgtatatatactcttaacccccacatgtacatccatgctgcatcctattgggggaggcagtttgtgaaagcattatccaagaatggtttagttgcccttgattttatatatagtgatccagtcataaaactgtagtttatgtgtataattacaggaagacaattcatttgaagagaggcatatgcacacagttatttcaagaagccattttttatttatgaattttcaggtcaaattttttaataacctaagcaacctttggtaggatgttttaacagaattctaaatattctatattgtagtcccccaaacagtgaaattttcaggaatgtaatactttgtcattatgttagctcatctatgtaaaataggctacatttattccaaaacgagaatactttgaaacttctaatgcttagatatttaaatgtggtgattatgctctcatgaatatttaaatctttggagtcagacatagttgctgctagtgccaatcaaatctaggatgaccaaagaaacactgctttcatgaataagtaatctttctccccatgagttttctgaatagtctaagaactcatgtgggaatagggagagcactgttagaatgacattttatctaaaaaagggagcaaccacgggagcagatgtagtatattataatctgcttgacctgttcacaatgatttgtgagttctgaactctaaaggaaatgctttgtttgattctaaactatagctaacaatgttggatcagtgtatgaataactgaagtatttattattctcaggaagtacatattggtcatccaatatgaattctaaaataatttaatgattgctattattttaactctataatggtaataataataatcttcctacatttcaaaggtcagctttacattaaaactttcgctctgaaatttcatattggccatattactctgtttaaaaacattttctaaatatcacagtgaattatatagaattctgtttaaaatttgaattatacagatactatattgatggtagatgccatgagtaagttgaaatatatattattagaagaatatgtcacaacagaataattaaaagtgagtactaagaaataccttatattagacttaagcctccctggataccaaaaaccttagtgtctatttggggaattcctgagatttcaacatagagcattagccagtgtatttgcaaggccactcaaattcactctcatagaaaggacaagaaatattttattcagaaagaagttcatctcggtaactcaagccaagtgaatcaaaagtctaatgttctttgggggcaaaatttctctattgtactcagaaaaaaaaagtcaaggtagtaattgttactgtctaaagaaagtcattgaaataacaggacattctgaagtttgtacttttacaattccttaactttatacatgcttaattaaaagttaataaatatttaccaaacaccttgtttgtgtgctggggaaagaggtatacatatatgtgtacaacagttcttcatttctcaagcattttttagtgggtagagaaagtggtcattagacatatacagaactgataataatacacagtagattgtgataagtgctaatatcatttaatattcattagtttaataaatacagctcagttctgttgctaggaagatcaaaatggctaatgcatggtctctggtctcaaactcacagagtagtgtgggaggtaagcagatacaatacagaatgataaagcctgcactagaaggttcacatgaaacatagaggcagacgcatctcattctctttgtgaaaaggtggcaagtcctgaagaacttctagtggctttggctaatatatagcttatagttacaaagtaagcagtatgacacagggaataatttaatatgtgaggcattattacatagttcctctttcaaggaaacatagctgtttagtccaatgggatcatatgggcaaaaatatcataaattaatatatataatcttcttaaaattccatatgttactctagaacagcctttgtaagccctttacagtaattaagaattttaaaccttattgtaaatatagtagatttgaactctaggcagcataagaagttttatatgtatattcatacagaaaaggaacaaaatgtacattgtgaatgattggttctttcggcataccaatgtgtcacttactgtggatattttcatgccagatattcagaaaagtttgtgtgtgtgtaggtttctatagtatcagtatagtaattctgtaatatagttcaaattataagtatatttttatataatttactgtgatatttaaacttttttaatatttaggatatacaagttcagatttcttacatgcatatattgtgcagtggtgaagtccacgcagagtaaaacatatatacacatggacataaacagatatatatgtatttacaataggtccacaagttatattttcctagagtaatatgttcattttacaggaaccaataataaataggaaaacaagcaaaagtactacattatacttttctttaaaaattgagattgtagattacatttaatagtaaaccaataactcactttttcctttattctgaacattggtatcagaaaagtatgacttctgtaacactgactagattatatgattcgacgtgaatctgttagaagcaaagagaatgatgaaaaagctataatatttagttacacatggtcattttaagaagagaaaaagcatggaaggaacattctgattgactggtgaaccactaccacgtattacgtgttgcctcaatgaattaaccgagagtggatttgtgtgctcacaatctgcttctgtagaataagaatgaacgtggagtctttacctgcttatagtaagcgtttatctctcaaaaacctttaatcatctgaatatcactaatgcaaaaacaggacccaggtaaatcggagaaaatagttcattctttgagcctttaggaaccagaaatttctgtagcaacaagagactttcttttataaggttttaatacctctgatttatttttcattgcaacagaggtttacaaagccacgcttggaggctttgtcaggattttgtagagtgtcagcatagtcatggtggatgttgcagttgcactgaaggtaccttaactttatgcaggaaaagaaacttaagtgtaactaaaaagctaaattttaaagtgaatcttaatctatgtggtaaggacaaccaccactacattcatagaatggacagaattgatgtttgaagaaatttagtactcacagaaatttggagtttttctgacataatatttgtaagatctgtacctatcatcatggcaaggatagcgagtatgtagctcattttaaaaatagttgatatacatttaaaatattttagattcccctttcttctaaatatattgctgttgattgttcaggttagtaatttgccttgactgtcactgtttttcagtttctctattaaaaattgtctgaatctatgtggatatatcatttattattgattgttccataataaaagaatctcgatttgtaggatcatggaaataactgaatttgaagcatttataatttacctggttctccatatccaattcatgattatcacctttgtattgatattttctgatgaaaacaaattcactgtgtgccaatttctacatttccactctcattgttttactcttttgctctagcaattgatctatgtcttttgtttcattgcctcacagactaaaccagtctctagtattaactccagtaatatttaaggtccttcaattaatcattccttaatgggtttacatattaattaatctgttgatgtattcatgcatgcatttgcaaatataatttgaagccctaccattttctaggaattctgcgagaacctagggaatagataggactacattgattttgtcatcatgggattctggaaacattcaggaggagcatctcatctctagcctagggtgtcagaaagaacttgagtaatcaaggattgggtcttaaaggacaagtgaacatgtgcaggtgagaacattctaaaatgaagggacttgaacaaaagcaaagccatgttaaacagcttgtacttcatctgtaggtagatcagtaaccactcaggggttttaatcagggaaatgatcttctcagatttggcttcatatgaatctctctatttgccttatgtcacagcatatattaggagatcatcagagtagtccagacaagcaggaatgaagataagcatttggaatctagaaatgattacattaaaacaggcctagacacaaaccaccacattttttgccagaaaggcatagaaacaaattgtattagtgcttgccaggttctgggaggagttggagatggagaatgactgctaatgggtataagatttctgtatagtctgttctcatgctgctatatggacatacccgagattgggtaatttctaaaggaaagcagtataactgacctcaggaaacttacaatcatggcagaagggacagcaaacacgtctttcctcacaagacagtaagagagagaagattgagtgcccagtgaaggggcaagctcctcataaaaccatcagatctcgtgacacctaactcactatcacaagaacaggatgagggaaaccacatccatgattcaattatctccaacggatccctcccatgacccgtggggattatggggactacaattcaagatgagatttgggtggggacatagccaatccacatcaatttctttttggaatgatgaaaatgttctggaattagatagtggtgagggttgcacaacattttgaatatattccaaattaataaatggttcacattttgaatatattcaaaattaataaatggttcactttcaaagggcaaattttatggtgtgtgagttatatctcaagaaaactgttattaaaaaaagaacactgcatttagtgatgaacgaacaatagagcgagatggaggtacctaagaaaactcccaaggttcttgctttggtgactgggtagatgactgtgttatcaacaagatggagatcaccaaaaaaggagacattgtggggtgacaatggggataaaattgaggtagttggtgttgatttatttttaattgtgtttaaggtctgtataacatccaattgtacttgaactggtgtttggtctacgccatagatacaaatctggtaaatcttatcccagaaagtgaatggctccccaaatttttctgcctttacatattccagaagtacaacataatcttattaatagcatctccctttgcatgccagtgattctcattcaaggagtggagcatgtcagaatctgccatgtacaagactgtagttcaaaaaggccagcttatcagagatgctgacatattccatagggaatttttgtcaaatctttctatatcctccattggaaattattgatatacatgatggctaaatccatgagttcaggtgtcatcacctacagctttatgtcaagtgaggagaacgttgaagggctcaaagaagtaaaagcagtatttgaaagctcacataaagaacgaacgaatgaataacaactgcaggaaagattcttggcagataatagtttcaaaattagtatttattgagcaaatgcattaataagtgaatgagtgtgttttccagaaaccgaagaatttcaagaataataaactattttaaaatcaagatatgaatctaataagacaaaaacaggtatgtccattgtacagttatgctctgcatgatgttttggtaaatgacagaccaaatttaccctggtggtcccataagattctaatactgtatttttaccatattttttctatgtttagctatgtttacatatacaaatacttaccattgtgttacagttgcctacagtattcagtacagtgatatgctgtacaagtttgtggcttaagagcaataggctatctcacagagcctaggtatgtagtaggctatgccctgtcgcattgtgtaagtattctctgtgatattcacatgacgatgaaatcacctaacgatgcttttctcagagcatatcctcatcgttcagtgatgcattactgtatttggtgaccatagtaggttgactatagtagtacagggatgactaggaaagtaggaggaggagatgagaaggcgatgggtatgaactatgctcttaagaaatgtggataaaggagagggactgagaacataggagggctctagaggaaagaagatagatttaatgctacttttcgcatataaagtcattcttctcctaaataaaagtttctatgattttgttcaggaatcatatttaaccagttttcaattttcctatgaaaccagaattaaactgcacctaatttctgatcattttctttcttaatttgtgtaatttagaaataggtatgacgggccaggtgcggtggctcacgcctgtaatcccagcactttgggaggccgaggcaggcggatcacgaggtcaggagatcgagaccatcctggccaacatggtgaaaccctatctctactgaaaatgcaaaaattagctgggcgtggtggcacacacctgtagtcccaggctgaggcaggagaatcacttgaacccgggaggtggagtttgcaataagccgagatggcgccactgcactccagcctggcaacagagcaagactccgtctcaaggaaaaaaaaaaaaaaaaaaaaaaaaagaacaaagaaataggtatgacatcatcccttcaaaatgtcatctttctccacattccatcttacccatttataggaggttaaattcatgtgtcattttttagtagaatttactgataaaagctggccctttagtggtatcaggtctgtgactgatatgtcacaagttgatgatgactttcccattgttaataattctacagctgtctatcttattcatcctggtccttattcttggtacagctcttctttaaatcacagaagtaaaagttccatatgtatttattataaaagatatgcatatggatactttaaaacgttttattgttccctgtttaagcacagtaatttctactagaatttttgtcatagaaagataaatcttctccctttgctactttctgctttcatcttctttgattcttccttggatcctgcccttttctccgttattttaaatttttaatctgctatttattcactgtcttcgtctatgcctaaaagcagggacttttaggactgttgcaaaacagcagtaaatcttatttaagtgtttcatgtatgttttcagcttcccttttcttcctttcaggatgaagaattccagaattatgtctgcaactgttattttcttgacatacactcactctttaactcattgccttcaacgctcactacactgtgcttttgaaatgcagtcatctccttattattatctattaatattttatacatcttcattctctttaaactcccagcaaaagtagagaaaaggttaattacccctttctgcactttttggattccctttttggacttttcagctcccgattttttctccgtattccatttgcaccttcaccagctccttcagcaagtcctcttcattctccctctcttccaatgtctatgtgtctgaagctacagctttttccttctgcacctttcttccagttgaatttcgccccaaccctcatgagagtcctctattctcaaggcacctgtcaccacctcggtgtgaccaatttttccatgtatatccttttcttctctggtaggccttacctactctctcccacttttgcctggatacatttacttatcattcctatggtaaatttaactttgatatgccaaaaactatatttgatagaaaagtatatttcttgcttgaaagagagattgcttccattcaagtcataatgtgtaccataaaaatatcaaatatggaaatcaggtgatcagaatatagaaacaatgaaaagtagatattgagaaaataacttttaagttccaaatattacctaaatagtcttgaaatgcaaatgtgtcataatgataagttttactttatttgtttttggttatcagagtcttaaataatgggtgattagcttagaagtcccattctgaaattcattaaaaaataaaatatttctctgaaaaggacttatgcctaaagctgccgtcattctttctcatctggcaccccaagcttcatttgattccctgtttccttattgagcataatttaatgcaacaatcttgcttaaataagtattacaagatccaatagattaactttaactctttatcaccaatctataggcttcatagaaatattaaacaactattgattttaatgtataacattgtcataattcttgttatttagaaacaagatccaatctccagtaaaccactcactgcagcccacacttgttagcataatcaatttatcacacttgttttataaagttgtaagagaaccccacagaagggtgttactaaaaattacagctgatgtaagcttttcacttcatgccaaaaggagggcagttgacgctaccatgaaataaactctactgcagcctctttaatcatttgtcaagatgtattatgtccttgtcaatatcaagggaggtaaacactgtcattaatctgcaagtgaggaaataagtaaccacgtcaatgttcaagtgcctggctgttaatgcaaattcatctttattccatctttctccctctttcattttatgatgttgttcctttttcataaaatgtgcagttacattgtaatgtttagaaaatatacataatgcattattaggatgttggccattgtgaaatttgctgggtgtgcttagcaagacaggcactgacaatgcagtagttaagctgagccagcatagattagtctaaagagaacataccagctataaatttaacaaactgttcattttctaaagtgattgctttatgcatctgcaaatagggaataacagaacattcaactctattttttccctaggcaaataaaaaacttagatcttgaaaagctttctttagaaactttaaatagttattttaattttagatgctgtcactgatgtgttatgcaaaagagggatgttacttacagtggatatgaaatggaattgcagttttagcatctattatttgacttgaattgccacttatgtcttgataccttcctatggggaatctatggcttatctgtatcgattagataaatatttaaagtaaagctgaatatagcagtgttttatatccaccagattacgctacaaaatctagtggcattagattttttctttataggatttttaattgaaaccaacacattggcaatataccttgtttatctagcatagttaccctcaatgaattagcaaatcagaagcttaactgagaaaatagtgaaactctaggagatataaaggctgaataaccaaataacaaatcactacttattgagtttatgcctgtgtaagatagtgtactgtcatttcatgtaatttatcaaagagcactatgaagtatttattatcatgcagacaaattaaatgactttctcaaaccacacagataagaagtcatagatcttagatttgaacccgtgtgactagatgaaaaatctcagctattgtgcaatgggtcacactacttctcagagcaattttacctaggaaaatcttcttatattttactttgaaagatgtccggtgtgtttacttaagttatttaagtaccctaattagggataagatatccaccttcctaaagtcccatatttatttttttagaggaccaacaggtaattcttttataaggaatgtgatagattgaatcacgtagtgattaacaacacagattttagccaccaattgcattttttcaaattatgactctgacatttccagtgtgtgatgttaggcaagttacttaaccactctgtgcctcagtttaattacctataaaataggcaaaattacattgggttattgtgaaaattaaatgtaatgataaatttaaagtaattgaaaaaaggtctgcaataaggtaactgcttacttagcagctatatcttatcatttaaagaagcaatgtctttggctcacatatttgttaacatgaatgggaataaatatccgatttagttccttaatgtctttaatgtcagtatctattatccagtcttgtccatccaaagctttctggctcactcttgctcagtctgtcatttttctacagcattatcatgatataattcatatagctacaattcacttatttaaaatgtataattcaaaggttctaatatatttacagggttgtgcaaccatcaccacaatctaaatttagaacctttttgttccatttaaaagaaacaccatacttgttagtagtcactcctcatttctctcctccctctctgcccagccctaggcaaccactaatccagtttctgtttctataggtttgcctatactggatatttcatataaatgaaattatgcaacatgtggtttttgtggctggcttctttcacttaaagtaacagtttcaaattttatgcctgtgatagcatgtttcagcacgtgtttattatccttgccaaaaaatattgcattgcatgtatataatattttatttagtcttcagttaacattcatttaggtggtttccattttgtggccattgtgaataatgctgaatgaacgttaatgtccaagtgtggacgtatgttatcatttttcttgggcgtgtaactaggagtgaaattgttgagtcaatagccttgattatgttttacttggaggaccacatagcctcctagttgggcttccagtttctggcctagcttagcctgtgaatgtttgtacactgctgccagggagatctttgtagatcttaaatatgattgtgttcatctcatgttcatggcctttagtggttcttctgttgttttgggaataaattatagataccttaacttgacatgcattatttaatcattaaatacttattgggttcctactatattctaggcactcttctagatacttgagtatccttgaaatccttgaaatcatgtcacattggaataaattattactaaaatcagaatcaaatttttgtagaatctttgatttaaaaatacactccttctttagcctatttttcactacaccacggtgcctaggattaaagataaatatggtaagataattacgttgctttccatgttgcattattggcaggttattctaaattatggaataatagcgatgtgttgtgtttgcctgtctctttacagagatgcttattttatgtgaatttccaacatccctgagagaggatcatggcaaattactcacttccatcttacacctagaaatgttgagactaaatacgtaaataaagtacagtgtttgctctactaaaggtgataaatatctgttgaagttaagtccaaccatactaggaagtccctggaaaatttatgaactaatttttagtttttgcctttactaagggaaagaaaagcaagaagtgggcaaatgaaagctgagatgactgcaatctcatcaggacctagtatcctggatgcttttacatcctctctcgtgtttttatttgaaaccaactctataatgttgttgataactgtattactttaaataaattaaatgctaggtagtgtgactactgatttgatttgatttgattatcagaaaccatgataacttctgttctgtaacaaattctaaaagccattaatccaaagcaagatttgttttcaaagctcatccaaatttgcagtagtgcaattttaatataaatgtagttattcacacaccagggccagttgggtggtggggggtgaggggaggaagagcattaggacaaatagctgatgcatgcacggcttaaaacctagatgatgggttgataggtgcagcaaaccaccatggcacacaacctgtgtaacaaatctacacattctgcacttgtattctggaacttaaagtaaaagaaaagaaaattaaaatagaaagtgtagttattatagcataaatatttcatcaaatatcctgtattttcagagaaatttgatcatatatgaatattttatttatcacctattcttatttttaggtgagataatggcacaatggttatgttttcaaaatgcatccttaatttttagaaataataactgaaatagtttatggaagatacacataaggatttgtatcaaaataatgtagggagggataaataggagtagagatgaaacaagattggccatagttttagtttttgtaatagactttatcttttagagcagttttaggttcttagcttaattgaatggaaggaacagagatttcctatatattctccaccccatctatacacagcctccccctacaatttacatcctctaccagagtggtacagttgttgaaattgatgaacctacatcaatacatcattatcattcagagtccatagtttacattagagtcactcttagtgttgtacattctgtgggtttggacaaatgtgtaatgagctgtatctaccattatggtatcatacagaatagtttcactctcccaaaaatcctctgtgctctacctatccatccttccttcccactaattcctggcaaccacaaacctttttactatgtccataaatgttccctttctagaatgtcacatatttagaatcatacagtatgtagacttttcaaataattagcttttttcacttagtatcatacatttatgttttttccacgtcttttcttggcttgatagctcatttgtttttgacatgaataatattccactttctggttgtaccacagtttattcattcgtctatggaaggacatcttggttgcatccaagtttttgcaattatgaataaagatacaatcaacatccatgtgaggtttttatgaagacctaaattttcagctccttcgggtaaaaaccaaggagcacagttgttggattgcatggtaagagtatatatatttttgtgaaaaactgccaaactgtcttccaaagtggctattccattttgtattcccaccagcaattaattagagttcctgttgctttacaagcttaccagtatatggtgttgtcagtggtttggattttggccattctaatagttgtgtagtgctatctccttgttgttttaatttgcacttctctgatgacatgtaatgtgaagcaactttccagaaacttatttaccatctatatatcttctttggtaacatgtctgttaaggtctttactgcgtttttaaattggattatttgtttttccattgttgagttttaagatttctttttgtgtgtgtgtgtgtgtgtgtgtgtgtatattatatatatataaatgtacttttaattgaaaaaattgtatgtgtttatcatgtacaatatgatgttttcaaatatgtatccatagtggaatggctcagtcaagctaattaacatgtgaattacctgacataccattttttgcaatgaaaacacttaaagtctattcttgtagcaatttttaagaatacaatacattgttactaactgtaatccctattttaaacaatagatcgcttggacttattccccctttctaacttaaattttgtgtcctttgactcccctcctcctgccagccctggtaggcaccattttacgccctactgttttttttgtttgttttttttttttttttttgagacggagtcttgctcactaggctggagtgcagtggcacagtcttgactcacagcaatctctgcctcccaggttcaagtgattctcctgcttcagcctcccaagtagctgggactacaggcacacgccaccatgcccagctaatttttgtatttttagtagagacggggtttcaccatgttggccaggatggtctcgatctcttgacctcgtgatccacccgcctcagcctcccaaagtgctaggattacagatgtgagccaccgtgccaggcctttgtgccctacttctatgaattcagtgtttttagattttacatatgagtgagatcgttggcatatttgtatttctgtcgctgatttttttcacttaacacaataacacaatatcctccagttttatacctggggtctattctagttctgggaattttctgagcctagagctgctggggtcagcctggcagtaaggtctgttcaaacaactagtccaaaaggtaagcctggatcttagaggtgcaagatctcatctggcactggggtgtgccgggaggtgcagtccatgagtactggcctagtctaggatagtgggtgtattcatccattctcatactgatataaagaactgcccaaggccgagtaatttataaaggaaaggggtttgattgactcacagttccacattgctgggaaggccttgggaaacttacgatcatggtggaaggcaaaggggcagcaaggcaccttcttcacaaggtggcaagaaggagaagtgccagcaggggaaatgctagatgcttatgaaaccatcacatttcatgagaactcacttactactgcaagaacagcatgggagaaaccacccccatgatccagtcacttcccaccagccctcccacgacatgtggggatggaagctataattcaagatgagatttgggtggggacacagccaaaccatatcagtggggtcatgtttatcactgggttttactggggtaggccaagtgttgtggtctaaggcaaaatccagtgctcacttccttaattttcctccaagtagaaggtatctctcttcacagtgctgcctgggattgggggagggctcacacaggtaatgtaaaactgcccttcctactcttttccatacatcttttctcatttttatgctacacccaggtgctataatctctcaactgatttctttagctcttgtgaaggtgattttgcttgtggatagttgtgaaaattgatgtttctgcagagagatgagtgctggaaagtcctattctatggtcttgctgatgtccatctttgtgtattttgcatgacagtcttttatcagatatgtcttttgcaaatattttctcccatttttcactggtcttttcattctcttgacattatcttttgcagaacaaaaaggtttgattataaagtccatcttatcaattctttctttgataaatattgcctctagtgttttatttacaaagtcatcacctaacctaaggtcacctagattttatcttgttatcttctagtagtcttttaattttgtgtcttacatatcaatctatgacccattttgagttcattttcatgaatggtataaagtctttatcgagattctttttttttttttttggcttgtggatgtccaattgttccaacaccattggttgaaaaggctatctttttttcattgtattgcctttgcccctttgtcaaagatctgtcaactatatttatatgggatctatttctggaatatttatttcagtccattgatctatttgtctattttttttcactagtgccacactgtcttgattatcatagctttagaatatatctcagaattgaataaagtcagtcctctgaatttgttctttttcattactaagttggctattttgagtcctttgcctctccgtataaactttagaatcagtttcctgatattcacaaaataacttgctgggattttgattggaatttcattgaatccattgatcaagggggaaagaatggacactttaacaatattgagttttcatgtaatgaacacagtatgtatttctatttatttggttcttcttttgtaggttattttctgaacctgactaatgggtacataggtatttgttttactcctttacctgtgtattttttacctttttatgttttgcctgtatatgttttaccttttacaagataaaaggctaaaatattttatatttttgcctttgtgatactagttttttggcaaggatggggtaaaaagtaaaataggacattgacatttcgaattttgaatttcaaatctcctatcagggaaattgaataaatatgttgaacatggtagtttggcaataaagggctttggcaaagagggcagattcggtgtaatgatagttctattgagatctagaaatactcctatttgaagagtgaaaaagtgctaccaggtgttcagaagaaaagaaatgttaatgagaaggccaaagataaggtgaatcttatatcaaagtactaaagagaatgaaagtgggattcagttccttctgggtgataagactgtcttaaattatttctcaattatgacatcatatttcccccccatttcttcatcttgcataactttgtgtttaaatgagagtttttaaaatgtgtttaaagctagtaatgtatttgactttgattttgcaaggataacacttcccaatatcctttttgagctcatagaatttgttcatgttcttttaaatctcctgattattagtggtttacttttgatgaaggtgatagcatattcttcatgaaataactatcaagcttagtgttaagataatttaggaaactaaagcagaattataacttcttgatttttatgatagtgtcccttggatgtgtaaattaaattacttattttcatttctaatttttgctaaccatttcagaaaagtggttcagcacaatcgttgccaattctacttcaaatcaagaaatctttaagcatccttaaaagctaccataacaggcctatggcactgtgtgtctttaggagattgatttcttttgtgggtattctgtttacttaatgacataaagaatgagtgagggagaaggcaaaatattctcccaggaagatggagaagagtggtcattgtggattagttaggcttttagtaaaaacaacattgtaatgaccttgtgatttttatgaaaccacttataacttggtcttaatttacaaataagttcctttaagtttgcatcaaaagtacagagctctttcttgttattcttaacaaggtttgatacacagcatttcctcatggataatttgtgggtttaaaaaattgaaatgctattattggtaactatcttggtcattgttgcaagatgatttctatagtgggagcatcctttcatacaatcatacggatccttttacggtttttctggttataatatcagtaaaaagtaccacttggccacaagtgacttttgtttatacgttgaatgaaggaagaaattatttctaggtgtgcaacatggagaatatttaaagttctcggaatgtaagtttcttcatatgtcaaagaaggtgataatacctaattttaaatgatgttgaaaaggttgacatataacttatggaagtactacctacgtacccacctacctacttacctacctacttatctatctgtttttatgtctatctgtcatgcttagcatagtaactggcagattgtaggcagttaggaaatgttagttgtcttctcactcatcatatcatgtacttttaaagggatggttttcacatctgtgcaggttgtctactgtaccactttagagggcaatgttcatgtagcaaatattatgaatggcaccactggaattctgtagtatgcaacttgaaaaactaaacatagtgtctgtatatttttaaccctctatgttggtgattctccaaaagggagcaattaaactcttgcatcagaatcacctggagatgatttctaaaaatgcagcttcttctgttcatttccagatctacctaagcagaatccgttgagatggaacatacagatctgtattttttaaagctgctgaagtcattattttgctaacagctatcttataatatgattcatatatcatacaattcacctattttgcccaggtcattcttaagcatgctgaaccattgctctcttgattgtctttgtgagaaaaaaaaaaggtgtcccctggtcttttctttctctgcgattcttcatggatcaataacaaattcttgcacatattgtattgtacatatttcttctataactttcatcacattccttcattcttagtgcttaatctccattttttcttctagcttgcatgcatgcatgagcgtgcgctcacgtgggcatgcacacacacacacacacacacacacacatacagagacacaaaggcttagagtcaaattgaactgagtttgaattgcgggtctgccacttactgtttatggaaccatgggcaagttaccctttcttgattaactgaaaaatgaagcccctaataccaattttataaggttgtatgagaataaaatggaataaaatgtgagatgcttattatactgtgtgacaaataaggctaataatatgttttcattaggtcgtatgagaataaaatgtaagttgcttagtatattatgtgggacatataaaaatatgttagctataattaaatgagagctataattaaattgaagacagtaatatgtactcccttatattccttgaagttcctaattttaataaatttatcaatttattgattacttactaaatacaagatactgtgcctgatgcagtatggaatataaatataaatattatatgagctctgccctgaaggactttgccgtttatagtacacagataaccaaatacaataaatatttcatgatggaataatagaacaaatgctagagtggattttcacaaaaaaatattgtcagaacacagaagagaaaaaaattttatttgagacaagcactgaatcagatttcacaaagagggtagaatttggtctgggactttaagggtggttgaaacatgtctatggagaaagggaaatggggtttggctgagatatggatacacggtggagagtttgggagggtataggcgagatgggagagtcttgatcttagaggataacacacgacaactcaaagtctttgaatgacattctttaagctattagaaaccactcaagacttttaagtaaggcagtgacatccgctgttccatatctaggaaaagttgttttagtggtatgtggaatagtttcaaggagtcagggataggaaatgaaaacaccatttatagggttcttcggaatattagcaggattgtaaaacagaggttaggcaaagaaggtgcaaaaccatctttcaaaattctggacatgtaagatattttaaagctcccaaaagtgaagttttgtgcaaaagttaggtgttgagctagggcagtaccaatgagaatgaaaagaaaagggaaaagcaagaaatgggacacacacacacacacacacacacaaacatttgagagataattggatgaaataatggccatgccacataaaaagaaattatagtacctgccataataacataaatttattccaaataaatcaaatgagtctaacttggaaaccacatcagtcatttatattattgtctaaaaccttttttgacaaaagtgaacacacatgtcaaaaatgttgatacttctcacttcagaacttagtccattttcacatttattcaagtctttatgtcgcaagtattttatttgtatgtagatttttagatatttatgattattttattttctaatgctgatataagtgaaatttattggtttgtcttaatattctgattttgtaaccgagttctctatttagttctaagtgtttttcagttcatatttgatatttttcagacaatcatctttacatgactgctttaccttttatttttcttgtgttataatattagccaggacttctaaagcaatattaactaatatttgtaaaaatctggctacttgtttttaacttaagctttcgaccactgagcaggctgttttaaataatcttcatttgataaagaatggattcctctactcttagttggttctgaatcatcaagatagacactgaattttatcaagtgctttcaatagacttttaatatttttaacatgaaatgtgcctttttcatgtcgttttctggagtaacatttatactagttttacaaaataagttaggaattcatctttttagtgctttgcagtaattttattggctttagaatctttcatttctggaaactttccaagtgtttattggtaaaattattgaagcctggggcttttcttagaggaacttcttcaccagtgtttttaattcccaatatgtattttaaaaatcctagaataaatccatgcaaagtatttaattcttttttttttttttctttattgagacagagtcttgctctgtctgccagactggagtgcagtggcgggatctcgcctcactgcaagctctgcctcctgggttcacaccattctcctgcttcagccccctgagtagctgggactacaggtgcctgccaccacgcccggctaattttttgtattttgtttgtttgtttttagtagagacagggtttcatcgtgttagctacccacagtagctgggactgctaattttttgtatttgtttgtttgtttgtttgtttttagtaggacggggtttcaccgtgttagccaggtcgatctcctgaccttgtgatctgcccgcctcggcctcccaaagtgctgggattacaggcttgagccactgattatcaatttgcctttccaatgttaaatctccaataatttttaaaggaagtattgttatagtgagagacagacacctatgacacatccatggagcagaataatgaatgcaaaaacagcaatgaatttagatccaaatgtaacatattaaaaagatttcatttcaaataagggcaaaaatagtttatttttcaaatgatgtttgtaattatgataccatttagaaagaaaaaagttaggtacctactatatagcatacacctaagttaactttaggcgggttaaaaatgttaatgtaggaaggcagaaggcggagaattgcttgaacccaggagtcagagctgcaatgagccaggatcgcaccactgcactccagcttgggtgacagagcgagactccttcttaaaaaaaaaatgttaatataaaaataaagttgcaaaagtactagagaaaatgttacatgaacattaatatagcattggagtgaaaaaaatgctttaaagttataaaccataaaggaagaaaggcatactggaaaatgactaatgaatttaactatatcataacatttaaaggttgttcttaaatatttgaactactacccaagaatgcccaaagcccgtggtggaaattctaatttttattgtgatatgtttgtcatatttaaatgataggtttttgttttaacattccaaaatgcagctcccttttctgcctttgactgccttctatagaaattcccccagctgccaggccaaatttctcatccagattcaggtactcttattgactatccaatagggcattgatgctgccaagttcgcattaactctcttattagcttcgagaagacttgagacagaagctatcaacacttcttcattggcatctatgtggctgtgaaagatggtcacattttagtcaaaagacataatcctgtccagttatatttgaagagaatcatagctaaagaacacatgccatcttccactcctgtttttacagtgttcacaaatataaaatagttactaacttcttatactctttccacctgtaacataaagatggaattctgcagaaattgagaaagagggcaaaaacgcggattttctgagataatttaaaacagttaagaatctgcagccaataagaatttaactcacaaaggcagagcaattgaaactgtttccggccatcagtacacaaatagcaagccaagcttcataattctgtgtttaaatgcaagagttatttaaaacaatttggttttagtttattttcttacatctcttaattactgctggaaaatattgtcaaggttgggaagttcttttaatcaaagtctagaatattaaattttagaatctatagaggtagaaacatcacaaccatttatttacttttatctttgaataagcattgggaattatgattcctttagttttcttacctgcaaaaacctgtatgttcttcatctaattcaccaaaagtctattattctcaaaattctattattttgagaaataatagaatcaatacaggtcaatttttaaaatgtgtgcaggactcagaaccattaatgtgctaatgtgcattctgatgttccaaggggcattcataacatccagcctgtcctataaatttgaacctagaaccctttttgcatgcaatatctattgagttctgttgggaatattgtattactcgaaacataattttgaaagtgctactataagagcttttagaatatgtggtgttaaaagctgtacattatgttaaaatagctcttgctattaatacatctaaataatatttgttgaggacattcccttgaaggccctgtgctaaatggctttgtaactaaacttctgttctgcttcagtgttatactgtggattatatctgatgttcatgtatgaacataaatatgaccagttaaagcaatttcttgccagctaaaagaggatgttttatgtctgattatttaattcaaaaagcaattcactagtcttacctccttatttgccattgtacatgtggttaataagtaaaatctgaattcctaacaatgtcttttagattaatatgttttggttattgacacttcatacatttttgatatggtcaaagttagttcctagatagggaggagcaggatttttctcctcttgcttaactggtttctaatttcttgtgagattcctttatgtgagtttcaccatactaaaaatggaattattttaaaaaattataaaatagagtccccttctctattttaacaatcaatgtacctctgaatcaactggttattcccgtgatctgtgaagtagttaccgtgcttttcaaattgtatttcatgtgtgttcaaaatgaaggataatgactcacattataataaatagtatgacatttatgacccacaaggaggaggagtgtacaaatgaactttaagggttttaccttgaagatttgtgagatacaaaggcacagtttttctaaaacaggaatatacctcagctgtcaggaagaactagaaattatagttctgccttattgggatatagcatgagtccagtgacccctgttctcattgttcatctatctccaacacttcttgttaagaagacacaattaggtcagttttcaatgatccaatatggaacacctctgacaaacgaggtttcaaatcaaggtatctcagacagttggcctcctagcgccctgtcatccctttggcttatgcccaaattcagcccagagccaattagtggatcacagcctctagaatggcttcactctgctcacactcaacaagatccagacagagctgctatgcaaaaaaaaaaatgttcacagggtcctttcgcagaggggcaatggtttaggtactttgagacttcatggcgcatcaagtacacacatgttgaagtaatgcaagtgagaaattttgctgacaactgatggaaagtaacatttaaatctagagctctacctttgtgggcagcctgagacaaccctagattaaacattttaatttttctatttactgtttgtaggtttctgtaattcactgagcctgttctaatatgtacaggtagatatttgcacctagaaagcatgcatcttggatatttatcatatataaagaaaaaactatatatacagccatttaaatatgctacaaatagtaatagaacactaataaatatgtacatgaaatgagtatgtgtttatccttaaattagtggtttggttttcaacattgttttattccttgacactgtccccatgacccatcatgttctgatcactaatattctctttgaccaaaccatgcttctggagtgggggccattggtactagtcttcatgtgtggggacaaagggacagagttttaaaatatactgttgagactttttccagattagagttaatttagctaatgtcatcaagaccaatagttgttaggttaaagtggggaatcattaaaaaattgcacacttgaagtaaacattttacttaaaatatacaagtacattcatttattaaccttttcttctagggtcaagaccttttccttaaatattggattccttagtgggcttctaattctttcttaaaaaaaaactctacccatgatgcatcatctacaatttccaatttcagtttctctaaaggagagcaaaagcataacggtaactctaaagcaatatgcatatagaaaacttatttatttttttacttatccccgtctttaagaattgactcatccacacctaatttaacagcagttgttttagtgactcattttaacccattcttttcaaacgttttgtcttacttttaatagatacaacctttttttgcactcacattttgttcttttgttcaatttgtaattgcataattacattacatattaaactagtatacatagattctggaataaacatgccagactactattaagtagacaactcactggtcaaggaagcatacagaatgctgagggaacaaacatggcctttaatccagcaagtctgttataaaaaaaaagctcactctcaaagcctccttctggagttcataataaatgcttcccagggaggcagtcctctgctctgctttcctacttcttttcttctttgaaggtttccactttaaatcaggcaatactgtctgttgaatactgtctttctcctgaatgaattgttttcttcttcctgtaaaaacggaattcaggatagttttagccctttggtgtgccctatttattgagaaggacattttctgttatgcccagaagtttaggagccttgcatggctcgggcaagactgaagaagcagctcacttcagcctgtttctctactttgtcccctttgtgctctagcttttcactagtggaaatcgcccactctatcacaaatgttttcagaggctacaatccaacttaaggaggataagctatgagcaacttgaactataataatacatgaacatcttgaactataatagatttagaggaagtccaagaagtaacaatcctcaaaaaaaaaaaaaaaaaaaaaaatcctgaggcagtctaatggcaactggccaaagaccaaatcaagatattaaagttgcctgatttagcatccctcaggagatatgcttccaccataccctatatgcaaacaacaacaacaaaaatagagccataaatccccatcctaattgtacaacaaaatcatctgtggaatttttaaaatgcagatatctgggtcctctctaacaattatcaaattgagaccttccagatcaggggcctagatttaaaaaaatgaaaaacattatgggttattacaacggtcagttacatttgaaaagtcagtttaataaagacatgaaatatatttgtactgttggaaaagtgagtttctaagtgatattttcctccttacatatggatgttccttttagtctatgatagcttctaccttaaaacacaccttctgatgtgaatctgcatggggaaaaaagtggtcggctcagtgaatgggtgacaggcaagcagcctctcctgggaggttctttgctgtttcctctggacccaaaagagtcctcttgcttaaaccagctgcttctcaaaacattaaactgcacaaggatcatctggggatagagtgttattaaaagtagatgttgtttcagtaggtctgagatggggcttgaaattttgcatttccaatgagctctttgtgctgctccagagaccacattgtgtagccagggtttaagccacattaatccaccagttttcaccagctgcaactaattgagtgtcaaaatttaggtctacattgtctcttttccatttacaacttctaaactttattaaaatccatgaattattactctaaaaaggaaaaaaataaataaaaagaaacccttttcactttaaacaaagagataatgtgtaaggtgtgttcacgctttatggtgtaggttttttgcctgtgaagaccaggaagtgggtcggctcctaatcaagatcagatcaggtgattccataatggaactaaccacctacagtttccccaccaggctcatgtcagtaaatgccagtgacttctttgtttcaggtttatttgctaactgtagatgttgcagatgattggttagtgtgaaagcacaaacatggtgaaaataaagaggacattttacctttcttctaatatattatatttggtgtagcatttctagtttaataggaattgtcctcttttatagtggaatgagttttggactgaattctaaccaagagtgtatgaatccttcttaatgatagctgtgttatcatgtttcctcatagagcataaatattttagcaaatgttgttactgagtttgtcttcaagcagcccagtgaatgtctgcacccttgagtattaaggaaaaactcattcttttcacttataaaaaggcatatgatgtagagaacattggaagcctatctcaaatcttaatctgctttccctgagatcccatgggacgtatctgcaggcaggggggtggaatttactctcaactttattgctgctatctggtactctttgtctgcatgtagccaccaacttttatttatgagtatttgctggacctcatgctaggtccactgatacagcttacagacttgagaaagatatcctgcctctaaggagcttatagtctagtttatctcaatttatacaatttatacaagcaaccgagcagaaaattttacagttaaacgatgatgtgttgttttaaagtactttcaagattcattgtcagtttgtcttcatttgcatttctggtaacaaagacagaaacagtatagactaggcaataagtaagtgacagtgtgctgaaggagaaaatgatgacaaagaagatggagttgagatgatgggaattctaataacccatataccgtgtattagttctttatttcttctacaaacatttactgaacacctacttaggttcagccaaaaagatgacagttttatgataacagtatgtttccagtacagtataattgttgtcacaatgagctgttcactaaagcacggacattctgtcatctcatctgtaaaaagtagataataatatcctccttatcgaaaatcaatgagctggaacaagtgatttctagttttccttctatgcagtaatagctaagagggggagaaaggaaatgagaacaaatatgagcccgagtttacaatgtcttcctgggacagtatcagaaatgaaacctaatttgtagtgtctctgataaaacatgagcttcatcttctccttcttcccccaaaagatatcaattttcattttaccagtttacccctactagctggagctcagaacataggcccacatgcctatttctgccatgagcagaacaactatatttagatattccagattgttcttattccatagaggcccaatgaatttggtaactaagactgaatggaacttggtatctcatcagtgcctctcaaagatttcctttcacttgtttcttcaggaagacaactactagttggacacataaaagttttaactgtggctaggccccactcttctctagttcccattggaactagaaactgttgtaagaatgactccaaggaacattaaagacattttcagattgactttgaaggcacatataagtgtgttcaatgactttgtaatttggggaagactcttaaactccctattagcagattatcatatataacatatgaatagacctgtttgaggatgtaatgagctcatgcatataaaataactagtaaagtgacctgtacattttcagccctcattgtaagcgtaattatattatattattcatcttttgtaggaaaagttttattgaattggagaacaacagaagacaaaagcgttcctcctttccctttctagatttgtatatattacagaacacacataaaaatggacatttctctgcagattatcttactgttatgtataaaaataataaattggctctctgcctatggagcagacattcttttgtttctttacttctctaataaacttgctttcactttaccatagatagcaatagtaataagtcatggagaaaattaataactacttggactttctacgaaaatgtagggaaagtgtatatagatttttaattgatgttttgattccaaacaaaagaaaaaacttcttacaaatcatttaatttaaagctaaaaattgccttagatcacacatctgtcctggttgtactaggaaaattgatataaatattctcatggctgtcacacacctgttcttcctaaggcagttccatctgaggcatgatattaaaaggaatcagaggtgctcaccaagcaacataacacccttgactaagacaccaacattgtgatgatgtgtgaaatacttacatttctctatggctgccatagtaccttatattggcttcagatctttttatgtttgtgatctctttatccatgaaatctagtttatttgcccccttttgaaaatccatcccctatcctcatttttaattcatccattcttcttcctattcagagtaacctacctctcttaccaagggtgtggccagatgtgatctttttttttcagggccttaaatccagcaaattatgtcttgaaataatgacacgtcataaagtcacttaactttttttccgagtccaccagttctttttaacgtttttcactgtctaataaagggtctaaagccctgactggaatccatgcatggaggtgtcaaagcttaccactgttataaaaatatttccccctacatggcatgtcttcatttgggcatgaatcatgaattcatcccatgcgttctcctttatttcatgaacacccaactgtgtcagaatgccaatgaccttcattggcttggctaatctatggatctgaaccctcctgtaatccattaaaagaataatagcaaattgaaagtgaatgtaaagatacccaatgggaccataaaactaactattcaatgtgacgtgctttggcttaatagggcttttatttatttaatttcgagctccccttggtttctgacagggttagtggaggaaacaaacccagacatcttgtaagctgtcaagctgatactcatctcaggggagcttagagggtatcatgttttaagttttatttttctggagcttggaatatgtctgctgacagacggctcccctgggttatagcaatgcaaggctgttgagacaattgaataagctgaattagacaaaggatttttattacaataacaaccagatggaactttgaaggaaatttttttttaaggtcttagaagttctgttacagaaatcatttaaaacatatttatgggctgggcgtggtggcttatgcctgtaatcctagcactttgggaggccaaggcaggtggatcacttgaggtcaggagttcaaaaccagcctggccaacacggtgaaacccacctctactaaaaatacaaaattagccgagtatggttgcaggtgcctataattccagatactcaggaggctcaggcaggagaatcacttgaacctgggaggtggtggttacagtgagccaagatcgcgccactacactccagcctaggcaacagagtgagactccgtctctaaacaaataaataaataaataaataaaaagatatttatgatgatttttcctattataaggttaaaaaaaacaacataaagatctcattgctctgttttttttaatccctaatgattaatatgtggccagttacagagactcttccagccaacccgtgacatatacacattaataatgttcttttgtatttgcagatcttatttcttcagagtaatggaaaatcctgcccagtactgttctattaatcttcataacgaatgctagggggctaggtgggcggcatttggtgttatccacatgtaatagattttttaaaaatggggcaatgaaaacaaaataagtcttgaaacttgttaacacccacagtggaagtttagcagtggaaatgaactaatattaccagaagacctcttattctctattgcttttcatgattagctagtacatttattatttttctcatgaatgacaagattgcctgtaatgtatttgacatgtggtagttttccaatctccggcaggctgtgtgcatgggtgtgtgtgtatgtgattaataaatacttaaatattttttatatagggattgttttgccctctagaggcagctcaatagaaggagcattcaatgttagtgattgaaaaatggtagatgaaacttggacaggaaaactcgagaggtccaaggtaccttatttagctactgctgtcacggtggatcataatgcagtgggacagtcaggactcaaagcctttcctataaccacatacgatggatattgagcacaatacagaagcaaaagatttgttttaacttggatacttcaactgcaagcgtctctgggcctgatatccagttcagaattcactgtactttttatttcactatcggctttccaaaatatggtaactaaatgagtaaatgaaaacatggcaatacaaaccaacacaagttcttttgctgacagagcatgcaattgccaagtaaaaatattgttctttattaggtttcttttcatcgtacatgtacatattcatttggaaacacatttttttgagacataatcttgctctgtcacccaggctggagtgcagtggtacaatcatagctcactgtagcctcaatttcctaggctcgagggatcctcctgcctcagcctttcaagtaactagaactacaggcatgggcacttgccgggctaattttttaaaattattttttgtaaagactgggtcacctcagccttccaaagagctgggaagagctgggcatataggcaggcatgagccaccatgcccagtctacaaacacattttaaaaccataggccttctagttttttgttgttgttgtttaggttggcttttgacatgctacttattgcatactagtctgtcatgttcctaaattccagttactcctgtagccatttttaaagattattttttaaatttttcttcctcctcctccacctcctcctcctcctccttcttcctcctcctcctcctccttcttcctcctcctcctcctcctcctccttcttctcctccttcttcctcctcctcctccttcttcttcttgcttctttttcttcttcctcttcttctcctcctcctcctcctcctccttctttttcttcaggcatggccttgctctgccactcaggctggagagcaggggtgcaattatggttcactgcagcctcaacctccatagctcaatcaatcctcttgtctcagcttcctgagttgctgggactataggcatgtgtcaccacaactagctaattaaaaaaaaaaaaattctttttagagacgatggggccttactatgttacccagactggtgttgaactcctagcctcaagcgatcttcctgcattggcctcccaaagccctgggattgcagggttcccaagtggccatatcattggatttgtcttcagagtgatgtacttgtgaaacatggatatgaacagggatagagggcaatagcaacacatgtttattaagcactcattgtatgccaggctaagcactttgtcacagagagcctatttaatcctcagaagaataatccaatgaatcactctattttctaggtgtcaaaaccaagtcttaaataagccaagtaacttacccagaatcatatagccacagaaccgagatttgaattcatacattatgacagagtcagataagctagccatcctgcccctacctccagttccagaatcagtgattggctttggtcttactcagcactgtcagttacagaaattggtgtcatcagattatctgtctgcctaccacctctggagcatggcaattacagcatcattgatttcgattgtcctaaaatggaggaaaacttgctgctggcaaaaggaagacccataatcattcatcagctcaataggcttgaatggctaaagtgctcacagccatcttcctgtctcactaattgctgccatttaaagataaagggggaagaaactaccctttacttcagtttacaaaacccaccgaagttaagatataccaaaggatgtatccaagaacccagaacttctggatggaaggttctggaattgaatcctcatgccctgcagtataacctccatacacccacatggcttgggcctcttagttttgcttggctgctactacttttaagtaaaaaaataaaaattggttatgcagttttcagaatgtctttcatttcaaatacattcttaatccatcaaaagggacattctaaataaagacttgtctctacatgatgtgttaatgaagaatggcaggggcaagtaaaacaaaacaaaaagctatgtagtgaggttctttcaagccaaaccacagctgtttgaagaatgacaatatgatatcatgcaactgccactatccctcattaattgattttacagatttttaggtattcactgatgtgtcttgtacttatggctgaaaatgcacactaacaatctgtagcaatgttacaacacagatagcatattgtcaaatgctgccatggatgaaaacttctcatttgctgtggatctgttaagataaacctcttgagaattacagatacatttattattggcattttcaaaatggcaaagacatctgttgctaaaagtctctgactggaaaggatttgggaccaagggtaaggttagctaacacttcttaaactagacaagtatgaacagtgaacatctgaaactacctgtgaccacagagcccaagtaatgtttaatggaggcatacatctttaaccattcaatataaattcaacctttttttttttttgagatggagtctcacactgtcgcctgcattggagtacagtggtgtgatctcagctcactgcaacctctgcctcctgggttcaagcgatcctcctgcctcagcctcctaaattcaacctttttttaaagttttcctcattaactgaattgggcacttccccccctataatctcttacataatttgttttaattcttttgacgtatgcattacataccacccttgtattggaactatgtatgtatctctttttcattcactcccctttccttccctgtcccattccttaagagaactgttatcttccatgagggaagcactcctgcaacttttacgtgtatgtgtgtttgtcaccatcttctaccacgtattaatgtcacatattaatgtgccagcccatattagtgtctcattctatgaatgaatgaataaattaatgaagaatgaattatgtatgtaatgtagttcaacttactacataacaccaagtaaactaaaccatccaagataagtttttgaatcaaagccaccatcctactaataaatatggtttcttttgtataaaggtgctagaattcctagccaaatattttattagtgttctatgccaaaacttccattcatcaatgacttatttcaatgataattacttcaagtctctgagtgtaggtatcagatgttgaatattagtatcctggtgctcaaggagtctttcacaggcttttacatatgcttctccatgtgattccaattttagcatacaaatcttttatttactatcaacctacttagtctacttgttgagaaaaaagtgttcatcatatttcttgattctgcatatcttatcaattgcaatttttctgctctattaatgtttagatagagaggaaaattagggaaggacaccaatcctgtgtgtaagacaaaactggaagtcattcacaaatacaatatgcatcaaatgttttcttctgagtggttctatattggttctaaatataatagtaccagcttatatgaaaagcatgagggattggcctcaccagtttttatcaaatgtaagatgctattaatttcaagatgcatcactcttttatgaaccacaaaggaagaaaagaaatgctgccaaattaacaatgatgttgttgatcataagttatatcttgatttcagagatattaaaatgggtttagaatgtatgtcttagaatagacgaaatatagtatttgttcagtaagtatggagtgcattctcaatgctctattactttcaacattgatatgcttcttttacaaatggtgaagatatgatagggtgtttgtgacacatgcttttctagcaatctgtctaaaacctagcatgcattgcaagacatgtcactgcaactctgcatgtgctaccacagctttccagaaggtaacatgcatcccacaaagcttccaaatttcttttcagaccgttttattggcctgatggcaagctaactcaaagcagtttgccatacacagaacacattcaccaaccttggtataatgttccctccgcttctttctaacaagtcacattttgccttttaaggttatccatcatccagtgttttaaagcattttgctttcaatgaggtggcacaaaaaaccatatttttacaatagccctaagttttaatggcaggcaaagagaatatgactacatatctcagcagacaattagagtaaggagggtgaggtaagaagagtggtgcaatggaaccgtgaagatagggagccctgaccctttcattttctgttccgtacatatttgaccttcagtcctgcaattgcagaaaacaaactgcccaatcttacccatgggacattttgtaattactttcttgtctcttctcttatgggtgcattgactagcacatagtacttctgctactgatagctcatatttatctagcactcattatgtgcctgacagtattctgtttcacatatattaattaaactgattaactttttaaaataaactttttattttgaattaattttagttttacaaaaacattgcaaagataatacagagttctcatacattttttatccaattttgctaaatgcaatgttaacgtattatacaactgtggtacattcgttaaaactaagaaattaatattgataaattactgtaaactaaactccagacttcatttggatttcaccagcttctccactaatgttctttttctatttcaggatccaatccctgttggatccatattgcatttaattgtcatatctccttcacctctttggatctgtgagagtttctcagtctttccttgttttccatgactatcacactatttttttcagagatggagtctcattgtgttccccaggctggatttgaattcctgggctcaagcaatcttcctgccacagtgtccctagtggctccaactataggcatacaccacacccggcatgactatcacacttttgaagattaccgattgagtattgcataggatatcctttcatttgagtttgcctgctgttcttccgatgattggactttggttatgggtaactcatccacttttcacaacagcctataagacggtactattatgattctcttttatagatgaggcactgagggagagaacagttgagtaatttgaaggcctgggtgcttgaatccagagggtctggttatagacctaaagctcataatcactatgttattattgagttataatttctaaatttgaatcttgacacactacatactaactcatatttattggtatcagatcactcaactgtgaagcaggaatgatcattttacttacctcatatggcaatgcttagcacagtatctcggtcacaccaaatttctggaagatgttagctgttagttttacttaactgtttgccattatttttcaggaagctggccatgttaattttctgaactgcacaatcacaattttgtgaaccttaaggtgttctgaaattacgggctcgttgattctgccctttgtcttgcttctcaaagaaggtgtgctggcactccatttaagtgctttatttgtcaggagaaagtgctcatttgaatctgaaaagcaatccatgtacaaaggaagaaaacttggaaaccctgatagtctctgcatgtttgagaatcaatgaaaaaagtaatgccactttccacatgtgcttttagaattctaggaatagatcagtctcaggttatactacaggaataatatctttaaataacaccatagaaaaacattccaaaattgtttggtagtggactgtgtctacacagatacttatacatgttttttggaaggtcatattatgacatatagcaatatcagaatttctacaccaatagcattaaatgataatccctctctgtcaaaccggaacatgtgttgtaggtaagcatgtacataacagtgtcgatatctttgcctgaagtaagaatattgagggaaaataaaagcgttatgagatgtgttcctttcattttaaaaaatgaaaaaattactccaaaatggtgttatggactcaacattgattctcctggtttccaatcccacacaggttgagttcttactacaacaaggcattttccttggtgccatgtcctagatcatacttttctgtttaatgcagaattttcttccaggaggctagaatgcttggaaaagtgtttgtcatatgtcggaaagtgagcattttctcttatgaaaactattcgtgcttttatgtaaaagtattgaaaaggaaacttcacaaaccataagaaaatacctgaagaggagatagaaagcaatccggctggggatcacgtagcaagtgtcttcattgggcagggtagaaaccttggctaccttttgctgctttccaactctgaaatcctaagtttctctgatgttaagttacctggttgtaattataaagtgcttatcattcagacgtatgtgaaatacttggaagtcagacttcctgccagtgtttaacactttggaaggatcaataagtaggctttattcagatattccaaatggccaccttcttggtgtcatgtgacgctatgtctgtggcctataatacatgtagttgtgattaattgacttttgtccagcatcctgtattttcggctctcttttagcggtggcaagcaatggaaaacattatttctttgctcagatttctcactatatgtgtaaaaaggtgatattgtgattccatgtttccaaatgagtgagactctatggacaccttccatatattccctccatatcaggagtaaagaaaggtatgtcccaatttaaatgggaatttagcacctctattaaatttttcacacagcttccattctgtatttttatgaactataccaaatcaaacatatttatctttttgttcagagaaatgaacatgaactccttatttctgttaaacctgcttttcttgcagtcttcactgtgtcgaggatgtctattccatcccactagttactcctagggaaaatcttggggtttaactccttcctctcacacctcacaccctaaccatcaacaaatcctcttagctttacctccacagtatgtccagaattcagtcatttctcgtacctctcttacaagcacccagttaaagccaccatcttcacatttaaaattccctgtgttagcaattttgaggtatacaatacattattactaactatagtcacctggttgtgtaatagatcaccagaatgtattctttctgtctaactgaaattttgtaccctttgaccaacatttccccttttcctaccctcccccacccacctcagcctctggtaaccaccactctactcttatcttgtctgaatttgaattttcagattacacgtgtaagtgagatcattcaatatttatcttttaaaaaaattttttttgagatggagtcttgctctgttgcccaggctggaatgcaatggcatgatctcagctcactgcaaccgccgcctcccgggttcaagcgattctcctgcctcagcctcctgagtagctgggattacaggcacctgccaccacgcccggctaatttttgtattttttagtagagacagggtttctccatgttgtttaatttttattttagttcagggatacatgtgcaggtttcttatatagataaacttgtgtcatgggggtttgttgtacagattgttttgtcacccaggtattaagcccactacccattagttattttttctgatcctctccctgcttctatcctccaccctctgataggccccagtgtgtgttgttcccctttatgtgctcatgggttctcatcatttagctcccacttataagtgagaacatgtggtatttggttttctgttcctctgttagtttgctaaggataatggcctccagctccatccatgttcctgaaaaggacatgatttgttctttttttatggctgcatagtattccacgttgtataagtaccacattttatttatccagtctaccattgatgggcatttaggttgattccacatctttgctattgtaaatagtgctgcagtgaacatacacatacatatgtctttatgatagaaggatttatattcccttggatatatacccagtagtaggattgctgggtcaattagtagttctgtttttagttctttgaggaatcaccacactgctttccacaatggatgaactaatttacactcctaccaacagtatataagtgttcctttttctctgcaaccttgccagcacctgttatttttaataaataacagcacctgttgagtttttaataatagccattccgactagtgtgagatcagttgcttttggaattttcatcatgaaatctttgcccgttcctctgtccagaatggtattgcctaggttgtcttccaggaatttatagtttggggttttacatttaagtctttaatccatcttgagttgatttttgtatatggtgtaaggaaggggtccagtttcagtcttctgcatatggctagtcagttatcttagcaccatttattgaatagaaagtccttttttccattgcttgttttcttcaactttgtcgaatatcagataattgtaggagtgcagctttatttctgagctggtatttatctttctgtgcctggcttatttgacctaggataatgtcctctagattcatccatgttgttgcaaatggcagattttcattcttttttaaggctggatagtagtagttcattatgtatgtataccacatttgttattcattcatctgttaatggacgctaatgttgtttccaaatcttatcatgtctctctccatctcccttagatcaaaattcaaattctgtgtaacatatagaaagacttgccccctttacctgactgagagcatcacctctacttctctcttccccctctacaccagctataccacccacctcactgtgtttcaatatactattgttctcctgctcagaagctttgaaattgctattccctctttttgaaatgttcttctccaaggtattcattttcagagtttgctccctcactttattcagtctcatcagagaggcctttcttgactatccgaaaccaaataccgctgcctcccacttacccctcagtctccttattacgctttgtctgcatatcgcttaccaccacctgttaaaagataaagctgagctcattaaacatttaaagattttatttgagcagactgattcataaattaggcagcaccaaatcacaagctgtatgggctccaccaagaaggtgtgagaggaaaatttttgtaaggtgttctaggaagcaagacaaagaaaatatttgatttattgaagtggaaagtccctagttagaaattagttggcagtttcagattaagttaaatgtttacactgaattgggttttggtttgtctacataggaacccagggcactggagccatctcagcctagtggcctcccaaattattttttttcgacacacgtgacatactattttattttctgtctttatccattacaacgtaagttccatgagagcaggaatgtatctgttccttttgttgccttatcttcaaaatgtagaatagtacacaatacttaataggacattaataaatacttgttgaacaaatggaagaatgactaaatgtgattgaaaggcagactagtagtaaattggactaggtcaaatacatgtgcagaccagtgttcaatagtatgtagcatagtttatatttacacatattcaatatttagcctttcaaaatgttttccagttacctaaatataagtatttagcattataggtggaaatctgtcaaattattttaactcataccacatttgagaaactgtgtggaacctttactattcctcagttttgtttttctataaatataatatatatttccttttcctactgaatgttcccctcagtgcaatttttttccagctattttacttgtagttttgatgtcttgctttgtttttacctatgaagtctaatgaaagtccagataagagcctataattctatccatataattcagtaacttccagaacatgttttatctgtcagactatggttcacattatcgtaggtgtaatgcaaagtttagagctgaaaatgtagccacgttcctaattcttgctctagttatcaatgtcaaatgcactatcaataggacttgaaaaacatactcagtaatattggatgggtactgacattctctcaaattatagtattgagtgcgctatactaaaaatagtaaaaataacatggcttagacaagtgagaaaacaaagctatgtcctactttattttgagaagcaaaatacaattttcctgtttgttttttctttttctcaaaacaactaaaatttgtaggaggataatgtttaaaatttgttcacatggttaaaattagaaaaataaataaactgacatgaaacatacattaaatttaaagattcattgttttgtataaacacagtgtatagcttataagtcattatgctattagattgactttttaacttacgagaaattggcattctaatttagatgcatgtatatgacttcccatgtctattttaggatagatttaatcataaaatgatttaccttgggcaaattacaataaactcacttgagtaattaatcgaggtgtttcaaggagttaatttagttcacgtaaataagaacgttgtttcaaggaatcatttaccactctgtattgccatttggcctagactttttccattttacatccagaagacaaactgttgataaactatttgttatttttttgctaaaaattgatacctttagtatagatagtactgtatcagaaaccatagaaactgatgctttaatatggacatgaactcattagacatagaattttggtcagtctctagttagaatcattgcttctatttattttcaagtttgtacctgaggataattaatattattgaaaatgggttaatttgcaactgaccttgaatcacaaagtggtaggaaaggagatctcttgttttatttatttatttattaacaataaggatttgggcattgtcatatgcattcttctgtagcttacaattaccacaacacttcacatcaataatatactggtgctgatttagtttaaatctttcatatacgtgtttattgtaaatttctttgagtaatgctgggcactgatattaacagaggattaactttatggcacattttaatagaatgcacaatattacttccaccaaattttcttcttttctttgtgaactgttattcattttcagacatgaagaaagtatttctttatcttattttattttatgttccagggtatatgtgtaggatgtgcaggtttgttccataggtaaacatgtgccatgctggtttgctctacctatcgacctatcccctaggtcttaaacccatcatgcattaactatttttcctgatgctcatttcttagtagacatggcacttcaaccattctgaagcttaaaaattatttgttattttaagcccgtaagagcattttaaaatctgatacatctgagcagaaacttttggtttttagtttttttataaattaaatgaaattaacacattaactatttcaagcaaataagatccacttacataaatgaccatgttagtttgagaagttatagcttactgatctgaaaacattaattgaacctccaaaattatacccgtggggtaatttctatcctcgcagcggtgtgcactttaggacaattaaagtgccaaaggaatctcattttatttcttggttattatgtctaggtaaactgatggctcatttttaagatctgtttagtatccaatgattaaaataaaaatgatgacctcatcatgatattcacatagcacatttatccatttctcttttgatttatagcttatttttacctaatgcagtttactcaagtctcctgggcttatacattttttagtctttgataatctatactaatggaccacaagggtagcaatataatctaatgaagtggttaacccagagtcttgggagtgaactattgtggtttgaagcagatcatgtttgtttggcctactttttttttttctttttttttcttttttttgagacagagtttcgctcgtcacccaggatggagtgcaatggcacaatctcggctcactgcaacctcggcctcctgggttcaagtgattctcctgcctcagcctccttagtagctgagattacaggcacctgccaccatgcctggctaattttttgtatttttaatagagatggggtttcaccatgttggccaggctggtctcgaactcttgaccccaggtgatccgcccgcctcggcctcccaaagtgctgggattacaggcatgagccaccgtgcgcggcctgtttagcctacttttatgactgattcacatttattaaatagctcctagctggatggatcattcagaatggcatagatctgagtagagacttggagactattagcagagctagcttctaggaatagaagtagaagtcaaatatttaaaataatcaccgtgaatcaacatttggtattacctgatcattctcaaaaccctgttccctatttaagctttgatagaattatatgttaaatattcagatacgttatgtaaatgacgaccaggacttagaagttgtttattattaccttcctttatgtggctactaagtatttctgtccatgaaaaatgactgaaatcataatgttaaaaataggaaagaggccgggcgcagtggctcacgcttataatcccagcactttgggaggctgaggtgggcggatcacaaagtcaggagatcgagaccatcctggcctacatggtgaaacccccccgtctctaccaaaaatacaaaaattagctgggcgtggtggcacacacctgtagtcccagctactcgggaggctatggcaggagaatcacttgaacccgggaggcggaggttgcagtgagctgagatcacaccactgtactccagcctagcgacagagtgagattccatcttaaaataaaaaaaaggggaagaaaatacacttacacccattcccaggtaaaatgtcacatctctgtttgaaatgctcatttgcatgaatacattatgaattgcagttccaatatatacatttctgaatatggaaacctcaataatattttctctttgtgttttatatttagtactaaaaaagtgatttgtggctaatataacattcaattaaaattaacatttatcctaggggcattccaggtactacagtctgtctcattcattagagcattttgtacttatctgcagagcatctctcctcagaagagaatctgctgaatttttgcatcttatccagcatcaatcactttgattaggatctcactccatgaaccaggcagcttctcttccacagcagttccatatgtctcctacagctgttctactttctaagtggaacgtgactctcttcagctcatagtttgtgtccccatcaaaaaagactgtcaatagctcctttattcttttgatttgctgtactctcttatggcttggaatatgacttatagtcagtattgaattaggatatgttcgattaagagaaattgtgtccatgaatgttttgataagtgaaatatttacatcaaagctcatgctaagaaactatttgaagagcaaagacagagcagaaactttgcttgtgaaggaatttctccagggaaattttcaccgtgcaactcggtggtggaaggctgccataattttggtttatgttaatagaggttaagttgatttttattattttctttggttggtttataatcagcaaattttatcttggaaagtagatttttttttgcccaggtactatgtttgtgtgttagactatggaaagccagaacaactattatacattgactgcaaagataacagaattttgtgtgtgtgtttgaaacttcctttcaacctcaacacccgaaatgtttgctgcaataccttttctatatgaaaaccatagaataaatagaatggaagtaaaactaattcagaataaaagaaactatcatttctacaaatggcaacctcatttatttacacctaaaactatagttttcatagggcttaatgtgaaaagataaaagaagtgaaaaggtccttgagaaaataatagagtattacctgaagcttgctgagcaaacatttttggggaatgacaaaaaaagcttttgaacatgaacttctgggatttcaactgaatgatcaagcatgaagaaacttgattatcctgattaaagaataatgctgggaagtctttgcataatttgataatatttttagtatgagctgatgtctttaaccaaaatagctaccaaaattttagaaaacactatcacaccatgcatgttgtgaatgaaatttttatttactcacttgttgatttgggagagctatatgaacaattattatcaccaatagtattcatggtcttttttaaaaaaagactaacaggtcaaagaaaaggggtttaatggattcccaattttagtatgttgtacccttgagtatcagatgtctctgttcttagcaactttccttgcttgtggaaatctagaaatggtttactcaatgtcagttgatcatgttgttttatctgaaaggcaaaaacactaggatactttcaacttcccatagagaattacacattcaaactaaagtctagttgttcaaatggaaaaatcgagaggcagacaaattaatgtaattatagacttggtagggtgttgcaaatgaataagaaactggcaatttgagtagttaagaaccattgtatattttattatagctgtaatgttttgagttcataaagccatattgaagtaggaatacacacatacactcatttttagtaagcacaatagaagtaagtcatttcattatcattttagggctgattcttacactttttagcccacaattccgtaagttgtctaattcgactgatacagaccagttctagctaccaaaatattatgtgcacaaaactccctttcattctatttttctgatcacaatatccatgcccacaatatagctaattagttaagtgtgggaggaaggcttttgttagaattcttactccaatggattaatcattggaaatcctcaaattgcctgaagttgttagcatattttaaaatcaccagataaatacctaactagaacatcagataatacatgacaattagaattattctagcgagctgtagtcacatctgaaagttaccatattcttgctcctcaaacaccttaaatttaaactctgatgaaatccatctgtaccttctctaatatctccccagatagtcatgaggagtaaataacatactacaaaatgttaaaatatttcaaatacaaagttctatagaaatgttacacagtgctattatcactatttctcaattaaatgtacattttaatattaaatgttactgctaaaattattttgatagtagttatttataaacattcactattagtaatagccaactattatgtatggttactttcacttaggatgaaataaaaaatattggcttatttatatatttcagagtatgttctagattcctataatggggttctaatggggctaaatatgtcaaattcttataatatatattaaatgtgtgactacagcagtgccttttaatgtgggtcttcttttagtatctgaagaaagctaaccaaattttccattgtaaccaccaatatcatatttttaatattagaatataatacttaacaaatacaatagttaaatgtttatttaatactaactaaacattgaacaataattcttaaagagattcacaaactataaaacactataccagactataaggtgcttttactaatcaatttggaaaccataacacctgtctgatgagcatgcttattttaaaatgaacagatgcagggtgtgataatataccagattaaagttatgagtgaatagatttccttgtaattacaagtcatatagtgaaggtatcgatgctatatatatttctgtcaatgaagaaactgtataatttgaagtgttttaattttggggggatgggggacggagttttgctcttgttgcccatgctggagtgcagtggcacgatctcagctcactgcaacctccacctcctaggttcaagtgtttctccagcctcagcctcccaggtagctggtattacaggtgcccaccaccaggcccggctaatttttgtatttttagtggagacagggtttcaccattttggccaggctgctctcaaactcctgacctcaggtcatccgcccacctcggtctcccaaagtgccgggattataggcgtgagccaccgctcctggccacgtgttttacatcttatttataaactagcctttggaaaatgggtaagaactgtagtgctttttgttggtaatactgtgtagttgttctttagttgtcatttcaaaaccaaagctaaactgtttacaaggaaataaaaacttaacctgtgcacaaatttagcattatggatttacatactaccaagtactagaactttttcagtctcaaaaactaagcccttttgaaatttagctatttaatatcaggaattctgaaaacaagggatatgggatgtaaggagaaaattattcctattctatagactttgttatgtatgttttaaaatgtaattaatatcaacgtaatattgtatctttcagacactgacttccatttcctgattggttataggtaatttgaagatttttcactataccagtagagatacaaagtaaaacacaggtatagtctcctagaaaattaaataaaataacccttgagtagacttgtaaggtgacatagaaccagatatgcctgtcttctgttttgctaaaaagaccttgtttccaagtgttattgaaaagtgtcataatgaaatcagaatttaatgttatttgccctggcaaaatcatgtgtaatggtaatcataaatcagttaaggagtaatacaagatgttatgcaaataagcactaaagtttcacaccaggtaaatggctgccttcgtgagtcagtggtgaaatggtaaggttctagaatatggatattgcaatggacattaaaagcaaaatgcgtagagacattttcttaaagtagtaattaatggtacatggaggtgtgcttaatgtgaaggaataataaaagcaataaaatttcaaacaataagcattcatactgatttgatttgtgcttgtataattctctttacaactctatcatatatgttcatctatttattacattttggatgttactgcattcttgtcttagtttattaagcttcccttttaatatttgcctttattttaccctcttctcatattatgatttccttgatcctagcttcttttttcaagtccatgcatcttagtatttcatggctggcatcaggaagttttctaaaattttgtctggttttcatggaaaaaattgcaaagtctcatttattttctaagcttcaagacaagtgtatccatatggattcagaaaatttctataggcaacttctattgttcttttcactgagccttaaattagaagagctgtatgtagacttagtgttaagtacaattattgatgtactgaccttcttctcttatttttcttcataagtggagattgatatacataatctatacctattcccagtaccgacttagcctttacccagcactgctttcctgatggatgtggagttttctccaaataaaactaccatatcttgtaaccatattaaaaagtagaagcattctgtatttatattttaacttaaatatttattataaaaaattctaaatatatacaaaatagagaatgataagtgaagattcatctacctattagcaaatttcaataattataagcattttaccaacctttgtacctattttctatgtaggtgtaatacatggaagtctatatcctcactatgcactgttgtagactcttctctcaacacttctgcttttcctgaagtgcctagctatctgagcatacaatagggctaccaatccatttttgttctccaactatatttttatctgtgatttataatatctgaatgaaagcaggaagagacaagatagaaaggaggaaaaggaaaaaataaaaactataaataagagtgtagtagtttaaaggaaccagggaagtaaatgcctgatttgtggttagtgcagtgctgtatactagagtgaagaaaccttacactcttgacaatatcctggtaattcctgttgagagggcaaaacacgcgtagtccagaactgcatttctttaactgaatcatccccaaaaacttaaggtcgtggaaattctctctaaattttggtgtctggttctgacatatttttaaaattcagtgcttccccaacacctgtaatatgtatattttaacaggtagttggacatggtatttcaggctttcctatttttttcctatgtaaatatgaaagttactctatgggcctatttccctgaaatgttggacccactaacacaatcagactttctacaaactgccacactgattctttgccttcaggtacacctatagaaagatgagtgtgtggggatggcatagacccaaccagcagcaagagggagtcattatttcctacccaagagtagggcagagagaaagaagacacatttgctcagccattaagcataaaccaatgaatgccagactctttatgatcttgccagtcaggattgatccatcctttcatttagaggaggattgagcaagaggtggaaacacacgctagacatatttttctagtataggtcattacaaggaaataccaagatgaagaagacagttcttcctaacaacctctgccatgaaataattactgaccaaatatatttgggaatatgattatgctgaaagggccacatgaagtccttgtttttttattatttacagatttgactattttttttttctattctaatactgtgcttcctgatgctctattataaagaacagaggggattgggaagctggggttcaagccaaagaataaatccatgatgtattttaaagaagttggtagaagaaaagagaacaagtagatttttttgttgttgttttttgtttttgtttttgtttttgtttttgttttgttttgtttctttgagatggagtctcgctctgtcgtccaggctggagtgcagtggcgcgatctcggctcacggcaacctccacctcccgggttcacgccattctcctgcctcagcctcccgagtagctgggactacaggcgcccgccaccacacctggctaattttttatatttttagtagagatggggtttcattgtgttagccaggatggtctcaatctcctgacctcctgttccacctgccttggcctcccacaatgccgggattacaggcgtgagccattgcgcccggccgagaacaaataaatatttatagagtttggtgtagtaatatttttacttactctttcttattctctttattatttgctcctgaggatatgagttaccatctaactagcatcatttccttaagccaatatatctttgttcccttccacctcatttgttttgttgttgtcaaaaatgttatgtaatacataagttataggtcccaaaataaagttatatacatgttgttttatacagttgactttgaaatcaggtgaaggaaattgcctttatacttttttttttttaatatttacataattacctttactccttgtttttctgcaaggattttgcttatggttactttcagtttttgtttgtgtggggatgtctttacttcatcttcatttttaaaagataactttactacatataagattcttggttgatgattttgtttctttcagtactttgagtatgctatcccactgtgatcaccattgtttctgctgagaagtgagctgttggtagttcccttaaagttattgaagttcccttgtaactgataaattgtttttctcttgttgagttaaagattttctctttgtatttggctcttagcatttttcctacaatgtgttaggatgtggatctctttgtgtttattatacttgtagtttgttgagcttcttggttgtgtagattatttttcatcaaatttgaaaagctttcagccgtatttttatgtttctcttcactttctgtccttctgttctgatatgctcattacgtgcatgttgtgtgcttaatggttgcccaactttctgtgaggctctgttaagtttttccattctttttcctctctgttcttctgattgcataatttctattgatttatttcaggtttgctgattctttcttctgtcatttcaaacctactcttgagcccttctagcaaattgttatttcagctattataatttttaactccagaatttcatttggttcttttaaataatttctgcttcttcatcaaaaactccatttgatatagcattgccatcataatttcctttacttctttaaatatggtctcctttattattttgaacatgcttatatggctgctttggattatttgtattaatatattaaacctgacatttggcctctttcacagtcaatttatgttgcttggtttgtttcccgtatatggggaacacttttttctttctttgtgtgtcttttttcttattgaaaaatggacattttagatactttattatagcaactgtggatactgatatcccctaatctggagattgcttttgttgttgtttgcttgttcatttattctgttacataactggactattttagttaaatgtattttcctgacagtatgaagcttgcaatgtccttcctcagaggaggcaaatttgggcatgtgcatagtcactctgggatgacagtggttttaggaagattctctttgactgtatctttccctgatctctctgttaagctgtcttcctctgctggtattagaccaagtttttgtactacattatttgcctgcttattgttttggataatacgttggggtataaattgctccacattctgatccagttaaactcaagcccctttggaagccaattttgctccaaagttcagggcaaggccactggcctacttctcttgaagtgacacctgtgctttatgagcagggtgttgaatagagtctgtagcctctggccttctcagcttatctccctcagcatagaacctctgccctaggaacaagataaggtgagggcagtagaagtgggaggagcacctccagtattctcagcatgcctcacaggagctgaagcccctgccctatgtgcaggaattgggtggaggaggggagctccaattctctcaaatgcactcactagaaatttagcctctgtaacatagagcttcagggcatgacaaatgctggtagcctgctgctcttcagggagagagtcgtctttgtctgggagctggggagagtgttaagtcccacttttttggccacacctgtccagattggagcttccattctgcggtgcagagtggggaggaaggatgtagaccatgtgtaaacgccacagactctccttgttcttactgagatttggtagagtttcttcatttgctgcttgcccttagggaaccttatggagacttgaaatggttgttattgtttgtttgtttgtttttaataattgtcagtaattattgttgtttccttgggagttggactacagagctcatcatactgctgttctggaagtgaaagtactccatgctgtattttaaaggccttctgggatccctgttgcataaagattaaattaagtgttaaatgccactgtacgtttcatgatactagcaagaaaaataaaacaggattttccaaatatccttgattcagactgagaaatagcaaactctcaaaacaaaacattaatgtgttggtgaaatgtgcaaaatgctagcttctcaatcatctttggatgcggaattgcttaagcgaaatgaagaaaaatattccctcattgttaagctacaactgtttcatcattggagtgttccacgaaacagcctatttcataccagttaagggcctagctagaatttcaaatgaatgcaaataagaacgtttgtaatgcaagttgcaaggtgggaggaacaactgtttatgtaattttcctctcttttcaactttcacagagcattgcataatgttagaatcagactgcttgtattttaatcctggcttcatcactaagagatgtaggcttttgaccagttaatctaggtttcagtttcccattaaaaaatagaagtagtacaggacctacttgtaggtttattataaggagcataaataattgatcacttgggtaaagtgttaagcaattccccaatgtataaataataaatttaagatggtaataaaattaaaaaatcacaaaagcattaaataaatattatctctttagcagcttggcataatcagtagaaatttgagttctacaaaacttattgctgaatgaggtatagatttggatattagacaagaattttttaatggtccttatattcattggttttaatttagtgggtttccttaagcttaatgtatctctagtatgatcatctccacaagaatagataatactttttattaaatgctagcttagtccacaaaactttgttttattaaagtagataaattaagcaatgaaactattgatacaagatgtctttatatctttcactccaatcagttacatagctttaaaactcagaattatttttgtgtacatccactgtgtagtacctgaagtgagatgaacttttatgctatgctttttttctatttggtattcattgagtagcttttaaccaatctccttcttctattatacgagttgctctactgggcttttgggatgcagaaatgagtgagaagtggtttcttcagccaaaaccagatagccatttaagcacacaaataggatacatttttagaggtactattggagagatacctacaaggcgttgcagaaacacaaaaaacaaagagtccctggaggtatagggaaaagcttcaaagaggacacgaaggtgaagtcatttgagattgattatataacctagtgaagaattttccaggtacagagagatgcaggaagaccatttctggcacagggaacagcagatacaagagcatgaaataattaaagtactgtgttgttcaagagatgctgaaaagttcagatatttggaaagttcagtgaatgggatgcggaaggataacggaataggatagaaggggcaggttgaagccagatgtaaagaacttttatgccttttttaagagttcaggcttcattctttaggcaaaggcaagccagaaaggattttaaccagtaggagtgacatggtcagttaggtctttagaacaataactctggcttcattgtgaatgattgaagggcatggtgcttatatttccattgtaatagtctaggtcagagtaagtcagagctgaattaaaaatagctggatacaaaacagcttttctcttccatgcaatagtgtgtttcctccctaagccccactctctcccagcgaatacagttagtcttgttttatgaaaccagttaagttattaagattcaagcacccagctttctttgcttagctagctcaggtaaattgctttaatgatgtccatactgtaagggaagcatattctaatatgggaaaaatggatcagatgtctttgaaattatcctttttagtgcaatgaggaaattgaagtgcatagtgaaatgttttgaaatgttgttaataatgatattatctactaccgacatgctgtaatatccatttaaaagaaataaagttaattttgtatttttctgctctaacaatgaggaaaaatggtaaatatttgggaacgtaatcgaatgtggaggttgtcataaagtgagttatttttttccaaaggactgtaatgggaaaaatacataagtgcatacatatggaaatgacttgatttggtagttgagatttatatgtgacttttaaaaatgatttccagttgctattcctaatccattattttgttgtcttgagctgcagattgttgtctaggtcactaaatggcacactaaacacatttgctcaccatgcccctgtttcttcagatcttttcctatagaacacacacacacacacacacacacacacacacacacacacacccctccccttcacagtttttatattttcagagaaatctatgcatgatcttctgtcatgcaatcctatcaaacatccaattcttttaaacagctaattttttatttcttacttttgttcccaagatgtaaggcacttgtaagattgttctcctttcctgaatattagcaacaacagccccaccagccgttgcagattctgccatcaagttaacacatggggtgtgtagatttacaagtaggaatgaaattatattagagataatagctcttacattgctcaagaatagatcaccccatgaccacctggtcctatatcagttcatttctcttataattcaggaattagttaatgtttttggattgcacgggatgtgaaacatgcctagaagctttgccttatatgggaatctcttaaaatttatgaattcttatatcaaggaaatttttaaaaatgcttaatattacaaaacacaattctgttctttatattatcatatttgcttaaaacctttaggatccaaagaagtgtttttcattttgacatcctactttggttttaattgtcatgagcactagaatgatatgtattgcttccaaactgagtagattctattcgctagcttatgctgtacttagcgagccgtcatttgtcttaactgtatgaaccttagagtgtttataatttacttagaagcagcagatatcagcgccctaattaacaccttcaccattcctctcctggtacttgagaagttggcggcactacaaatggaacagaggctctgaaactaaacacggacctgacacaggatggacatcaattgtctttcatggccttgaggttcttccaattttattttgtgcaataattcccctggatcctgatttctatctcccagtgccatgttttcccacattgttcattgcccaaacctgatacatcatgcaccaaaattaggaagttgacacaagtctggatctcctagtatacgtaatgtggaatgaagatttgattagtaaagggaagtaaagatatgcaaaaaccacagaattattaatattttttcctgtacacttctatagtctggcaaaaaaaggtttggaaatttctaaagatagtagaaaatggactataaatgacttgtatacagaaaaaaagtgtttcaaaatattgattcatgaggttaataatagcttaatattaaagcatttatttgtgtcttttcttacatatctaaccatattgcacaaaaaacagggtcctagaattctatacagaatattacatatctatatcagacatgatcagaaatcagtatcagtacataaaatatactttatattacttaaatggaagaatttaaaatgatattaccatgtaattgaacagatttgaggtgcctgaagattgaaaaagaaataattattttcagatcttgagaaattctacaaggtaatcctgttgaagtcttcatcataagtgagttttccatttgtattattagtgtttgtattttttgttgtgagaaagcgatcctgattctgcttattttaacaaagacgagaataaatatatcagaaggtcattgggtcaggcaaagagttgtttgtttttcaacataggccacaaggatgaacaggaaaaggacatttctagaatgtactgttacagttttatgaaagtaattcaagcaaacaaaacagcaaaaagacatagctgccatttctcagtgttctagggaccaaagaatgtacttacagtgctaggatgtctgcatctttccagctctcacaactaaaataattcaagtatttatgccattattttaaattttgttattactgcccttgcctagatcttcattttcactcaattgaaatagtatgggaaattcctaagtgggatgcaaaccttcagtctttccaacaggattgtaataatctcctggctggactgtactgagtttatcttcttatcccctatagtatctagcacagagaaggaaagtgtgtgggaaatgcaaccacgccccttttcttcctttatgacagatggttttaatagattctagcattcttttcctcacaagtctcagcataacatgctgatttatcagagttggcacatgtcataaaatctacttaccatttctgaactgataatacttagtaggcctaaataaatgtttatcgaactaaagtattgcacatacccagaaatggaactgggaggataagtgaaaagaaattcttaaagaattatttcatagtttttctatttctattcctaaagctccccttttgtttccattgccttcagcggcaatggaagacttacaagagacaagtgctaggtctcatcaacttgagagtctgttcattattagtctcttctttgctcccagctgacttatatttaaatatatggcttccatccaatgattcccagcagggccattaaataaagtatgtattatggacaaaaaatggcaaaaatgtacttggctcagggacacacctttctccagtgacttggattcctttactcattaaggaaaaaaaaaaaatggttctatcgactcgtcattgttgttttatatcagcatgtcttaaccataggaggaaaaaggcagttacagttttaataatgaatcttaaattactggcacttcactcataaatgaagaaaggacagtataatattttattctcagaaacttttctcatctcccctttcctgggtcgtgaggtcaactaattttgattttatctgctctaaactcatcctaatcctataacttagtcacgttggttttaatatttgaagattgttttgtttcttgagattttcctacttctctctaaaattgcatctggggcatggagaaatggctttcatgacattgtgtagttgagaggaaatggatcccctcacctcctgctggttcttgggggattggtgacaggatttatctatgggatggtctttagcatatgctaattgaagttgacacttggtaaaattcatagtctaaattatctcagcttggttaaggcctcagaaagatccctagcttgttcatccactctaaactctaaactctgagagtgtctgctttgcctttcatctttctcctggtacaggctatccctttatttcaaggttgctagaccttcttttagaccttctttacagtggggtcagtggctaatctgcaaaacccgaggaaggcctgggagggcaaactagaccatctctctggctaatcatgccagtctgcttcataagctctgcgttttcacacaagactgtgctttcacagtcaccctgcacagcagccttgtgctagtgttcaaaatggcaacagaaacgtcctatttcctacaatttatggaacatatttcctcctctccactaaagcatgagggagggaagtggagatatgtatctccctcacctatatctgcctccagtccttttcctgtgagccttgaggaaaaagaaataaatcatattcttaagttttcaaaaatcttaatcatattacattatcagtagataatagaaattatagaaattttattaaactttttctttgtggtatctataaccttaatctcttcactctcactaaatcttcaatctgttatgtttgatgtattgcaatagtttttaacttgcttcttgcctccttttctctttccactccaggctattttgcatcctgttgccagactattcttcagctctctcgctttgattacaccgtttttcattaagacatttagaattttgtctcatcatttatctattattctttttcaatcatatgcctgctgagtcctaagactcttttcttcttattataatttctttactacattacccctaaatttgttccttcctcgtttctttatcatattaccttgtaatgataagacatccatatactgtctgattcttcaaagcctagctttagaccctcttgggtgaacctgactcactccataactagagtatttagtctgtagaacatatcttgatatgacattatgagtttgagtaggtattctctcttttcttcatatttatctttcccactaactcttttatttttttaaaaataatcttcccaacaacccttcagtgtgggtgttgatatctgcaaattacagacaagaaaactgaggttcagaaaagtgaagtcacctgcctaaagccacaaaactagttgatttttggagctgtgattcagatccaaatctggtttcagttttaagttcctcactggattaggctgcctcttcttaacagaaggggttttacagtatattttgagggatacttcacaaataaggtgatgtttgagggggcaatttattgattactaaatgctgaacacagtatatcatgttatcctttcaacaactctgagagttaggtgctaccaacagtctcgatttttcagttatggaaggtgagtgatagagggaatgcaggggctaaataatgaattgaacacaaggccctaatcatcatactgctctacttcccacttattgaactcaattctacacatcagacccttctcaatctagtttctgggctctggaggttgtggcgatggatggcctagcatttcctaggatctaagccctgggcatagcctgcttccaacattgggagcatagagatgagtcaggaaagcctgaccatggcctaactcatttttaagcatcttaaacaaagaatagtgtttagtatttgtccacggttattataatgtctaataggtggtacagagcactaaatatttacttcattatacaaaatctaataggacttaaaaaataaaagcacgtactgcaaaacacaggtttgaacaataagaatattgcttttttgctgttctttagacttcttttccatgttttcattaataagcatgtattattcttataatttacatctgtgttagttcaacaatactgtaatttaattacattgtgatccaaacaattagactgtgacattttatttaccaaacattactaagtctgcagttaatcataaagcagtatttctggtgttcatctccaaacattttatctacattattaacttagaatatttgcaacatgctgcttctcaactgtgactatgattattcacttatatttgtatttcatcattaaaaagaagccctcattttctcattattaggtcttaaactgaatcaacctgacatgaatataaaaaaattagagtagtttaaaacagttggttcatcagagatttgaactgaggtaaacaaaattaggtagattctgtaaataatcaaggcattttattttaattaatggccttgttacagttctgtttcaaaaactgaaggatttggatattacacccccttaggttttatatacatataatgacaacgttggtttggatgacgtctttgttctttctagctgttacattacattctgtagttatctgaactgcttgccagactgtttagggaaatgcatgtatcacagttaggggggattcacaaatggtaggtttctctgcaaaattgagacatatttagagtagaaaacactttgcctcttggaaatagaagtatagggtaatctctttttgtttgtaggccagaagtttctgtggactataaatagaaacagctcacagctaggatggagaaagctagagaaatgtacctatttgattgaaagggatagctaatgtactcaaaaattgctcttgagaaagagcaatgacacattcattctgaaggactacttaattgcccactcttggaacaagttggtcttcagctctaaactaaactgaagattttgaaaatgatagaaaaatagtgcagcaaatgttaaatttatgaaataggcttgcaattttctcatcaaacttagaccaaccttaacgatattgtaagagtaatatattctcaaggataaaatgttctctagttcaacttctacatagaaaatgagtttaaatgagccagtcgtcttaatatttggatacaatggtcattttgaaatatgtgaaatgtgttccactattattagaaaggaaaaaaaataaatatgcttatctttgatttgggcaatacccaggactgattcatagaaaaaaatctaatatatttatacataggagtgctttctctctacttgtacctacaataaaaaggtcgtcgtttgctttttaaaaattattttcactggagtatacttgaaactgtacatctcaaatgttttaacaaatatacctaaatattaaaattactaagtaattttgtccattgaaaaatgtggctactgcatatataataagacatagtttcttctcaaaagtgcctaataagactaaagagagtgaatcaatggaattatttatttgttaaaatcatgttaaatgtcttaaaggtgttattctttctttcctaattttcaaaagaaaatactttgtcttctttcatactcattgtttctaactctttctaacttttagtaattgtcaataacacttatattacttaaaatcttttccttaatttatcttcttctacccttctatccaactcttctttattaaaaacatgtcttcaggataccacaggagaaaaggtcagaaaaagaaaagggagttttagtgtatacctacctccaaacagtcattattactgtcaaggcataaagccatatgttgcatatgacaaattctgtatttctactggggtgcattgtactgtattttcataacatatgccaggcaacttctatgtatttcaggtcactaagtatacttttcaacaagacaaggaaactttctccctcccatcccttctgaaatctttatttggagatctagctctaagttttatgttttcctggtggtctttcgattcattccattccattccattccattcattcattcattcattcaaaaacattattattcacataccataggtcataaacctcattacttatgggaaatacgaaaatacttaccattctgtcttctctcttctttgaggcttgttctcatgaaataagacagatctatctatctgtctgtctgtctgtctgtctgtctatctatctatctatctatctatctatctaaacaatgaagtgatagattaagtatatgaaaggaaaatgaaaagcaaagaaaaaaggaaaaaggcctctgctagttgcgttgtggatttggaaaaacttcatggatgagatgatcctaaaagattactctgggtattccatgcagctaaaggtcgagggccaaggtggctgtaatagtccaagtaatgtggaaagaatttgggtgtgaaaagacttgccaggaagttttgactccagaaagattctaaaataaattggtaattataaagatgataatgtatggcctcgaaggccatgttcaggaatttggactgtgtacagacagattgtggaaagctattgcacgattttgggcagttacacaataaggttattctattggggagtacacagatttggctgggtgaaaaaggctagcagagaaaaaggccattttgaaagctgttggaaatagtcctgtgagaaataataagaaaacctatcaaataggccaggcacggtggctcacgcttgtaatcccagcactttgggaggccaaggtgagcagatcatgaggtcaggagttcaagaccagcctggtcagcatggtgaaaccccatctctactaaaaatacaaaaattacctgggcatggtggtgtgcacctgtaatcccagctactcaggaggctgaggtcggagaatcgcttaaacccaggaggcagaggttgcagtgagccgagattgtgccactgcactccagcctgggcaacagaaaaagactctgtctcaaaaagaaaaaaaaaaaaaagaaaaagaaaaccgaaaacctaccaaataagtggagataaaataaagaataagaagcataccagactatagtgagagcatatgaaagccaatttgatggttgaaggagaaaacattcagtattagaacaatcacaagacacggcaaatctaggggggaatactgtttagttagaggcatgttgcctttgaagtgcctgagttgagaaacattggacatttagaaagtgagggtggtggtcataaatctgggagtcccagagaggtagactgatccatgggattgtctaagttgggagtgggaagagagcatcttgataaagaagaaaagccacgctacaagactagagaaaatcaacataaagaacaacaggcggcccagcacggtggctcgtgcctgtaatcccagcactttgggaggccgaggcaggcggatcacctgaggtcgggaccagcctagctaacatggtgaaactccgtgtctactaaaaatacaaaaaaattagcccagtgtggtagcgcacgcctgtaatcccagctactcgggaagctgaggcaagagaatcacttgaacctgggaggtggaggttgcattgaggcaagatcgtgccattgcactcctttgcactccagcctgggcaacaagaacaaaattccatctcaaacaaaacaaaacaaaaaaaacaaaaacaaaaacaaaaaacaaaaagcaaagagagaggtttgtcaatcacagtttaaaaaattaaggcaactgggataagcaactaatatttcagccatttgagaatgactctatctcttcgtacacttgcaaatagaattgtaatcacatgagatttcaaccagataaatttggttacccagaaaaaaatgaggtcatgacatagatttgaaggccaacaaaaattacataatcagtgctccgtaaattagctattacgtaggtggatgcacattttgtttcatgtccatgaagattcgaagcgttaagttattttactcatgataacaatctacttcctatcgaaatttcatggagagataatagatcagtatttattctatactgagtatagaccatgaagattaaaaatagctcatgaataagggaaagggaaactctatatgtgggattttatgtaattatggtaacaattccttggagatattgtggtctgttatgtaaatatgtgtaattatgataatttcaaaaaccatgttatttactcagtagtttaacagctccttcacaaagcagtcactttcagaactcaggaggggtatagcaatactttccataaaaatgaggtaaacttaacatctcatgtgaatttaaaatatatttttataagaaagacatcagaatttaagggtatatttaccccatttttactttcacacaataaagtactgctgtagcacagatcattattacccaagttcagggatgacatacacaaagattattattgataaataatcagaatgaattggtagtatttgcatagatttttctggaccatagttgtttttacctgttgtttgagggcctattatggggggcatatttaatatatgagtgctataactagaaattcaaactgtcagagggaaggaaaccatccatctacccattcattaaatgaatatttattcaaggccaagatgtgctaaatgtgggactgaattttgggaccaaaatcttaaatgatgcatatgtcctactattacatgctgtctaacaggcagaggtaatcaggtaaataagtcagtgaaataacatcattggagtcttcacatttcacttttccgggggacaccattcccattgttgtgaaatgcaaagaccctgagtgttctaggtgttataatagaaagaaaagtagggtacaaaaggggaacaattttatatggtagagctaaggtcacttaggatgatccaagttttaatgtctccactagacagccagagtaataggtgaatgtgtgtgtgattaagaaaaatcatccattgccactcattgatatgtaagggacaagcagaggaggggaagcactatcagaggagaatgagaaggaatagttaaggcagaaaagaaaaaaagtgaaaagtacatttttttctgaatgtaagattccagaaggcagtcggtaaaagttccaagagatccacggaagtcaagtaaaatgagagggaagagtccattggatttgaaaattaagtcatgagcaacttcacttagagcatgttcagtaaagacatacaaataaataaaagtgactttgatgataacttttggttggcaacaccaacaaaccaattttgaataattcctccaagaaccgtcatagtgaaggaaaacggagtggtgttcctattctaggaaaggtttttgtttgttctattttggttttgttcttggattttttttagttttagtttcctgtggtattaaaacatgtttatataaagtaaagggggctgggcacagtgtctcacccctgtaatcccagcacttttaggaggcggagacagaaggattacttgagcccgggagttcaagacaagcctgggcgacaaagtgagaccccatctctacaaaaaattagttgaccgtggtggtgcatgcctgtgatcccaagtacatgcgaggctgaggtgggaggatcacttgagcccggaagattgaggttgcagtgagccgtatttgtgccactgcactccagcatgagtgacagaacaagaccccgtctcaaataaataaataaataaacaaaaataaaaacaaaaaaataaaaaagggaagaatggttatatatggtaaaccaggactcctcaagaaagggagaaattagattcagaccaaagaaggagtaagtggctttaatctatgaacaagataaagggttcatccttatctgaagcaggaaagaggaagggaaagagagaaggatggattctaatataaatacatgcagaaagttcttaaccatatttttcacttagaatcacaaaaaaaagacatataaaacaaagtcactaaagaacataataatgtgcttatattacactgaaatgatactctactttcctctaattattattcttccaagcaaatacttttttttttttttttgacacagtatctcactctgtcatccaggctggagggcagtggcgtgattttggctcgctgcaacctcccactcctgggctcaagcaatcctcccacctcagcgtttgtagtggctgggactacaggagcccattaccacatccagctattttttttaaatattttttctttctttctttctttctttctttctttctttctttctttctttctttctttctttctttctttctttctctctctctctctctctctctctctttcttttcttttcttttcttttcttttcttttcttttctttctttttttttgatggagttttgctcttgttgcccaggctggagtgcagtggtgcaatctaggctcactgcaacctctgcttcccgggttcaagcgattctcctgcctcggcctcctgagtagctgggattacaggcatgtgccaccacacctggctaatttttgcgtatttttagtagagatgggatttctccatgttggtcaggctggtcttgaactcccgacctcaggtgatccacccgcctcggccccccaaagtgctaggattataggcgtgagccaccgtgcccagacacacacccagctaatttttgtatgttttgtagagatggggttttgccatgttgccctggctggcctcaaactcctgggctcaagcgatctgcccacctcagcctcccaaagtactgggattacaggcatgagccaccacgcccagcctcaaatacttttttgacccgaatatcctgcctaattgtgtaagagttaatctatattgtccaaagtaccagtaaggtttttcttcttaggcaaggatgttagaaacatattaggtttttctgatcaatatggctcactttttaagaggaaattgttaatatttttgagtcattgactgcctttgtgctgtttcagagaatgtacaagagtgcggcaataaaaaatggcatacgtattgaaaatattattgctctggttttcagttatttagctcaggttttagaagtttcatctgcctggaaatattttcaaacatccatctatattattgccatgtgagtagtggatctagtgtgacattgcctcttctactggcaatgatatggcataactctagtttgaggagtcaaaataggaggtagcagatctattgtgaatatccaaagtgcagactgcctgttcataacaaattctcttatgaaattatacctttgtaagagcttccataatatatatcttatagagaaactcccaaatggaatttctctaacagactttgccaaactttgatttcttggttaccgggctatagttaatgtgttcataatagcatattgctaacacaaccattaacatgacccttgaaaaataaaatttgatttcacaatgtcacagccgtacatggaattttgaaactaagtcttcttataaaatcattttgagaggtagtttatttctaagtgaaggttacttgtaaataatggtataaccattagcttttgacttttaccacaatattgttggctagtcataatgttcccattcataaaggataactgtgtaatcatttgttattcagatgttgtgccaaaaatccaaaataacatttattcttatttctaaaagtatcagaacatttacaatgaagctgcagttgttttttggtttttgagtgaaatatacaaccaataaacaggataggattacagtatattctgataaaaagctaatttggggcaaatgagccatattacagttgttacctatcacttgattgaaaccaaatcattatctagctttggataaccatgcaccttaaattgaaaattctacaacccattctatggcatacttctgaaaggctctggagtttctctagatgaaatcaaacacccaaagaacatgaaattttggtcagttttcttttacgtgcacatgaaatcatgttctgtcaagtgtgaagattgcggcaggtgttatgagtcagcacacagcataagcaaagctgtatgattgtctacctaatgttctcacgatgatgtttctgcatagttatggaaataaatgtctgtctgaatttttagagcttcatcaccacttatctgaggctaaggtaaatccaaggaggatgtaacatctttttctttacatttttgactatatatatatatttcttttaaaagttagcaattaagccatttctatgtgcctaacacagtgctaaatccttgatagctgtggaaaaatagctgtcataaatcactgtccttgtatttgtggatgctggtatataattttctgtagaaaggtttctgatttgtatttactttcatggaaatcagtgacaggaaactggaaagtatgtagggggtggaaagatcatttgagaatgatgcaaatattgtttgaaaaacttgtatttatatttgtatgctctggagatgcatatatccaaatttaacctcatgaaaattccaggaactaaaaccttgaagaccagaagatgcataatctccttaacaaacaggcttgtttcacatcagcaagctatgatattaaaagggtcagcctatctcaatttgattgaccaaattagaaacctatttaggatgcaattataatgcataagagatcactgtgctctaataaatcctgaaacacatttcatggccagcaccaaggtaaggggctgcccaagttaaatatagaaacatgtactgtgaagggtcagaagtttgcttcttggcatgcttttattcagcactccatgattatgcagtagtggccagtgtggtgtggactttgaggacttgccttaccaccaactagccaagtgagcttggaaagaccccttgaactgttctgttactgcaatgatctatgagacaatagatttgaactaaatcattcctaatagtcttaatgaatagcagtttcattagtttagtaatgggataatactaaagaaaataaaaaccccaacctttgttaggtacatagagtatagtaaagtgattcagataaaggttatatacagagaacaaactaagaattttttttaagaagtaattgacaaaaattgtgtgaaggcaaagagagctaccagtataaaaaccattccaggtagtgtttgtgtcttcagagagaaagaaaagagaccagacaggtctggttaggatattgttggggaataggtagccaagcaactgcatgaaaagccaccaaagggagccttcttcaaagggatgggcgcatcactgagataatccctggcttagcctttgacaggcttgcatctcagcattcacttctgtttgagctattatgtgctgacttcagcatgggagcaatgaaattggggcatgactacacatttcattaccgactcccaagccctgggaaaataatacttttttaaaaaccctgtacctaccatctaataaggtaatagtcaagttgtcttattagattattcattaatgaaacaaatctgtgatgaaacagacttcagatgaatatagctgtaatttttttatcaatgacataaaactgacctgctaaaacagtatagcaactggtaaaatagtttattaaattcttttaaaatatgaccagttacattatatagaaataactggactgtggtccctaaaaaaagagaaatctgcttaggaaaaatgtaattaaaggcgacaaaagaattggactgtcttactcaatgtaaaacttttaaatcaatcttattattttaggagattcatacatgaggactgttgcttttgtattagcttaacaagcacccagggagtcctcctaatagttaagtttatagaattaaaagaagtagggctaatgtgggcttattttcctaatgtgcaacattatttggtattccaaaaaaagtacgtgatcatttattcttttctttgacagagtttcagtcttgtcgcccaggctggagtgcagtggtgccatcttggctcactgcaacctctgcctccccgcttcaagcgattctcctgcctcagcctcccgagtagctgggattacaggcacctgccaccatacctggctaattttttgtatttttagtagagacggggtttcgccatgttgggcaggctggtcccgaactcctgacctcaggtgatccacctgcctcggcctcccaaagtgctgggattacaggtgtgagccactgcgcccagccgcatttattcttttaataagcatatattgaaattccactcaaattaaagggatacatatgtaaataaggactctgcactgagaaggttaactttagtggtgatccaatagaattctattagaatagactaatggatttatataatgatagtacataataataaaactaacaaatatataataaagtataatattatattctagagaatttggaggaattttatctagataagccagatatattttggtcagttgtgagaaagagtgaaattaaaagtaaacagctgggaatagtgcatattaaaaagctgtagcaacagtagtggtgataatggtgatgactgtgatcatgagaaaaagaaaagaagatagaggaggaggaaaaggagaggaatgctagctaaccctgtagatcttactgtgtgctagacatttttctaagagggtttttatatatgaacgagttaatcctcacagcaatcttttgaagtatatgctattattggtcccattttacagttagggaaactcagatacagaggatttagcttgcccaagatcacatagtaagtgtataattgcttttaaaatcagagcatacccattaaatataaaggtaaatattccagagaaagtctgaaaatgttgacagtttatatcactcaaatatctaccgtagccaaatagaaatgtgtataaaatagggcataagaaggagtggtgggcacgatagcaaattggagagcatggatgataaactggagagctacagcccagctaaacatggctagtgaactacaattgttgtggcccgctagaaatgctgtctccgtgttatcagatcatccaagtttggaaaggatctgaaatctggattcataagtgaaacctccaggttattaaatatttggcatttaattaatttttaagataaaatgttagtgggcttgagaaaacacatcagtcactgtgtttgatatatcctgagagccaccagttcatcattccatcattatacagaggcatttattgacttttcccaaatgtctaataatctgaactcagaacgaaatatgtagtagctaaaagtcactttccctcaataataaatattgcttatagcttagtgggttgatttcagtgctaagatattcatttgaagaataaacacaggaacatgtgaaaatcaaagtctagcaacctattttcagtttgttgctttagcttttcagctccaacattgtgagcatccctacgtttagtctgaataacttctcatggactgtggctgtcttattttatgtctctaataccagattatgaaaatcacagaaaaaaggaaaaaatattatttccaaagagtaagttatgaagccatgttagaaacccatatgacaatatgaatttcttttatctgtcaatctcaaggtagaattcctcatatttctgataatgccaaataccatgaaatgtctcaaaaaagacttgactttatataccagttgtttgtcttgctgcctcacttcttcctttcttttctttctcccttttatctgcacccaagttatttctattctgtgttttattggttcttaatatattattatccttgatctctagtcctatcataacttcattttttgtaccaaatgttgctttgtaacatagagaacttaaatgccaatcacctattaacaagctaataaatgtcctggctagaagtgtcataaatggtgaagggtcttgacacaataccatgtgaggattacttaaatagattagggaaataaataatatgtagggaaaatataatagctatgctgaaatatttggaagattggcaatgaagaagctatagtgtttggctagtttgaaaatttattctgacttggaacgtgtggaagctatgagaggtagagtttagtttaacaagtgaaaatatctcttcataaagagattaacctaaaaagtataatggatacctcaaaaaatagtatgttatagagaaagttccagaattgtcaggcagaaatagttaacctctgaatctgtgctctgtctccagaaatctagacagaagctattaagtaatattatcatttaagatgatttttatgacatgacagaggacattatttaaaaattttttttttttttttttttttgagacggagccttgctctgtcgccaggctggagtgcagtggcacaatctcggctcactgcaacctacgcctcctgggttcaagcgattttcctgcctcagcctcccaagtagcttggaccacaggcgcatgccaccatacccagctaatttttgtatttttagtagagacggggtttcaccatgttggccaggctggtctggatctcttgacctcgtgatctgcccgcctcggcctcccaaagtgctgtgattacaggcatgagccaccgtgcctggccagccagaggacattattttatcgacagcaactacaaacattgaaagagactacaacataaactgttattattagagaccaagggtttgttgctagataagaatatgaataaataccatattctcttgtattgagcttgtttttcaataagtcactgaacaacaataattaagcaatgaagccaatacatctagagaaaaaatttaagaaaacatcacaatgtttcaataactatttccatctatacatatttcacacattataaaataatcagttatatcacatggttttatttttaagttcaaaaagtcttcataggctgagctcaatggctcacacctgtaatcctagaacttgggaggccaaggccaaggcaggtgtgcttgagcccaggagttgagaccggcctgggcaacatggcaaaaccccgtctctacaaaaaatacaaaaattaaggcatggtagcatgtgcctgtagccccagctattcaggaggctgaagtggaagggtcacttgagccccatggatgttgaggctgcagtgagccatgattgtgccacttcacactaacctgggtgacagaacgagatcctgtctcaacaacaacaacaaatgtcttcatagcactttctccctactcgagtcttccataaagctgttgaaacacatgcacattatatctgttttttagcactctatctggtaatagtttgtcaaatacgtgctggactcactattttaacccatatttaacccaaggttgtggcaattatcaaagaaaatcaagcaacattactgaacaaaaaaatattttctatgttgaattatgtagttaatgttccatcttctctttgctttcctatccaggtctagctttaggtacattacaaagtgaactgggaagaaaatgctgacatttaagtggttcttgttgcatgtttacattaagaaataataaggccgggcgtggtggctcatgcctgtaatcccagcactttgggaggccaaggagggcaaatcacctgaggtcaagagttcaagaccagcctggccaacatggtgaaaccctgtctctactaaaaatacaaaaattagccgggcatggtggtatgtgcctgtaatcccagctacttgggaggctgagccaggagaattgcttgaacccaggaggcggaggttgcagtgagccgacatgcgccattgtactccagcatgggcaagagtgacactccttctcaaaaaaaaaaaaaaaaaaaaaaagaaaagaaaaatgcactactgtagaatatcttaataattgtcttcagaataagtagattttaaataactacgaactaacacatagtgctttgcaagtgaagtggaaataaattcttaaacaattatatttaatgcaaaaaagaattataaaaaatccctataaagaaaataatgtagactgcattataatcttagtctgtggccctgaaaattttagtcactaccattagtctctacagacttaaccatgtcatgcttcagtgttcgccagttgtcaagaaaaaaatgtttcctggagaaaatgagaacagtcctacctttaagcaaattgattttgatgccttttgtcctagaaatgcacttgtactttattaatgttcttatgtggatcattttgttttgctggtgattttttcaggtaattctgcatgagggagacagcagtaaagaggggagtagtaaagagggaagatgtagaaaaaacactgctggatttagggtagacatagcttgaattactcaaaagcatattccccttcagctttattgagatatgattgatgaataaaaaagtatacatttatggtgcactacatgatgattttatatgcatatacattgcaaaatggttactaccatcaagctaattaacatactcatcaccttacatagttaacttttttttggtggagaggacatgtaagatctactctttttttgtagtctacagtttataattatacaaaacagtgttaactgtagtcatcatgctgtccatcagaattcaagaacttatttatcatataaccgaaagtttgtaccctttgatatttcactgtcttttttcagcatgtttttaatatgtttgtacctttttttttatttcatattttgtgattcctcttcaatctctttgcttttactctacaggtttggcttaggggaagtgtggagatgttggtcaaaagtgtattttgatttaagtttgaaatctttccctctattttccttatggtcgtcgttcgtttttctacatgaaagcagagaaatatgaatatatatatatatatatatatatatatatatatatatgtgcatacacagacacacatgtatatgaatgacacttttttgcattccctgttttgcccaaagctgatagtgaactgttatgttagaatatgagatgaaacatctgattcaggtcagcatgctcaaaacaaattgtagggcttcatttcctgaagtctttttcttattcatttcatcccagagaaatagaagccctctcatagcttaaatttgaagcctaggtgtcaacagaaccggtcactatgaaagtacaactgtaattaagtggtctgcaggtcatctcaacattactgcattgtataatgttctggggtgcatatctcaagctctttatttctgtttcttccctacacctatgtcagctttttcactgtgcaataataactcctatttatcagtaaaatagatgttttaaaacatgatattcttaaagctagtttgacaacttaaaaatagggaaatatgttaaacagatatgtttttaaattttccgtacgtttccttttatttgcctactccccactattgtagattatttaaaactgccctctgtccaaattgtatccttttggagaaagcattttaagtaggagaatccattaaacgcttttttctaaagctcaaactgagaggaaaacttttacatttaattaatgagaattcagctctttaaaagtttgatgacttttcaaacttatataatctgattccatctctggggaggaaaaaagacattttggttttattaaagaagaaatgaccaaaaacattgaccacacgtttgctgttaaagataaccgtacttaattcaacagaaatgggtttttcaccgagtctaaatgacctgcagcattatagaattggctgccattctctctcagtcagaaatcaggctgtggaaagccagaactcttctctacatctagtacaaagattgtgcttagggtttaaataaaatgaaaagaataaggtggaaaattagaatatgttgaaggttgaaagatttgattctgtgacttttacataactcaggaaggaaataacccaattcctctccacatttagtgaaaaagcaactcaaaaccatagaggctgagaactttctctgcatggcttttcaaacgatttatataaagatgttggagaaattcacaaagacctggataatgttggaaaatcttgtgttttgaagacaggacagagctgtatgatgcaacaatgccatctattggcttccaaggaatggcactgaccacagctagtttgtagtgtctggaaaaggaagagattatcagtttggaacatgtgaatataaacttattaatgaactagatgctatctttcgtattctttactcctgaatgtggaactatacatgatgcatataccacacacatataaacataatgcatagagatatgctcacctgcatcttcaacaatcctctccttgatgctagaagatgagcttgccttatcatcatactgatacagtagctgggttttgtcttcctgtggactagtagttgtcatacaagaggatgtgtttttaccagaactctttattcagggtgttactcatgtcttagtctcccctgctctgctaatcccaactgttactgtaatttctaagcacactcagacaaaaacgtacaggactggggcttctctcagttgagccaaatcaattctacttccagatattgcaatccagagtttgatagagaatttttggctgctttgaggaaagaataaaacatttgattgtgactgtcttagtttccttgtttgccctttaagttcattaaaagatacgtcctataagagtcagttgtgaaacctgtgcaatcatttgaaatgagagtatagatttaaaaataaatacatgcctgatatttacatgtgatttagaaaatatacagggagtacacatattatttcaaataatattaatactaagaggctcagaagtgccataacctaaaaacaataaagacatcaaaattgtttccctaaaatggaactagaagttaataaagcaatagttccaaaaactttttgtttttaaatattgagaaaatacaaaacaataaggattttgttgggcaataaattgggaggcattttcccctgattttcttaaagatggtcaaaaaaagtaaaataaaataataggttcccaaaattcttccattgtatgtagtttttaggttgatggttgcacatgtgtagtatagtttttgaacaaccattgcaaataaaaaatctgtgctaaaaataacctttttatttaataactcccttctcattttcatcaatttgatcacttgctttaattcatgggggttctaggtggcacttcaactgactgctactgattagtaatttaactaattgattgtcaaattgtaattattgctatgcagcataagtgtttacttgaggatagtaaggagtagccaagtctttcttatttaaaacacttacactaataagactctagtcaaacaaacatatttatttgaatactgtggctcatttgaaagcagaattaagttataaaacaataacccattgtattgtttctgctttctgagtaaaaacaaaatagcacactgtttcccaaacttaagtgcttctaggcccaccttgtctatgtctgccatgtctgattactaactgtggtttatacacaatatatttccttaagttgactctcattttttactgaaatatattttcaaaggaaattttatatcactttcataaatgaaaaaaactagaatatctataaatagtaaacaaccatttaaaaattgatcataatactactgttttaattaatataataaaccattattacatctaattgatttatcaaaaatgaaataacttcttcaggattaaaaaaatatatgtcatcagtcagcaataatgacatgtttggcttaatttaagttaaggaaaggttcttggttaacaggaagtttctatttttagttctaatgatgactagcagtgagaatcacaatttgcatatgtaagttttgaaaaaaataaacatcatttaactagttattgtgatagtgttggacactgaaatcaatcctggcaacatgttgtgagtgactttgactcagcaaatctttgtgtcaagaggccatttgaagcttctgctctttagaatgggctacgttatttaatagaatctatattaaccagtcattactgccatgttgcttggaaactgcaaagatgttatatcaagttacttagccatcttttcataaattttcattaaaatatgactgccaaacaagatcaatcaggtgaccttgatatattaggcttttctcatattgctataaagaaatacctgagactgggcaatttataaagaaaaatggttcaattggctcacaattccacaggctgtacaggaagcataaggctggcatctgcttggcttctggggaagcctcaggaaacttacaatcatggtggaaggtaaaggggtagcaggcagttcacatggccagagcaggaggaggggggtgggagataccagttacttttaaatgaccagaatctcaagagagctcactcaccatcactagaacagcatcaaaggggaaatctgcctccatgatccagtcacctcccaccaggcattggagattataattcgacatgagatttggtggggacatagatccaaaccgtatcactttgttattggtagttgtttgtgggttgaaagcatgaatgatagaaagacatgttctcaggatgcaggctgggataaagtagaagaacacgttctataaaggaacacttattatgtgttaggtactatgctaaatatgttacattaattatcatctcatttaatcctcactacaaccttcctaggtaggcattatttctactcctactttgcagctagggaactgagatcagacaaggtgaagtgatttgattagtctcttaagttaaacttactgccttggtgagcaatggtaaggtattagatgctacaggtctgctgcatacccaaaatcctgaactttggctccaggcctggtctgtgggtcccaagaaaccaaagtgtaggcgagcctagccctgagggatcattcccaggtttctcctcaacccttcttgcccagcctttccctggaaacccaatagcagagagcataatcaagaatgtataaatgtgattataaggagccagagcaagaaatatttcttttttcttccttactgtctacctcacctggtttaatattccctaccacctcattctcacagtctatgcacctatactttagtctgggtacccctaaaaaattatttcttgtaccatgagtgtgcatgcccccctttgggatcactgacgattaaaaccagttccaaatttacaagcctcttgggatatgtttgactcccatataaatgtagctattttatatatttttgtgtatatatgcccattttaatatatgatgaaaatgagttctctaaaaatgttaaaatatgtaatgcatttctgaaatttacaatgagtgcctttcaattcactatggcattgttataaggcggatttttagttgtatcgtagttgataacatattggttttcttttaaatttctagattttttgttttacttaaagaaacatctattggctgggcatggtggctcacgcctgtaatccctgcactttgggaggctgaggtgggtggatcaactgaggtcaggagtttgagaccagcctggccaacatgatgaaactctatctctacttaaaaaaaaaaaaaaaaaaaatcagccgggcagggcatggtggcaggtacctgtaatcatagctactcgggaggctgaggcaggggaatggcttgaacccaggaggcggaggttgcagtgagctgagattgcaccactgcactccagccttggtgacaagagtgaaactccatctcaaaaaaaaaaaaaaaaaaaaaaaaaaaaaagaaacatctatttaatagaaaacacacctaaaaactaaaaaaaaaaaaaaaaagaaaacaactactgatctcactgcctggtattaactacttttaagatttttgtgtatatctttctccatttacattgatttttaatttcagttaagtgagaattccatctcttttttatagctttcactttaggagtaatttactttagttgagaatttcacattcatgtatcttaaagtcctttctctttttggattatattattattttatttttagtatagacaaagtattcttgcttccccaacaagatatggaaattcatatattttgacaaaatatgatgctattttccatgtaaaggacagatatgttttctttgatttctttttctcatagacttgtttatcatttctcttgctctaaattttagaaaggtgttgtttttgccttcctgttaggcttcacctgaacagttatagtgatggtgtggaaggcaattcttactatattagtcatttgatggtagtctgcaacttcaggggctctgtcttaatagttttacattgctataattcagtggctttgaggtctagcttaatacccaaattactaatatatttaggattgttgaaactgcaaatgttcaagctttacctcaaacagtccacaagatattccctaggcttcagggtttgagaatcctctaaatgaacaaagcccattaatccatgctgtatcatagtgactgacacatggtaaactcaataaatttatctattttaagttaatagaattctggcaagattatctgttcattgcatgtataacatggtgaccttaatcttttgggtagaaataaatcagctatcacttatgattttctcaaggaataatggtaccttttcaaaaggataggttttatatactatgagatgtcctgatataatttgaattcatggcaatactgcatttgcctttttttttttttttaccatctttcaagagggctgcctagagataagaatttaagggccatgtgttgtatttttgctagtaccttgaaagaagtttttgctttgtttttaatggcaatacaaataaaatccaaaaatcctggacacatatgataagttcagttgtttatttgaaaagtaaatgcctcacatgccttgctcataccactttaaaatgggattgattgataaacacaaactctaactctcttacattaaagagtatcaacactctgaatttttaattatctttgataatccccatgaacatttttaggactcacacgtaaaatagtcaagtctatttcaagttatgtcagacaatgctttttaatatactgttcagtgcagcaccctaccaaaaactagtcctgtggttgctttatctaattgtgccttggtaagggatttgttaagagtggggaaaaaatacccccagaaatgctttaattaaacagcttcaaatacagccattgttcttacaacagaattgtgtaagtcttctccctgaagagaaatattgctgtagccaatatagctatacaattagtctatgtatattaatgtaaatataatttcattataaaaatgcttactcgtacagaatctaatttttatctgattattttttcaaacactggccagtcccatgagtgaaaatacctataatgtaaggtcagttgccaattataaaaaacattgtttagatggaaacccagggtattcacccaatgtggttattacttgtgcttacataatgaaatttgatcagcttgttttaaaataatctatttaggtcctagtattcacaatatctcttcccagaaataaagacttccttgaagaaagtaaatgatttgaactggaaaaacatgtaagaaatttaaaaaaattaaatatatatttattttaatatatgtatgaagaaagtttttcaagatgttatgatgaaattgattttctttgaggtccaaaatggcctttacatgaggtataggactaagattttagtaaaaagcacgtaccttggtcatcacagaattgttgggaatcattcagagaccatgtagaaatgtttcccagggtgagaaagactgaaccctagactaatattggctctgccaaaaataaaataaaataattttttaaaaattaaagaacttatggagggcacaccctttcattctgtgatttccacgtcaagaggtctcagtggagcatacatctgaaacaaatcatttaagctataaatttagtcactaagatcatctttagatccaacattgatatgttaatttatgaaatcaaaaagtaatatactttatagcttcctcctaaatcttagaaggtactggaacacccatactttgaccattcttttacgttcactaaatttcctaagagtgtcatggaaacagaagaggaatagaaaatctatcaggtaaccctgccctacctggcaaatttttgtgttgtagttgcttttgtttaacatttcttttatcagttaattatacgctgatagagattttagatggactcttggaactccaagaaaaaagaggttctgattcagatgctcttggaaatatagacacatttgagtgtcttaaaagcatacacgagacaaggtctattttccaaaggtgcagagcaagtactgaagcttctccacttgaaaacaacagtataaaaactaccattaaggccatttgttcatttgcccaaagtatccaaggagttgtttaagctttcagccccttatgcatttccatcaaatatgaatatgtgttgctccttctagtagttaagaccagtgacacccatttcttccttgatggtctatattttattgggtatttaattacagagcaatcaactacactgaaaaaaaaataacttgattcagttaagttcttaccccacaatgctcacaggctttactgattatacaccacctcttatgtgcaattgtctttggactaatcagatgtgatgggcttaatgttgtttttaaaccctaacaaatctggtcataggcaaagcaaacctgctaaagatgaagggactagatttaaatgaccttgctgacttccagacccttcttttgatcgtgggcagaatggatatgctcttgttgtggaatataactatgtatggatttataaaagtttgtcaaatgaaagttgaaagttctatattcactttacccaatttactagaaagggaaccaattttctcgttaattacaggctgttagaaaggcgtaatgaaatttcacaactgtccaactggtgcttgatgagaagattactatctatggatgagggttatgtctacagttctttaatctttcctttctttctttttttcctctatagtgtctcctctgtttctcccaaacatctgctctattccttttgatgtcctgttagtcatccccattccatgccactaccactgctctccttttacacttcctttcttctgtcttgtgtcttctacttactcattgcatcccctgaattgttgttgttgttgttattgctgtagtttaaacacatattgacctccatggttaccctgttcaccttttgtgtcaattcatcattttacaattattataatgtatcattttatttatttggaaataatatttatttggaaaaatgtatttatttggaaataaatgtttcatttccaagtttcatattagagcttggatactcaacttgtggtccttggaccagcagctgcaacatcacctagggacttgttagaaatgcaaaacctcagcctctaccctaggccttgagtcagaatctgaaattcaaaaagttactgaggtcactggtgtgcacctgagagtttgagaagcactgtgttggaatacattctcattaacagaagaatttacaaaatagtgttagttatttggtatttaatgaggaaaatggtaaaagatgtttagtcctttttttctcattacattggaagcatatgaggatgcagacatccttcttaactatttaataatgttttaaaaactttaatgtatggccgggtgcagaggctcacgcctgtaatcccagcactttgggaggctgaggctggtggatcatctgaggtcaggagtttgacaccagcctggccaacatggtgaaaccctgtctctactaaaaatgcaaaaaattagctgggcatggtggtgggcgcctgtaatcccagctactcgggaggctgagacaggagaatcgtttgaacccgggaggcagaggttgcagtgacccaagatcacgccattgcaccctagcctgggtgacaagagtgaaactgcgtctcaaacaaaacaaaacaaaacaaaacaatctttaacgtatgatggtattagctgtcatttaaagaagatttttaatcagtaggtcttgcaaacgttacgatttatcacatgtatacagtcaaaagacacaggtaaaaataaacttcaattatttcctttgaagtctgaaggccataaattatattatattgatgtttggttgataaatcaattatgtttgattattaataatactattataggtagtgtttgtggaaaatttactatttgacaaacagtgtacaaaacactttataaaagttaacttatttggtccttacaataacattactaaatttcaaaattacaactttcattttcagaataggaatctgaaggcaagtttcatagcttaaatagtgggcagaactgagatttaaacccaagtctgtctcatgctacaactgcagtttgtaaatcccatgtgttattacctccgttagtcgataatgtacagtttagttcatcagctatgctagtgatagaaaacaatgataccataacagcagcaaattataggcatttgtaaacttttcagaatgaaagttggtagttcttttaataatctcactggaataaataatctcccttcattttagtctttttatgttagacacgttttctccataatttctaagaccttcaaaacattgcaattatatattattaattattaatagcttttatttggtaactttgtaattatatttatatgagtttctctcctcagtattatgtattaggccgggcgtggtggctcatgcctgtaatcctagcacttagggaggccgaggcgggcagatcatgaggtcaggagatcaagaccatcctggccaacatggtgaaaccccgtctctattaaaaatacaaaaattagctgggtgtggtggcatgcgcttgtaatgccagctacttgggaggctgaggcaggagaatcacttgaacccgggaggtggaggttgcagtgagccaagatcgtgccactgccctccagcctggctacagagtgagactccatctccaaaaaataaataaataaaaactttagacaaatttaatattccaggattaattgagcaaataatgatttacaaatcagacagccctcagaaccaacagaggttcagaaatctccacttcacaatgtggacaggcagcctttatggacagaaaacagaagagctgtaaagagaccacttgatgagttacagtctggagcttgcctcccttgaacatggtatgatcagttggctacctgtgattgactgaagttcacctactagctactttgattggctgagactcagctagttgttatgaaagtctactcctgtggtagactttcagttagtttacatactaagttatattgtagtttgttacataaggactcaagtacagaggcatgcttaagtcaaatttagtttaacatgtggtagttagacccttagtttcagagtccaactcttcgggttctgatctgggctttagcatttattagatgggtgaccttagacatattagccttctctacttcaaatatctattagccttctgtacttcaaatatctcattgttaaaatgaggatataaaaaaggcacttatctcacagttttgttgtcaggtttaagttagataacttatgtaaattgcttaacacattgccttacaaaaattaaacactcaataaatagtaactattactattatattttgaaatattgacaatagagattttatcacatgcatccttttatatgtgaatgttggtatacaatgggtagttttgggaatgtgtataactgtaagcatgggcaacctatcagtaacttaaactgataatggcttattttatcatataaaaagaaatccaaactggggtttttgaaggaataaataaaattaacaaacctttagccagactaactaagaaaaagaggggaaacccaaataaataaaataagagatgaaagaggagacattacaaccgataccgcagaaattcaaatgaccattagaggctactatgagcaactatatgccaattacttggaaaatctggaagaaatagacaaattcctagacacatacaacttaccaagattaagtcatgaagaaattcaaaacctgaacagaccaataacaagtaatgagatcgaagctgtaataacaatcttccagcaaagtgcagcttcggactcagtggcttcactgctgaattttaccaaacatttaaagaagaactaatactaatcctagtcaaactcttccccaaaatagaggatgaggaaatacttccaaactcactctacgaggccagtattaccctgacaccgaaaccagacaaagacacatcaaaaaaagaaaactataggccaatatcccagataaacattggtgcaaaaatcctcatcaaaatatgagcagacataattcagcaacacattaaaaagatcattcatcagctgggcgcggtggctcatgcctgtaatcccagcactttgggaggccgagacgggaggatcacttgaggtcaggagttccagaccagcctggccaacacggtgaaactccgtctctgctaaaaatacgaaaaatgagctgggtatggtggcggacacctgtaatcccagctactcaggaggctgaggcaggagaattgcttgaacccgggaggcggaggttgcagtgagctgagatcgtgccattgcactccagcctgggcaacaagaacgaaactctctcgaaaaaataaataattaaaaaatatcatttatcatgaccaagtggaatttatcccagggatgtgaggatggttcaacataggcaaatcaatcagtgtggtaaatcatatcaaccgaatgaaggaaaaaaacataggatcatttcaattgatgcttaaaaagcatttgataaaattcaacatcccttcatgattaaaaaaaaacacccttaaaaaaaactgggtatagatggaacgtacttcaacacaatgaaagccatggatgacaaacccacagctagtatcatagtgaatagaaaaaattgaaagcctttcctctaagatctggaacatgacaaagatgcccactttcaccactgctattcagtgtagtactggaagtcctagctagaggagtcagacaagagaaagaaataaaaagtatccaatttggaaagagagaagttaaactggccaggcacggtggctcacgcctataatcccaccactttgggaggctgaggcgggcggatcacctgaggtcaggagtttgagaccagcctgaccaacatggagaaaccctgtctctactaaaaatacagaattagctgggcatggtggctcatgcctgtgatcccagctactcaggaggcggaggcaggagaatcgcttgaacccaggaggcagaggttgcagtgagccaagatcatgcctttgcactccagcctgggcaacaaaagcaaaactccatctcaaaaaaaaaaaaaaagtaaaattatccttgtttgtagatgatatgatcttatatttggaaaacactaacgactccacaaaaaatattagaactgataaacaaattcagtaaagttgcaggttacaaaatcaacatacaaaaatcggtagcatttctatatgccaacaatgaataatctgaaaaaagaaatcaagaaagtaatcccatttacaatagctacaaataaaataaaatacctaggaattaaccaaagaagaaaaaggtctctacaataaaaactataaaacgttgaataaagacattgatgaagacacaaaaaatggaaagatattccatgttcatggattggaagaatcaatattgttaaaatatccacactatccaaagcaatctacagattcaatgcaattcctatcaaaataccaacaacattcttcacagaaatagaaaaagcaatccaagaatttatatggaaccaaaaaatacccagaatagccaaagctatcctgagtgaaaagaataaacctggaagaagcacattaccgagcccacgttatgctacaggccactgtaatcaaaacagcatggtactggcctagaaatagaaacatagaccaatgaaagagcatagagaacccagaaacaaatctatacatctacagtgaacttatcttccacaaaggtgccaagaacatacattgagtaaaaaaccatctcttcaataagtggtggtgggcaaactggatatccatatgcagaagaatgaatctagacctctatctcgaccatttacaaaagcaaaatcaaaatggattaaagacttaagtctaagacctgaaactatgaaactaccagaagaaaacactggggaaactctctaggacattggactgggcaaagatttttagagtaataccccacaagcacaggcaaccaaagcaaaaatagacaagtgggatcacatcaagttaaaaagcttctgcacaacaaaggatacattcagaaaagagaagacacagccccaagaatgaaagaaaatattagccaactatccatgtgacaaggcgttaataaccacaatatacaaggagctccaacaattctatgggaaaaaattaataatcaaattttaaaatgggcaaaagatctgaacagacacttctcaaaagaagacaagtaaatggtaaataggtctatgaaaaggtactcaacatcactgatcatcagagaaatgcaaatcaaaactacaatgagatatcatcccaccccagttaaaatgggttttatccaaaagacaggcaataacaaatgctggttaggatgtggggaaaagggaacccttgtacactgttggtgggaatgtaaattagtacaaccactatggagaatagttttgtggttcctcgaaaaactaaaaatagaactaccatatgatcttgccagccccctgcaaggtatatacccaaaagaaaggaaatcagtgtattgaagtgatatctgcactctcgtgtttgattactgcactactcacaatggcaaagatttggaagcaacctgtgttcatcaacagatgactgaataaagaaaatgtggtacatatacacaatggagtactattcagccataaaaagaatgagaccctatcttttgcaacaacatagatgtaactggaggtaattatgttaagtgaaatgagccaggcacagaaatagaaacattgcatgttctcacttatttgtgggagctaaaaattaaaacaattgaactcagggagatagagagtagaatgatggttaccagatatgagaaagggtaaattgggagggggagtgggagtggttaatgggtacaaaatttagttaaatcaaatgaataagatctagtatttgatagcacaacaggctgactacactaagcaataatttattgtacatttaaaaataactaaaagaatataattggattgcttctaacacaaaggataaatgcttgaggtgatagatatctcatttactatgatgtgattgtcaggtattacatgcctgtatcaatacatctcatgtaccccataaaaatatacacctactatgtacccacaaaaaaaaatttaagaaaaaatctaaaggcaggcatatgagaactgatgtgccactaagcattaaggtttctttcatttttctgccccgctatcttttaatttgtaagtttcatcctcatgttcacagaatggctgcagtaagctggatattacattcatatttcaggaagatatgggggagaagagcaaaaggggaaatacaaaaacctgggaatgatggggaatgctatctgagtctgtccatgctaaaaaatccttcctggttttcctatgaaaagatttctgcttccatcatcttggcaaaaacctggctaggtagctacccctggctgcgggaaagtctaggatggtaagtattttagttttctattctctatataaaggaagacattggaattgaatggctttggggtaattgattcataatatctactatagtactcattaatcagtcagcagccagtcaatgaaccaaagaaaaaagtcaatatgaaaccctttaaatgaagcatatcaaacctttttaaacaaaatgaaattcatgtatatttaaatatgatgatccctcttacccagtattttgccactaaagtgttagaagtaaggaatgaaactttacacagataatttattttggcagcattgctatggtgctaggaaaaaaattgtccctagaacagaccctgaaaacaactgctcatagcaaatactcataggtgtttctgctgctacagataatcacagaagttgccagaaattaaaatgtgcaaaggataaatacaaatctttctcctttgcaatgttggagagatcttgcttcttttttaacctccataattttgttgccctgttttgcagcatctttgcaatgtttctgggacagctcagtcatcaccatctcaatctcattcaccacagaacaagtgcttgtcaattgtaaatgtgtaatctcaggaaattcttgcctgctctcttcatctctggccatttgtcctccaacccatccattcatagtgctgttataagcttcccaccccagggttagtaatcttccagggctctgtttcatccagaaagccatcaatgggctgtacctgctgcagggggatctttcactttccacacccttacagcctcacatttatgaaagtcttctccaaaaaatcttccttattctattttgaaggaaataccttctacctagaatatgtttcattaatcctcaaggcaagatataattcttccatcaacttgacttgaactaaactgacaccatgctaattttttctttccattctttcctcattgtcaatatgtttttactgattccttgcttcattcattgattcatctggcaaatactttttgagcatagaatatgtgcgagaacttttgtgaaagataggatttatagagatcaagaaaatttagggcatgttctcaagggggtcacaagcttttgaggaggaatgattctacgtttatattgggatagcctctggtgttttggaagtcttgagctgtaaccgaccaacctttcattctccctttccatcacccctttgccaaacacacataccttgctatgaaaaattcttaagggcaacagggattcattctttccttttcttttggctttacatcccgttctacaaggactcagtgggattctaaaaaaaaaattattttttctaaaatattctggaaaaatatttggaataaaattgagatggagtgagataaggatattttcttgacttgtgagaaaaataacacaaccaaacatcatacaatgtgattcaatgaagattcatgaaaaaaatacaatttcaaacttcagaaattaaaaataatagacctaataatatttccctttgtatgtatgtggcatgatgttgttatattacttggtagcagagtggaaatttgagcataatctaggttgagagaaaaggtcattattcttagttctgtgtttttccaatatactgtgttcttcaaaatataccaaaaattataaatcagtaataattgatactttgtacagatttttttattttatattttcttgtttctcttgcaatatcttttctttgattttttgtttgtttgtttgaaacacgtatttgccactgttcaactcttacacctacattctcttttgcttactgaggggaaatgggccccataaaataggtgtaactcagtatctcagttcatgttcaaacatgtataaagatgacctctttttctattcttgagcaaaaactaaatgctcatgatatattcttttatgtaaaatctagttattcaagttaagttctaaatgaatttttcttcatcttatttaagagtaagtactttttttcttccatagtactaggtaatcgttttcagtgatctgaaatacttacgaagaagttaggatctttgcaactgtttgaatctcaaattattatttgttctctgttggctgtaagagctcactcattggaattacaaaaccctttctctttatagctgaaagcgtttaatgtatgcaaacttacatttggcttgagaacatttttaaaaataaacttttcaaattggaatgttcttactgaattcaggcttttatgatgctgtttgatttggcatatgttcctcctgatatctgcattgaaaacactttgcatttgagagacttttcctgccttattgggacatttcaactcaatttatagttatcagtaggaaaagaaagaaaacatttccatccaaaagaggtttcagtaggatttagcagtaagtgctttaaaaagaacaacagcagcaagcttgaacctttgcccattaaaaaaaatatatcaaaaacaaagaaacattacaagattctctttccctttttaaaggatccacagaaggaaggttcttcctagtctatttgaaaatatatcagacttactcaagagactttttttgtctattttacctgatccacttacattcagaatcagtctgaatttattacacaatgttacgtttactgctaaaatgctggtcgttggttcaatacttggatccttcagagagagcacatatccatcaggatgcatttggctttacgtaatagtcaatttttggaagtttagaccatgaagatgactactctttacttaacagaagtctggggtaggtgttgctgtggttggaaaggtgcatgtatgataggtggacagctccctgtttctttataaatggcacatacctggagaactagcacataggtagctcaataaacagaatgttaccaggacccccagaaactccctttttattctgttttggttctcactctccaaaggcaatcagcgttcagagttctgacaatgtaagttatttttcctatttttgtaccttttataaatgcaattatgcatgatatactcctttgtgtcaggcttcttttcttcaacattatgcttgtgagatttactcacactgtggcttgtagttgtagatagttcattctcattactgtatagtgttacagtgtcagaaatatgcaccaatttatatgtctattctactgcttgaggagtttccagtttatggctattacaaataatgttacaatgagcattttgtttttgtttgtttgtttgtttttttgagacggagtttcactcttcttgcccgggctggaatgcaatggcatgatctcggctcactgcaacctccgcctcccaggttcaagcgattctcctgccttagcctcctgagtagctgggattacaggcatgcgccaccatgcccggctaattttgtatttttagtagagatggggtttctccatgttggtcaggctggtctcgaactccagacctcaggtgatctgcctgcctcagcctcccaaagtgctgggattacaggagtgagccaccacgcccagcctatacaatgagcatttttgtatatgagcatttagtatacgtctttgagtaaatacaaacatacaattcggcttgatatatatctaagaaaggaattactgagtcatagggcatacatatgttgagcttcaatgacgctgaagagaaaataacacaagcaaacattatgcaatgtgattcaatgaagattcatgaaaaaaatgcatttcaaacttcagaaattaaaaataatagaccagttttccagagtaagacatctttttttttcattcttagatcatattttgcgttttgtaaatgcgtttcccaatcagcagggaaaaaaatataatatgcaaactaaagcatgtatacaatgaattgcatttagtttaaaacaaaagatttgaaaaacgtaggaggagagagttatatttgtattagttcacaaaagaacatattcaaaaaaaagcaaataattgtattttgagtgtatcatagagttaaaaaggatggagtcaggctttttgaaaattgacttgttttccttctccccttttaaagaagataggttattgaggaaaaataaatttttgtcatttcagagagtacctgttcttttttttttttttttgtagaaaataaaacccacctataaaacatgaagattaagcttggggtagctcaagggaaatgactcaaaccatccaaacacttgttttttcttttttcagtttttctaatgtaaagttaaatcattaaataaaattttggtagctatatttaagtctcccttattttattttttagtaatattaaattattttaggacgcctgattttgtggtaagaaacatcaaaggtcttgatataatttttgaccgatgggctttgaatcaaccaattctagcctgtgggtagaggacagagcactgctgtctcttgcatattaacctttatggggctgctggagttgtggacattgagtatatagtgctagtttgtactcggattgatttattttcaaattttcaaaagaatatctaagttcaatgatattcttttagtttatctctcactgtcaaaaagtctcctccaatgtcattttaagtgagaaagttaaatgatattttgaaacactggcttggggaaaactgcagttcagtttgcttcaatgagaaggaaaaataatttccaatattagattacagtgaaaagaaatataaaagagagttttactggaaggtctgccttttatccttttaacgtttcatggaactagaataagaatatcccattttgtctaagatgtacctttaagcaactttttaagcctcaaggcacttatcttatacattgtgctcttcagctgtattaccagaagtcttttgtttaaaaaagcctttggtaaaattcttcaaatatgaatttaagcctgaacaacaacaacaaaaaggtacttaacattgctgcctttctttatgtaatgatcaagtcctcccatgttctcctttatatcagtaagccattttcttgaatccctttctaaaatgaggttaaagaaaaatgtgacataaatcctatatgtatgttctgatttttaaagggtctttatctttacttttactggttcgaatatagaaattatctcctcccgtttccttctcctcaattagctgccaatggtctggaatttaacgattttacctcatgtgattctatttgtttgtaatcctatattcaacattgtactgaagtctgttaaacattgataagccggtttttatgcagcaggtcctcagagagcattgcactaaaatgctgcaaagactgggattaggtttacgtattgtaaggtggtttcgagacgttttcctagtgtctgttctttcaaaggtgccaaatcaagttggccttgatttaatattgcgaaaattgtaatgctgagctgacttggagcttcacgtacttcaaaacgagtttttccgggggtgatttaacaaacagttctaattttttgagtgctgccgaatgtaacgcacatatgggacattattgtgtagtttctgtgagacgctgaactctttgccaaaaacttaagtttctttcattgctattcaagttataccttcttctgttatctcttgccaggattccaacagcctcagctgatactggtttcatttagtaaggagagtggcattggattgtatttcttctgatttttacaaaataaaaatcctcctgcatcccatagataaccactattagcatttgggattatatctttttcatatgtttcctataggtagatataaattttgaaaaaaaaggtattttgtttgaaagattcttttgtaactcactttaaaaattttttattatgtaatcatatatataaaagaatatatatgcatatatgatacaaagaataataaaatgaacacctgtgtaaacaccacctaccttacagaatagtaccaatgttttgaacccccatgtgtctctaccaaatgttcatcttttccctatcttgcaaagataactgcgcttctgaattttgtatttgtcattctcttcctttaaaaaaactgtttcactaaatacatacgtgttcctaaataatatattgttagtttgggtgtgtttttgaactcgatataaatgtgataatgcatataatcttttctgactcgtttataattccacattttctccgaggtgcctccacactgatgagtacactggtagttccattgttttgactgctatttagtattgtatgatataaacatatggtgctttttacttaagttcttgttgatggtgggtggcttgatctcaacttttgcactgacaagcaatcgtcttatgaaaattcctgtatacgtctcctggtgcacatgagcaagaatttcttcagggccagtgactagggatgagactgttgggttattagataaatgcagtcaaacttcaaggcgatgccatattattttccaaaatgattcacaaataacgctaagatgtcattgtgtcaaagtttctacactttcctcgatccttaatattgttctaaagccttcataaaatactatctcattgaatttacatttccctgatagtgatgttgcacatcattttataagaggtaactatctgtccctcctgttctgtattataattttcatcagcttttatattgttaaatattttctccctgtttgtaggttgtattttcacttttcttttttttttttttttttttttgagacggcgtctcactctgtcacccaggctggagtacagtggcgccatcttggcttactgcaacctccatctctcaggttcaagcgattctctcacctctgccccccgagtagctgggactacaggcaggcaccaccacgcccggctaatttttgtatttttagtagagatggggtttcaccatgttggccaggctggtctagaactcctcaaagtgatccgcctgcctcggcctcccaaagtgatgggattataggtgtgagccatggcacctggccatattttcactttattaatagtataatttgaagattagaagttcttaattttaaatattatcaaatttattgttaatatttgccttaacggttagtgatttgagtctcatttaaaggattatttcctaccctaagatcatacaaatattctccaatattttcttctgtaatgttaatacattttctgtttatctttataatctaccaggaattgagtctttgaatggtgtgagtgatttgatttcttttttttttttttcaataggaacagtcaggttttccatcactgcatattgaagagtctattcttcccctactgaactgcagtaactaccctggtcctgtatcacatgtattagaatagaaccagctgctataataaatattcgccaaatgtcagtgacccaatacagtgtgactggttttagtcaatgctttcctccacttgcttatttaatgacccaaggtccttctctttcatgtctgaccattcactaggacattatagtctactgcagccagctggcagatggaagaagaaagggtagagaaggcatgtcaactttggtttttttttttttttttttttcctgaggtggagtcttgctctgttccccaggctggagggcagtggcgagatctcagctcactgcaacctccgccccccaggttcaagcagttctctgggcctcagtctcctgagtagctacgattacaagcgtgtgccaccacgctgccaccatgcccagctagttttttgtatttttagtagagacggggtttcaccatgttggccaggctggtctcgaactcctgacctcgtgaacctcccacctcggcctcccaaagtgctgggattacaggcgtgagccaccgtgcccagtcagcatgtcaacttcttaaacaccttgtttagcaagtgattatatcacaaccgttcataatccattggtgaaaactagtcatttagccctatgtaaatgaaaagattgctgggaaatgttccctgatggaaagcagcttctcagaagcatctctatctacagtgtgggataatatgaatttggggtgtttagctagctgtctcaattatatcaagttttcgtatatgcactggtctttgtctggtagggctagtccctcctctttattgatcttcttcaagtgtgtctcagctattctttgtcccttttcaagtatcacaaagaaaaaagtcactgtttgaattgggaagctctgaatctacagggcagtctggaaataatatatttacataatgaggctacttacccattagcagtgtacctctctgtttacttacatggtctgaaatgtctttcagtatactttacagtcttattcaaaaggtcttatatcacttttgttggatttattcctagagattctgcttttttgctactattataacctgccttttctaaacttccctttcatgtctgccaatacatagacatgaaattgatttttgtatgtaaattttgtatcttgacatcttggtttggtttgttattaattccagtaatttgtgttcagaacttttggagggggcttgtatgcagatgatcatattatatatgaataatgataagtttttatttctcttctaatttttatcttttatttgcttgtctaactgaaaagcagtgataggcatctttgatttgttccttattttagagggaattattttgacatttcatcatcatatatagtttgctctagtttttttgtaatgcattatatcttctttaatacattgcgtgattctgtttgccaatatcttctttagaattttccatttatgttcacaagtataatattagtttatgattttctgttcttatactgttctgtgcttagttttggtatcaagattattctagcttcattttggagttgaaattttcccattttctgtttcctaagaatttcttatgagtttggaatcatctgtttttcaaaagtatagtagaactcacccataaaaccatttgaggctgctgttttctttaagaggacattttaacgctaattttgattttctaatagttaaagagcttttcagttttctcagctcttcttagatcagtgttgataaattctgtgtttcaaaaaatgtgtttgatttattttagctttcaagtttatgggcatacttccttcatggcttttaaatctcttgtgagaatatatgcacacctcttccctttattgatgtcttctttccttttgtcctgatcaatttttcaagtaatttaaaattttgtctcttcaaatattgtctctttaaatattggatattttgaagttctatattgatttctgcccatttatttttttttctgctgctttattagtatttgtttggtttttcttttgttggtttgtttgtttttttgagacggagtttcactcttgttggccaggctggagtgcagtggtgtgatctctgggctcactgcaacctctgccttctgatttcaagcaattctcctgcctcagccgcccgagtagctgggattacaggcatctgccaccacacctggctaatttttgtatttttagtagagatggggtttcaccatgttggtcaggctggtctcaaactcctgaccttgtgattcgcccgcctctacctcccaaagtgctgggattagaagcatgagccactgagtccagcctatttgtttttccaattaagtgtttattatgtgtatttatgttaactttctactataaatattacgaatttttaaaattattccttaaaggacctcaaatattttgctcatttacttctactatgtttacatttccattatgatttcttcttttacccatgaattatttggaactgtatttttaaattttcaaatgtattttcaggttatctgtgttatttctgtctaatttgattatattgtatggtatcaattttttaaaattctgagaatgttttattgcacagtgcatgacagctttctgcaactgtttcatatgtgcttaagaagaatgtgttgagtacacatttggaaacgtgatttttgcaggttcattaaatcaggcttgttgattgggttaatgggatcttccacatgcatgtgttgaaatgacccactaagctcccagatttgattagttaccttgtagttctgtctgtctagtttcccctatatatgcggaggctgttttctgaactcatttaaagtttggaataattttattcaccaggaggattgacctttttattgttatgtagtcttttgtctgatatattattatataatttatatgttagctttcttttagtttgtattttcctggcatatctttagctcgtatcctcaagttttctgttctcggtgtttatatgtctctctctcccttataaaaagtctattgctggatttaaaaaatctgtaactccacagatatcctgtctgaccacttttgcctttcatatagggcttttagttcactcatattttcatgtatatttattacaattacttttatacttgaacttatttatagcattatattttctgatgttgactttctttgtctttgctcctctttttccttctttactgccttctttttgagtggttgagttttatattcttactctaattttccttcttccattttggaatttgtgcactctttctattattttaggtgttactcttaaaattttactatgggttatttagcaaattaaagaataatcaatggtttagtttttctttccagataaattaagaacctttatgaataataacttctctctcattgtacccgttctcattatccagtgtttagttctattttgtatactttaatcttcaatattacatattatagctatagttttatataattaattttatttaaatgtattcacatgtttaccacactctttgtataccatttccaaaatgcttgggtaagaattgatactttgtccaatagcaagggggggattatggacatttttcatctgaggaaagacatgatcaaaatgatactttaggaagattaatctgatgcagtcaaaaaagaatggagggaggaggagatgataagtagaaacacaaattaaaggctatgacccgggaacttggtacaatgatttgaactagaggggtggtaaaggagaaaaggagtaagaacaggaagtaaaagtcactgtgaaagaggaatacacagaaattaacaagtggtttgcttgaagtattgaagaaaacaaaaataagaatgagatttttgaaccaaggttactgaaatattggtgaaatattagcaagtaggaagtcagagaaaagagctgctttcaggagaaagataaagaaatgcccatggcatataccaatgatacactcagcacagaggtctacatacaacagagtacttgtaaatacaatagggtacttgagagaagttaagactggggaaataggtgttatagtggtaagcatatatgggtcattagtggagaaaaatatcgaagagagtgaatgatgtcaaataaaagtgctttgtgtaatgttggacagagatatacccccaaagaaaatgttcaaattttgaaagcccaacaagagtcagcactggagatacagaagtcaagtcagggagaatctgcttttgtggaatatcatctatatgtggtactgagatagatatttcatatatattacctgatataactatcaaatgaggaggtggtatggtaccagtggaggagaatcattcaaaaagaacaaggtgttcagcagtgtcaaacgatgcagaagcactaagatgagaatgagaattaaagaagatgtaattgtgtgattaggatgtgattgaaacgtttgcagataatgagttcccagggaaagagacagaaacaaaactgtaaggacttgatatggaaatgaatcctgtgccagtgaacactgaaatgcaaacaagacttaataattcagtgacaagggattgtagcaaggctcagagaagatgcttctgatttaaaatagaatagctaagttatgtgacgaccatactgtctatacataatagacactaaatttatttgttgaatgaaaagctaagtgttcagagtttgaaaaataggaaccagagggaaggacaaataagcaattgaaagttactgaattgataagttctgtgatttaaaaattccagcaatatctgtaagaaacacaacttcgtggaattctacagataaagcacaagctttggactttttgtgatttcttttctgtacgtgtttttaaatgtacagcaagtgtaggaagataagcgttgataaaacattacttgagaaatgttaatttgctattaataacaattgacatttaccattttaaaggccaaagagaggtgaattttgataaaagataggttcttacttggaaacgtgtatgcaagtacactgaagaggtcttcttaatatagcattttataactcatctcaaatgttagcagccctgtttttcattcgtttccaaaactcatcaaccccagtcataataccagccacttaatacagatcccataagtctgtcatgtgttgtttacttaaatgtgactgtttctgatgacttttaaagtccccaaagcagttttgtccacgttaattttgctctgtatctcagcattcattgcagtacctattgaaagtgatttcactagcataagataaaaatttgatgacacatttaataggcttactctcaaacaacggattgactcaaatattatcaacaatgcaaggtgggctcttatgccaagatgtgttcggtttttcaaattttaatctaacgcctgaaatttgtgttgcataaatgtttgtcttattctgtgtataacatatttgcatatgtatatttgtgttctgtataagtacagaatagttaaaatgtgttctctctatgcttacataaatgtagcagtgagatattgataatagcaataatagctacatttattgattgttaagtgcgaagctctgataaaaatgttttataggtatcattgtacaaatcattcaaataaacttctgtggaacatacaatggttattcctattttacagaatggggtgaataaagggacacagagaagttaaaataatttactcgtggttacagagccaggaagttctagagctagatttctaacccatgcatgctcactctattgtgtacccagtaatcaactggatatactgtgattttatattaatcaaaatgcaaagatgcagaagttgtgagaaaattccctatctctagccatttattttcctgaataaaaatacatctataaatttccccttatctgatgacatcttaaggaaatggtcatgtaagccaagaatatatattatagtttactactaagttgttagaacaagctaggcaccagtttatatagtctagaacaatatactcaagtactgatgcttattatgcccaggtggtagtggcattatttgagaggttatgttttgtgtgaaatttctactttaaaaaaaatgaatttgttttgacaaaaaatataaaatgggcaagagattttgaaacaagtttacctagatttgcaacaatatatgttagaaactgtttgctttgattatacacacatatatgatatcctaacatgtatgaagcaattctttagttgatagtgacttatcttaaaaatgtataatccaagaatcatggagcattgtatttagaatttaagagtatacattttaacaaaacacataagaatataatttttatacaaaacgaccaaaactgagtctttaggatcatagtttaaaaaatgcaatatatgttctcataaatatatgtaaatatgtatcatatatagtaaatatatagttacataaaatacatatatttacatagatgtaaggatgtataaaatgtacccttaaacatgtttaaataataaaagaacacataaacattatacctacatttattttattctatattctataattctccaaaagtgggaaccattttcttacaattacttatggacccaaattcctcaaaattaaaagatcatttcattggcacacttacaagagacttagctgacaggggtagtttttaaaatcaaattaagtggactccagtttcagattcatcagttaaggagcttagaaattaccactcaattcttaacaagtaaaaagctgaacaaattgaaaatcaacaacttttctcagatctgtcagacaactgaggtcacagggcaaaaagctgcccccaaaattgcagaaacagattgatggatacaaagaatcacaattttctgagcagaaacctccaagggaactagttccagggtacaaaaacctgtaattgacgaatctttggaggctaagtgtggaccaagtctgagagttaaaaactacaggacagcccagtcataaatcatagtagggggctgatgcttttgtgagttttaccttcaggagccttaccaagtcctaatagtgagcatcagagaaaaatccctggtgcatccatcaaggaaagggggaaaatacagattttgaattatacacaagataattctgttgttagcaaagtctgcccttaggagaaactatttttccagaccctagccttatggggtttaatcagagcctaacctacctggaaggaattgaaataattcaacttcagctccttctagtattctacaggggcatagggaaataacaaattccaccccgctctggccatcctgcccacccaaagagggaaagaaaacaactcagactcacttgtgaagctaacagtctaatcacacagacttacccaagatagtttcttttgctgtgcagaagctctttagtttagttcggtcctacttgtcaatttttgtttttggtgtacttgcttttcaggactttgtcataaattcttgcccaaggcagatgtctgcaatggtgtttcttaggttttctgctagaattattatagcttagagacttacatttaagtctttaattcatctcgagttattttttatatatggtgaaagacaggggttcagtttcattcttctgcatatgactagccagttatcccagcaccattgattaaataaggagtcctttccccattgcttatttttgctgatttggtctaagatcagatggctgtagatgtgtgactttatttctgggttctgtattctgttccattggtttatatgttgggttttgtactggtaccatgctgttttggttactgtagccttgtagtatagtttgaagttaggtaatgtgattcctctgattttgttcttttcacttcagatgactttggctattgaggctattttttgggttccgtatgaattttagagtagtttttttttctaaaattgtttcaaatctctacaatgtcttccagaagctagaaccagaggaactagttcttaactcattctatgaggccaacattaccttaattacaaaattagtcaaagacattacttgacaagaaaaatgcaatccaatttctctcaagaacatagacgcaaaaatcctcaactaaatattacaaatgaatccaataatgtataaatagcatcatgcatcatggccaagtgggatttatcccagttatgcaaaactggctcaacactcaaaacttaattaatgtaatctaaaatatcaatggactgaagaagaataatcactttatcttatcaatagaggcagaaaaagcatgtgacacatcccaaaaccctttcatgataagaagtctcagcaagtagggataaaagaaaacttcctcaactcgataaagaacatctacaaaatacctacagctaaggtcatagttaatggtgagaaacaccaagctttcctgctaagatcaggaacaagacaaggatgactccactcaccactgcttttcaacatcatactggaagtcttagctaatgcaataaaacaacaaaaaaagaaaataaaaggtacagatgctccttgatttatgacaaggttacatctgcaaaaacccctgatcagtagaaaatattgttaagtcaaaagtgcatttttcaacttaccatatttttcacttattgatgtgcttatccagatgtaacactatcttaagttgaggagtgtactgaatgtgtatcccttttgcaacatgataaggctgaaaaattgcaagtcaaaccactgtaagttgtagactatctatatagacagggaaagaagaaatagaattgtctttgttttcagatagtatcattgactatgcagaaaaccctaaagaattgacaaaacagcagcagcaacaataacaaaaaaacacctggaacatttccctctgatcctagacagaaaaggttctccacctttaggtccttaaggactcatgtgattcagttgagaccactcagataatccacaataatctcctcatctcaaattcttaaccttaatcacgtctgcaaagtcccttttaccatgtaaatttgcatgttcacaggttgccaggattagaacatgaacattttcgcaaagggctttgttttgccttctatatccagtcaattacttccagttaaaaaacttatttatgttatataacacttgatatttgccaggtgttatgctaggtgatatttaatattttaaaatatctgtgaaattagtgatatcagccttagaaacatagatggaggggttggtcaccactcattatttaatgtaagtaacttatctttgtgtttttatgtaattattctctgaaatactcttattcaacaagcaagagtattcatccagcattaggaaaatattttatctttaaatttaactagaactataacgttttagaagtaggccatcactatttaaactcttaaaaagtcatagttaattaacaccctcatatgggtctttgattatcgctataataaaatctccatttatagataagagcaatgtgcatcacatgtaatgtaaacctgtattaatagattagatgaaatattattttctaactgtaagagttaattactctgaacaattccacaataaatagtcatagaaattgatttgggatatatacatctctctctctctttctctctctctctcacacacacacacacacacacacacacacacacacacactcgccccccccacccccaccccacccacacacacttctttctttgcttcttgcctggctgtaaatcggctatttttccatatcccatcatgagcctaaagggaaacatttgtatatttcaggctcctaggaaagcattttgaaaattcatttaacaaaattgggcaatatcaatgacttcaaaattagcaatggcagaaaagaagtagtaattaatagcagcggaaggattaaaatgtgttaagattaagttaaacatgtcgttgaatcactgtaagagactgctgattgcagagcctcttagtgtttgatattactctgacttgatgctgtggaattatatttctgaaataaatagttcttagttctgaggttatgctaaaggacatgttcaggaagagctttcctttcttactgcctagtcatacccttaggcaaagaagcagtaattttgaagggacaatgtaaaatagaagaataggcaatcttggatatgtgtagtttcacatttcatgtttatagatgtaaaagtattatgttaattatagaatagcacgttttatttatttatttatttatttatttatttatttattttttgagatggagtctcattctgttgctcaggctggagtgcagtggcgcaacctcagctcactgcaatctctgcctcctggtttcaagcaattctcctgcctcagcctcccaagtagctggaactacaagtgcctgcccccacacccagctaatttttgtacttttagtagagtcggggtttcaccatggtggccaggctggtctcgaactcctgacctcaagtgatccacccgcctcagcctcccaaagtgttgggattacacccggcccaatagcacattttaaagtgaatttatgttcaggtaacatgaatagaaagatttcttgaagtttcaaccagcttctgaaactttgtaaacagattaaataaaatttgatgattaaaatatattcagttaatacatatgaaaagattcaactgtaaaatatgactaaggcttcccgctaataaatggcattatgacgaaatctgtagtaaactgtgggcaatgtatatggatatgattttaaaatcatgagaaagctcattactgttggctatgtcattatagcatgatttttttccttataatatgccaatcaagagtaactatgttatgttaaaaggagaaaatgtggtgttttaaaagtgataaacctgatgtatttaaaaattttttgagatttcctctggagctgcactgcccaatatggtagccactggccccatgtggctgttgagcacttgaagtgtggctagtagactgagacatgttgttagtgtgaacacacactacgtttcaaagacttcatatcaaacagtaaaatactttattattaattttaatattgattacatgttgaaatggtaatattttagatagattgtgttaaatatgcatattattaaaattaaatttagggtttttttcacctagtttaatgtggctactagagcatcttaaaattatacatggggttcacatttgtggtctgcatcttatttgtgatggacactgttgttctaaactttcctaattactgagacatttcccttcatcactttttgggatgcagttttcatttataagttaatggtaaaactgcacaagtaacggaaatatacttaaaagatcaaaatatgaaatttagcactttcaaaattcctcatttaatgcttgagtcaatccttggaaaataattgatccagaggatatttacaaatagtccatcatcaaaaataaagaggggcatagaaggtactagagctctatgtataaaatcctgccctctggcctattctattatactcagaagagtctgtgtcactaatatatagtaattatcgtcggaaattatttgctatattaggattccctatggaaaagtgaattgattgaaaagatttagcaaagagttaactatcaactttggtttttaaataacatgtgaaagctaacttactctaatcactctgtggccataaaaaaggctctgcctccaacctccagaatctacatccaacaagaagtcttggtgaaaaggattggcaaaaagactgcaggttctggcaagggtttgtaagtggaccaacgaattggcatttgaaattgttagtcttataaaatgaatcattgagactggaaggtcaatgtaattggcaagccatgtgtcacctttttcttgggagaaaaacacatcatttccataaaaaagtatagagcatataaaagaataagaaagtaatgataaaacagaacttacagtgacattaaacagaaaggtatttatggtaatggatttggtactgaataataattaggctaataggataaattgctcacaaatggtacatttgggcaggaatagtgtattgttcactaatgtatctacaaaactgaatctaatgcccagcattttgtggaagggaaaaatgaattaacgactaatgtcatatatacataaactagctatcaacaagacaagctagggattagagaagacagggaaagaggaagtaatgctgatgcctctaaacatgaccaagatttattcttcactccttttagtgttttcaacgttaattcctgtagtgttctcttgccttctcaaaccagacttatttttaaagcagcttaggctgagtagcatatttttataaaatggtcctctgcgccatttctaagaatcataggtcaaattagtcaggctgctgttctaacactgataattatatccacctcctaccaaaatctgtagttaattggtagaaattcaagctttgtagattttagttgttaaaagcgtcacatggagaaagtacaaaggctgtcctaagtaaatgactttaagattgatttttgaagccttttctttactcaaaaaaagtaatggccagcttaacaaatgcctccagatgaattgcttgttgtgttcatcattattatattacacattcccctggaaactgcagatgataagggtgcattttattctgaatgttgtgtaaggcacactgcattttgaaagagttcagtgatgttaggataaatgtgtatgagaaatacgtttgaatagattcagtaagtctattcactagtccctttttcaccatttgctgtttggaatcaagtttgggatgttccatgcatggtcatcttactttagggtatagaacatcaggagtttaagaaactggggtttttgttttgactgccatcattttgctgtgtattacttgacaaggaatagaaggggaggcagggattagatcaagcaaagaagtacccagtaagaaagacctttcaacaatgtataaagaatttattttaaataaatttctgaaatggttaaaaaaaaaaggcagagatgagttaggtgaggtgagtcaagcaaggtggctgagggtttagattttggaaagtcacaacataaccttttacaactgaaatacatcatctgtaccatgcggataattgcatttatgtcttggtggtgttggaagaattaaagggtataatatatttaattcacttaatagagtgcctgacatatattaaattttcaaattgttgttagagtggctgcttcaaagaatagctaattttacagtatggtatcatggacacagactgtcaaaagccaacagaataatttcaaattcaactttttttccacatatggctttgtgagttgagtgcatactttagtcaaaaatatgttttcacagagtgataatttctaggggtgattaaaagtttgattataaccactcttgggtttcataatctaaaaacattttcagaaagtctgtgattaatttttcccatttaaaattttattctcaataatgtgcagtattaaatagaatttcacaaggcatcttgggagttacgctctcacatattaaactacacagaaaaagttatatgtcatagctggtcaagaactcagagcaaaatgaaaagataagcagatagtgcaatgtggttcatggtccttaaaagaccttttaatgtggttggttattttctaatgaatgcaagtaacacattgaatgcccacctatgaacagaaccgaaattaacaatttagaaatgtgaaagtgacataaacttttactttcaccatttttcacagggtcatttgttggtaaaattatctcctgtacttgcttcttgtcttactacatcagtcacctgtgaatttaaattagaggcattttgaaaatataattagtaagtcattgcttggatctattgagtagtaaatttatatttttatagtacctcagatatagtgtgaaactttgaataattcatttctcacatgaaataggcacattacaaatatccagcaagttgtaattctgggtaagagtccttcaaagaatgaagaacaacagttaagctgtacctttggtcatgcatggcaatatgtaattactatctgcaggtcctcaagatcaacttaatctctagtatgtaagtcaaatgcctgttgaactgtacagtataatacatggataaacaatccaaatgactcattttataagtaggtaccactttttataaacagagcgttttataacaacctgctgttggtggtggtggtggtggttttgttctcctcctgtttcttattctttattattgtcatcatctatacttactagatacaggaaaaatgcttttacaaaaatgacccaattcagtggtgctgaaactctagagacatcagaatcacctggatggcatgtcaaaacacgatgcatggtgcttgcctcagaatttttgattcagcagacataatgtggaaccttaggatctgcatacatagcaagtacccagatgatgctgatgctgctggtccagggaccacactttgagaatccctgctcttgtaaatgcttctttgtttcctgatctagcccttcttctatcattttaatgctaattatgcccaaaagtatagtagtactgctctttgcgtctttgcacaccaatctctgtggacaatctcatccacacgtgtggctactcacaaatataaatcaccagccctaatctccttttgagtgtcagactaatatatcaactgcctacagcacacctccacgtggaaatcccacaggatctttaaatttaatatggctggctgggtgccgtggctcacgcctgtaatcccagcactttgggagtccgaggcgggtggatcatgaggtcaggagttcaagaccagcttggttaagatggtgaaaccccatctctactgaaagtacaaaaaaataaaattagccaggcatggtggcgggcgcctgtaatcccagctactcaagaggttgaggcagagaattgctcgaacccgggaggcagaggttgcagtgagctgagattgtgccactgcactccagtctgggagacagagtgagactcgatctaaaaaaaaaaaaaaaatattaacatggccaaattggatctcttaagtcaacccccatgaagattgtttcaatcaagaattgtcgcattttcatgaggagcatatttttatggtcttaaaggatccccccacaaattacttattagttgcataggaaaaataataactatacattgaggaaattgaagaacatcttggacaaggtgatcaaaaatatcatcaccaaggaggggcaaatgagcatcatgtaatgccctaagatacattacctcattgctcttaaagcatgacccaatacattacctcattgctctttaagcatgacccaaacccatggcctaccatgcaagtctcctcctttcccagcctcacttctcctcaattcacacctcacagtcagctttacagttttaccaatacacctgagtattgaagaacgtgccatattctctcttgctttagggtctttattcctgctatttcctttgcttggctcgccttgcctcctccccaagcaccttctgtctctttgactagtgaaaacccatggtccttcaagactaaaattaatattatcttttcagagaaaacttccatgctgattcccctttcatgagtggtttaacagctctgtcctgcttggggcctcctagcacttaccacagtttattataatttcttacttgcttctctgtttcctggcttgcctctgagttctgaaaggtgggaattgtgttattcaccattgtttcctcagttcttagaatactgttaattaagatacagttccttaatgaatggatggatggatggatggatagaaaaaattgaaaatgtcatgcattttaataaacacattaagtgtttatttttatttggtagaaaactgatggaggaaatgaacaataatgtttagttttatatttggtgctgagtcctggataaagacaattgaatatgtttggtgttcatctaatttgcaattcaaaaccaccacgtgtagggaccttttctgccttactatttaaaatagtttacaaaattttgagaaaacgtagttttaattttacctagaatctttttttttttttttttttttgagatggagtttcactcttgttgcccaggctggagtgcaatggcaccatctaggctcaccgcgacctccgcctcctgggttgaagaaattctcctgcctcagcctgccaagtagctgggattacaggcatgtgccaccacgcctggctaattttgtatttttagtagagacagggtttctccatgttggtcaggctggtctcaaactcccgacctcaggtgatccccctgcctcggcctcccaaagttctgggattacaggcatgagccaccacgccagcctacatagaatcattttacatcagtgttttagatatgaatatttactaatctattatatttgatagcaaccataaatgcttaaactcacaattttttgtttttatgtgtgggaaaatttaaaaaacaaagactaaaaggatatgtataacaaaattttatctctatattgtgagattaatcttctctttgtattttttaacttttctaaattaatgtgaattaactgtatatgcagaaataatgtaaattttttttttttttttttttttttgagacggagtctcgctctgtcacccaggctggagtgcagtggcgcgatctcggctcactgcaagctccacctcctgggttcacgccattctgctgcctcagcctcccaagtagctgggactacaggcacctgccaccacgtccagctaattttttgtatttttagtagagacggggttttgctgtgttagtcaggatggtctcaatctcctgacctcatgatccgcccgcctcggcctcccaaagtgctgggattacaggcgtgagccactgcgcccggccaatagtgtaaaatttttacatagccaatgtttgctatgaatgtggttttctaaagaaccctcatattttctatatttatttgaaagggaagattttgggtttttcaatcgttttctgaccaactatcattacatttttggctgtaaagtgaattgatacacaaaagtcttggaagcaatttactacccacccctagctctggtattcttacgagggatgatacaaagacactaccttttctacaagctcttgtgtttacaagcataagagaaaaacaatatgtttaaggtattaattacccagaattcagcagtacattcctttgatttttgtatacaaatgctaacatatcacgaaggggaaagtgttcactgttttgtattggcatttaaaaactttttatgtatcatttataattgtgagagtaaatctgtagttggcttcttaaaaattcttgattacattggttctttatccacttatttatgttgatccgatgacaaagagttgttaataagtcaagacattttaacttacttattgacaagctaactaagaaaatagccaaaatagaggtattacaaatttcttattcaactcagcatgttcactgttcacttagccaaacattctccaactgaagaactccaaactagtttactcttcatatgactatattgagcattaccttactttaaattgtgccacttaatagtgaagttcggtgactatttcagcattatgatggatcctcttggactaagatacaaaatttacagttaaatttggtatttgccatcataaatggcccagattagctggtccttcccctatcactggagaggagtaatagtagctggaacccagaaacccagtgggtactagtttcctttctctatcccactttactcccctttatctcctttgcttacttcaagttttaaaaattacttacctggctaaccatgttttaaaatacattttattctgaaaatgtgaaagcattcataatacggattttttaggtcaaacttgccacattggtgatagttggggattgcggctgatttgtcagatgtatcttaccattggagtctgtgataattaagagcagtgttggactgtggtcatgtcagacactgcggagaagaaaaccgtgttttacatgcatattcagctgctgcatgatgtgttactgcatttcacattacatatagtagcccagtgccaactcactgcagtaaatctcagtgctaggctcttgccatttgtcatagtaacagaaaaacatgtgcagttttccattttattgaatgaatttgaattcatagaggacatcagattgtgctcactctctagtttatatgcctgtgtgtgtgtgtatatatatatatatatgctggcaatacaaataagctgaccatcccaggcagactaatcgaagatcttgtctaatattttggaattgtgattatttctatttctctttaccttaacttagggtacttcatctgatcaccacccctctaaagtatagaggggggtatttttggctcttgttctcattaatttaaaagttctcaatttttttgcagaggaaaggaaaacctacctgttggctgttttgacctatccatttaaccagtaatgcaccacagttagcacttctgggactaatctggccctccaaccttgaatagggtttacatggcattgccttaaggatatgtagtctttctattcctctaaatcagtggctctcaaatttgacaggtgtcagtcacctagggaacttggtaaaaatacaaaaccctgattcttactccagtgagtctggccaattctgatatgcactaaagtttgagaaccactgctctagacactaaaacaaatcaaaacaaaaagacagatgatctgaccaaggtagaaatgcagacagcattgagttgtccaattggcctgctatccccgtgccccaggctacttttactgaactctctcctgctttatggctttacttgaaggcgacgttataagaaacagccctcccagtatctgtgaactgcaaatcacagatctctcaaaatggaatgctttctgtaagtctgatgtcaaaattcatttgggggtaaatttaagaaaatatattattccttgtagtgtaaatatttatgtgtttaagtgcagaaatgttaatacgcttaactctagggtgctgccctaaagcctgctagggttttttcaaaatatttgaaatgcatactgaattagcttccaaaatccaaaaaaagtccactttaataaacatcttagtcccaaagatttcagattataattataaacaatgtgcttattaatacagtcatatgccacataatgacattttggtcaatgatggaccacatatttgactgtggtctcataagattataacagagctgaaaaatgcctattgcctaatgacatcatattttctataatgtcatagtgtaacacattaccttttctatgtttagatacacaaataattaccattgtgttacagttgcctatagtattcagtacagtcagatgcagtactggtttgtagcctagaaacaaataggctgtaccatatagcctaggtgtgtagtaggctctaccatctaggtttgtgtaagtaggctctgtgatgtttgtacaacagtgaagttgcctaaggacgcatttctcagaatgtatccctgtcattaagtgatgcacgattgtggtgtgcttctggagaaatggcttatttttatcttgtggacattgaaaatgacttggcagaccatactgtaaagctctaagccaggcttttgtcttcccttgatcaggagctctgtgacgttattctacctttatctttttttcttggtatcttcctacctttttattggtattattattatccattataatgattttgctgagtgcatttactcgttggctttttagatttttttgaatgtgtataaactaattgcttcttcatttagttggatatatagggtgataaaaatagataaatatattacttgttctggggcattgtctgggggagatttagcatagttgtcctcagttgtctctttctttcatgccataataaaataacctctattgtgaggataatttttcaaaaggacttagtgtaatgagcatacatttttggctaggtcagatttctaatagttggcagcccaggtattagcaacctcatattctacttccctgaataagaagtctctaggagtatctatctaccaaaaccactcaaatccctacaatccaaagaattccaggcttttaagttatgtttctgattctaatcattatttattcagtaaatggttgtataaaagtgacacaccctcaactgcaatttcagtttccctgggggaaacaaggaccctgaagggaaaacttgtacatagtgttgctttcttgctccagatcactggctcagagcatgaaagaagtgaaataacaaaccactgagtttcccctcaggtcttaaactatcagcctggatagcaaacaatttttattgcaaatttgagtagttactatgctttaggtttttttttggattaatgcagtttattttagagctgttctgagtttatacaaaaattgcaccaaaagtacagagagttcctatacacaccttcattctccatcccacagttttccctattaatagcatcttgcatttgtgtggtaaatttgttacaattgatggacagttgtaatacaatatattgacatattattgttaactaaatccatagtttatgctggggttcactttttgtgttgtacaattctatgcattttgacaagtacatgatgtcatgtgtcaccattacagtatcatacagaatagttttattgccttaaaaatttcctgtactccacttgtttatccctccttctcccaacccctaacccttggcaaccagtgatctttttactgtctccatagttttgcctctcaagaatgtcatatagttagaatcataaagtatgtagccttttcagattggcttatttcacttagtgatatgcatttcaatttccttcatgtatttttgtgacttaatagctcatttctttttgctactgaataatattccatggtaaggacttaccacagtttatttattcattaacctgttgaaaaatggcttaaacttttggtcgtttccaccttttggaaaatataaataaagctgctataaatatttgtgtgcaggtttttttgtggctgtgttttcaactcatttaaataaatactttggagtgtgacagctggatcttatgggaagaatatatttagttttgttagaaactataaaactctcttccgaagtgactgtaccatatttgtttcacaccagcaatgaataagggtccctgttggtctatatcctgtctgccagcatttggagttgtcagtgttcaggattttacccaatctaatgtgtgccatgctttatttttaacatttaacaaatagaaaatttgtgctcatggcatttgtttcttccaattactaatgaatagcatcatggttaaatgggatcattaccctgcttctttttccacccaccttagcttcctccagagttcactgttatctcttctctcagcaggtctgtggttggctattcttgtcttaccagtttgctgttattcctgcactcagtttctgttcttgtatgtgcctctctagtgtctagcataaatccctcaggactcaaaaagtggtattaatatgtcagtgagtcctattctgattccatttttcccaaatgagcctcctctttcaggctcctttggtaaagttcttctaattccttgggtctattacctactttttatattgttatagagaatgtcaaacatattcaaatacataaagaatgatatactggactaacgtatacctatcacacagtcccagccaccaacaacccatggccaatagtgctccatcctctcccatttactttttctaaatgttgtattattttgaaacaaatatcagatatcatattattttacatattcatgtgaccaaagatatagagcaatgacttctttttctaacaaacacatagcattattatcacacctaaaataacagcaatcatttattatcatcaaatatctaaataatgatctcattaaagttaagatccaataatgtccatgtgctttgactggttgatgcatattttaagtctcttttaatctatgggctctccctctattgtttgccctgccaacccccacaatttatttattgaataatcaaaattatcctgtaaagtttatcttataatctgatatttttactgattgtatttccgagatgtagtttaacataatctctgtattctgtattgcctgtaaataagtagaacctccatacaggtttgacttattttgatgtgactactataacttaattttttgttttgtattaatgccagttcattactggttctctcctaagctaatcttagagggcataccagtgtatcaattcatgcttattctgaaatctttaataaagttgtaaatgaattatacaataaatttcacagtgtcaggaatctaattaatgaaatagctagattagaaccctggaccccagacttttacatacaatttcctttccctgtaagcactatgttagcctcatgatagtagcatgcctctttgtaacttttaaatatcctgcagcagcaaattgagaaacacatttgcagaacattccctttactgtgtaatgtggttcttagtagagaatttatttatttatttattttgagacagggtttcactcccgtcacccaggctggagtgcagtggtgtgctcttggctcactacaacttccatctcccatgctcaagcgatcctcctgcctcagcctcccaagtaactgggactacaggcacacacgccaccacgcctggctaatttttgtatttttagtagagatggggtttcgccatgttggccaggctggtctcaaactcctgacctcaagtgatctgcctgccttggccttccaaagtgctggcattacaggcatgagccactgtgctcagccattaagtcttacatttgtatacaactttaaattatctacgtaatgtcactgcatagtcatatagcttggtagttaagcatttgaactcttttttttttttttttttttgagacagagttttgctcttgttgcctaggctggagtacaatggcacaatcttggctcaccacaacctccgcctcccaggttcaagtgattctcctgcctcagcctccccagtagctgggattataggcatgcaccaccatgcctggctaattttgtatttttagtagagacggggtttcttcatgttggtcaggctggtcttgatctcctgacctcaggtgatcagcctgcctcagcctcccaaagggctgggattacaggcgtgagctaacactcccggctgcatttgaactctttattctaatgtctaaataggactcactatttagggtactcactgtgtgatcttttttattattattacttcatagagacaaggtcttgctctgttgcccattctggagtgtagtagtgtgattgtaactcattgcaactttcaactcctggcctcaagcgatcctcccaccttagcctcccaaagtgttgagataacaggtgtgacgcactgcacccagcctcactgtgtgatcttgaataagttactgagcctagtttctctgcctgccagatgagacttttactagtaacaaccttatgaatttgctttgattattcagtatggataatgtatggatgatgcttagtacaatgcctgggatataatagcaaatgttcaatatagtttggaactataggcagagagaagtgttattatgagaaaactgaggcagtgatagggttggggcattggcctaatattacatagctgacatgtactttcacataagagcctgtcttttgtgtgagaactgactctgtaagtgtctctactgttatgaaggcaggaacctacttaggtactaggctatgtgaaagaagctggtgattagttgaatctaaagttggtgatgcactcacattgccaactacacacagtcataaaatccattagcctattttagacggcttactgcttaccttggcctcagctaccttactgcttaccttggcctcagctaccttggcctcagctactgcttaccttggcctcaggatatttaaagactaagattgtttcagtttgtttaaaaaattacacacacacacttgcgctcacacacacacacacacacacacacacacagtgggagagtatttttgccaaaacgtatgaaataattttctcctcttcacagatattgaaatggtgatttgttttatacatattccacacaaggtatatatatgtaagggataatttttttgtggtgaaatttaagtaacggaaataacatccactattatttgggtaaaaattacaaaagcacttcatagagacttttttccttagtgtatgaaccacatttatcaggtggtacaatagctgaattaagttgaaattgttctaaaatatgcttgagattttcgtctttcttcaagttgtcctgaataggtagacagatacctgaaaataggaataaaacctaaacctctactttaaaatgaggatattttacctttaaatgtctatttcacttgatgaatatttaacctttttgttagttgacctatctaaaatcttaagttacttgaaaaatatattttcttgtctgtggcttcttaaatggtgcacatgtggttagcaagcaacagctattggcttgccaaagctaaaagttaaaatataagatgataaagttgatgtaatatgtgaccttttataagtcactttcccatttgaaattaaatgtgccagatttgacaaacttaatatattgaataggttaccctaatatttttgttgacttttagcaagaacactataaagcaactataaagtgttatttattttagcttttctaaataaaaatcactgaagcaattttaatttgtacatataactcttccttaaaatttaaatacctgttttacttcatgtgcttccatgccttatttcattaaattttcaaacacgtatagaaagccacatctacaagctatcagatttccctgagattactatattaaaacatacactgaatcagactccatttcttccaacgctgattcagcactttaaaaataatctttgattttatattaaaataacttatcaccctttactgcatgatatcagaatgacactagttatttcactacaaaaaaatgtcagtgatcaaatcttgctggtccacaaataactctccacttgctaatttgcattttagcatcaactgtaaatatgtagataaaagaactgacagttgacagctaggtataacttatatatatttcatacagtaactcaataataccagattaatatttaaaaacattagtaggccgggcatggtggctcatgccggtaatcccggcactttgggaggccgaggtgggtggattacttgaggtcaggagttcgagaccagcctggccaacatggtgaaaccccatctctactaaaaattaaaaaaaaaaaaaaattagcaggacttggtaatgcgtgcctgtaatcccaattactcgggaggctgtggcaggagaatcgcttgaacccgggaggcggagcttgcagtgagctgagatcccgccactgcactccaggctgggtgacagagcgagactccatctaaaaaaaaaaaaaaaaaagaaagaaaacaaacaatgaaagacattaacaggagtatggcagaataaagaaatgtcaaaatatcatcctttaatctttaatgttataatttgtgtttgaattatgaaggatatattgaataataacaaatagaagtatttcaggaagcatagaggtgctgtttaaacacaatatgaaagtaatgagaatcattttccaacacggcattggatccagtctcatgacagtgtaaagaaactgtgggaaaagtgctctgtattttccaggtgaacctggttgcccatctcttgcaaccagctacagaaggtcagccagtagcactggatttccatggtcactcatttctccattctacttgtagtctgtgtagtgagaggaaaacaaatgtgtcccaaaaacttggtttcacatgagaagttcttcaaataattttcacctttagaaaaaaaatttatggagcatgatgatagtcaggagggaagaatggcagtttggaaggtaaggcaagaagaataatcttgagagtttctaatgagaaaaataatggaaaagggtaaaaaaaaaatagagcagctatgttaaagtataatattataattattgaatagaactcaataatatataattctgagcactctttttttcttctgactttatcatacaattttatctttagcctacctttaccttaatttgtatattcttagccttaggttattgaatagatttttataaaccatttgttttagtcagcttttgcttagtaaaaatacaataatatacaatccccaaatatcagtgccttttaacagcattgatttacttctctctcattttacatgtggcagctctctatggttctgtgtatcttcttcattcttgagtccagaataaataaataacttctctctggggcaaggcatagggaaaagagcaatggcagaaacatgcaatagatttttaaaattgtatttgagtataatttgaaaaaataatataatttaccctaccaacaaaatccattctggaataagatgtcatatagtaacataaaatttatattaatgtatgtaaaagaataatattaaggttgaaacttaaagaaccatttagtgtcttagtcaattttgtgttgctataaaggaatccctgagagtggataatttataaagaaaagaggtttatttcgctcatggttctgcaggttgtacaagaagcatggagccagcatctgctcctggttagggcctcaggaagcatccactcatggtagaaggtgcaagggagcaaacataatatggtgagagagaaggaaagagagatgggagggaggtgccagacttttttaaacaaccagatctcacaggaactaggactagaattcactccatcctgggagcattctccaagccatttatgaggaatccactcccatgacccaaacacctctcactaggccacacctctaatattggagatcaattttcaagatgagatttgacggggacaaatacccaaactatatgaaatggttagcatcattttcacttattaaaattttatcaaacatctacgatacagatgataccaggaagaagcaaagatgaataaatacctgtactctacatttaaaattctctggattcagtgaggaatatagcaaaatatataaaaccaatatagatgcatccactgatgagtgctttcttgaggattaaaagaggtgctaataagcagaaactgtgaatgaaactgtcaaccactgatacctagaaaccttaggatagtttctgtgtaagaatctgttaaattatctcagtccattcagactattatagcaaaatactctaaattggatagcttatgaagaaaggcaatttattgctcacagtcctggaggctgagaagtccaagatcaagtcaccatcagattcagtgtgtggtgagggctcgttctctgcttcacagagggcaccatcttgctgagtcctcacatggtggaagggcttcatcagcctcttttataagggcactaattccatcgatgaaggtgtagcctttatgacctaattacctgctaaacaccccatctcttaatactgttacattggtgattaggtttcaacatatgagttttgagaggacacagtcagaccatagcagatgaggataataataaagatattaatagtaataataactatctgtcttatgcatttactatatatcaagtactttagaaacctcattgtactctcacaatgaatttttgacataaattcaattattattctcattgtacagatgagaatataaaggcacagacacatattgaaagactatttataaagcttgtagtacctgagtggattaatggtgtttatattcagtttgtaaaacaaaactattatgagattatatatatatatatatgaatgaaaagtttccatgcctgttttcttgcaatattgattgtgaatgttaccgcagcctaagctcataaagcattttcttaacagaagcaatcacaggctatttgcaaagccatctcaataaaacttacaaacatgagtcctaagggtagaatcaattggtgagatgctacatttctttgtttgaattattggggaaaataaaacagtatgaaccattgatggtgttttgaaaaatatttttacactctattacttttattcttacccttaatatgtagttctatcattattttccatagaattaatctccactcttacatatattctttatgtaaatgagaaataaaatttcaaaggggaaaaatgtaagtagccaaaaatttctacataatgctttattaatgagcaaaattggggcattttatcttctgggtgagaaatgtaatattcaggaaaagtgtggtataattaatcatagtttatgtatttattactctagggttctttttgtaaatgttccatagttctttagcagtgaactcttctctaagttgcaaacagtacacctctattgtcaaaaaaggaccaatttctttgtttgcagcatattgtcaatatcaaatatgcatgctgaaagacagcagactatcaatagctagtaaattcacaaaaccattgggtgatatgctaatatttcacaagacaaacagtgaagggagaatattgtagtaatatttgcaaacaatattttctttagttttgtatttaaaatatgtcatttttttcttactcttgtgtgacttctttttcagtcagaacagaaaccttaaaatagataacctttgatttttatatttattccatttttctctgacagagtatggatgaatagcatgaaactagtcaaaattgctaagggaattaatttatctacaaaccttgttcaatcttattatttaaaaataacttttattaagataaaaattactaaaaatagattagactcttatgatgcacttagaaggacagaagatcatttctctgatagtcttgcctcaagttacaacctgattctaataaggagaatgcattagacaaacccaaattgagttacatgctacaaaatggctgaccagtactctgaaaagtttctaggtcaggaaagagaaagactgtagaactgtcacagtttggaggagactaagaagacatggcaactaatgcaatgtgggaacaactggaccttgaatcagaaaagaaccctagtggacaaactggttttgaaatttgaatacgtactatagatcagttcatcatattgtatcgacgttaatttcctcattttaataattgttctagggtttggaaaatgttaacattatggcaacctacctgaaggatgtgcagtaattattttctattcttgcatgttttctgtaaatctaaaattatttcaagatgttagagaatttttttttttttggagacacagtcttgctcttgctctgttgcccaggctggagtgcagtggcactatcttggctcactgcaacctccacctcccgggttcaagcaattcttgtgcctcagcctcccaagtagctgggattacagatgtgtgccaccacacctgactaatttttgtatttttagtagagacagggtttcaccatgttggccaggctggtctcctgacctcaagtgatctgcctgcctcgacctcccaaagtgctgggattacaggtgagccaccgcgcctggccaaaatgtcaaagaaatatttttaacttcgggagcaaagaagaactccaatctctggaatcagaaaaaataaaatattatttttatttgaggttatttaaacctcccatggagtatattaatatctgcaaactgagtgcctgctacgcaaggctacaaggtgctgtatgagacggaaacatggagacaatttattttttttattattttatgatgacatttattaagcttctaaaattatgtaacaaaatgaaagacatggacaatcacactttttgatatgataagaaaagagattatttgaatctgggacacagtgttccagaatttagaagatccatacaaagtgttgaggagaatctgattctaatttagggtttagggggaacaaagatacagtagttcccccttaaccatagttttgctttctatggtttcagttacctgtggtcagccacagttcaaaaacattaaacagaaaattccagaaccaaacggtgcacgattctgagtagtgtgatgaaatctcgtgcagtctccctctgtcctgtccaggacatgaatcatccctttgtccagcagatccatgttgtatatgctacccacccatttagtcacttagtagcaggctaggttatcagatcaactgtcatggtatcgcatgacagtaatccttattttacttagtaattgttccacagcacaagagtagtgatgatggcatattgttataattgttctattttattattcgttgttaatatcttactgtgcctaatttacaaattaagccttatcacaggtatgtatgtataggagaaaatgtattatagatcaggtttggtgctaaccacaggttcaggcattcactggggatcttggaatgtattcccgtcagataagagggaactacgatatgtcgatacaacagtggttgaactattgagtcatgcttggagctcttgagtatgaatatcaggaaataagcctggaattaatccaattgtggccaatttttaatgccatattagggcacttaaccttcattgtgtagtcagtcttaagtgatcaaataaaccacacaattggttctatggttcacaaagttaatggcgatatcaagtgaaaattggagtgaggcaagatgggtttccaggagaccagagaggcaacaagggctatataccttaagagcaatttacaaaagattaaaggagggcagtggcaatggggatgagaacaaataaaaaatagcaaaaaataatatattgaacttattgtaattatgtcaagctactgttatctttaaaggtaggaaaataaagatcttggctgggtgcggtggctcacacttgtaatcccagcactttgggaggccgaggcaggtggatcacctgaggtcaggagttcgagaccaacctggccgacatggtgaaaccccaactctactaaaaatacagtaattagctgggtgtgatggtgggtgcctgtaatcccagctacttgggaggctgaggcaggagaatcgcttgaacctgagagacagagattgcagtgagccgagatcacaccattgcattccagcctgggcgacaagaatgaaactcagtctcaaaaaaaaaaaaaaaaaaaaaaggaaagatctgaataaataatctcctttccttaatataaattttaatgattacaattacaactaattgatgagactggccagaggagtaaggcatgttgatcttcttttttttttttttgagatggagtcttgctctgttgcccaggctggagtgcagtggttcaatctcagctcacttcaacctccgcctcccgggttcaaggaattctcctgcctcagcctcctgaggagctgggattacaggcgcgcaccaccatgcctggcttatttttttgtatttttagtagagacagggtttcactatgttcaccaggctagtcttgaactcctgacttcaagtgatctgcccgccttgacctcctaaagtgctgggattacaggcatgagccaccatgcccggcctgatcttatttttaaagagtgtaaatgtaatctaattataaatttaaactttagagagaatgttgagagatacggacataataataaaaaaaacctgagccggataattgtgcttgtctgaaatgagctaatgaaataattttgttcatatcctttgggggtatttctgaaaatcagtaaagactatgcacagccattttatgtttttacaatagtgccattaatgatgccttatgagtgaagaaagttggatgattgggtgtaaaagatgtaaggttaatgggaaaacttccctagtccacaaatcatcttattatccagtctgtaattctttgttccatgccaaaaatctatatttcgtcaagtaataatagatgctttcaggcaaacagccttatatgttgaaatgcaaatgattacttttaccccgtctcctatgcttctccttaaacactgaagtgagtcagaagaaagaactcttaccctttctatttacactcactgctttggtggtatcactgaatctcatggctttaaataccatttgtcttctgatgattaccaaatactaatctccagctcagacctttctctccaacacgagacaggccactggactttcaataggtagctcaacctcatcctcacgtggtggaaagctctggattgtcccccaaaactatttatctcatcattcttttcccatctcagttaattgcatcgtcattcttctagttactcggcacaaaaactttaatgtaattcttgactcatatctctctcacccatcatttgattcatcagaaaatcctattgtctgtaccttcaaatcatttccaaaatctgaccacttctcaccagctccaacgctagcatcctggtcagagccacatttcactttgcttattgcaagagcaccctaactgacttccaacttctgccttgcttcccatcaattcactcttaactctgctgctggagtaattctgttaaaacagagattagtatgtgtcacttatttgctcaaaaacctccaaagacctctactttcactgtgagaaaaggccagaatacaaaattacaagggtccgtaaggccccagaaagacttgacctggcctgacctcatctaccgctacctttccctcttgctcactcttgcttattttcagcaacacaaggcttcttcccttttcacaatcactgcaggaacactcctgcctctgagactcagaccttgctctttcctctagctgaactgctcttccaaatgccttttttgttcactccttcaccttcttcaggtcttgacttgaaacaccctataaatagggcatttccaggccactctaaaattgcaaacttacctccattccttgcaccctttccctccttacagctgttatcaccatgtaatttactatagtttttgcttacttgttttttatctcttacgcaaccatcccattagaaagtaaactctattaaggcaagaatttttgttttttcaggactctacactaaatctcataattataagacaatatttggtgactaattttaataggaaatattgcctagagtaagtccagattttcttcttaatttaatcattaggcaaaatattttgagcaccttttatgtacttgattagaacataagggcataatgcattttaggatgtctgagattattggggagtaggcatgaaaacaagtattaatggtccattgttacaagaaaaagagtgaaatctgggctgatgctctctagtttgagcaggaaaatatctcatagcctctaaccttacttaaattctgccagctctggcctgtagaagcagtgaggcaaaatgacccactggaagaagctacttcttttgcagaagcaacctaactctgagaagaaaaaaattaagcctatcatcttcagttctacttgagatcttaattataaaataaactcagatttctatttccagttcagatggtttggtataagatgggccataatccctgaaaagtggcaattccaaggaagtttggcacaagtcttaatatgcttattcaggctgaagttccagcagttccttcccataagcagacctgctagagtgtggaagacacataatgtaaatacgttaggagcaattgttgtttctttcattttcttctgaatcagtccacagcccaaggattctgtgaagtaacaaaattggctgttacagattatagccacattcccatcttaatagcagcagttgaaatttcttgggcatttcaaggtagagatttatgttttatttgcagttcatgattattctgattcaaatatctgtaaatataaagggagggggagaatgctaacacaaaaaatattgtacccagttaaactttatgtctgtattaataaagcagtctttgatttagaattcttagtccctttcttttagaggattgaggttagggtatgtgggtttgtgtatgttttgtcaccaaggttggggtgatattaccacagtgaccagaactataaccaaattcccatttatactagtgatggttgtatcctgtctaccagagaggggaaaaatgctttgacaaattcatcattgttatgttttcttgccacagtttattctcttctgcattctgtggaagttcttttggccctgtggcttcctcaatcataagctaccacatacaaagactattttttcaaagaagccaattagttttttactaatcatacgaacttagaaaaatagatattaaatattactgataaataacacagccttgtcagaaatctctcaaagtgtgtgatcattgtctatagagtagaactttttaggggcaatacagtactgtttttatattcaatgaagataagttagattaaaaatgtaagatatctttttgtgaattgccacatggtagaattttgtaagaggtttttataatgctattcaattacttctccatggaagaattttgctcacagagaaagagagacagtgtgtgtgtatacacaaacatatataaatgtacatatatctgcatgcattatatatgcatatattgtatgtgtatgtaaagtatgtatagacatacaaatacagtcatatatacatacatatatagtctatacataatagctatatgtgatatactctctagatgttataaaagcttttcaaatttcaacttattggatttgttttggtgagtgttcaggtttattggtggaagaattatgagtttataaatcactgattagtcctctattctcacaagagtaaaagaatattttaatgatacatagtcaccaagggattgcacattttcaaatgaactcactgttactgcccctgttgtcaagatggtatctccctctttctcctcggcaaaaacaccatgaatcaatttatttagagtgaaaacaaacgtcaatcattaggtgaagatgctttttctcaatatctaaatggtttaaaattgaatttctcacgtaactgcccatttaaagactcaaacatggttctttgtttttgaggaatattctttataaagtctctgaaaacacttttactctcttagcaagataccttctttacttggcaacaaaaaccacattgaaacaatcgtattcccttttgtcagcctgagccagctgaaatctttggagttatcaacctctgccaacaacttgaagtagcggttgcacaatggataactgagatgtagtttattccaagctaatgattttctgaagctttcgggatggttatatttatactgacagatacagacctaactttcccataaaaagaacagactgtgttcaacgtacccagataataccagcctcttttttgtataatcctttaatttcagatgcttatagctgcttcagtcctgtcaataccagcactctgaagtcttgccctgcttgataatcatttgtctctgtaatttctttatcattgctttacttagggacaacacaaataatctatttagaccagaagagaccaactttctttcttctttatgatcaaaatattttgtagactccctacaaaataattatgataattgtagtagccattgggtaagaaatgcataatgacaaaaatctagttttaattcagtcgtgctaagcatatactctgctttattacatcagctacatatgtttaaaaatactaatatatattatttatctagtctgcatttggacttgcctaatcctttcaactagaatgccctctcaaagatccgtatcttgaagcacgagaaccaatagtttgaaacaactgatataaagtggataacatcaggtgtccaatgacctaccacatttgacactgaaaatattttccaaagaaatacagagtatgaaaataagaaagaactactctatcactcattgtcccatcgtctgatggccctgttgactcattgtacaccaagggccttttgaagtagggaaatacatgtgaccaatagagatagaacaataagacaatttcagatttgaaagaaacctgagcaaccacggagcccaaccctctctttttctccagtaatccaaagaggtcaagtagcttgttaagggcacccaagaagttgatggcaaagccaggcctaaacctggattatacaaacttgaaactatcttgaaatgtagtaagcactatcgcagtgttgggtaatacccttacactcaatcccagaagattgagttcagaagatgaagatgtggaggctgaaattataaccctggggattcgttgattgtgatgtactttatgcaggtttagaggcaaaaacacatggcttggcatcagaagtggaaaggaaagtagagtgttgtagaatgagtgctggatttgaggtcagaagacctcttttaattcccggtactgtcaccgattagatgtgacctatggcataacccttaaatatccttgacctcctctgtttccttttatgttaaaatgggaataataatgcatgctttgaccatcatttagaaaggttgagagaatcaaaatcagtatcagaaaatgcttttttaatctgtgcagagcttgaggtaacaaagcagtatacctcaataaatatcgttgcattcctctatgccaggcttcgtgcaaggcactgggaatagagcactgaataaaatagaaatgatcatagtttaaggaattttcattctagaaaataattacttaaatgtggctctatgtaacttaccaggagctttcttatccgttgttcctcttgagctttgcaacagtactaggcagacaggatagataagtaatgataataacaaaacaacaataatagcagcagcagcagcagctaacatttctattatttcaatgtaaaaaaagaatttcagattgtttaaatacagaaatgtggtggagtagaaagaaggccaagatggggacaaggggaaccatgaccccaaaagcaaataaagcatctgagcattcctttctgtttggttatgaacatctgagggtacataatcataatgagctcctttcagtaaatacaagatgggtgtttccatcttgatattataaattaagaaacaaggctgggcgcggtggctcactcctgtaatcccagcactttgggaggctgaggagggcagatcacgaggtcaggagtttgagaccagcctgaccaacatggtgaaaccccgtctctactaaaaatacaaaacttagctgggcgtgttggtgcatgcctgtaatcccagctactcaggaggccgaggcaggagaatcgcttgaaaccgggaggcggaggttgcagtgagctgagatcgtgccactgcactctagcctgggtgacagagcaagactccatctcaaaaaaaaaaaaaaagaaaaaaaaagaaacaaaagcacaatatgatcgtgtgacctgccctagatgctaaacctaatgagcagagaagcaagcaaagattgattccaggatttcctggctccaaagcctaggttatctccattgtatcaggctccttccaccacatctggatgttgactacatccagaacatgaaacaaaagcttcagtgctaaaaacaaacaaacaaacaagcaaaccaaactatcacattaagaagcaagtcaccaactgatcattttctgattttgctgtttccatggatggttccaaaatcctacctaactcatcaagcttaaatcaaagttgactcatccttacttgtcatcccatgtaaaataagttgccaattcctatctgtttcactttcaaaatgtttttaatcctgctgcttctgtgtagttttgaactggatagttctaataattgttgccaaagttccatactagcatctctggcttggactccttacatgctgaatccaactctcttagtttgcatcccctcactggcagatcctgagacaaggctttaagtgctggtagtttatttggagcatgaccccccaaacacaacagtctgggaatgaagtgagatgggaaaaggaagctgaccaataaaaggtgtgttatcaagaaagttacaactgtacatagctggaacttagtcctaacagagaaccctaggaaacaggatagagcatctgacttggagttattctaactgaggatcaaaagagcatcatttatagactggttcccattggttattggtttaggctacccccaagaactttttggtgttgaactcttcctgcgtgtagtgcaagtgagaagagaatgcttctgcagccagggaaatccctcagatgaaaggacttagatatgaaagttggaagtcagagttcagagaaaagatactggccaggggagtttatctgggtcactgtatttgctctgccagcctatatattatttctaaattaatcttcttagtgtacatctgtattagtccattttcatgctgctatgaagaaatacccaagattggttaatttataaagaaaaagaggtttgatggactcacagttccacatggctggggaggcctcacaatcatggcggaaggcaaaagaggagcaaagtcacgtcttacatggtggcaggcaggagagcatgtgcaggggaactgccctttataaagccaccagatctcatgagacttattcactatcatgagaccaacatgggattaaacccatccccatgattcaactacctcccaccaggcccctcccatgcataacatgggattatggaaactacaattaaagatgagatttgagtggggacacagccaaaccatatcaacatctttgctggagaaagctactctagctattaggctactcagagtatgccttgtgactttcatccttcatgcctttctcatattgtctccttttcttgattattgttttcagtcttaccctactccccgtcccacatagtcaaatgttacctatttatgaagactcacactgtgggcatttgtgattacatattatttttaattacattataacttgatgtaatccactagcacagtgttctaaatataatagaggcctaatggatgtttttggactcattgtctgacaacataacaacttgtgattgtctgaaaatgtaacaacttgtgattgtctgaaaatgtaacagcctgtgaactcttcgttgttcaaagaaaacagaaaaattccaaatatgtaactctttgaaattatgtcaatgtagatttgtttcaaatgttaatatatagtaaccagggaataatagcaatgaatttgttcagttacgatatttggtacttccaaatagcttcccatgatgaggataagataactaataattcttacagtaaaatattctttgattgggttgtttcctattgctgctataataaattaacataaacttagtggcttaaacaacccaaatttattatcttacagttctggaagtcagaattccaaaatggattttactaagctaaagttaaggtgtcatcatggctgcattcttttctggagactctgggagagaatctgttttcttgccttctttggcttctagagactgtctacatttcttatctcttggccctcttccatcgtcaaagctagcagtagccagttgaatctcacagagcatccctttgacattaactcttctgcctccttttctcatatttaatacccttgcgattacactgggctcatctggataaccctggcttatctctgtatcataaagtcagctaactagtagtcctaattatatctgctacgttaactcccctttgccttataaggtaatatattcgcaggttcaggagattaggacacagatgtctttgggaggccattattctgcctaccacaattgatatgtcccactcttccctcctaatttaataagacaatcctatactggtttacccttatctcgtaaaatattcaagatgtagtacagatgttcttgatgctagatgttgaattatgattttaacaaatggaggcttgtgtctcataatgtatatttcgttttgaaatagaaaagttgacttagaaaattagacttccatgtgtacacataatagttctgctacttgagatccagcgattagcctacttctagcattttcaaaataaacttgtcatttgtgtcattatcatagctgattagaaagtaaattatttgtattgaccacattgagaaaattaccatttagcttatggaactctttgtcatagagtgtggatattatatttgtacttgattctaatagtggttagggacattagaaggatatggagctcatcattcaactaagtccttacaaaataattcaatctctgttttagaagtttatcataatattagtacataaactgaacacaagaaggaatttataccatagaaaaattagagagaaaacttagaaaccatctcctacgagctctttgcttttcttgcgaagtggctgctatcaacagaaagagccgttgttaggctttgcatgttctggagtgacatctattagagaaggtttatcatctttgaccactttgcacttcctctcccaacaaagccttacaagcatgtgtttcctagagtggccacttggatcttcatcttccagtaatgttcatgatttgggtattcctagttctctctatccaaaatggccagttggtatcttcttaacccagttgtgcattttaaaatattttgtgggccaggtgcggtggttcactcctgtaatcccagcactttgggaggccgaggcgggtggatcacctgagatcaggagttcgagaccagcctggccaacatggtgaaacctggtctctactaacaataaaaaaattagctgggcatggtggcgcatgcctgtaatcccagttactcaggaggctgaggcaagagaatcacctgaacccaggaggcggaggttgcagtgagccaagatcatgccattgcactccagcctgagtgacagagtgagactgtctcaaaaaaaaaaaaattgtggagtccaaactgttactagttaatctggaaaattaatctataaaaagttcctaataatttatactattttttcttcctgtcacaatataaaaaataaacattacctgttgtaatctgaatatgtgattgtaaaatgattaagcccgatttttcaaccaaagagattatgacttaaagtgtttattatgaagttcgtggtaaatgaagaaccagaatgtataaaggtgattcagctataaataaaatttaattttgtgttaataaaagtaaaattagggaattatgaaaagatattttcaaatacaaagatgcatttaatattcacacaatattgatacttagtacccccatttaactaattaagaaattaagactagtaatgattaagtaactttcccacaattacttagctggctagagtctaacatggtatctttttctttctttctgtcttttttttttttttcttgagacagagtttcgctcttgttgcccaggctggattgcaatggcatgatcttggctcactgcaacctccgcctcctgggctcaagtgattctcctgcctcagcctcccaagtagctgggattacaggcacacgccaccacatgccaccacgcctggctaatttttttagtggagacggggtttcatcatattggtcaggctggtctcaaactcatgacctcaggtaatccacccgcctcagcctcccaaagtgctgggattacgggcatgagccaccatgcctggtgaaacaaacgtggtatctttttcataagaggaactcaaacattctattgagttgaaatacattgaatgaggcatcctttgttttttgcactgaataagctctggtgagagctctattgttgtctttaaataagtctattcttctaggactggctaaaagcccacttaaatgggagccctcaggtacactcattgtcttcattaacttcctttgttagaaacaccattcattcaacaatatatccaccaaaaatattcagaagtggatgacctttcttatgctgatttttgaattgtagaaaattgcggagattcttactaagttttgggatagaactctctctcactggtctttcctttaaatataaaatagaaccttgaatatggtaatttcaaatatgcatgcttttaagtgaattgtaagtttcttgcaaacagggattttgttacagtctacctttattctaacaagataatagtagctaccatttcagggcgtgtatgtcattaactgcttcataacacatgatttgacttttgcttttatatttctaacatttataagcagtacaatgtaatagtcacacataaatactttataatatttatcaataattaaaaataaattaatacaggaatctaataatttatagtatatgaatttagaattcattatttatattataataaatatacatttgtaattcattattacattatttatttattgcatctaccctcttgacactatttcaaagtgtgcataagtattgcactttggctttgagaaatctaaactaagaaaagataagcaaattttccaagggctcttagctagcatttgacaaaggaaaaattctaaccctggtctgtctgactccaaagatggattttattcctttttagtgtgctacattgcttgcaattttccatgagcctagcaaagtgtatcctgttggattgaagcatattttcgagtggagatactgtggtaaatgagatggaaggagaagatggtaactgggacacctactgaggtgtgttcttagaaccaaagacttcgacttaaactctatcatagatcacagttggtattagattcacttagaagaatataaaacacaaatgaacattatgtgtccttcctccttgagaatagtcatcacacaaatctatgtagcagttcccacagccatctgggtagttatctttagcgattcctttcccccatgtctcacatcatggaatacgaatcacattgtgtaggtgtagaaatcacctgggcgtaaaaacctcattccccagtagccagtatctcttatatcaaatctgtagtcacagcccctgaaaacatgctcagttgcaagtcatcacactcagggaagtgcaaagatatgacatccagatcaggcatctatacttcatttatagtttcttctagttcatgtgaaacttaccaatcaggactcatttttatcatagccagtatgaccttgtaacacatttgacataccacgtttatctgtcttcaggggatcagaactaaaaagttaccaaagatccaattttaacacaggtcgaagggttttgatagccttttacccaaaataattacagaatggatttcttgaaaagtagttttgaggattttgttctatttttaaggatgggaggatttggatatgacctcaacagttggtggctgagaaagagtggagaaaaagatccttggagttaaagagataagagaacagagaggctagaatgttagacagagcccctttgtatatgttgaaataagcaaaatgtggacatgtgggtaggtgaatgggacagtgatccaggctctaaaactcttactaaatgagagaaaatgacagggagatctgtagataactatagctttgagggaagatgggtgatggtggctgatggcacaacctcaaatgagttccttttattgaaagaagacaattcatttggaagaagtaattgggagcaagggaaacacctactctatctctaggccctaatttttctcatgataattcattgaagtgctgtaaaatatccaaacaaagtaattcagtaataagggaaaaaacttaaaaatatacacacaaatttataaatgtcatgtgtatatatttgtcctcaatacaatttctcctgatcagttgtgtgtaactaggatgtgtaataaatgaacacaaggacaaacacactgcagatatttaccctaaatatctcagtgtattttaatacatggaatattattgtgctgctttgttagtggggtataatttaggggggatctttcttgatagcatagcagaaattgatctgaatcctaaatactccatttattagctgtatgactttgggcaaattagtttactcagcctcagattcatttctcaagaaattagcccaccagtatgacttacctcttaggattatagttaagattatatgagataaagcacatgaagattttagctcagtgactagtgtagtaaatgcttaataaagctattattgtcattgtaattacattaaatcacattaaaaaatttagttcccctattaaatcatatgaagagtttaaagaaagtcaacggggtaatgtgttcagtttcttttttaaataaaaagtatgcaatattataatgattagagtcccatgtagtagaaggaagagaataaaggactgaaattataagactatttgtgcccttgattttaatttcttaccttgagtccttttgttatttagaatgaccccaagggaatcattccttatttgattagcagtgctacactttaaagagcattacttcccccttatctcactcccattccaaagaccactagggtataaccgttgcaaacatttgtactttgtctaactacaggaaaacataggaaagggtaccttgcattccaaactcaattttaaatcactggtaatggttttgactggctaatgcaatgggaacacctccaatatatgttggccagtattaatcttagcatagaaaatattcacttttaatttgatggtcattttttttctttttttggaggcagagtctcgctctatcccccaggctggagtgcagtggcacgatctccctcactgcaacctctgcctaccgggttcaagtgatactcaagtcttagcctcccctgagtagctgagattgcaggcacctgccaccatgcctggctaaatttttatatttttagtagagatgagattttgccatgttgaacaggctggtctcgaactcctgacctcaggttatctgcccgactcggcctcccaaagtgctgggattacaggcgtgagccaccactgcacctgggctggtgctgatatttagcaatactgccatctgtggtgttcatagaaacaaaaaaaatcctccaaatactgcttaaaggagtctcatcacacttgacacacatcttttaaaaatttgtgtttttctattgctctttcatctcaaagaggcctatagcagagaatgagtagcacgttgcgctgtctttggggtcctggataaacaacctctttcttttcttttttcttttcttttctctctctctctctctctctccccccccctccctccctctccctctctctctctctctctctttcctttctttctttgtttctttccttcctcttctttttttttgagatggagtttccctcttgttgcccaggctggagtgcaatggcgtgatctcggctcactgcaacctctgcctcttcatttcttcatctgtaacaagagaataaaaatgacttcttcacagatttatataaataatattttaactaagtaattcattttgaaatgtttatagaatgccatttacagataaggtagaaatagagtccttcctaaaagtctgttttagataattaatcactaaaattataattggagttgtcataatcaattatgtagcattgtttcaatgatgttaacattgctctttttcactggataaattgttatgtggcatgtcatcattctaatattcagtttacatgacacttcttctttaactctcctctgcagatattcaatctagagtttgtggcacagtatacataatttttggcagatgatagctaagtgcattgtataaaagatacattatttaccagatcaaaggtcaatgtgttcataatttaatatgccgagggtcatacagtccagaaatgtctgtgaatttctgaagtgacacacatttttgatagaaaactgccattttgtaatggatagcacatcaattggatagcccagcattcttttcagatttacatgtcaagttcatcagtgaggccctacataaatctactctaggattaatttccagatttcatctttaactgtatcacaattctttttttttgagacaaagtttcgctcttgttgcccaggctggagtgcaatggcgcgatcctctgcctcccaggttcaagtgattctcctgccttagcctcccgagtagctgggattacaggcaagagccaccacatctggataattttgtatttttaggagagatggggtttctccatgttggtcaggctggtcttgaactcccgacctcaggtgatctgcctacctcagcctcccaaaatgctgggattataggtgtgagccacagcacccagcctcttttcttcttaaataagtctttctcaaggaaattttcacaatattgctcttgggactcaatgtccttatgtggtaggacactacgttttctgaaaaattgcttattaatctggtatatgtgaactatgcaaattatgttttctattttagtctttagatgcagtagttttactattttagttttctcagatatattcacagcaaaagtactatcattgtagagtagtttcacttagcagtgaaagtaactctgctatgatgtggacactgcttctcatttttcttaataaatattatgtttgttatttttataaaatttgttcattagatatggagttttattccaatttaatgatgatagatgggttttatttttatttaattttactgttgtgttctatgaaagtatcttctttaaaatattgtgtaaagatgtcttaattttactaaaacgatagtaataataatatagatgatactactactaataaaactactattttctgaatatgtacaattgccaagcatgatttatgatttacataggatgccaaatttccattatatatcttcaaatttatatgttcattggtttgttcatctatgccacaaatgttaatggagtacctactaagtgccaacaactatgccatcaaccatgaatcagtcacttaacaagatagatataatcccttccttcagaaagcttgtagtctgggagaaaatttaacagttaaacaagacattgaaaaaagtgtgggccgggttgggtggctcatgcctgtcatcccagcactttgggaggccaaggcgggtagatcgcctgaggtcaggagttcgagaccagcctggccaacatggtgaaaccctgtctctactaaaaatacagaaattagccaggcaggcgtggtggtgcatgcctgtaatcccaggtacttgggaggctgaggcaggagaatcgcttgagcccgggaggcggaggttgcagtgagcagagaagattgtaccactgccctccagcctgggtgcaaagcgagactctgtctcaaaaaaaaaaaaaagtgtgataactgttttgatacagcaagtggatggatggaagaagctctatgagtatacagcagggatacatggcctgggaggaaaaagggctgaccatccattgaaaggtttaattaggtcagtgaagttgctcaagtacagctataaaatgaggcaatcaattactggtgatgcaggagagaaagtgatgtatggagaactttctgaactatagtaagaaatgtaatctgtattctaagggcatacttaattactgaaatagtgtattcaaaataggtatcataatcaaggaaacaatcttaaatcatcatgttccaattgcttgatgattattgaagctaacgtattaggaatagatgtattagctaatgtattaggaatagatgtttcctactgctgagttgaaataacgaacccacttgaactttcgcagacacctctaggtttaccttttatttaataagtaaataaaaatgttcatgttttctataatactttgcatcagctttcccttaatcttggaaacatttatttgactgaagaaattaagcactctcacctgcataaaatattcttctgtatgctatagtggagccagttgtaaagatttagttcagttaataaatatctgttgagatgctggcaaggctgtggagaaataacaacgcttttacactgttggtgggagtgtaaattagttcaaccattgtggaagacagtgtggcgattccttaaggatctagaaccagaaataccatttgacacagcaatcccattactgggtatatacccaaaggattataaatcattctactataaagacacatgcacatgtatgtgtattgcagcactattcacaatagcaaagacttggaactaacccaaatatgcatcaatgatagactggataaagaaaatgtggcacatatacactatggaatactatgcagccataaaaaagaatgagttcatgtcctttgcagggaaatggatgaagctggaagccatcatccttagcaaactaacacaggagcagaaaaccaaacaccacatgttctcactcataagtgggagttgaacaatgagaacacatggacacagggaggggaacatcacacacgggggcctgtctggggttaggagacaaggggagggagagcattaggacaaatagctaatgcatgtgggcttaaaacctagatgatgggttgataggtgcagcataccaccatgtcacatgtatacctatgtaacaaacctgcacgttctgcacatgtatcccagaacttcaagtaaaataataaataaataaataaataaatatctgtttaatttctgcagaagaccataaatatacttggtgtgtcaggcagtgatctgtaagtatttttgttcatgcaatcacaccaatcaaaattttgagcaaataccccaatatgtgtatatttttctaataacaaataatacatatattactatattaatatatagtatacattaatacctaaataaaatagagaattgaaataatggaatacaaataaatttttaaacagctgtaaatatttttctcatggctcaatcgaggaaatcttaaatatcgcccagggagtaggagcttattttgcataccatcacaatggggaaaagaaaaatgaatacactgttatgtctaccttcaaggaggcagcaatatggtaatagaaaagttcacaggggccaggcatggtggctcacgcctgtaatcccagcactttgggaggccagggcaggtggatcatgaggtcaggatttcgagaccagcctgaccaacatggtaaaaccccatatctactaaaaatacaaaaaattagccaggcatggtggtgggcgcctgtaatcccagctactcgggaggctgaggcaggagaatcacttgaacctgggaggcggaggttgcagtgagccgagatcacgccactgtactgcagcctgggcgacagagcaagactccgtctcaaaaaaaaaaaaaagaaagaaagaagaaaagttcactaaagctaaatgctgtgccctgtggtattagaagttagagctgttgtggttcaaagtcaggaagatattttcagggcaaatttacttgtaagttggggccaaagaaaggaaggtaatagggaacaaaggctggaaatacagcatgatggttctttagagcaatgcttctcccagtgtaatgtgtctttgaatcagctagaaatctgagctgcggcctgggagtctgcatttctaacaagctcctaggtgctgctaatgttgctggtatacagaccacactttcagtgtcaaggctttaaaggactttctcatctaaaatgaggagtttgtgcttaaattgataggcagtaggcaatttggaaaggtgttccagctcagagcaacatgatcaagttgaactctaggcaaagtaatttagcagtaatttatagattggaggccaagactggaggcagagagataagtctagaggcaattacaggtgagaggtaataagacctctgaagtaggacatggcagtagacacagaaaagggacatggtagaagcagaatcaacctgagaagagagataacaaaggaacacaggtataatatatagaacaaattaaaacgaagactagagaaactaatgagaaatgtgtcctttactgttcatctagtaatttggaaatttgaattttcatatatttaaatacatatgcataaatgatattttcagctaaccaccagaaaatttctggtagaaaatatcacaaaataaaactggctttgaatatgtttgtctttttccttgatccttatttccagaaagaaatacatgtcctggaagtatatgtccatagaggtccaataaatctcaatgattgtaaatagagctttattcatattgagcaaatgtttcctgttcacttgcctctaggtgaaaaacataaatgtctttatacaaatctctgaaatgtttgaagcataaggaaggtgaaagtggcaaggagacatgtattttcattataggctctgaatatccatagctgttttctgctatttagccacttcttcctttgtgacctgactttggacggcacacattatcaatcaggaagaccattatgttccttttacttgtacttgtcaatgtctggctgctcctactgcaagataagctccttgagagccaagactgtgtactattcattttgtatccccagatcccagtgcagatgctgaataattgacttataaataaatgtgtaaatgatcccagaaccaagcacagatatgaacacaaaaaaaattcctttggagtgaacgaatgaattaataagtaggcaagtgaaagaatgaatgttgacttagcccttagaatggccattgacaggttctgtttttttattactagataagcaccaaccttattctactcaaagtatgtgatcaatatttcactcattcatgtccacatactataagaagccttcacattatatagtgactttgaaatcaaagtctaagtctaaattttattataggagaaaaatgtgtgtgttgtgcattgtggtttagtataaatataagtcagattccttgacatcaaatcagttcaccattttttcactcacagactttttcgtcatccttttaagcctcccattttttctttttttaaaaaatgatttcattatactccattattgtgtatgtgtgtgtgtgtatgtgtatctgtgtatgtgtgtctaagtcaaaaactaacctcttctatgggtattttgttactatcctctgtaatataatgtgggaatctttgtccgtgagcataaacagggtgagtgcaggaatctagccatcagttctttctgtactatgcatgcacagcgtctaacttgtgcttgtaatttgtgattacgtcttcaggatacatagttttaaactaggccgagtgcggtggctcacgcttgtaatcccagcactttagggggccgaggcgggtggatcacctgaggtcaggagtttgagaacagcctggccaatgaggtgaaacctcatctctactaaaaatacaaaaattagctgggcgtggtggtgggcacctgtaattccagctacttgggaggctgaggcaggagaatcgcttgaacctaggaggtagaggttgcagtcagcggagatcgcgccattacactccaacctgggcagcaagagcaaaacttcatctcaaaacagaataaagtaaaataaatgaaaaaaataaaattaaactaacagctaactcacagtcttctgctaaaaaagtgtcatacattcagattgtttactctatcaggttagttactcatgctgctatactgtttccaaactcttaggattctagcacattgttttagtttaattttcactgttcctttaaatgtttatttaattcattttctaaaatcacagatatgagcagagccttggagaccatctagtagaatccttccgtggaatagatattaaaataaaaactcatattggttaagttactttacaaaggacatatagctggttattgaaaaaagtggagtaaaaatgaaaatctcccaaatccctaggacagtgatttctcttacgctgtgctatatcactaaaagattttatagtttccctttggccatcagagaagctatgtttaatgtcaagcctgattcatagttaacatcatatcttttgggagcctagatatgataaaagcaaaagagctacaggcattttgaagaagcacttcctacacactactatataccttgaatttgtactggaattgtttgataccctctcagtttattgatactccaaaagaccgaatttctaggtttgttttctaagctttgtcaataagggtagtatttagtcatgcaacactttagctcaaaatattatcattacacattgtctatatgtaaaaataactttgcatatgcatatagattttccagttccattcagcatgaggcatcaactctttgtagtcttttttatataaacacacaaaaattagtttatgacttgtgctatcatgtgttcatgctggaagacggtcagatgtatgtagaatatagcttctgttagtgctcatagtctggtggttcacaggaaaatgaagaataacacaaggaagtgcatgtaattattttaataacttcattcttgcaaataacagaatgaatgaaacaatgttttgcacaacctattttatttgattttcaaaggaagtcatcatgcaatagtccattgactttaattctacctgcttactgtcataaagtaatcttcatggcttgaacaatccagagcctgtgaaatctcccttgaatctctgcatctctccatttccaacaccatcagcctactcgaagtgacaatcttctgaacaattgaaactgcattcactcttgcctggtttgtttactcatcattcaggcctattttttaatgtgtaaaattttaaattttttgtttaaaaatgcaagtatgatcaagctgctctctgacttaaaaccatttggtaacttcctgttggtcttaataacttcccattgctcccaaatccttaatgagaccaacatattttgcttacttttttctctttctcctcctatcttcaccccattcctctcatcttactctctcagcttctctcaccatgaaagtgcatgccttgactttttcatcccagggcctttgcacatgctgcttactccatttgcaaagtattgtctgtcaaatgacttgcaccacttcagccaattatctccttttcatgcgtgaatttccagattcaatgtcacttccttaggaaagctttttcttcaaagactgggttagaattccctgtcacataccttctaacacctaacaccgtgcagtcctgcttcacagcaataatcatagatataatgtggaatttattgattttgttgaatttattgttaaattttatgctaaataaggccgtatgttctttgttcacttcctccatgagaaccttgcatcttgttttgaacacggtgaattctcagtaagtatttcctatcatttcaaattttttgtgcctattttattttttacataatatattggtagaatattacaggtatataatttatatagtgataaatgtagagagagaatatgtactcccttcccattccgcttccccttccccttcccttcccttcttcctttccttccctccctcctttcctcacttcctcctttccttcttatttttttctgtaacctaataatattgtataatcaaaaagtctggagacttctgcttgttttttacttaatacgtattttccttctatttaataaaaggagactggcctgtcttttaaattgcattttatggcctaaatttctactatatgattcaaaaattgctctgccatagtttgtgagaagacactatgttattttacttcctaaagaaagggtagtgaacaaaataataaaagctttatattaaagacaataaagttgatagtgttgtgaaatcatgttactcttattttcggtctgttttctttccagatctctttcctgatctatggtatatatgccagaagccataaatacttaatacagggtgaataaaagacattttaaattaagcatgcccccccaccaacattatcaagagtaaaatgaaatagaccaataaatcggcttacttactggccaacacctaaattgattattagatgtaatggtacaaatttgtataaatatcacacttccctctaatctttttaaatgaaatatgcaggaaggattgtcaaatggaagtactatactaaaaagcgattatcaccatggtaatgttggcttgcttttctgttccttttaatttggttaccctctttattgttaaattttttaaaaagttttctacttttacattttttatttatacttaacacataataatttaaatattggggtacaatatgatgtttcagtgcatgtatacatagtatgaggataaaatcagggtaattatatacaccaatttagacatttatcatttctttttggtgacagcattcaaaatcttcacttctatctgtcttgaaatatatattacattgttatttgctatagtcaccctagtgtgtaatagaatagcaaaacttattctttcctgtctaactaattttgtaccaattgactaataacctttcccaagaaccccctcccacataccctcaccaatgtttgctaactactattctactctctacttatataaaatcaacttttttaggttccacataggagtgagatcatgcagtgtttttctttctgaacctggcttatttcatttaacataatatcctccaggttcatccatgttgttgaaataacaagatttcattctgttttatggctgaatagtattcaattgtatatatatatatatacacacacaattgtatatatatattcatatatacaattgtatatttatattcatatatatacatctattgtatatgtattgtatatgtattgtatatatattgtatatatattcatatgtacaattgtatatatatattcatatgtacaattgtatatatatattcatatgtacaattgtatatatatattcatatgtacaattgtatatatatattcatatgtacaattgtatatatatattcatatgtacaattgtatatgtatattcatatgtacaattgtatatgtatattcatatgtacaattgtatatatatattcatatgtacaattgtatatatattcatatgtacaattgtatatatatattcatatgtacaattgtatatatattcatatgtacaattgtatatatattttcatatatatgaatatatatgataaatgtgatatattaataaatgtgatatatatcacattttcttcatttgtaaatgggcatttatgttgattctatatcttggctactgtgaatagtgctgcaataaacatgggtgtgcatatgtctctttgacatactgatttcatttcctttggatatatatctagtaatgggattgctggatcatatggaagttctatttttatttttttgaggaaactccatactgttttccataatggctattctaatttacattcccaccaacaatatataaggtaaattctttaggcattgccttaacctatacagtcactgcctcactatagaagttattttactctgattttgtggcatcattgtgttttaaacaaaaagtgtcatctattatgataatattatggcagctgtatttattttcctgctttctgtaaattagggtctcaagacttccttaagtacaattatagccaaaatctcatatgaaaaaaatgacagaaacatgcatcagataaaaaaatataaaaatcttcagtgactccaaaaatatatggtcatttagttttaaaagcaatttcaaactacctggtaggatctaatttaatgattcttaccatgatttcttaaagagtattcatcgttgcctccccttaacttttaatgaaaataactaccaaatctctttgttatttggaaactaaataaataaactggatcattaacctgaaaatgttatcagtggtcccaaagtttcactaatggaattttacatatttaaattaagcaataaaggataagaaaatatgtaataaaataattagatttaatatctatatgtggttcatggaaaaatcaaatgttactttgaaactttgtccctataataatatttaattataaaatacacaatagaaattactcttgagaataatttttatgtacctgattgcatttcaatccacatttcccatggaacctgaagcaaataccttacaaaaaagtaaaaattctataaggaatgtactaaatttgtaccccagcattagtgatagaatagatgtctacacagattacaaataagtcaacaagttatttgataatgccaattcttagatgaaactaaaaccttttacattatctatattgttcccttttatatcaacaatgatctttttcctttacctagtcaagttgctagagaattcccctttcaattcatgtagaaatcactttctttataaatctgtgcccatctgaaaacagccaatacttcttggatttttctttattcattcttcacatgactttctttatctgaaggaaaaatagtagatataacctatgaatcttattattcatcaaaaagacagagaatgaacatgtctttagggattactatgaaaatttgacaaaaactatatatgaagatgaaggcgagtatttgagatgacttgcaacctgtttttctgtttctctttcttagtttagaaattcaatataactatgatttcagataatacaaaccttgtcagttttgttttatgaataggttggatgtctcctttactagaaaaatgggaaatatgtttagtgaatattcaacgtatatgtagaagtgattagtatattatttattgcaatttgagaaaccaaattgaaaagtcaccataaattatgaagaaaaatgcataacattccaacccctcgataaaatttctttgaagttaatatgaccatataataacttttggtgttagaaatatatattttatttttacttgaactccgataacttcagcaaaatgctgttaaaagtattctgtgcctccctccattattgtattagatgttttaagaacataacaatgtggtgattattaagagtgaataattatatttaatgaactatgaccatgatttgaattttatatggatggtggtttactttctgttactgaatgttgcacccagtgttgtgggattttgttttgttttgtttttgagatggagtctcactctgtcgcccaagctggagtacagtggcacgatctcggctcactgcaacctccacctcccaggttcaagcaattctcctgcctcagcctcccgagtagctgggattacagatgcccaccaccatgcccggctaatttttgtatctttagtagagacagggtttcaccatattggtcaggctggccttgaactcctgacctcaggtgattcagcctcccaaagtgctgggattacaggcgtgagccactgtgcccggtcataccaattgtttttaagtcatagggtaaaattgaaagggcacagacaccagaattaaaatgcaggtctgtgtgaatgacctgaactactctggtcctcaatttttttcacccataaaatcggtgttagatttcctactttcccaggaagtggtgaggatggtgttgtcattattgaataaattcaaacatgagtcatgtaccacagcatctaactaatataaaacgcttagttgatattaattctattgtctctatgtgagtatgattaaatgtaaaaaagtaacactttataaggcaaaagatatttctcaaaacaggctgaagataaagattatagctatagaattatcaagaattatgaaatatataaatagaagtaaagttagttaacatttgggagatacagtgttcaatcagtaatttattaggcatgcaaaattaaggctgtagacatagaaaaataattatctgagagcaaaactaaatatcatgtctatgtttctaaatgtcagtacaaatagcaaatggagggaaagaaaaaaaaaagggacattttgctttcagcataacactccatgcatttgaatgtttattgtggttttttaatgggtaaaatagggcttcttaactgagagaatgaatttgtgttcaaatagtggttttcaatttgttctaagcttcttaccaaattgaaaataatgacccattttgccaataataacctcaagatgtctttaataacccaaggtattttgaaccattaaactggcttgaccaaattctgcttagtagcacacatgcagtttctttcagcatcaagaaaattactacatttttcttttcaaaaggttaagttagctgtgaactgaagtttttctaatttaaaggttttttaatactctataggtatagctaaatctcagtaattgaatttgttcgtgaaagcaattgtatgatcctagaatacatatgtggttttcagttcattgcttatggcattggttctcaacgtgtggttccttgaacactagtagcatcacccaggaacctagagatgcaaatttctggtccctgttcaagacatagtgaatcagaaactcaggagttggagcccagcaacctatttttttaaatcaattttattgtatatatttgaggcttacaacgtaatgttttgggttacatatagacagttactctagtgaagcaaattaggaaagctattgtcttggtgtagcttgtttatatgtgacaagaaccacaaaaatctacttacttaacaaaaattgctaatacaatacaattaacatgccctccaggtgattctaatgcattctgaaaatctatcaagtccatatctggcatttaataccatacattagtgtttgcagcagggaagcaaaagttttgaggagagagccctcatcagataggtctaatgaagtttaatgagtcttgtgtgattaaacattgacaagccggaagactttggggaatcataataagaatcattcgagtcatgagagtctcattggataactttcttcagcaattcattaaacattggagaatcaggatgggaagaggaggcactgaaagaaaaactggtgaatttggcatgggatcatttatctgaccacaagctgagcagggagactgttgtcttttcatggatgtcatgtctcttacagaacagagaggtcttggacttgctgctaaacccacccaaggcaaccaaattatggttgtttttattccagtaaagtggtggttctcagatcccagtgtacttgataatcccctgcgtaattattttgaatacgtatgcctgagtcacttcctgagagattgtgatttaggaggtccaaggaacatacttacaaaacagtgctaatggattgtaggtaggcggatgattttattcagatgccttgtacaaaatcagtattatttttggattgaaaaacagctaataaaaaaataaacacttaaataaagtattatcaagaaagctgttttaggaatctccacatatgggaaatactttttggtgcaatttctagtatcactgatttaataaactaaaaataatatcagataattgtttatattgttaatgacaatgaatagatagctactctatggtttactagtgttctgcattatgaaaggaacagaaaattcatacctttgtggtccagcagctactctaagtaaagtctcattttgactgttctgtaagtactttccttatcattgctaatggtgattacagggccactctattattgtaagttagctcaagcaacctggaagctgaggctacttcaatgatcatttacaagttataagaggaaattggttgtgaagagatatcccgcaaattcagaattagcatggcatatgctacttccatagagtaagaggaaacctaaaaggtaaaatgtagaagacgcagatagggaaaagcaaaaataaagcataaaagaatatgaaactgtctggatgatatgtgtgaaactttgccaaaagatgactcaaaaatcttcaatataagccgcataatgcttccatatatgtattaaaaggtcaacataagcatatggatttataaaaatgaacaatcaacaagatgcttttttttttttgagacggagtttcactcttgttgcccaggctagagtgcaatggaacgatctcggctcactacaccctccacctcctgggttcaagggattctcctgcctcagcctcccgagtagctgggattacaggcatgagccagccaccatgccctgcgaattttgtatttctggtagagacggggtttctccatgttggtcaggctggtctcgaactcccaacctcaggtgatcagcctgcctcagcctcccaaagtgctgggattacaggtgtgagccaccacgcccgccacagtcaacaagtttaaagtagttgacagtgtattgatatgagatgatttgcatggaagtaggaagatgaatgtgcagaaaaattgctgattttcaagagacataatttcagacaaagatttactaaattgttctggcttggctgatggtaacccatcacttgtgccgtgactcggagccataaaggaaaatatatcaaatagaaaaatgaaatatattaaggtgttattgcaaaatgcatgtgatgtttaggttacattgtcttgcttatgaagacacagctaagtaatagtacatatcaaatgtaaacttcatggagagatgaccagtggttaatagttttatgtaatatttgttatcgcataaaacacagaaaattcagaagtagatttatagtaaaaaccaatggggtttaatgatataggaattgctattccagtaaagtacagaaaaaaaactctcattaaaaagcataaaggttgatttatttaaattgcggtgggtttgtttactaacttcagtggataaagttctatagtaagaaaaaggaggcacaaaaagatccaggagacctggcgtgctggctcacgcctgcaatcccagcaactttgggaggccaaggtgggtggatcacgaggtcaggggatcgacaccatactggctaacacagtgaaaccccgtctctactaaaaatacaaaaaattagccgggcgtggtggcgggcacctgtagtcccagctacttgggaggctgaggcaggggaatggcgtgaacccgggaggcggagcttgcagtgagctgagattgcggcactgcactccagcctgggcaacagtgtgagactccgtctcaaaaaaaaaaaaaaaaaaaaagagaaaaatagaaaaaaagaaaggatccaggagtcttaactttgtataccaagtaaaaacctcacgctcaaaatggatattggttgtcataatgtgtttaaaatactctagcataatctttaaagaaaaatgatggtcatccttttgttatagtgacaagtcactacttatttatgttttgaattgagatttgtttatttttttccactgccttattgcaaagcacttgtcacataaaatatatgctcaagggccttggaaagccaatgaagtgagttatacatgggctgagattaatcagtttattatttcttaagcttagtagctataagtaaaagtaaaatgcaattcagtatttgaaaatgccacatactgccctctggagttttccatgcagaagaagaaatagaaaaatgagaattgcgaggatttagaaacgacatggagtagcttttaaaaataagattccaagctgggtgtggtggctcacacttgtaatctcagcactttgggaggccgaggcgggaggatcatgaggtcaggaatttgagaccagcctggccaacatgacaaaaccccttctctaccaaaaatataaaaaattagccgagtgtggtggcactcacctgtaatcccagctactcgtgaggctgaggcaggagaattgcttgaacccaggaggtagaggttgcattgagccaagatcatgccactgcactccagcctgggcaacagagtgagactctgtctcaaaaaaaaaaaaaaaaaaaaaaaaagattccagtgtatattccatgtagaaatgggaaaatttacatttttcttgaaatagtatactgcccaatatgatgcttttatttactctagcttagtagtgctaaaactttagcctgcatcagaattagctagggagctggttatacacaacttgttaggcctcagccctggagtttctgataccgtaggtctggggtagagtttggtaatttgcttttttttttttttttttttctttttgatacggagtcttgctctgccgcccaggctgaagtgcagtggtgcgatctcggctcactacaagctccacctcccgggttcacgccattctcctgcctcagccgcctgagtagctgggaccacaggcgcccaccaccacgcctggctaatttttttttttttttgtatttttttagtagagacggggtttcaccgtgttagccaggatggtctcaatctcctgacctcatgatccatccacccatgtaggcctcccaaagtgggtacttcgcttttttgacaggtttctaggtgatgttgatgctgctggtctaggaaccacactttgagaacccttgtccgagtttctcataagcaaatttgaaacaaacaaaaaaagcaacttcaaaggaattcctcaactgttttataaatgcacttactatggatggttacctttagaaaatttacaaggaaaaatcttgaaattttatggggattgttgaaagaggaacatttgtttcattcgatttttttcctctctagcaacttaagggatccatacttacgtctgatggtcatttctggacttacaaagacaatacgatacaattctgtttgtggtgaatagactttctgtatgatgaatgggtattagtttgaaaatgtgtcccctttctgctgtattgtgcccccttccccactaaaatcctcaatgccatttaccaatcttttcctgaagatttcttgttattgacaagcagagggagattggaccgtgattcaaatgaggttgacaaaaaccagaaagcatttgatttcaagactctaaatttacccaacgttttgttctggggatttggatattttggttataatggtcgtgatacttcctgactcatcagtcttctcagcattctcatttcccttacaactcaattgaaggctggccccagaggaactggggatctgtcaagtagtgttcatctcccttctcctataaagggagatgactgtatagtcaactgagctgaattctgcttcagtggagaagaaacaaataagggagaagcagttctgcccattagaggacataccataatacattgttgatgatggagcaggggggatgcctttctttttctctgagaaagaacagaccagttttgctttaatcacttgttttattggctcattttgaagatgtattgaatcatctgatcattacattcacaattatactcttaatgaactattttttctcactgtagttacactgaacttctcccaaaaattcgattgctgtctccagctgaatagacctattttattttatgaaaaattggcacaaaatgcttctgttcttttctagggcagagtggttaatttcatttgaaatatacttggttttcttataagaatcactgtgtatacatataagtacatttgcataaaatacaacatttacaataaaagtattgtttaaggtactgtattgtttaaattaattttctattattatactttaagttctagggtacatgtgcacaacgtgcaggtttgttacataggtatacatgtgccatgttggtttgctgcacccatcaactcatcacttacattaggtatttctcctaatgctatccctcccccagcccccgaccccatgacaggcccggtgtgtgatgttcccctccctgtatccaagtgttctcattgttcagttcccacttatgagtgagaatatgtcgtgtttggttttctgtccttgtgatagtttgctcagaatgatggtttccagcttcatctatgtccctgcaaaggacatgaattcatccttttttatggctgcatagtattccatggtgtatatgtgccacattttcttaatccagtctatcattgatggacatttgagttggttccaagtctttgctattgtgaatagtgttgtaataaacgtacgtgtgcatgtgtctttatagtagcatgatttataatcctttgggtatatactcagtaatgggatggctgggtcaaatggtatttctagttctagatccctgaggaatcgccacactgtctttcacaatggttgaactaatttacacacccaccaacagtgtaaaagcattcctttttctccacatcctctccagcatctgttgttttctgacttttgaatgatcaccattctaactggtgtgaaatggtatctcattgtggttttgatttgcatttctgtgatgaccagtgatgatgagcattttgtcatgtgtctattggctgcataaatgtcttcttttgagaagtgtctgttcatatccttcgcccacttttggatggggttgtttgatttttttcttgaaaatttgttcaagttctttatagattctagatattagccctttgtcagataggtagattacaaaagttttctcccattctgtatgttgcctgttcactctgatggtagtttgttttgctgtgcagaagctctttagtttaattagatcccatttgtcaattttgccttttgttgccattgcttttggtgtttcagtcatgaagtccttgcccatgcctatgtcctgaatggtattgcctaggttttcttctagggtttttatggttttaggtctaacatttatgtctttaatccatcttgaattaatttttgtaaaaggtgtaaggaagggatccagtttcagctttctacatatggctagccagttttcccagcaccatttattaaatagggaatcctttccccattgcttgtttttgtcaggtttgtcaaagatcagatggttgtagatgtgtggaattatttctgagggctctgttctgttccattggtctatatctctgttttgataccagtaccatcctgttttggttactgtagccttgtagtatagtttgaagtcaggtagtgtgatgcctccagctttgttcttttggcttaggattgtcttggcaatgctggctcttttttggttccatatgaactttaaagtagttttttccaattctgtgaaggaagtcattggtagcttgatgggaatggcattgaatctataaattaccttgggcagtatggccattttcacgatattgattcttcctacccatgagcatggaatgttcttccatttgtttgtgtccccttttatttcattgagcagtggtttgtagttctccttgaagaggtccttcacatcccttgtaagttggattcctaggtattttattctctttgtagcaattgtgaatgggagttcactcatgatttggcaataaaaaatccttctcaaccagttcaagttttatatttgtgtattctaggatagctagtgtggtagttagaataatgactccccagagatgttcatgtgtttatagctggagctatgttacctagtatggcaaaaaaagaaaagactgtagatgtgattaaattaaatgttaggggatgggatatgatcctggattatctgggtgggcctggtgcagtcacaatggttcttataaagtctgactcagaaaaggaactctaagtaaagctttggtaatcaacattattactgaacgcatgctgagtttgaataggctctgctgtgacttttaatttttttgtacaaccccaaaacataagtgatattctcttattggttttgagtattgagtccttataagagtacatgaaaggacagttcctacctcactgctgactagaacagtggttctcaaattttagtttgcactggaattacctggagggcttgctaaaagacaaaagtatccgattcagaaagttgggtggggcacagaaatttgcatttctaagttttccaggtgtgggtttgtgaatgagtggaatgggtaatctactcgtgagcactactggcccagaagaaggtttcataatctttgaaggaaatgaaaaaaaaatctactttaggcttattgatcaaattaacaacaaatcaatctctctctctctctcaagatttcactaatccttgtatttcaggccctttgttgatcatctcattgaataagccatgttacattggatagcatcacatataaggatggttgtcagtgcaatgagaactactgtcaaaaaaaaaaattgaggaacaatgttttatataaagcacctctgaaaacctgcagatataacgaatatttattattaaatatttttaatcctttttcatccttttgagattagtaagactcaagtacttctctattttcaagaagaaactcattattattattattattattttttgagatggagttttgctgtcgttgcccaggctggagtgcaatggtgctgtcttggctaactgcaacctccacctcccgggttcaagcaattctcctgcctcaacctcccaagtagctgggattacaggcacccaccaccacacctggctgatttttgtatttttagtagagacggggtttcaccgtgttggccaggctggtctcaaactcctgacctcaggtgatctgcccaccttggcctcccgaaatggtgggattacagatgtgagccaccacatctggccagaaactcaattatttttgttttttgaaaaaatagtggaacctccattaggctattcccttaattccaaatcttgtgctctatcagttgatcctcatgacctaatccaaacataattcctttttcatactttgctacattgctaagaatgtaaacattacagtgacgttttagattcctgtatctttatctgtatgtacatgtgtgtgcaatacatgctcaagtatgtctgtgtatatatcaaattgtttctgtgaaacaaagaaacggaggggtggtgagagttgaattgattcttggaaaatgcatccatgcttttgtgtttccttcttttgataaatataattactttaaaataaaaccttctatattgtctttccactgtgtgaactatttaaaattcccaaagaaagagtttaaggaacatgtgatctgactgagttgctaacatgtgacctggaggagtttacctggcctcttttagtctcaattttctcatctgtagtgaaaacaataatagtctcatcctaggtttctgatgaggattatataatatagtacttggaaggtttttagcacaccatgtgttcattaataattacttattagtattctcagctatttaatactatattctcactactcctatttgcaaaatagcactgttaggtctccatggagctctgaataaatcttttgaccataagaacattatgattcagcatctaaacctataattttttacatgctaatagtctaggtattactgtttgaaatacattatgttaagcatctgacctcttccttgtactttgaataccttgatcatttcagctaaagttcactgatggggcaaactttagaaagaattaggtagaagcattcactgactaattcagtcaaggaacaattctagaattcctactatgtaccacatactcttttttagagatacagcagtgaaccaaacataccaaaaattatgcccctgtggtatttatattctagtggagtgattgctctcaaaattgcataaaataaaggatggcaattatatttatataactgctaattcaactttatccatgtttcagattttcaagaaatgctcctttttaaattatcataataaagcagatgcaactgaagaccatttacgttcatttttacaattcatctagactcataagcactaataataaataatctctaagtcattgaaatattgtcatttatagtaagtatgtatttggtctttttctccatttcttggcaaacaactgctaaagcccatggaatctccaaaatagtgtctttgtgtgtaataatgagatgactgatggctctggcctcttagatagctttaagatggagggcggttgccaggggaaccaaccatgttattagagagttggaacttttagccttgcccccccccaccccatgccttccctgacctctggtagaggagaagggctgaaggttgacttgatcactgatagccagtgatttaatcaatcatgcctatgtaatgaagccttcataaaaccccacaattcttatggaaacagaaaaactgaatctggcactctgctttactagactaactcctgggcttttccattctgtagcatccaaaggaaaaaataagttttgtgttggttgatttgcagacaggtgtgtagcactaatgactgcattccagaagtggcagagctaaggtgatttgattttctaaaatggtaaaaaagcctttgtaaaattgcaaagaaaacaaaccaaaatcttcctttggattgcacatagttgaattgctagagaaatcaattacattaaactttgaaaaaagattttacatgtttatattacgtggagttaaattacacgctcatgtacttagttttttttttttttcacctttgtcaatgtctaaagaggcatcccaaagtcacaaaaattgtgaaacattgttttgtcatttggtaacggccagcatatgacaaaacttgtaacatatgtgccctgtggtaggcacaataatggccttcccaaagacattcatatcctgatttttggaacctgtgaatatgttagcatacatggcaaaaggaactttgcagatatgattaaataaagatcttgagatggggagattgccctagattatccaggtggactcagtgtattcacagggtctttataagagggaggcaggagagttagagtcagagaggatgagatagaagcagaatttgaagtgatgcgggaccatgagacaaggaatataggcagcctttagaagctgaaaaaggcaaacagaagggattcttccttagagcctccagaaggaaagcattcctgcttacccattttagacttctcacttccagaaatataataaatttttgtagttttaaggcactaagttttggttacttgtttacagcagcaataggagattaattcatgtcccaagtacttaaggccagtattgtcttccaatgaatgtgacgtcaaaaaaagaaaccaaatatttctatactgtttcctgtggagatgtactactctgattttttccctcttctccatccctgcagatgctgactgagttcgctctgatcatctcccatctgaatcaatatagctttctagaattttcccattcttcaaacttgcatccctccaatccagccccccaccatttgattgttcaaacattttttgtcaaacctaaatcctgttatttctctgcctaagcatccttatggtctcctatgtttctgtggaataaagtgcaagcaggtgactttgactgacaaacccctccatgatctacatcttgattgccttttcagtcatctccctcatcacatactcatctctataccctgtggtacaaactgtcatccccagtacagatgagattattttcttgcctctggctctttgttcaaacttttcctactgaatgagatgccctcctctctcctcttcactcccattccctattttattttattttatttacttattttgaaacagaattttgctcatgttgcccaggccagagtgcaatggcacgatctcagctcactgcaacttctgcctcccgggttcaagcgattctcctgcctcagcctcccaagtagctgggattacaggcatgtgccaccaggcccagctgatttttgtatttttagtagaaatgggttttcaccatgttggtcaggccggtctcgaactcctgacctcagatgatctgcccttctcggccttccaaattggtgggattacaggagtgggccaccgtgtccagcccccctttttttaaaaacaaaacaaaactttttcttgtttttaggacgtttgctcaaagaagctttgtgttattcctctagttagaactgaccatgttcttctttaggaacccatttcaacgtgtatatacttctattataaaatatacacatatttctattataaaatatacaccgtcatcctgacttgtttgcgtttccatttctcatttctagcccatgagtgcctaggtggcaggaatgatgttttattagtctctgtgttcccagcaacgaatatagtatttcagagagtagtagggtgcctaataaaggcttgatgagtgaattaaattaaccagtgctcacctgaggacatatgacatttgatgaaaattatacattgatttcagctgtaagaaatgatatttaaattattatccagccaaggtttgttttcttcaacgcatcacttaacatgcccctgtagaatgccattgagccacttaaattatgtatttttgtatgtttgtttgttttcttttttgagacagagactatctctgtcgcccaggctggagcacagaggcttgatctgggctcactgcaacctctgcctcccggattcaagtgattctcctgcctcggactcctgagtagctgggcctacaggctcatgccaccacacatggctactttttgtatttttagtagagatggggtttcaccatgttggccaggctggtctcgaactcctgacctcaagtcatctgcctgcctcggcttcccaaagtgctaggattgcaagcatgagccaccgcacccacccacattatgtattcttcattgagactgtgttcctattcttttttccccggatttcttgatgagcattttgtgaaagcacaagtaaaataatgttctcaagtcaaaacaaattaaataaatcaattcctattagtacactggacttgtcatagaagacaattttgtgagtctatatgagatgtactgtgttgttcctaaagccatgatgatttctgttattccatagaagtctaataaagcattcacagagtaaattgtacagtgttaaaaacctgccatctttatcactttcagtaacaccttctaaatgatcgtgagtaatttgtgattttaaaaattatatttttaggtatcaaagcaataatgaaagctttttgtcaagtgaatcactaagtaaaagtttgcatttatcattcatgtaattacagaatattcaattgactggaaacattccttaacactttcttcttaaataagcatggtggtaaatttccaatgatgtctatattcttacgttttgttttttcacagaggatcttaatggcatgtattcctaacctgactttatattgctatatgactttggggaaattacttacccatgctaggcctctgcttctctaactctaaaatgagaataataatgttgataatttcaggaggttgttgtgaatatcaaatgaaaatgccagtaaagcacttaccgcaatgcctggctcaaagtaaacgcttgatcaagattagctataaatatcattactagttgtggatacctgtgctttatttgtttatgacataatgctcttcatttaggaggcactctatgagtgctgttgactccatgatactccaagtcataaaacataattaaactacaaacctggatgtcaaggtgatttacaatgtaacagagatatgataaatctacaactaattataaggaagtatatgattaattgcttgagaaggtcaaatgtgtaataggtttataaagaaagcagaaatgacatttttagctgggctcaggtatcatggtgtcacagcagcaaaaaaaaaaggctccatttaagcatttaagaatgggtctaattttgacaaaggaaataaagaggtattctaggcaaggggcagcaaatgactaagaagaaggaggagagtggaaatacttaaataaagcaaatagttttagttttacttcagtcaccctactattagtttgagaatttttattacctttatctctaaataaaactcactgttaataggtgtttacataacagcctgtaataagcttttaatatttgttttcatgttgatgtgtgaaggtttttttattcataaaaattatgacacatacaaaatatagtgttgctataaaaatgaatgatgatcataccaattttttaaacagctagatacatgcagcagagttgaaagcaaataacaaaaattctggtatgaaaaatgatgtaattggcctcataagtcttctttgtgaccaacttggacagttgctctggctgatacaattcgttttgctataatcaactattaggatgccagaaatgagtttgacaccttgagtacaatcctttagtccagttttgaaaaaggctaggaactctgcaatagtaaaaatattaaaaagtcagtttaggttgagaaacccttgatttaaaagacttttatttgcaacaatggcctagtagaaaggaaagaaagatagaatataagaaaaaggaggaggaaagacaagtatatttgtaatcttgttcccatagttgtggcattaagttaccacggttgcaggaaaaagaaaattcatctctaaactgatctaaggtaggactggagtgtcatatctttaatacatatttctgttattactaataattataatgataataataggtatttacttattgactagtatatgacagatattctatgtggtgtttgtgtacataatttataatgcaagagaaatttttaaaaaggtatgtacatttcataggtaaggaagtcaaggtttaatgaataagtgacaaaatcagcatttgaaattttttctgcagaaaagtaaataccacatattctcacttataagtgggagctgaattatgagaacacatgaacacatggaggggaacaccacacactcgagcctgttggagttgggggggagggagagcatcaggaagaatagctaatagatgttggtcttaatacctaggtgatgggatgatctgtgcagcaaaccaccatctacctatgtaacaaacctgcacatcctgcatatgtatccctgaacttaaaagttggaaatccaaaataaaaataaagaaacttgttctgtataacaacaaagtatttagccattcctctgttctagacttggtctagaagggtcttgcatgatgtttggcttataaattgaggagcaaatgaatattttatgaaaacatttactaatcctcagaatcttctgccaagaattatgacatgtgtaagacttgactctacttgaaagctaacaaggtagcttgccacaggttcatgaatactggcacaaaagacacagagtattgggacagaggcaaatggccttattactcatggcaataaaaactccccaaaccccaattctgagggtgtggcatgaaaaaggtcagatgacgcctgtttgtactgtgagttgcattataggataggaaccctgagtatagggaaggtaaatctttatactggacagtaagcatgcatgcccattgctctgaaaggagacactgtcttcatcttccaaggccgttcacaatgcaaacatcttttaaaacatcatctgcaccaaagtacctctacttgcaagacttaaaaaaatgtgagcaattcaagaagaattttctcctaacacctttcatttacacaaatgtattcttaggcacatggaaccaatctatcccgttttcaccccttactcccctatcctcatactcttctgctttaactgttatttagattccaccatgctgccataggagagactctagctgtaatacattcaaactgacattgaccagcctgaaactggaaggaaaccatatacttatttggcacaagggaacttggctaactctgaaaagctggtctaaactgccctctagagctctactctaccaattagtgccaaatctaaccaattacatgcagttcccatgcatattcctctctttgtaaatgaaaagtaagagctaagtaagcagtgggtcacccagcttctggctaaactagaatagcttgcttccccaggagcctgcaatacttacagcctcaaccatgtggttaaaatcattctccttccacagactactcctctgtgtctttacaatgaacttccatccctttaagcaatctctgcatgtctcttcctttgtgactctgagaaatttgactggcaggataggactatatttatcttcctaattttaaaagcatttaattaccaataattaccaccaatgtgattttttcccctagtgcacattaaaaattttgaatcccattttctgtaataatttaagttgatctggagggacagagagtaattaattatctataatttctcaaactgtaaatgccgaatttattgaagtgaaacaaatccagggtagaataaggctgaaataaataggattgcatgagaaagaaggatgcagcaaaattaaatattttttcaaaattgaaagagcttaaagctcttaagtactgtagttgggttaaaacatacactttttttttttttttttttgagatggagtcttgctctgttgcccagactagagtgcagtggcacaatctgggctcactgcaacctccgcctcctgggttcaagcgattctcctgcctcggcctcccaagtagctaggattgcaggtgcccgccaccatgcctggctaatttttttatttttagtagagatagggtttcactgtcttggccaggctggtctcgaactcctaacctcgtgatctaccagcttcggcctcaatgtgctgggattacaggtgtgagccaccacgcccgcccactattttaatcagtatgtcaggtcatgtctcctaaagccctttttaaacaaaaattgagtgtttattgcttgcaaaatgtttttactgtaatgagtttaatatacaactgtgagccataagaagggaacaattgagaattgtgttgtttttgttttttgtttttccactgtggttctttaataattggtatagtttagatagtacgtgttttttatttgccaaatatgtaaacgttcttatgagcttctttacagaacgtcttcagtgtgaataagaataaagcagaatataagatgtgtctgtgcattttgcaacgtattgccatttaaagggcatggattttggactcaatcacacttaagtgttataagctctgaatgtattaatgatatgattttggacaagatatttaacctctctgatactattttcattatctctaagctggtgataatatttatgttgcaaatctcttgtgagggcattatggaataaattataaagatatctaaatcagtgtctagaactctttaaatgttatcttcatttccccctctttttcctagtttttcttgttcccttatgttccctaattatcttaatatctaattcttcctgttatataagttctcagaagaattatatattcatataaagtaagtgttcacctgttttcagtaatttcattatctcccatttgagaaattagaattatttcattactgctggtaaatatgaaaagaacaagaagaagagggaaaatattatatattttcctacccaactttttcctaaagcttagcactaaaagctcaatttttatatatacgttcataaattacttgaatcattcaaaagttgtctgggataatgtgtgattcatattttatatctctactctggcactatcagatctgtatatcaggaaatgtactttgaaaactctagatctttataccacaaacacaaggcattactattgataataatataatccagttatgggccacacattgtatgaggcattagaagaagtatgacgtgaatggcatgttgggtcatggtttaagagataagtggtttagagcatggaccttgaagttaggcagatcttgtttcaatcctgactatcactcactgtttgaacttagacatatcatctaaactctccaagcctcagtttcctcatctctaagatgtgactaatacttactaccttacagtatcattgtaggatacgataatgtatgcaaagtgtgatgtatactgactagtacttaatgcaaatttaataaatggtaattattagtactattgctaataagacaagacatctgtccttatggactgtcagtgtagttgagaatagaggatcatacgctatttggtatcatatgaagccagatgtcctatttccaataatagaggttttttaaaaagtactaaatgggtataagaaagattaagtttcattggttgactctccaaatcgatttcagtagcaaccatattccttgcacggactatcaaactgtggtacctgctgcagagggattctactgatattaacttatgttggtgttaaggattagtcaaagttgttgtgaacatgacaaaatactaaaagcacttagcacagttgatgggatacaccagtaattttatagatgttgcccatttgtatattcttgtcaagaaccaattttgtaaggcagagcttacaaaagactgttccttgctgagaaggctgacagattcctggtaattgatgccgatgtgtgttgaaccataattatgaactataattagtactatcctccatagattagaatggtctttatggaaatccttttttcaattaagtactgtttatggcttatgccaatacattcagtattaagtcagaactcttccctgatgaaagcatgatgaatcttgcaatgacctttataaacttaataaaataacattaattttaaaatcttgtatccaactcaattatatactggtgtattgaggatctgttctctataactgaggtgaataatacgagaaaatcaaataatattgaccagttgacatgaaaaaatacttattttggaattggctgtattgatattatattctctgaaatgcgcatatatttcaccatgtctcaaataatagattgtatatagttaagaaacatttgtcattcaagcaaaaaatgagtttcatgtatttgcaatctaatatatataggtatatgtatatatttgtgtttgcactgatcaaacaaggttaaatgtggctttcttgcctatttatataactaattgtgatgtacattaattgaggtaatgatttaataattataaaaattaaataaataagcactacgtatataatgtaataaacagaaatcaaccttatcacttacttttcttttaagtgtattgggctattgttcctcatgttccatgaaacctagtccgcattttataaccctcggagtcactttcaggagaaaaaagaaaagccctcctctcagtgattaatgtggcctgtaataatcaaaactctgtacttattttaaagcagtggtttccttcttcatttccccccacctccccatcagtctggcccagcagcaagctaaaagcccagtcagaaaaggagatattatttgatttcttctttctttccctgccatgtactttgacaccttttgctgtatctttcaaaccaggttttggattccttatgattagagtgtggggagggaaaagaaataaagggggcagcagagtgttaacttaactggcattgtggtaatagtccacagggcgcttcagaggtagcaccgacctcccccatggagaaaccttctgcctgtggtttctttcactggataaaagtacctccatttcagcttactacagtctccgccctcatccccaggcatttagaagctcttttcacatccttctgctgaggcatgtggcccttacagagatttatcttggtcagggtctaagatgcgactaccccagctccttgtcgcacgtggcccacctctgttccattcatgctccaacaaaatttgagaccaactccaatgcaagagcaaactctcctttgctatggaactccccagctagccagtctactcagctatgtatcaggcagcagtctattctttcgttctccacaaaccgaagggtgaaggttttctcttgactcagagtgaaggggaaagtattccccacccctccaaaggggacacgactcgcaggcatatggacagttgactccaaaagctgtttcaacttcttacccctttatgcccttgtgtgtgggtagtcaagagccatggcagatagaaggtgtcttgttcttcaactgaaacttaaattttaaattgcattacataatttttcagtatttctctattatctttacaaaagaacatatacttactgaaaacaaggtatctggcatccctagtgtgcattttggtggccccaaaatttctttgcagtgaacacatttaatagatggagtgattatttaacagggaagcatttatttgaactcttaactgtttaatataaccaactagtttatttcttttacattgtaatgcactaaaagtaactataaactagaaaaccaaatctatatcattgaggaacaattctattctcaacattgaatgccattttaagattaatggttttggcttataataagaactaaatataattttaaaaagctattttcctatttatccatttatgatatcttccaaataaaatgtgattccactaaaattattgatgatattaccataaattcctaatataaaacagacaaaaaatatatgtagcaatctattttctttgactgttgtcataaaaactattggatatgtggcgtgtgtgaatatattatggttatgttcagaacttattatctaactttttctcatgaggaaaaatgattaggaagtatgttagtactaaccattaactagaacagttaatatgttaaatgttcataatattaacaatagcgttttaagcacataccttaaagaacagtttagatattagccaaagaatagtattattattattattggttgagtgttctatatttacattataggatttttattagatagcatgcttataaacattcttcatataaaatatagctaaaagttgagtgattgaagataactttattgttttttagtttataatttactttgctataataatctttcccatatgaatatcatattgattatcagattttccactttgaattttgtatttgttttttcaaattgtcagtgttgttaatattgacaagtagaaataggtaaattgaacaaccaagctacattagtatttcctactaattttttaaattgctagtgattaaattaaatgtcttatataacacaaattctcagaattcccatattaccatcttctaaaataaagttttctgttttttaatttataatattcatcaatagaaactgcatcagaaaatagcccatatattaactcttgcatttaagattttggcagaataaaagataaatagccttttaggaaaaaatgtaccctatttctcccccaatacatcgtagatctagggtaaaactactcttttatagaaaggcaaatcaattgaaatatagaattattctatagatatagtgtagtaaaagattagggcaggttggaggcgggtgtcatgataaaaatgtagaacaagggagtaattttatgatgatgaaatgaaacagcctatatcttggttgtcatagtggttccacaaaatgatacatataataaaattgtaaagaattaatacacacataggcaaataaattccaataaaaactggcaaaatctaaaatactatatgtagattgtaccaatgtcaatttcctagttttgatattgtactagggttacatgttacttatggagtaaactggataaagaggacaggagacttctctgtattatttttgcaacttcttgatctatatttatttcaagttaaacgttgaggaaagataacctcttgaatgttttagagtttcttccatttaaccaaagttgtgaattgtttttcctcaagagacctgtttttcacagtaaggttgcttaaaattagagaatggcctaggaaattaggtatatcattaatatcaaatatacttaagtaaattaaaagagcatttaaaaatcattggactgaaatactttgaatcaaattctgaaagagaaacattaccatatataaattaggcaaagattattatgattatttaacaaataaatttagccatgtaaatgctttgtttttttctcatgaacatcatttatattcatggcattgttagtaaaagctagtacctctgtttttatagattttcatttttttaaaacattaacacaaaaatgatttatacagtgtattaaaagatcagtcctctattgcactgttagcaagggctatctaaagcaaataggaccttgagatctaaatgtattgctgcattcatgtgtagatatctaatgtgtacccaccatgtgctagacactattacagaagctgtggtgtagcatttggggagaaaaagaaaacaaaccccttttcctcaaagacttttctttctgttctggggagatggaaaaacaaatacatgtgtttcaggtaaaaatatttaaaacgagatttggtctataaaaagttgtttaaaagacactggtatttaataaagacgaaggaattacttgggtatgaaatggtaattatatttattaatagagcccacaaatgtagtattagcatcatactcagcatttagagaattctcaggagtggagtcgatgcatatcttttttctcacatgccccacagttcctttaccagaggaaatgttccctatatataatttgaatgcattgtcattactttttttttttaacactgctccccttgaagtgggtcttccagtattggagatcaagttccacagtcacctcagtttataggtgagaaaacctatttgaagttaactcgccccaacccatttaatcagcaaatggcaaagatgaatttcagttctggtcctctgactccaagtccagaacactttcagggtaggaagaattatctcagaatatcttttcaaatagatctagcacaacactctcaacttcattttcccagagtcttatatattgatatgcttttcacagatatttactgagtactctgtatgtacatggtttctaggtgctgggggtgagaagagatatagtgaagaatgagacctaggttctgacgtcagtcctaaactgtgaagtagaaattctgtgtgtgcacaaatgattacagtattaatacaagggagaaagtggatcatgccatgagggaggcatagataaagtgctatggaagaccacagaaagatcaactgcttctatttccagacacccaggaaggtttcccaaaggaagtggcttttgttttaggctttgaattgggaggattgtggcaatggaactgaggctgtacttgggataagtacttttatctctccaatatagtaaattcaccaatatcgtccaaaagtttgttcatttatctaactaattactttttttttttttttttttggagacagagtctcactctgtcacccaggctggagtgcagtggcgccatctgggctcactgcaacctccgcctcccgggttcaagcgattctcctccctcagcctcccaagtagctgggattacagacatgcgctaccacgactggctaatttttgtatttttctgtagagacggggttttgccatgttggccaggctggtctcgagctcctgacctcaggtgatccacccgcctcggccttccaaagtgctgggattacaggcatgagccactgcacccggcctatctaacttcttaacctaaatccctgaaccttccaatttctgtagaaatttacactctgaagcagttaggtggattcctaaatttcctagatagtaatatgtctaaacaaattttcttcggtaatacttgacaatactaccccattatcaaaataacttgaagttagctgccaaaaagtccagatttatgccaggctgtcaccatgatgattttaaatttctgcattagtagatattaaacatttccaaaagtgcttaaatttccatccactaatttttttgtcataaaatagagattgcagatgtattttgtactttgaagaatattaagggctgaataaggtggaagcacttacaactaatgagcctgcacatcttgagtgagctacctagagaatgtttctccttagcaataaagaacgacaactgctttgttctagctcagtaataacaataatatcgtagtatgtcctttgggaaactaactgaaatataagttcagataagttcacatccttgtaaagcaatgatattttgctatgttgctttcctacttaaagctgccatggataatgcacaattaagtcaacacatctaggcttaccaaaaataaattcctagattgtatttggtcttatccatacaaatgcttttggtttatgggcctgacaatggaggagattggaggtcagaataatctcataacagttactggttgaaggcctcttgttaacccatcattattgctttgttcctatgacctggcatcagacttacccttctaatcagcagtgcagacctcccccaccacccctcctcccattttaactagaactctgcagggaacctcacacttgcttgactgagccataactcattgtttaggtctggccagttttttctcttgggggcagtaagttcctatatcttaactgccaactcctgtaaagggtaattctccatgatgctgcatggtattacactatactatataatataatactatactattatattaatataatgggaagcaataatattgcatcctgccttaccttctatctagtgtatattttcctaatcataggagctggcttttggatagcgatgccagtcctgctcaaacccaacttcatctttttcttttagatacgattttaggattcttagaggttagagccacatactttccttattctgtgtcccttcagtcttgttggccctttaggttacatctataaagcctaaatatatgcgttttaagttttaattattcactgtgagtttttgtttaactgaattatttaatttacttatatacaagttgaacaaaaaattaagtagaatctgaaagttatcattcttgctttctacttagaaatatagaaatcatttccaaagaaacaactgctttattgtaaccaaggcttgatttagaaaaaaacaatccatgatttttaaatgtctgatgtctgtttggagaattatctcaggctctctggggggaaaaaagaattagtgtatttgattcatactgcccatctctaaacccaattgacagccccactttaatgaaaatgcagcctgactttcctgagtgaatcactatctgattatacaaatggcccacaaatttctctgcattctctatgcctatacttccttcattcttggcagtaaattttagaaaggttgctgattttttatatacatcctatattatagggcatgtgagtgacattctaattttttaaagtaggcaatttagactgttatttaaattataagtttactgggtatcagcattatattttcttagttctttaaggaggtatttcagtgagaattttttttttttttttttgagatggagttttgctcatgttgcctaggctggagtgcagtggtgcaatctcgcctcaccgcaacctccgcctccctggttcaagcgattctcctgcctcagcctcccgagtagctgggaatacaggcatgcaccaccacaccaagctaatttttgtatttttagtagagacagggtttctctgtgttggttaggctggtcttgaactcctgacctcaggtgatccaccggtctcggcctcccaaagtgctgagattacaggcgtgagccaccgtgcccggcctcttctacccattttattttggccatcattgtacaatattttgatccttgagttggataaaaatagaagacatgcttttcaaatatatggattatgcaaattaaagtaacagaatagagatttatgaaccactctcaggctagaaggaagtgacaatttaataagagaacatttaataaggatacacacagaatcctgttcttggtcacagtagtgcactgcagaaataaagaacaaggaagatgccgctagatttggcaaaaaagattttaggttttttttttctttttttctttttctttttttgagatggagtcttactctgtcacccagactggaatgcagtggcatgatctcggctcactgcagtcaccgcctcccaggttcaagcaattctctgcctcaggctcccgagtagctgggattacaggtgtccgccacgacacccacctaatgtttgtatttttagtagacacggagtttcaccatgttggccaggctggtctcgaactcctgacctcatgatccacccacctctgcctcccaaagtgctgggattacagatgtaagccactgcgcccagccagattttagagttttcatgcattggtaagctcagcataagttgacagtttgatgtgactattaagcaggcaatggcaattgttggccactttaatataaatatattccctgggtcagtatttctcagagtggcttattgcatcaaaattacctggagaaattgtaaagtatagaatgcaagacccaacaagttatccactgaaacgaaatctcttggtgtgggatctgtatttttaaaaaaactttcaggcagtttttatgcaaattaaactttaataaccattaaaatggactaagggcaattttgatgctattctgttttatcctgttttatcactgcaggatagttgcgttttactctcttgcttatactttaagaagggtgtgaaattttggctgcattcgggaaaaaagcaactttacaaaaatggggaactaattcatgtccatgagtaatgcatggagaaaatggaacttttacatatttaggatataattgaacaattaaataaattatggtggttaatttgactgttattcatgaatatctgataaatatccactaccataaagagattgttgtgaatatcagatagtaacatgagaaaatgtttgtataaataacgttacacaaatattttgattacaagtgtctaaaaagaagatgcacattaaataacaccagaaaaaatacacccaaatgataagtggttttctttgaatgatactataatcacttttttttttgcaaaatagtctctgtttatgaatatgctcttatatacttaaattaattttcaaagttaataaaaactatgatattgttaattacctcaaataataaagtatactgtagatgagcagttcccagtctttttggcaccggggactggtttcatggaagacagtttttgcgcagattagggggcggtgcagctgatttcggggtgaaactgttccacctcagatcatcaggcattactaagattctcataaggagcacataacctagatccctcgcatgcgcagttcacaataggtttgctctcctatgagaatctaatgctgctgctgatgtgacaggaggcggagctcaggtggtaattcttgctagcctcctgctgtgcggcctggttactaacaggccacggactggccctggtctgcggccttggggttggggacctctgttctagatgataaaacattatttttttctaatacaggcaaatataaagaataatggtatgaaacgaatggaagtaaattctgactggatttaggaaaaaattttttctgggtctcaataggatgtgataaaattcacttatttaatcatatgtaccaagttctactttttaaattttgttgaagcaaatgcaatttatactttttttacaccatattcattaagtacctactgtttgttcaggatatacccatggctgttttgctatactgatggaagtttataaggctatgtattaaataaataatgttctggtttttaagttgtgtatttagaacataggcctgaaagcaaatgcttgtgtaaaaagaaaaaaaaaatccaacagtcaaaaagtcaggtctatgttataagaaatacagcattcctggaaaattgcagtgctttacattgcccagatgttatcatcgctgttgggttccttggcagagtcattcagaggctctgcatagctaatactatcatggttctctgtggcacagcccccccttgattgcatttagtatcttcttcctccagcttggggcttagcagtttctactcaaaaaagtgacacagcaataaaatttgaaaccatagaatgatcactcatcctagtgatgtgttatttggcatctttgaatatatgactattgcaaatagttcatttcaaattttagcagattgttttttctcaattcaaaatcacattgaaagggggagagaaaactgccacagtggaacgtttgcaggtactccattttttcccaataaaataatgttttatcataaattcagcatgtgttaagattgacatatttatagcatatctgggcaggatatagcaactagagctgtaatgattgctttctctactataaaaactatgacgctcatattaatacttaagacatatttatattattaagctcacattaatattaccataaaatatgacagtttacaggccatgtattactacacgggatttttcttttcttttttttcttaacttttattttaagttcaggggtatatgtacaggtttgttacatgggtaaacttgtgtcatgggggtgtgttgtacagattatttcattacccaggtattaagcccagtacccagtagttatttttcctgatcctctctctcctgccaccctccaccctctgataggctccagtgtgtgttgttcccctccatgtgttacatgggaatttttcattcactcttttactcacttcatgatttttggtatttgattaggagcaagaaaaacaaggaaaaatagatacagtgtctctttccatctgacattttccaatgcctagagtctataattctatctttcatcctattagatatcataatccagaatattatttaccaattttatgtcttattaactacaagtatatttagccaaatatttgcatagttatttcaagtacatttatatttattattttatatttttcattgcctattttgaaattatattttttaaatttctaaaataaaattaattttgataactgtaatttttacattggtaacttttgtgcattttgtcagtttttatagtcattgtaacacatttaaaaaaaaatatgacgttgtctctgttttttaactaaaggcaatttacattaccattaacaaggatttgtatatttttaagtcataatataaagagtcccttccagagagtcctccattccagtaacatacttaggaaataaataatgcatatgcaaaagacatagaaccattgtcaagatagcactttccgttttctttctttattgggcagacctatacacagttcaatttgcattaaactattttgactttagtataatcattattgatttttttttttttttgagatggagtttcactcttgttgcctgggctagagtgcaatggcacgctctcggctcgcggcaacctccgcctcgcaggttcaagcgattctcctgcctcagcctcccgagtagctgggattaacaggcatgcgccaccacgcctggctaatttttttgtatttttagtagagacgggatttctccatgttggtcaggctggttgcgaactcctgacctcaggtgatccaccagcctcggcctcccaaagtgctgggattacaggcgtgagccaccaagcccgacctattgatttctttttaatgaagtttctaggtttaaatatgattaagtttccctaccactgtaaaagaaaagttttgcatcagacacttgatacaattggcaagacatatgcaaactatgcaaccgacaaaggtctaatatccagcatctatagggaactaaaacaagtttacaagaattgaacaatcctataaaaaagtgggcaaaggacatgaacagaaacttttcaatagaagacagacatacagccaacaatcatgaaaaaaagctcaacatcactgatcattaggggaatgcaaatcaaaatcacaatgagataccatctcacatcagtcagaatggctattatcaaaaatttaaaaataacagattctggcaaggttatggaggaaagggaatgcttatccactgctactgggaatgtaaattacttaagccattctggaaagtagtttggctgtttctcaaagaactcaaagcagaattatcatttacctagcagtcccattactgagtatatacccagaggaatataaatcattctatcataaagaaacacacatgcgtatgttcaccacagcattattcataatagcaaagtcatggaatcaacctacatgcccatcaatggtagactggataaagaaactgtggtacatatacaccatggaatattatgctgccataaaaaagaatgaaatcatgtcctttccagcaacatggatggagctggaggccattatcctaagtgaactaacacaggaacagaaaaccaaatactatgtgttctgacctataagtgggaaccaaacattcagtacatgtggaaagaaagaaggggacaacggatgccaaggcctacttgaaggtggagggtgggagtaggatgaaggttgaaaaactaccttattgggtattgtgcctatctgggtggtgaaataatctgtacatcaaacccccatgacatgcaatttacctatataacaaacctgcacatccacccctgaagctagaataaaagataaaacaaaaaattgtcaagacagactactacaacaggggagaaagattttagtacagaactgagatctgtactaggtgagaggatttttaaatgctgaagtatagtaacagaaaagtaccgaatggcactggggaaggagggaaatttgtccaatgtgattggaccatctatatgtggtcattgccccatttcaaagttaggctactaccatctcacagagactggaagatagggcccctatctttatttgtttttattgatacacaatagttgtacacatatgtggggtacatgtgatattttgatacatgtttacaatgtgtaataaccaaatcagggcagttgggataaccatcacctcaaatgtttatcttttttttgtgttgtgaacacttcaattctttcaagctgttttgaaatatacaaaaaaattatttttggcagggcccagtgcctcatgcctgaggccaaggctggtggatcacctgatgttgggagttcgagaccagcctgaccaacatggagaaaccccgtctctactaaaaatacaaattagttgggcgtagtggcgcatgcctgtaataccagctactcaggaggctgaggcaggagaatcgcttgaacccgggaggcagaggttgcagtgagctgagatcgtaccattgcactccggcctgggcaacaagagcaaaactccgtctcaaaatatatatatatatatatatatatatatatatatatatagttaactatagtcagtccactgtactgtcaaacactggaatttattttttaactgtatttttgtacccattagtcaacttcatttcctccccctctctctaccaccctcccaagtctctggcagcaaacattctactctacctccatgagatccaaatttaagctcccacatatgagtaagaacatgtgaaattgtttgtcattttgcatcttcctgtttcatttaacataatgacctccaaatatccatgttgatgcaaatgacaatattttatgacttttatgactgaatagcattccattgtgtatatacaccacattttcttcacccattcacacatcatttagtcaactgcccgttgatagacacttaggtagattccatatcttggctattgggaatagtgctgcaagaaacaggagtgagaatatctcttcaatatactaatcgcctttcttttggatacattctcagcagtggaattgctggatcatatggtagttctatttttagtttttctgaataaatttcttacagttctccacagtggctgtactactttacattcccaccaacagtgtacaagagttcccctttccgcacatccttgccaccatccactgtttttgtctttttgatgatagccattttaactgggctgagatgacatctcatgtgcttttgatttgcatttccctgataattagtgatgctgagcattttttccatatacctgttggccatttgtatgtcttcttttaagaaatgtctattcatctattcaggtcttttgcttatttttaataggattatgtgttcctatacgctctttgtcaagtgatgttatgtattcatttaatactcaactataatgattaataatagttgtagtaattatatttttcctataagtaaaataaaattagacggatatattgtattcctatacataatcctgttatgagttccctatacattgtgcttattaatccctttgtcttttgcaaatatttactcccattttgcagcctttctcttcactttgttgattgtttccttcttgatgattacacttcaaagggatggttcctaggcccttgagaaattcattcttgggttgtagaagattcatctcaaacagtcagaggatttataattgcaaggttcctaaactaaatgctctaagaaacggaggtttgggttggaacaaagattaaaattttttggtagcattgaactttttcaggaagaaatttaagggaactggtgtcagcatcctagggacttggccctgagttgttagaaactatgctattatttgttcaagtctcttattatggggggtagacaaaattgtttgtactgaaaattgcagttcccatagaccaaggttgaggcctagccgaggagagagttcagaggagactgacaaaagttggtcaaggaaagagtctttttcactgacccttcaccttaggaaaattgcctgcaagtaatggcttatattagtgaatgtaaattttgtaaatattttacttttctatacttatagttgcaattcaaacattcgaattaaagaaacaagttgtgaatttaggccataatatttgattttatacattctgtgagattctcccaaaacgcatgccatcccagtgtaagcctggtcatatatatattgatgttatatagcatgttatcagctacattttgcataatcagtgtggtagattctggattcagagttcatgacctcaaaaattgactccacctcttatcaactgtataacattatcaaattgattaaactgtccaagcttcagtttcctcatctgcaaaatgggcattatagtaataggtattgcataaagtaactgtgaggattaaatgatccaagtgctttgcagaattcctggccagcagtaatgactcaatagatattagtttctttttattttattttattttttttattattattattttttttgagatggagtctcactctgtcgcccaggctggagtgcagtggtgtgacgtcggctcactgcaacctctgccacccgggttcaagcgattctcctgcctcagcctcctgagtagctgggactacaggagcatgccacaacacccagctaatttttttttttgtatttttagtagagacagagtttcaccatcttggccaggctggtcttgaattcctgacctcgtgatctacccacctcagcctcccaaaatgcatgctgggattataggcgtgagccactgcgcctggccgatattagtttctataatttgtattagatattattagtactgaataagtactagtggagaaagtaattacctgatctatatcattaacttatttgaaaactcttgaaaataagagatttcagtttttatttgaattttcttctgtcatttgctctgtatacttgctgttcttagcccattttcctttatttattttgtgtatgtataggataattaatttaaaatgtgtcatatttaaaagaaaataattttatcagttaaatgttaattctgttttttttcaagaacaaagacatcttttcttctgattcataactcgcctgagagggagtagacctttgagtatgtataacctatatatagtctggcttatttattaatagaggtttattttaaattataattgaacacagagtttaggaagacaattacatttgagattgctaatcttggggtcagagaaacttgattgcatacaattccaaactctttgtcaagtgatgttacgtattcatttaatactcaactataatgattaataatagttgtagtaattatacttttcctataagtaaaataaaattagacggatgtttacatggattatctcattgcatttttacataaattacataaaacacattttccccctgaaggaaacagtaatatatacatatgtatacaagtatttgtaccattttaataccaaatagatctagtttttaaaagatatatgtactgaaaagataaaaaaatgtaaaaattggaagggataattattgaaaaataaggtgaagatagtggtaagttaatacacaaaatacatgccatacagttctggaaactttgctgtagttggcctataagtgtttaacctaatagtcacatacattttattgatggatcagagactattttatttaaaacgctttcccaaattcagatgtcatgaattcacatgccttccagtcctcaccccaagggctagaaatgtgcttttatgaagtctttcttgcctttttttgtggagtgggggcaggggggaggattgaaagagggaatggtactgcacggctaaatttcaaaattttgttctgtaagtggaattttaatgtattcttcattttctaaaatccaagaaacaagagaggccataaactatttcctcaaataaacttagaaacacagagacagttttgaagtcatcaaagataaagtaaaataacataaatgattgaggttgaattatctgcgaaaagaacaaacatactttacattttgccatatcctgggtcatgaagtcaaaatgaaatagtcattcaagatctaaactctttgaaaactctgtcagccaaaatttcgaattttgaccatgtttgctaagcatattgccttctaactcaaaaagcagaaagagcaatgcttatttttaattttcttgcactatgtagtatttcattacatttggccagtgttgtgttgagaatgctcctgaacagttcaatggataactatatcaccttaatttctttcttacgagttttagtgtggtttctcaagagaaccattatacccatgctgacctagcatgggatatactagaggagtatgtgtgcttggttatctgagacagtattcttttatcatatttgcctgtatttcactgctttgacttcattatagatatcttatatagactgaaaaatcatggacttatgaaggcaacaattcataccaaaaataaagagtgaactactaaattatgttacaaatgaaggaagacgttaatatcaaagcaaaacttcctgtcaacacgtgagcagtataattctaataagcagttaaaatagcttaagaacgtaaaacttgggttttataaatacatatatatttgtaaatattgatctggatagttattttaagctgctttgaaatcacatttgttccctttggaaatatgcaagagagacaattacttgcctctcagtggactattaaggtttgcctttgcttatacctggtacaaaataactatatatctgatgtaagcaacagagatatgttatgcaagagtagatacggtatgagcagaatcatgcaaataagattcatattagaaatcttgtgtcccaactctggtttgtcagtggtgaaaacagagttaacaggtaatgcataggttcccaaattcctgatgaagtaacatctctctaaactacagatcaaacctccaacagactcagtcaacaaaagccataagtctaaaaacccaaaatgaatttggcaatgagaaatagagcagcgagaaacagtactgggcctaaagagccagaatccattgacttagaatcatttttagttggttggatttaaaagtcttaggtaggggccgggcacggtggctcacgcctgtaatcccagcactttgggaggccgaggtgggcggatcacgaggtcaggagatcgagaccatcctggctaacacggtgaaactccatctctactaaaactacaaaaaattagccgggcgtggtggtgggcgcctgtagtcccagctactctggaggctgagccaggagaatggcgtgaacccaggaggtggagattgcagtgatccgagatcccaccactgcactccagcctgggtgacagagcaagattccaaaaataataataataataataataataataaataaataaataaataaaagtcttagctaatctttcttcattagtacttctcagagtataggaagaatacattaaaaactccaagcaaggggtgggaggtctaagatggagagtaaagtgttggcagtagacatcacacagtatacagccaagcatttttggccaacttcctgctttaggataaagaaggcatcatttttcccatttgacaattgagaatgttgagacccagaaatgatagataacttacaaaggttatacagcaagaaagaaatgaaaatagtagtagagcctgattctcttaccttctatttagcactctttcccagatgccatgttgatagcactgcctaaaatgtgtctagtttcgtacttttgtcattgttttgatataaggtgcagtgggtcaagagaaccatgatattcaattcgtgacatttaatctatttttattttgtttctatgtgtgactgcatgtgtatgttcttttttctgcatactgcatttcatttccactctcctccccagtacaaacattgtgttttaagtataaatttttttatttgaatggtgtcctttcaaagtatgaattgctttctgtttgtgaattataatttatgtaaaatacattctgttagatatttcatttttcatcttgttttctcactaaggtttattatttgttaggatccttccacattgctatacacctactctatgacttctcacttcatggtgtgtatatattgaatctccatgaaaattgggaatagcgaattccaagctatttatttccttgccaggcagccccttggctaggtgcgcttatacaggcacaagctatgcatctgtacatatctgcaatgaagcccatggttgtgtatccagcaaattttgcctctttggccttgatggaaactcaggttacttctagctctcaccattaccaatagcactgtaatgaatagccttgtatatgtgtcttatgcacctgcgtgaaaattttcctgggataaatgccaattgtagaattgctatgtcaaagggtatgtatatacttaatttgactaagtagtaacagatggataggcagattgctgctgctgtctaccctaccaccagtagagcaccaaggctcctatgtcaccatatacatgtggttggttccttttgtatttcatatattcttgccttgtttctctagctgcagtgaaggaagggaccattttaaatggctcagattataaatcctaggaattattaaactaccagtgaatatacttggcaggtgaaagtcaaccaactttcaaagtggttcaaattaatcatgtgttttgtgaggtataactgttgtttaatttgtgtttttagagctaaacaatgttctcaatcagacccaacttagagttgttttgcttttatctctgatttgtttctttctttcacccaattaaatatgatttaattttacccattatttgctttttaaactaagacagaatgaaaatgtcaaaaataatatgacgcttctaaacctgtcaagtatgaatgtcatggatcacgaggatttactgttatattttgggaagttggcataatataaatcgtgacgctcttctgatagaatgtgtcatcactttaaacccagatgtctgaattttacagcaaaggactctgaataaggaaattcttcccattgatctgataatgttcaaatatatcttaaggaagggatagtcaaatgtgcatcatttaaatgtgatcttagatattttaatctattcatttaatttattctttactcatttgcttctctaataaaatgaatgacaataatctaacttcagccagcttcagaaatgtattcagtcatattatcatgaaatatgtaattctcatgagtgacactgcctggcccactcactgtgtcattgggattgccctttctctaagctcgcatgataaaatgtcattccaggtgcaacttaagagtcacgctccccttgtcctttacaataatgctaggtaaatagcaggaactcagtaaatatgcaccaactaactgataggtaacttttaaaatatgaaatcttctattctttgactctgtagagaaagtgtttttcttcagctctatatgaataccagatatttactgaatgttttgccacgtctcagtcttgcatttgcacgtccgcacactacttttatgccatctgttgtctttcgtcattcaactgcttatataggtgaagaataaaaacggagagtgacagattagctgtattctatcttctaacagtttattataacagtttagttagctttcatcccttcttaaacacacacacacagagtgagagagagagagggaaagagaaagggagagagagagagagagagagaaccgaaacaaagtattctctcactttcttctcttttaaatataattaattttagtaaccattgtgggatagaggtggggccggtctgagatgaaaacaaaaattgagcaaaacagccataaattgtttgtatagagtgagcatctcattcccaattatttgttcaatgctattgacataaagtttcctgtgttctaaagaattaatggcatcacatcctcttgactgtgctgttgcttacttggccatgggtgtcctgaagtaggtgaccataaaatgtattattgaaattggggcaggcttttagctttgttaataattctgttgacaacaggggtgaaacaagacatatgcttatcctgccctcaggaagcatcagaatgagtagcttttaaattcgctgccaccatgatgacttgaaggatcagaaagcctcttatacttgacgcagaaacattgtagaacacctgtaaagtggccaaggtagtggaaaaaacattcaattgggagtagttaaacctgtatgatactgaaccaaggagcaaaatgatgagtctaaggcaaggagaagtcagacgtagaattcctaatccgtacgagactgtacctcgtcaagcaaaacttgggagttttaaaatgaaattttggaagaaatgaattattacaatagcaataaccatttttgttaccatcctggttttcctgatctctacatattggcatgccctggattcagtccttggtgtcttggatcttccctttctatacttacagtcttatagtctcagaaaatcaccttatatatcaatgccctcaaatttacatctgtggctcaaagccttctactcatatccaaacttggatatacaacttgctactcaacatctctaacagtaagtcagtggacatcttcacatgtcctaacctgaactcctgtccccccgcaaagcctgtgactttcaatttttaattgataacaacttcatctgtgtttgctcaggctaaatggtttggtgttgccccgacttctctcctcatttcacatcccatccctaataaatcagctttaacactaaaatacagctgaccctcgaataacatggaggttcaggggtctggcagctccccacgaccatgcagttgaaaattcatgtaaaacttaggagtccccccaatttttttttcaaaatggagtctcaccctgtcacccaagctggagtgcagtggcacgatctcagctcactgcaacctctgcctcccaggttcaagcaattctcgtgcctcagcctcctgagtagccagaattacaggcgcccaccaccatgcccagctaatttttgtattttaagtagagacggggtttctgcatgttggcaaggctggtctcaaactcctgacctcaggtgatccacccacctcggcctcccaaagtgctgggattacaggcgtgagccaccacgcccagcctgagtcccccagaatttaactactaatagcctactcttgaccagaagccttactgataacataaacagtctattaacacatattttgtgtattatatgtatcgcatactgtattcttgcaataaagtatgttagagaaaaaaatgttaagaaaatcataaggaagtacaaatatatttactgttcattaactgaaagaggatcatgatataagtcttcattatcttcattgtcatcttcaagttgagtaggctgaggagaaggaacaggaggagttggccttactgtttcacagatggcagaggcagaagaaaattcatgtgtaaatggacccgtgcagttcaaacctgtgttgtccgagagtcaactgtatattcagaattagacaacttttttttttctttttttgacatggagttttgctgttgtcttccaggctggagtgcgatggcacaatctcggctcaccgcaacctctgcctcccaggttcaaatgattctcctgcctcagcctcccgagtagctgggattacaggcatccaccaccacgcctggctaattttgtatttttagtagagacggagtttctccatgttggtcaggctagtctcaaacttccgacctcaggtgatctgcccgcctcagcctcccaaagtgctgggattacaggcgtgagccaccgcgcctggccagaattagacaacttctaatctctattcccgatcttcatcactgttatgatctcttgtctcaattactgctagagtttctcaagtggtctgaaaatcagcactttctacccatgcctcaaactgcctagtctttgtatagtaaccggaatgttcctctttaagcaaagagcagaatgtgtaattgctctgtgcccactcttgcaattgcttccattgcattccaaagaaaagctagagtttttacaagagctagtaaggctttttataatgtggcctcctgtgtcctctctaaccttattcattattctcatctgcagtcaattcacttgagccacagatgcttcccacatacatgtctgtgcatgccttggggcatggacactgcttgttctttctcctttcttctggaggctgtccttccagatatgccagaattaactttttcatcttagtctttacttcgatatattcttctcaatgaggccaatttaaaattcaagcgtaacttcccccacctccagcacctacctatttcccctacaattttctttgatccataacatttatcatcctcaaatatactctgtacttgatttatttttaatgtttatattacgttcctccaacaggaatagaagctccataagggcagagatctttgtcaattttgctcatagataattcccaagtacctaggacagtatctactagatgcttataaatatttgcagaatgaatagataaagtaagaagcccagtgatgtcaagaaaatgaattaccctctgtgcacctcaagttgtgcaaactaaaaagattaaataaaatggtttctatatgtcaaccaagcgcacatgtgtacattttgtgtcttgtggggatcctgattcagaaatcaaatgcaaaaaaaaagaaaaaagagagtgagatactaagaggtatttgaccatggcttgttattccattattttaaaaaattattcttatgtcaatacatgtgataatcataagccctttggttaagggcttatgtgtttgggatgcaaaatgaagtatttagaaataaactgatatgaaattgaggatgtggttttaaatattccaggaaaaaaaataagtgaaaggaataaatcaaacaaaattggcaaatactgctaattgttgatgaggggtgataggtgcataggagtatattgtagtgttctcattacttttgtgcatgtttgaaatatcccataataaaagaattaaaattggtaacctctgaagtccctcactactcaaaaaatcttttattagagccatcattttataagtagatcatttgtatcagatattaagaggatcattgggatccccgagataattccacagtataacgaaaacataaaggaagataaagagagaaaatccaatagaatgtcatttataaactaaaccttcaactgtaaatgatagttgttctaaactgtggctctgtctaaagaattttacccaaatttccattcattgtgaataactaatgcaagtaaatgggtaaattatgtctgtatatttaatcattgtacaaattatatcccataattccattagcagaatggagtacaaacttttttctaaataagtccttactaaatagatttaacagcaataactatgcaatttgactaagcaacaaactgccatttaaactatatattactatataatataatatgtcattaaaatataaatactaaaggctgtcaagatttttttttaaaggattgggccaggtgcggtggctcatgcctgtaatcccagcacttcgggaggccgaggtgggtggatcacctgaggtcaggagtttgagaccagcctggccaacatggcgaaaccccgtctctactaaaaatacaaaaaaaattagctgggtgtggtggtgtaatcccagctacttgggaggctgaggcaggagaattgcttgaacctgggaggcggaggttgcagtgagccgagatggcaccgttgcattccagcctgggccacagagcaagactctgtctcaaaaaaaaaaaaaaagattgtttatcttctatgtgtatgcatattcatagattggtatagatataaattgtgtaatgtggatatacaagtaatgagacactgttacatgaataagttctgaatcgtgagtcattttgatgataaaacatagaggagaaacagatgagatcatggatataacttgtttgaaaatggtctcatcccataaagtatagagaggcagaacattataaataggacagttaggtgaagaaaaaaatatatatgggatttgacacaagggcaaaatattcttattaattgttgaaaatctaggaaaaataataatgaaaaactttaataattgagtaatttaaccatgatttcttgaggctatgtctttttttatgacaaaacatgctgatatagaggatcaaaattagatcatagaaatcatagagacagcaaacagcatttttgttttctttgctgtcattttgttatcttggcttcagacttttttatcattgttttgtttattacttatatgttataaactgtctcccctggcccccaatctcctgaaagttttagaagcttgatctggtccattctctgcttgaaccacagtaacaagtatctcctggcccctccttccatccgcaaagttggattaaatcctacattctcaattgaactcaaatgaaaatgatcacttcttccttaaacattaactctctcaacaaatagcttcagatttatggtcttaatgagcctttcaagcatgttttgttagtcaacgaaattggactttaggcttatttgtttctttgtttttttgttgttattgttgttgttgttttgttttttgttttttgtttttgttgagacagggtctcactctgtctcccaggctggagtgcagtggtgcgatcacaattcgctgtagcctcaacctaccaggctcaagtgatcctcccacctcagcctccttagtagctgggactacaggcacgtgccaccacgcctggctaatttttttaatttttgttttgtagacatggagttttgccatgttgcctaggctggtctcaaattcctggactcgagcgatccatttgccttggcctccaaaagtgctggaattacaggcatgagacactctgcctggcctgtttcttgtattttctacagcagtgattttcaaacttttttgatgtattgacacatatacaatactgtaacactcgtgacacctcctggagttttgcagcactttgcctacaaacacctgcaactcaaacaaaagttcgctgagctaacacttattttcactatattctcaggtaagaatccaaccttatggagggtggcaaaggttaagatttcaaaggagatggctaagcaagcaaaatgttggcctgtcacaactccataggtgctcaaagtagacaatgagattcaatgggttagagcatgagtctttaatattcacaatatagcaaatagcaggaacagtagcatggtagtaccagttcctctgcctcaagtattacgaggtgacacaagaggccaaaacggtgactatgcacacagtgggttgtgctgcagctggggaatacagggccaaggtctcaccatgtagtaaacaactaacaagacagtctcctttccctggagagaaaagccttatggtagtcatgctgtggtcacttttacctaattaattgcctacgtgactagctacagaaactgctcagtaccatggtatcaagggatgataaagccttagaatttgtcacacttaaaaaggacaggcagggttgtttatcgcccatgatggactgcccttttcaacaaacctgtgatacatgattgaattgtttattttactccactttgataaaatgctagtctagaccaaatcaattgacttcatgacccaataatagatacaactcacagtttgaaaatcactgccttagattcctagtaaatgccttgcagattctaattcaaaaagccattgttaaacaccaaatatttgccaggtagtgtgttccatgctcagaagacaatgttatagctgttacagcagaagaatcatggtctttgtaacaactgtagtttaacttcccattttgctatttatttagtcattgtttagtattttggtctttattatcttattttgttcttgcgaagttaaaacatgataatcttggtgaggcaccttgtgcattgccaggtagctgccaggtatttatcttaaataatctgccttccatggatttctttgcagtgaaatattacacataagttaaagaaaaaatattgaagtggcactttaagaaactgcatgaaaattgaaattactgattgaactcttgaacttagaaaacacaaatcatctatattaaaatttatacattttttctctctctctctctctctctcacacacacacacacacacacacacacacacacacacacacttacttgtattatacaaaagccagttaatgagatgtaaaataaacttgaagcccgatgtggcaaagaccaaaggaaacagaagaaagaaaaatctgagattaaaaaaataaatttgtttttccttatatcctataggtagctttgaaactttgtgtaattgatattacttactattcattaattttctggttataattctttaaagacaaagtcaatcaaaatgttatgtttgctgttttttgtacagaaaaaaatctcatttgtttcctctaccaataaaatgccatgacaatgtagaataaatatataatttacttcatagtgcaggattatgctgaagtatacatgaaactattgtccaatgaaactgctttggtatgataagtttttatataaatatcaacctggacacatccggtataatttttattttgtaatgtttggcttaaccagtgcactctctttgttaccatttacaaatgaccatgctagctatttcttcagtctatggagaaacatggaagcctaaaatatttttttaaatagctatttcctcatatctcctaggtaagacatatccaaagcacgacaaaagaaagctaccctgtctttatattaaatcttgttgaggaatatttatagcatcccagagttataactattttagggtgacaatgcaactgatgttgagcaattatgttctgctgctatatcctatgtctatggtcttaattattaaaaaccaagaaatataaacctaaaattgttgactgctacctaaagataaagatcattattaaaatactgatgacaagaagtttcattattaaaacaataatgtacaactatggattcactttaaaaacttggtttattcatctgtattcaagaaacagagttaatatcaaagaaggcaaagaatattgaagcatattaaggaatgctgtgatttagcatttgtagtcatgttaatggcatcagactataaaattataatattccctcaatttagccacgtaaaaataaatcacttaatgacaaaagtacatattttagcaatctgggatttcatgtggaagaaatattgatttgccactgcatctgcatgtcaactcacatacttgagtaaaaactagtatttctgagaagacacgaaatcactttgaacctattaaaatggacaaaagtgacaatcagttgatgatatgaaatgcggtcttttgagccaaactttgacaatttataattttctgttgtgtgataaattttaaatggaaacagttgcataactcactagagtcagaacatacattataaataatttagtccataccctttgattaatcgataattgggaaataagtgaaatgtcagaagtctgccaagtagttattgggtgagccaagactcaaatctagataaagtatttattctactatacaaattaatgtcattaaaattattgctttatttatgtattcacgtgaatattctctaagtgtttttaaacacttacaatgtaccaggccctgtgctaggacctggggataaaaatggaaaagatatgggtctgtcatctagagatactgtggtttagcaagggagtgagctactaatatgaagaaggagaaggagaaggataaattattatagtacagtatgataattgtgctaaaagtcatcacagagttctaggattgtgcccagtaccctttgactagtagagaggggagaggtctcacttgaattacatcccttcttatctggactgttgcatcttgaaagatctcgccacttccagtttgaccttcctccaaatatttcctccaaattgctgctggggtggtctttctaaaatctgaaatttaatcagagcactcacctgtataagaaccatcagagtttctccatttcttcaaaatgaagttcaaattcattatcttatcatgagacctttcatgatctggctttagtcaatcactccagccttacttcctgctactctttcagaaacattctccaattcaaaagcatagatctacttatagtcacctctaggtctgggtcaaagagcttgagagcattgtagctcgaaggccaccattaactcaatgaaatcagcagtaatctttaaagaaaaaaaaaaaagaaaaattggcaataggagtcctgtgggagaagttaaagtttgtaatagtgactaagatgatagggagagaggaattctgggccgttaataaatcaatgataaggtacagttagggctaagcgtgcttttgtttccctaataatttatgtgtaatttaacaactaaattaattgaaaaccatgtttgaatctcaccttaccaactgcccacctggttgaaaattaaatactattgaatcttaaagacaggtattttttagaccaatttatatattttgctgttcatgttatagatttcaatttgacataataattcaccacaattaaaaatgttcttgaagtaaaagatatttacatgtctaacatatctaaatagcttgaaaaattacatgaaacattagtacatttttggagactcttatcttgcccttattttccaaaggataagttcttgaaattgagtaaacgacagaaatagcatagctagattataattttgaataatgctgaatactttctgatctggaacctgtaaaacgtggctgtagtgagggagctactcttggttgcacaagggaattgggaactgattgtggttacgtgaaaatcgtaaatgtcggatctcagtttaattgtggtagaaatatgtggtagatgattctgagtattaaacagctgtgtaaatattggaagagcagaaaatctaacataatacaacaaatacatagatcttctgatgttcttctttttaaaaagctgtaaattaaaatcctgtgtaggaaaaataaaggtaagatgcagtgtacaaatcagggtttctcaactctggctacacattgcagtcactcagggagatttcaaaataaactcatatctgggtcccactgctagacattctgcatcagttggtctgaggtaatggctaggcattagtattgcttttcttttccttttttctttttaagatgtagtctcactttgtcacccaggctagagtgcagtggtgcaatcttggctccctggctcaatgcaacctccacctaccgggttcaagcgattctactgcctcggcctcctgagtagctgggactacaggcacccgccaccacgcccagctaatatttgtatttttagtagagatggggccaccacacccggccttagtgtatatctgtttctgctgtgcaacctgagttgagaactactggttaacatagatgaaaataaggttcatatatttcagttataaaaaataaggcagaaaacttatccaatgttattagaatttttccttgcatagctatcatgcaatgatgtagttaacaaaaattaaattgcttacctgcaattttatgatgaaactgaccaaacacaccttccaaagatcaatggaatgaaggcaaaatcagatagaagtgtatttcactgtcttttgtgatttcacctctacctgactaaaactactaatgctcaggagaacgaatcaactgacagtgcatttttatataccccgtgaaggtctcataaataagacatggctgaaattaggtaggaggaacatttatcttgaaaatccaaaattcctaaagcaagggatcatatactgcatatgttaccgtcattatgccaaaggagcaatgtatacacacacatacacacacacacacacacacacacacacacacacacacacacacacacacacatatgacagacttctccagctctctgaactacaagatgctttataaaaccttcacatgggccaggcgcagtggctcacgcccgtaatgccagcactttgggaggccgaggcgggcggatcacgaggtcaggagtttgaaaccaacctgaccaacatggtgaaatcccatctctactaaaagtacaaaaataagccaggcgtggtggcatgcgcctgtaatcccagctactcaggaggctgaggcaggagaatcgcttgacccaggaggcggaggttgcagtgagccaagatcttgccattgcactccaacctgggcgacagagtgagagagcgagattccgtcaaaaaaaaaaaaaaaaaaacctgcacatgtatatatttcaccaaacaaatataagcacaaacaaaggaatgcagctgtcttaaatagtccccatctatttggtgtagatgtattgcaccatttttccccggtgcaagaagactagacatgtttccaatagaggattcacctcaaagcgttcagctttgccaccatcaagaatatttgaaagaatgtgccacacaaacacaaaaattaacacttattgtgaggccacaaacgttagctgaaacctcatttctgcctaacttctataaatattggcaatttcattgataaaattttgatacttttccagcttcctaggattcttgttaggattaaaaactaagctccctgaagggagagggttttgattattttattacctgctcccaagcctctggaacaatgtttagaacttaatgctaggtcaatatttgttcaatgaattattggaacataaggacatatgactgactaccttgcacttaggagttgttcagaaaattgtagttagtattatttctcttttattttattcatttcaagagatgcttgcctaacttgagttgccaaaaaaatgagatgggatactaagacagcggaaatgggtccttcaaaaagattgtctgtttctatattgcaatgatatctgaaatctgatgctgtgataagaaccaaaaacttatcaggggtggaaggattttgccctgaatgagaggaggccccggtgaagatggtgtcttataatatttggtcatcatatgcagggctggcatcttttaaagtgtagcagttttagacctagactgaaaatccattatatgtgtcgtattccaacctcttcccaaacaagactcggattgtctcctatggtttctggtcacaaaacagataaaataaaaccatccctcctgttaccctattcagaaactctgatagcattcttcatatctctcattctcaatataaatcactctccaccaaaatttgtttattctccttgtctctactcagacacctgcccaaccctactcaatgtaatattttctatatgttatagccagaatgatctttcataaaggtaaagttgataagtatcctgaagttttaaaaaaaaatggtacattctctttgcccttgaggtaatgtcagcatactttaaaagacttacaaggtttttcatcattttgcccctttggactctataggaaaaatacgtgtatgcacacacatacacatatgtgtgtctattttcatttatgtctaactgaaatttagtatttgcttcatttggaaatactagccacactaattagtggctattgaaagaaactgttactttatcacttgaagttacaaatattttcttattatattatggtttttgtaggtttctcagatattatttgcattcattgtcactccaaaattaggcctgccactatctcctgtcatgtaagtgtcaataaagaattacatgttactatattgcaaattcattttattactttttttttttttttgagatggagtctcactctgtcacccaggctggagtgcaatggtgcgatctcggctcactgcaacttccgcctccccggttcaagagattttcctgccttagcctcctgagtaggtggggttacaggtgcatgccaccgcacccggctaatttttgtatttttagtagagatggggtttcatcatgttggtcaggctggtctcgatctcctgacctcatgatccacccgcctcgtcctcccaaagcgctgggattacaagtgtgagccactgcacccagcctattatgttttgattattgcctttcaatataactggttttcatcataattcaatgaagttttattttgtgcatatataaacattccagaaaggcatccataatcaccaaatgccaaaggagtccatctctctctcctgtacgcacacacaatgttaagatcctcaggactatattgtaataccttgcatattattgttcacttgttttccatgtaaaatgtttacaccattagaacaggttttgtttcagaatgataacctcccagactgattcagtagggactaaattaatatgcatctaattaaattgaaatgaaacaaagccccgagatacggacagaatttcagatggtaattttgagaacacctttagcatttagtaaggtggtactctttaaactcatgctatgttgtcagtattaacatttccaaagtcactaggtttaaattttagagacttactttctgactaccggctccaagcatttattttagcctatgtgtacaaacattcagactggctatgtgatggaaaagtaaaaaaaaaaagatgacttttgtcctggccctcaaaatcttatagcttaagatctaattctccaaaagtagacaaaagttgcttgagtattgggttgcacttgtttgtatagtttttattcagataagaataatgaagactcttgttctctctttctatctattcctttataataatagtaatcatcatcatcatctcaggcaacagcatcctcaatgcggtaaattttgcctatcatataaaaaatacatttgaatatatagttgtatcatgtttactttcacttttttgtaacatttcaaaaagtattattctgctatgacattttttgggcttagtcatagaacaaatgtgagctgttagggaactttaaatgtcttagttttattgtttatttataactaaagagcatttttagtctactgtaaaggcaagttatcatatgctaaacaacataaaaatgactgaatattaaagttaaaacttttttatgagaaaatgagagacccctatgtgatttattttaaaataatcattgcatatgccctcacacagaaaatcagaatggtgtgattgttgcctgcatgaccaaaatcgattctgcctcctttgtggttagccaacacagtgacttcagcacctagtagacacaggttgtgtagttgtagtggtgcatccttagtgttatgctctccattgctggcaggacagattctttcatgcttgtcttctttaaagcattgacttaatttttcaactgaaaacagtaagtgacaaatggagcacagagtattttagaacatacccagaaagagcacttaaagacaataagaaatactcaaataattgaaataggaatatttttattattatgtcattaaactagctggtgcttatctgacatttccatgttagacatccgtgcttatctaacattgtaatgttccacgttccaagtctgttttatcttgacctgtgcactattaagtaccagcagagagtgatcaatattattgtccaaagcagtgcatcacaacctttactgggcactggaaacacctgaggatcttgttaaactgcaaattcggattcagacatgaggctgagagtcttgtaaaagaaaaattgaacagatcggttaaacaggtaaagtagactttattgaggactgttgtaataggagagagtttcatctcaactcttccactgaagcaaaaggtgaaaggatttttaaatgctggggtgagctaatggaaaagtactggaggacataggcaggatggagaatgtgattgggctggttaatatgattaggccacctgtgtttgctaatggtaccttatcaaagttaggctcctacactcctatagagactgggaagtagggccctatctttcttgatgattacatttcaaaggattggcgcccaggtccttgagaaagaatttcctaggttgtagaaggtttacatctgaaaggggcagagaaggaatttacaattgcaaattttccaaagtaatcgctctacaaaaaaggaggtaataggcctatctatagtcagaaagaagcttgtctaaagttgggagggggggaccattaaggccattgtggtcagtcagtatttctacaaactcccaggtggtgtcaatgccattggtctgcaaaccacaggtctgcactgttacactgataggaaagattccatattgatgattcatgttaacgcattttctagcttatacagtgtactgtatatagaagtgtgtatttgaaatggtcaataccattgtctgtctagatggataataaaagttgttgtgtacaatatttatagaatgatatcttttcatacttctagaggcctactcagaacatctgagtctctcctgatgagatgaaatttggaataagttatgtcccagaattcaggacacatttgatgtttaacttatttcactatgagaaaagtagtgttataatgatgttccacagttgtattttgttttaattattctcattaagcccctagcaaacaggttgcttcatcatttttttctttctttctttttttttttttttttgaaatggtgttttgctcttggaatgcagtggcacaatctcggctcactgcaacctccgcctcctgggttcaagcaattttccttccttagcctcccgagtagctgggattacagtgcccgccaccacatctggctaattttttttgtatttttagtagagacggggtttcatcacgttggccaggctggtcttgaactcctgacctcagacgatccacatgcctcggcctcccaaagtgcagggattacaggcgtgagccactgtactggctgattcgtccatttttaacagatgaaaaaaaaactgtaatcaattttggtcagtgacagtgcaaaaaatgcaatttaatactacaaatacttattacctgataaagttctcaaataatgagctaaaatagaatggatatgccaaaactgtagcaaatcattaaagacaaaataataacattccagggacttaaaacaaattgaattctccaaagaacattattataaactaatattcctaattgcataggaatggaagatttttttttttttaatgttagtcataggagtttcaagacatttgaatcacctgcgtggacactggcttttatcctattaaatttaatgtggtaatttagagtgtttttattagaataatcaacattctaaaatgcaatcattagcatatttggcatagaaaatagatctgaaatgaacccaaaaaatgagctttaaaaattgctaaaactagcagtgtataatggtaacacaatccaaaggtcaaaaaacacaatgattaattaaaactaaagaataataattaattagtagtattaagaaagctttgcctccttttcaaaaaaaaaaagctaaaaaggaaagttgttgaatgttattgtttttaaagaccagcttttcatgaatgaagtttttaatcctttcaaagcctaatctaaatttaagaattcaaacaaaaaatccctaatattttaatttgcaatcaggagaggttcaatcagactaagactttttaatttgacagtctcctttttaacacatagagctacttctttgatctgccttggttaatgaaatggatgagttccaataaatttggatgcaaagtaataatcaacagaattccatttcccattgattttcattgtaaacttgtatcacttttttgacataaaataagcactctctggaatgaataatttaatttgaaatatgaataaaaaataaattatggtgcagaatattgctaagtccttcatacatttgcagcactttgcatctaccactgcttacttcctagacagagaaccatttcctataataatagctaaaacccatgaaggatttcctatctggaaatagtttctataacctttacatctattcatcttcatgattacattgtttaatgggtactatagagatcgtcagcatccccattttacataaattgtaagtgccagagttttggtttaaaccaggttgtctgactccaaactcttcacttaaaaaatatattttatttttatagataataatacaaatactgaaaatatttacaaaacaaatttacaggtaatgaacactcttattactaatgaaggcaaatgcctttattactatccttgatgtcagaagctagaaccttgcgagccattccagaaactttccacgtgccttcttataaccatctccggacacacgcgtgcacacacacacacacacacacacacacacacacacacacacacacaactgtgaccattatgatgattttattttttggaatggcatccttacttttcttcatagttttgtcactcaaatatgcatccctaaacactgtagtttagttttgcctagtgtgtgtgtgtgtgtgtgtgtgtgtgtgtgtgtgtgtgtgagacagagtctcaccctgttacccaggctggagtgcagtgatgcgatctctgctcactgcaacctccgccttctgggttcaaacgattctcctccctcagcctcccgagtagctgggattacagatgcgtgccaccacacctggctaatttttgtatttttagtagagatgcggtttcaccatgttagccaggctggtctcaaactcctgacctcctgatccacccgcctcgtcctcccaaagtgctgggattacaggcgtgagccaccgcacctggccagttttgcctaatttttaaaatctattaagtttcttttaatctataggtttcttcctttatctttttcttttatttaaacagtatatgtgttgaggaagctaaatagtttgttctgtagtcttccgtggactggcttttgctgcctgtgtttttgtgatgcaatttgttttgtttcactatcatccgtattccctatctgccttgttgccttgcctgaagatcaccaaatttcaaggacttctttcctgctctgctccaaggcacttctcagcccactctggatgtgcgtgggtggtggccagtagaggtgggctgcaattactggcttctttagtaagagctgtgaggttacatatattcaactctgggtttctaaaggcccatccaaggacaagttccagggaagatagggcatgcatgagtttgaggcagaatgagaaaaataagcaacatacaatacattttttcataaaattaaatttctccttttaaagaagtgttctttattatatttcagttagcctactgtttcattggcatcgtttccctttcattgtttgtatttttgttttggtgaaacaaaaaattagaaacccaatgtcagtctttgttctcttcttatgatgctaatttccaaaattgaaaagtgttggaaactctgctttagccttaaattttctgcagaaaattacattttgaattttcataaaagaaattattggtcttaacccattctgtatgataatttttaaaaaaaaaaaactctctaaagtgtaccttgaaaaatagtacctgtgatttgtctaagcttttgaataattcattctatctcaaatgtatttctaccactaaagttgctataccactttatggaaagaagaaaagcaactttccttttttgtacaggaaacttgaaagttcatctcatggaaggtgtggagagaaaggtggctatgtaattctcctttggatatttctggatctgtttctcaatcagattggttccgttcacactgcctgctgtcatgaaagtttatgcctcgcatgcaatgccagcataaatttctcagcacaaaacagctctgcttgttaaggaagatgttctgaattatcaaatatatattttttaattagccaccctttcttatgctttcagaatatatattaaagtgatctggggtatttcatgttaatgtaagaaaaacaatccaaactccctttgtttcttgacttagcttattatatcttcagtacttgcaaactgtgtgatacatgatcagtcacagcacactgctatttactgagcatccatggccactggctgacgtggcattgaatataacattgtattgttgctctaagccttttagccttcgtgctaaatgactcaacccatcacaagaaatttataatggacatataactcacctagttagtctgcatgagattgatttgttgtgaagttattggctataatgtctttgagaggataggccttcatttcaaataaagacagcctcatttatggatttcaaagcatgtctatacactgtaagtctgtattaaagaaatgggatgaagccagctgttaaaaacaagaaaatatgtgcaaaaggatttggagttgactgtattatatagaagtattaaattaggagctttagggcatactgaagcttcatattgtttgaaagtttattttgaattctgtagaaaaatgagtactgttaattaggtgatgtggtttcagcattctcaggcgtctgctccccacagtatcaaaacctttgcccaagtccactcactttattgtgacccctgtagatgctctatcattatggtccctttaccaaaaaaaaaaaaaaaaaaaaaaaaaaaaaaaccttgttgtctctcaggcaaccagcgctttttgtcagcctatttcatctccccatcccttcctacaatcgtttatactactgaaaacttgaaagcccacatcccattctctcctggatctctaggcctaccaaagtttctttctaaaaccatgaaatgaccacaagttaatttgatgaagtgattcataataaattgttaataagaagtgacctacaactaggtcaggtcattcttcaaccacctattttattagtgatcccccacaggcaatacatgtgactgaagctggaatttgaactttctgtgatgagggccctgtagcgtatatgtgagacctctggtagcaggagtctctgagagcctctaactcatggtagtctgaaatagacataggcaaagccccagggacatttttaagagagctgttgtaagtaatccagtattataagttaagtctgtcctgtattcatcagaaaaaaacagaatctgctgctacaagatattaggatttctggtcttaagcaacagacttgaatttcactacctggattcttctctttggcttcatgtttgcagataggatggttgaggaggatggagctattgagagggtggctgctctgtgcagttgcttttgtttatattcttactgacctggcacagtgtaggtggaggtgatgcatgttttctgacattgggccagtgatgtatggcctgaccttcaaaatgagaaacatcatctctgtgggtgagactatagccgtgcaaatgcttttatcccatattgctcagcagtttgcaaccggttctgataaaaagcacccaccccgctgagttcgctgaagcttgtatattggttttaggttgaacattttggcaaattaacgactgagtgaaaccataaaattggttttatttacaacaaagccttgtggtgtctgttggttgttcttacatctctttcctttaatctttgaggttgtttctgtaggtggcttatctaactttacattgaaatttgcattcatttcaggataatacttcccctgggtttcttcttaattgacattggacatggtctgcattctcaaactttgtgcataaagttggtaactatacagagtcctagtttacgcctaccccaggtgattctgattcgggagatgtgagatggaaacccaaactacacattgttagtcagtaggtgactcccccagtgtgaatctactgatctcatgtttagaaatactgctgtataccatgcaaagctgtcattttctaactctgctaaacaataaaggttcacaagccatacttctgatttgccataaagttcgagtttttctccatttggttcaatggtgttgctatggatggcattcatagcaaatgataagattgggcatagtatactttgagtgaattcttagttttccttagaacaacaagataatgagttagaattataagagagccatctagtggataaggatataggcctgttgcatcttgtcttaatgtcggctttatggttttatcagattacagatttaaatataaatgaaattaagtgtagatatatactctgaatatattacattaaatatatattaaatgttagtgaattttgtttttgttctttttgttttaaaaaaataatttcttattttataaatgagtctgtacttttaagtagttctactcctttaaatgaaacatggatacagagatgataagacatgattttaccgtaaaataaaacacacattatatttttagggacataaatataggctagtaactaaaacatattttttaatgcctactatatgttccttggatttgaatgtaaaagagatttcaggacttaaatagtagtttatgcaattagagaatgcagaaatagcgtgaaagaattatagtctagatacattactattttttatatactctggaagtttttaacagttcgtaacaaatgccttgggcagattagggcattgccaaaaatcaacatcatgctacttacatttacaatcatctgacagtcatctctcagacgagcatcctcctgattgcctaacatgtttcttttataatgtaataaaggtgagttacacatttgagcaacagtgtttgtctgttatacctagagagaagaaaaaagattgtaggagagcaagatacccaagatactaacttttccaggcccacattttaagtgtattgtcaaaagaagcattttatttttatttttttttacttttttattttttttgaggcaagtgtcttgctctgtcgcccaggctggaatgcagtggcccaatcttggctcactgcaacctccacctcctgggttcaagtgattctcctgtctcggcctcccttggagctggggttacaggcacccgccaccgcacccagctaatttttatatttttaacagagacagggtttcaccatgttggccaggctggtcttgaactcctgacctcaagtgatccactggccttggcctcccaaagtgctgaaattacaggtgtgagccaccgtgcctggccgaaagaagcattttaaaagtttgatattttaaattaaattgaagatactctatcacaacttaacattcttatgctgggtcatccctccttcccctgtactcaagctcctagaaatctcatctatttatacctgactctgctattcaagtaacttccaggttttcttcccccagcgctacatcttttcttctcttctccaggatcctgctggacatcacttcctgatattcttctggcacctcaacatggcccaaatcaaattagttatctttgcactgtttttgtattgtgtatttcagttaaaggggcttacctttaattttcttaagaataaaagattatagtcttatttaatctttctttttttcttatctccttcccccagtttcctgttggttctacctctaaaacctatctggcatcattcatcaggatactttgcaaaatgaggattatgaggtcaggtcctgtggtaagcagggagccaaaaataagaccctcagagtttcttgcctccctgttgtacacacccagtaaaatccccttcccttgagtgtgtatgagactatgaataggatggataccacacccccgactaggttacgttatacagcaaaatggaagataattttgtgtatataatttaggctgcaaatcagttgattttgagctaatcaaaggaagattattctgggtgggcctgactttatcaggtgaaagcccctaaactaggaactgggctcttcctgaagagataaattctcctgctaggaatgaagtactccttgacaaagtaagcagccatgttgtaagcgggcccatgagagggccatgtggccatgaatttcaagtggcctctaggagcaaagagtggctcttgtctgacaactagcaggaacagagatctataaccacaaggaaatgaatgctgccaacaaccacatgagcttggaagagcacccaagctccataaataaatgcagcgtggctggcacctcaatactgcttcgtgagactcggagcaggggacccagttaaaccgcacttggactcctgacccacaaaaactgtgaaataataaattcaggttgttttaagcactattttttaatttttaatttttatggatatataatggttgcacatatttataaagtaagccactaaatttgtggttatttgttatgcagcaataaataacaataaatgtcctcattatcttttgctttggatcagtgcagtaaccttcaaatgaagctctcttagctcatccgtctccatgaaatcctacataacacagccaaagtcatcttccttatcctacataagacagccaaagtaatctcccttataaacagactataatgtaacctccatgagatagggttatagatagagttttgttcaaagctgtatctctagaagaacgctaacatttatgcatgctataaatattgactgatggactcaatgaataaatatcatctgtcctcctacacatacatcaaaacctttgctggtcccttgcctacagagacatcctccagatacaagaagagggaaggtatataataaaatgcttcagcatacaggttctagagtaaaaccttgggtttagatttcagctctaatatttcctagctttgtgatctcttggaagatgtatgactttactaagcttcggttttccaatttataaaacatgaataacttttaccactcaagactgtattgaatattaaataagacaatgcatttaacatattttcacagtgcctggcctatgcaatagatcaacaagtattatttatgattataacatttaaggccctttactatatacctttccttcctgtcctccagccttatgaagctggcacccttgtgtttcctgcctttgcagcatgatggagagtgagatgcatggatacttttaaagtgtccacttctacgcatcccctgctaaatgaccttgagcaagtttcttcccggtctcagtttggttatctgagtaatggggctaatttgaatacatagttctcgagtttgtattgagtcgatccctgcattagtcagtcacattgaacaataaccaaatattggccactgaggtcacttactgcaggaacaatataatggacgtctttcataacattatgaagacccatggaaaacttttcttaatattagaaatagttgtgttggtactgaacaatcaacggttgttattgtttttatctgaccaggcttttctctttgaattagcttctagttgagacaatctgtactgactctagttcagaccttgttccctgtctctgtgtatttccttttttctcgttacaaatttctaatttatgttttcctgctatatttaggtaagttaccttaaattcattctttaaaaaaaaggtagaagtaagtatataaaaaccttccatggttgttacatatgtaacaagcactattcctgtgtcatttgtgtgagggtatgtgtgtgttttaatggtgagagttaacaaattatgtaagaaacactgacattggaaaactgattttaaaaaaacaacttgcaaaatttcatcaaatgagtcttgtttcttgcattgaacagatcataaaagcaattcataaaaaggcaaatatagtgattcttacatcacccatttagttaaagtatcccaaatgctatagcataaggaagtacatgtgctaggcagcctttgagttaatgaactgatgttgatgttaaaactggtgcactcttttctcccggaggtatggctgaatctgtgccacagccagccactttttcatcagattccatttgaaagtcaattgatgaatcagccctgatgcctcattgaacataatgtcgagaagcaagatttctgtactctattgatgtgtttaagcagcatcaaacaagcacacacatcaatggaaatatcggtcaaatcatttgtcaacaattttatagagaatacagttgacttcctaatttctccactgtttgggttgctatagtctaataaatcatgcttctgcatggagacatactaatacttcgtggaaaagtaatcagaagtcttaattgaaataaaattatatttgtccctgtttaaagatattcaaacactacttcagttcacagacttaaaagtgaataacttctttatgaccttattgaatgaggatgtgattaatgttactaaagtcacacttacgttggattgggggactgaccgaccatgctgtgagatctttagcgagaaaattgagctctcttctggttagcgttgactggctatactttgtgctagccatcactgacttccacctaaaaagataaactgtaggtgtaagcagcaaatatcaagccgtcttaggctgtattcttctattccttctctttttttttttttcctttctttttctttttttttctttttttttttttttttttttttttgagatggagtcttgctctgtcacccaggctggagtacagtggtgcgatctctgctcactgcaagctccgcctcctgggttcacaccattctcctgcattctcctgcctcagcctccccagtagctgggactacaggcgcccaccacgcctggctaatttttttttttttttgtatttttagtagagacgggggtttcaccgtgttagccaggatggtctcgatctcctgacctcatgatctgcccaccttggcctcccaaagtgctgggattacaggcatgagccaccgcacctggccccattccttcttcttcttaatatttttccatttcaaggtcacaactgcaataccttatatatcccatattagtaatgaggacatctgtgttgcactggtattgttaaattggccttcagtaaaatcaaaccattccttgcagtaatgggtgagaacttgcctttcacctagagccaagttcattacaaattcatgctcacagcccagagaaaaacagggtttttatgaggtttcaacaagtaatatatctgcatgatgggttgttccaagaaactaagcaaatggaaatgtcagtttgcagaaactgtcaaaacgaacataacctaattagaattgctgcttatttaataagccatcagtagccctaccagatagagtcctgccaatcttgcaagtactcattcatcttgcatttaagtttgtagatactctaggctctgctaatgggaaaacaacgttaattagataccgcacccaatcattaaacagctgcaagcatagttagtgcccttagctatgaaatgctgtaagccttcatgtgaatataccttgatatgtcaacatgggaccccagtgtgtattgcagttataaaacagtgtgcatcactgtatgctttgcacatggcagatcctcgcaatgtacacatcgataagtagtttttattaatgtatattccatgtgtttgaattgcatgtcacccacttaaggtaggttcttatttgatgcccgtagtgtttgcatattaagggccctgaatactactactttgcttagtaacgtgtctttacagacattacctctgacttcatgttttatggttgttagtaattgtgaaacaaatgtgtctgactgccactgggcaatgctgcttcaatagagtacacacattaagtgtatgacattcaaaactagcagaggaggaactctgaaggaggtagggcaggggatgacaagagtgtgggaggaggagaggtgtaaggagaggtattatgaaagaaaaaataatcatgcttttttaattgcataaaataatttgattgcaagtttcaaagacaaactaaaaaagaatgtaatcaattatctgcgtgttggcacaatagaaatttatggggagactgtggaggaaacgaaatgagaacagctgaatgaagtcaatcgctgtgatgtggcgccttccctattgttgagaatggaaaagagtgcaaatgcacagtgcaccggatttgtcagcaagctgtgttttctcggtatggtagatctctattgctcatgactattgagaaagacctacacacctgcttctgttattctcaagctgaatgatgaggacagagtttataaatagcctttctttcctctctgttaagtgtttcctcatatgtgggagaaggtagattatctggctatctaaatatcacctggaattgttacaccatgcagtgaatgtttaagaaatgagagtggacgattttggttgatggttttagttagctacaatgttttcaacatctttaatcatattatccagacttcttatttgttcttcctgtattacctattgattattataattctggctccatatacctgttacctagagtcacattgatacatttttgtcatcatgtgacattgctttccctcaatctcatatgccatttctaatctcattcttgctttactgtttactcgattacatctgaatctgggaatcactctctcatccaacataacagcagcccctcacatggctcctttgcttctaacttgcctcaatttctttctagccagtagagatcaccaagacccaatttggtcatccattatgtttgggaggacagaaatattattttagttatatattcagtgacttacaattgtttatcacaaacctaaagttacctgtagtaagcactggatctgtttcaggtacactgtcaattgtagaaggtagttgtggacatgaataaaatgttagagatgtcagaggccgatgtggctgtctttagaggtagagttttattggaatatggcctagaactttattttcaaaacaaaacaaagaaatggataatcacctcttttccttatcaatgatctcttaatctctactgaattagttttgcaaattatcactgaaagaggatttcaagaaatatgattttaaattatctttttcatatttctctagattttaaaaagctttctttaaaaagatgacaacctttaaaaataacttttagataccatatatgccttccaatctaaaaaaaatgaaaatattgataataaaacatttttctccatggtctgtgttaaaatttatagtctgactcactcaatactaatctatgtggaatttatcttgggtagtctaatctttgttgcaaaaagtgcaatacatgtcttccttgctttaagtactgctttcttatgtgatagaaaactgttacaactaaattacattatttttaaaaatatgatattttttaaatggagatctttttgaatatcataccacattcaatttccagttaatcaaatggcaagttaaaaataagtagtgtgcattagatttttattgctgcagttgtaaattaccaaaggcttagtggcttaaaacaacataatgttattatcatactgacacaggtcatactgatcaaggtctcagcaggactgtatttcattctggaggctctaggagagaatcagtttcctttgccttttccaacttctagagcaagtttgtccaacacgtggcctgcgggctgcatgcagcccaggatggctttgaatgaggctcaacacaaatttgtaaactttcttaaaacattgtgagatttttttttttttgcaattttttttagctcatcagctatcattagtgttagtgtattttatgtgtggcccaagacaattcttcttcttctaatgtggccaggggaagccaaaagattggacacccatgttctagaggcttaccacattcccatgacttatggcacctttcttcaatctttaaagtcagtaacattgcatttttctcatccttcttcagtagccatatctacctctctgactcttctgcttccttcttccacttaaggatggttattattaaattggatccacctggataatctaggctagtcttcctttaaggtcagttgattaacaacagtaattccatctgcaagcttattgccccctttactatgtagcctaaaatattcacaggttctggggattaggacatggatctttttgttgggggaggcattcttctgcctaccacatagtagtatataggtacacacacacacatatatatatatatatatatatatatatattttttttttttttttttttttttttttgaggcagagtctcactcagtcgtccaggctggagtgcagcggcatgatctccgctcactgcaacctctgtctcccaggttcaagcgattttcctgcctcagcctccctagtagctgggattataggcgcacgccacctcacccggctaatttttgtatttttagtagagacggggtttcatcatgttggccaggctggtcttgaactcctggcctcaggtgatccgcccttctcggcctcccaaagtgctgggattacaggcgtgagccacctcgcccggccttataaatatatttatacctaggtttgcacatggaagcaagcatcactattttagattatggacatcttaattttcaactttggcagtaggtttttacctgtaaaatgaaaggaaatcaacctgattatatactgtgtactttgaatccatttgaggcctacaaattgtttgtaaaaacaattgtttttgtccaactgctttttttccaactgcatatatgatttatggaatttgatgataagatcatggaatttttctcaaccaaaagtaatggtttgtgacactaatacatgaagcacattccagaatgatactccagattttaaaaagagtaaaggcaaaaaattgctaacgtctccaaacattttcctgtgagccactaaccattgctaatgtttccttgacaagtgaagaaaacaattattttttaaatattctgtcaaatggtactattttcttcaggtcaattctaaattccaaaatttcagggattatgagcaagctctcgatcgctctcatccagaatttatagtgtccgtgaaactttatgtgcagtacaggaacattttacattttggggttaagagttgcaatagtttggatgattcctctgcaaactgaaactaatagagtcatacaatacaggaccatgttcttaaggcaaatatactatatagtgaatgaaagaaatggattttggtaactccctttcgggctgaactgagtaagcagttcttcacacaaaggcaccatgatacagtgataaaaatggtgagttgggataccagaaacttggtttctggtcctggctctgtctctaattattgcatccttttaaacaagttaaaggatagctttttgcctcatttctctcatttaaaaatgagtttaagaggaattatcgctgaagtcctggatcatgcacagcttctgtgatgttataatcccagttttacatggccaccacatgcctaacatcatctgtggtggctcctggaaaaaagaggggatgtgagcaaaaaaaaggaaatacagcagggagatgtgatatgacaaaaatcttgctaccacaattgttggaaacagaaagcttactcaatcgctgagagctaaaaagggcttttatgcacatctccttgctactttactgttttctgagttcaattccaatggaaatggtaaatatgaaggggccttaaaaagaaatagcatcaggatgttttactatagttctgccttattgtatatggaatagacttgatactagaaaattgacagcaaagtgtagttctctatataacattttttttccccaactgcttttgtagaactgaaactgcactcccaggggaagataaacgatcccacaaggtgcagtaaaagtcagagaatgctattgcagtagggacaagatggcccagagacacagtctacccaacacccacatttaactgatgcagacctgcaaacagagagtcttcatgattcactcaaggtcaagaagccggttagttacagagtcagagctgaggctgtatttactctttcccacaagcaaggttcaactgttcctacttgaattgcatatgattacatacagtatgaaaaaggatttttttctgttaactgttgacaatattaacatcagtcactaattttaataatagtacttaattgatgctttgtatgtgctaaacagtcttgtaggtgttttactcaatatagttttattaactcatctaatcatcccaagaattctgtgaaataattctacgtacactcctactttacaggaggggcgcccatgccccatttaaagatgacatttgaacttagacactttggctgtaaatccagtgttcccaattgtgctataatgcctctgaacttaaatgctacaagaaaaatcaaactaccaggttggacctcaattatgattacagtcatatgagatgagccacttaattgtatggatctttagatatataacattttataacttgaggctcattcattcaacatgtagtgattaagcatctattatatgtacagggatttaccaggtgttataaaggctaccaaggataatgtaattgataatgctagtatgcgtgataaaatggtataattcaaagtataacgaatagcattaataacaacagttcttagatagtacgtatttaatatgggccagcctttttgctaggcaccttgcatatattatctcataattttcaccccagtcattaagccaagtcatatttttccattttagaaatgatgaaacagacgtgaataggtaagcaacttacccatacttacaaaggaagtgacagagttggtattcaaatctaggtctgtgtgaataacaacctcattttatttcaactactctgctttaaattagaaaacccaatcctatcaaaagaacacgtgaggcccctctccaggcccagctgggaggcttattgctgaatgcatggccagaatccattgtggcttctttttgcacagatcttacatgttccccggggggtttattatctccccatatatggtaaagaggagaaatcctggagttcatctccagtctttctgtttaggctttgcccaccagtgaaatttaagagcagagtattgcaaagcgtatttggaatatgttaagaacccttcattttgcgttcatgctttgatgcttcaacatccttctcattgtcctaattttgagtccacattcaaaaccagctgaaaccccttgaaaataaacccaaccgctggcatctggctccgcagccacccaccttgcttggtttgctttcaaattgcccggtgaaattcactggcaccaatcacaagtcctcatgctctctctgctcatcacctattaggtcaagcactcatgggttgtgccgtgttgtggccctgcatggcatactgtcaccctctctctgggacctgtgagaataagaaatgtcatcctctcaaatcactttctcttgttctcctgtggcgggaccaactttcccataccttaaccaacacctacattcttagaacagatggaatgaatggaaacgaagctacacaactttctaaacttgtgattctaacttcaaaagtaatgattactttttctctttcctgctgcttttctattttatctctcatttttctaacatcttttctctcatctacctctgaagatccactctacctaggatctggagccttccttaattcagtcactcatttagggactgtactgagtttcaccaggggtttcaccaaataatgatataatttcagctctttatgccttttgagtgacactcataggaagagaaggattgcatctctacctctaaagggtcttgaattgtgaaagagtttccctcccctcttctcttgtgctctacttcctctgctttcctcccctccttttccctctcccccacacatgtaaacattgtgtaattccatgtgtgtccctgttatctatttgtttctagtgttaaggtgacttacagcttaggggtacaactgtatatgtattatattcagatgcagacttgtcaagacaaatacagtcttcctgacactgatgcatgcagtcaacactggaacagaaagttgatagctgcattaaaatttttgcaatggctgccatagaaacccacgcaagagtgactttgcgctgaaatatgacatctcagggatctgtctggtgaatctttgacacagaaagagaaataaattagaaaacagttttccacagagccttttagatccttaaaacttgagtctcaaagcacttgaacaaagtaactatttggaaaaagaaaaggtattcgttcttggcatttttaaattcattgaatagattctccttaaatgttaatagcattttgatgggagaattactctattcagagcattcggctcacctcagaaatgatttaaaaattttatgttatgccttttaaatattaagcttctcattttccatcccatatcaaaactggcataacatttcagaagtcaaggtttaacagtcagcaaataaacatatttgcaaaactgttaaatgatgattatttttgcatttgatacgcaattgtatctacaatatatgtcttgaggaatatgtgttttattcactgcatgtatgcaagcaataaaatttcactaagcagactccatggcaaattagttacctgagtattccaattactgaggttcctcaaaccactagaactttcatcttttttttcagtcctttttttttaatcatactctaagtctgggatacatgtgcagaacgtgcaggtttgctgcacccatccacccgtcatctatgttaggtatttctcttaatgctatctctcccctagccccccaccccccgacaggccctggtgtgtgatgttcccctccctgtgtccatgtgttcttatacttcacctcccacttatgagtgagaacatgcggtgtttggttttctgttcctgtgttagtttgctgaaaatgatggtttccagtttcatccatgtccctgcgaaggacatgatctcatcctttcttatggctgcatagtattccatggtgtatgtgtgccacattttctttatctggtctatcattgatgggcatttgggctggttccaagtctttgctattgtgtacagtgctgcaataaacatacatgtgcatgtgtctttatagtagaatgatttataatcctctgggtatatacccagtaatgggattactgggtcaaatgatatttctggttctagatccttgaggaatcaccacactgtcttccacaatggttgaactaatttacactcccaccaacagtgtaaaagcattcctatttctccacatcctctccagcatctgttgtttcctgactttttaatgatcaccattctaactggcatgagatggtatctcattgtggttttgatttgcatttgtctaatgaccagtgatgatgagctttttttcatatgtttgttggctacataaatgtcttcttttgagaagtatctgttcatatcctttgcccactttttgatggggttgtttgtttttctcttgtaaatttgtttaagttctttgtagattgtggatattagccatttgtcagatggatagattgcaaaaattttctcccattctgtaggttgcctttcacttcgatgattgtttcttttgctgtgcagaagctttttagtttaattagctcccgtttgccacttttggcttttgttgccatcgcttttggtgttttaatcatgaagtctttgcccatgcctatgtcctgaatggtattgcctaggttagggaactttcatctttactagatgaatcaaacctggcaatcctcagataccaaaacaaaaacaccttcatatacatgttagccctcatagaattcttcaaaggcatactttctgtcttaaagtataaaataattcaaatataaattttcttttctcttgatgattctgcaccgtagtacttttgggtgttagtgtaatctactggtgcttttgtgtagatacaagatgcaagtcaagaatcagatttgttgtcatctctcatcgctctttttttttttttttttttttttttacaaatgtaaccttgtgcaagatgcctttagcaatcaatgcctcaagaaaaaaagagatgattgccaagtggttaattagccttctgccaggtcttccccacctcagcaacctatttaccaacatgcaaacttgatgcccactaacagtggaaaagtcttaggcctttaggggtcacagtgatgaggtacaggtgactctttacccaccccacccctgatagctgatctacctctcatcatccttctagtcatgacttcaaattaccaccatgctgcctggacagctgatgaggggattttcataacagccagtatggctgctttgaatgattgccatggaattttttccctcttctttcggtttccctcccttttactttcttctatctcctgttgctactacaaattttctgtgaaaagctggtttatatatagattaccaacccatcagagaatacttttgctttcaagtaggaaatcaaataatcatagcatactgggtactattttttatgggttctctcttctatgttgtttattacttggattcatggggatgcttcattcttcccaatgaggtaaggtttccagccctctttttgtaaccataattgttttgaagtctagagctgttcccaaagattgagagttctgaaagtttggcctcaggagtgggtggggtgggggagagtagtaggtaagctgttgtgtgtatatttatgcttattgtttgctcagcaagcagtagacatatacttgaattaatctggcaaagtgtttagttttaatgtaaggtgaaacacaggaaaatactcctatcccaaagatgtgaaaaaatagtttgttaggggaaacaggaaagagcagctctacaaccaatgatatattcatatctaagttgaagtcatatattctgttttatgtggagcacacaaattagctttgcaagttggtcggctatgcctagatatttactgtaacatatatttttctaaaagcatatatgggtgccttaaaattaaaatctgtaccacaaggaatattggatattagaaattatgaaacaatagggcttatacaaaagaggtatgtttattcatttacttactgttttttattggatacatgtgattaaaagaaaaatttttatataatcctattgtctcaaggacaaatgattctgtgctcatctgggcatgggacatgtcacacagatattaaagacactacagagccatactgaaataacacggacagagaaataaaaaaaaaaaattaaaaacagggtcaatagtggcaaaaagtgagcttgttaaaaaacagaattggccaggtgcggtggctcatgcttgtaatcccagcactttgggaggctgaagcaggcagatcatgaggtcaggagttcaagaccagcctggccaacagtgaaaccctgtctctactaaaattacaaaaattagctgggtgtggtggcgggcgcctataatcccagctactcaggaggctgaggcaggagaatcgcttgaacccagaaggcagaggttgcagtgagccaagatcatgccactgcaatccagcctggttgacagagctagactctgtctcaaaaataaataattaataaattaattaaagtgaaggcatgcaaaatatcctctttggagtctaatttagacatcatggaaggataattatttggtggtggggatgacatggagattaaaaacaggagaaggaaagccctgtgtgttttggcattttagacatttagtggaacacactagggttcttgacactttctctgtaacttggagaggatacttttatattgtagataaccttgtggagaggtagaagaactatggtggagtctgaagaagtaatacagttcaaggtgtttccaatttgctctaagttagcaaaagaaaaagacaaacacaaacaaatagaaagtattggctgggcatggtggctcacactagtaatcccagcactttgggaggctgaagcagacgggtcgcttgaggtcagtagtttgagaccagcctggccaacatagcgaaaccccctccctactaaaaatataaaaaattagctgagtgtggtggcacacgcctgtagtcccagctacttgggaggctgaggcacgagaattgcttgaacgtgggaggcggaggcagaggctgcagtgaaccgagatcatgccactgcactacagcctgggcgacagagcgagacaccatttcaaaaacaagaaaaaagaaagtgttatacaagttatatcacgaacaagataatataaaaagctattgcacatcaataagaaaagttcaactcaatgcaaaaatgcacatatgatatgaatagacaactcataggaaaggaaattcaattgactttgaaatatatgaaaatatattcaacctcatttgtaataaaataaacataaattaacattaaacattttacccatcggattaacaaagttaaaaaatggtatagagaattaggtgttcgtacactgctgatgggagtttaattgttacagcctaaattcaggcaagtcagcaatacctatcaagaacaaaatgatgcatattctttaggcaattctcaaatgtatcttgcaaatatggtcattcatgccatctcatgctcattcatacacattcatgccgttgtgtgtctgtgtgtttgcagccattgtgtgttgaattgcataagattggaaattactgacatatacatcaatggaggactagtcaagaaagttataggtcattcacaaaaagagactattctatatctattagtatggaaagaagttgaaaaggtatcattaaatgaaaaagtaggggattcgaaacaacggttatagtacggtatttcttgggggaaagaatacacatattgtgataatggaatatctctggcctgtttatacttgggtttggctaagggattgtctctagggaggggaactcggctggggagattggagtgggacaaaaatttacttttcaatttacacagttttatagcttttacattttatatcttattgtatggtcaactcagaaagaatagttaaaactaaagggattagaggaaattatgaattctaagaacttactttgtctgggaatttaactgtgcattgagctagaattatttttgttgtattaggaatctggtaatagtgaacatgaaacaggagagaaaaatttttcacagatattttgacatcaaactgagatcatttgatagtttttgcctgattaatattcttaaatgattatggagaaggtgttgtgacccagaaatgcaataacccattatagtatcttgtttacaccccattaacactgatagcactctatgttactttattttcaatttttttccttcagagtctcagttatttaaccattttccaattactaagcgatatatgaatctgactcacattctatattcagaacaatgaagatcaaaatatgtatttcttatagcagttatagattacaatagtggaaaatgggcttcagagtatgaaaaagtggagagcaagtcaaaatcttatatgaatatgagagaacattttagttataattacaaagccccaatggcctaattttcctcattaatgctgagtgatatttttgaaaagtatgtagaatttaaggtaccaattgccaaaacagtgaaataaaggaaaggcgtgagaaagaaagataaatgaaattcccaggtattacacaatttacatcaaagtattttctaattggtaatgtaaaatgttatataggaaattttacacatcattttatatatctctttacttgaagtgttaaagtgatttcccatataataattcagaaaattatgtataagctaacaaaacttagacctgtagactctagttgtatgtagaaactgccaatagctgctaattcaattctctcttcaatgtaccccaactgatatcttgtttactgggaatatcacattcttctctctcattggactttatttcactggaaaaataagtcctaaagggaataacaaagaaaactacaattgagaaatagaaacaacaacaacaaaaagtttagctaaataattaaagatatttgatgagcatcctggggatatccaagttaatgaacttgagtgagtaggatgggcattcatctctgattcccacctttcagaagagtgaagaaagcattaaaccatgaaactatggcttgtgaagatttccgagggccagtttactgagtgctgagaatgccagttttttaaggcttctcattaccttttagcatttggaacccaaagtggagaatgattgcttctgaaataacaagaggtcatttcctcttccttcaggtctcttcctaaatgttctcttgttccttatgctgcatgatatgtaagataaaatttatttttttcattgtatcattaaaaataagaatctttctgcaaggaaaaagaagggtatttagataaaaccaggagtttactttgatacttccatgtaaactcctgtttgtatcagcagtggtaccttggctgttgtccagcggtttaattggctcttgtttgcctaatctcctgtaacagataatgttattacagaatcgtaggactccaaaatttcccatcagacaaaacaagccttttaatgagaatcactttgttttacctggcatttggcttggtttgagccacctcaatcccatctcacttgtgagaaatgcattatttttcctaacaaccatgctaattctaagccaggaaacatttttttggatcacttcttttctggaatgattcaaagttcaggaaagtaaaagtgggaaggaatttaaattaagctgagatgggaaggagacataattaaattggactttattacccctgttttgcaactaggttgatgttaattggtatctcaaaagacatagcactataacatttgctgtttttgaatttacattaatttcttctataatagtacgtcagtgtatataatttgtctaaattctgtatcttttatttatccatttagtaattcttacattcaaccaatatttggtgagtgtatttcgtgtttaaggcactgttctagggaccactaatagagtaaagcaaaacaaaccgacaaacacaaaataaagtcctaactgtaatggagctttttgttcaggtagtgaaaattgttttaagaaaaataatatatggggataacagtagaccgtgtatgcaggagtaggacagttatatttatacatctatacacacacacaaatacatgtatgtattcacatccatatacatctgtctacatagatatagattataatgttatattataggatgtcaaaaagaatctctttttgataggctggcttttgagagaattaaaaggaagtgaaggggcaagacatgtagccatatggacaaaaggaaattacagacaggacacagaaagttgcaaaaacctgaagtaaaagaatgttttgtgtttaaggggcaacaaacagtgatgtgagttgggggaatatgctagaagaggagatgagagagacaaggtgggaatggaaaaagtccagtaggacttccgtgacaaatatttaggaatggattttgttaaacaacatgtatacgatattgtggttaaagtagaaaatcaatgatagactggattaagaaaatgtggcacatatacaccatggaatactatgcagccataaaaactgatgagttcatgtcctttgtagggacatggatgaaattggaaatcatcattctcagtaaactatcgcaagaacaaaaaaccaaacaccgcgtgttctcactcataagtgggaattgaacaatgagaacacgtggacacaggaaggggaacatcacactctggggactgttgtggggtaaggggaggggggagggatagctttaggagatatacctaatgctagatgacgagttagtgggtgcagcacaccagcatggcacatgtatacatatgtaactaacctgcacattgtgcacatgtaccctaaaacttaaagtacaataatagtaaaagaaaaaagaaaaaaaaaaagaaaatcagggccatagagaaaagatggaagcaaatatagtgtagagaaagctaatatgtttctgtagttgatcactagatttctctatcagtttcctagtggccagggcatacagggaaataaaaatgttgtatgtctggttaaatacatttttttaaagcaagcaagtataccaattatttagggaaattgaaacaaaattacaaaacaattgttgctcttgtttgtcttctttgttagccaaaaaatgcctcccctttatttttatttgttgttgttttggttcttcagtttctattaaataaatttccacacttgagacgctgtgtaatttcatctagttttgtacaaggttgtgggtgatacaatcttatgtcatttttaaattgtccactaccatactgaaattttcatgacttgccttcatatatgagtatgtttttatttcaatcccaagattcaagtatacaaacgcagtgcttttttaataggaagaacatattaaaagtcttcatataccaagagaaaacttacttctcttagaatactgattgtctctttataaccactcttttataagtaattgtataaactcttacattgggattatggtagtttcttattgatctggtaaatgttttctcgtgtctataacaattcaaggtaaaatacactacaatcaccagaaataaactatgttttctggtactaaaatcattattttagtaatttttaaaaataatgttcattattatccattatctgagagatacctctcattacctctctcaaaaatgacaagaaagtgaaataacatgtctaagattattgttacctaatgtttataaaaatagataaacccaagaaaaatatcgaaaagtattaattgtatgaaaagatggagaagaggaaaatatcccttataatgaaaatcagtcatgctagatgataaagtggtgagatttaaacaattttctgggcattgtattctcaaatggatagtgagttgagcaaatagattaaaaatagtgtaaagtaatgcaatagtaaaataaacatgctgagtaggaagagttaagtcttagataacaaaaggcagaagacaaattaaatcaaaataatgtagaggcatgacaatgaaagctaagtagtctatggaaaactgttaagagacctgaattaattaatgatgataatggtcgtaactaacatatatatgtagtgacaggaatcaatccaagtattttacacaaactcctcatttaattggccccacaactcctttaggttggtattattatcatttccatttacacatgacgaaactgagagcacctagaggattaactggatcctaacactcaaaggctttgtgatatgaagtgttcagtgattaatgtgtttgataaggttgaagatttggggtgcatcatttcatatcaactatagtaggtggaccctgtcaggagaccagggaagagatgattagaaaacccagatgaaagaaactaggacctttatcaggaactaaaggtgaaactatacatttagatggtgtaaatgccttaggggacctgaaaaatggcaagcatttaaggtgaaaggtaaataggtgagtagccccaattgaatgtataatattaatgaaagtcacatttaaagatgtttagacataaagcaaatggtcttgttatttagcgggacttaaaaggtaaatcagtaagtggagaaaatctcatctacaatgggaaaatataattgagcttagactggatataaaagggcagaagtggagagctagatctatgtgtatttatccagggtttgttatgagcccagagaaaatgtaggaaaagaaattcaacaactgaaaaagcaaaaaattaaatgaatctgaacaaagaaagctgcttatattagatatattttctggaaaaagatataggtgtcctgtcttagcaaaataggaactagaacaaatgccaccatctttcaaaatttaatattttcttgctacaatttatgtttatgatttatacttatggatatgatactctattaagaggcatcttgtgtgaaacaattatcatatacattgcaaaatagaatatgtataaatgtttccgtgtatatgtgtagatgggtttgtgtgtatgtgagagagagcaaagagggggagggagagagagggaggagaggagaagggagagagagaggcagcaatttctaagtatttctaaacataggagggttataagattatattcatggaaaaaagacatgttccagttcaagctgtatgcatttatacagtggactactagtatgatgaagctggagaacaagtcaaaacactggagtggaagcagaataatcacacacaagacaggtgaaatattccagagtcaccttgaaataaatataaaattgatgttggcagcctgacagtgacaggagtcaagaaatgatgctgctgtgaaatcacaaaagatgcaattgatattttaatctcaaataccacgtctgaggagaaagcctgaaactaggaattgtttgtaaaagtgtatctgttgatagatttctgattttgctgcttttcatttttatcctcttatggagaataataataaaagtagtcacatttttagtttatattgctctttaatttttttcttaaaatgaatttgaatttttttaagacaagaacataatatgctctgaaatcgtgtcattagatttaaaaaacattattggagatatttttcttgttagaccactgcttttcttaagtgaagttgaccttttgagtttttagtaactaaggtatttgtgtgtgtgtgtgtgtgcgtgtgtgtgtgtgtgtgtgtgtgaaattcattatatttgttcttctaaaactattttcttcagttctaggtttcctagtttggagcagaattctatatttttcttgttttatgccctaggaagggcataaaattattttgaatatttttttccctcttcttcctgacccatgtaatcgcctagctgaatcaggcctccccagaaactgattcatggtcgttgaagtatctcatatgacccccatcccacctagtccgatattaaccctataaaatgtctcaaataaactcttattttcgtggcctctaatctccttaattttttaattttagattcagggtgtacatgtacaggtttgttacatgggcatattgcatgatactgaagtttgggcttctaatgatcctgttgccgaagtcctgaacatagtacacaaataggcagttttctaacttttgcttcactcctgtctttcccccttttggaatccccagtgcttattgttcccctctttgtattcatgcgtacccagtgcttagctcccacttttaagtgagaacatgtggtaattggttttctattcctgcattaattcgcttaggtgatggcccccagctgcatccgtgttgctgcaaaggacatgattttgttatttttttatggcaatgtagtattccatggtgtatatgtaccacagtttctttatccagtccactgttgatgggcacctgggttgattccatatctgctatcacgaacagtgctgcaataaacatatgagtgcaggtgtatttttgctagaagaatttattttcctttgggtatatacccagtaatgagattgctgggttgaatagtagttttgtttttggttaactgagaaatctccaaaatgttttcacatcagctaaactaatttccattcccaccaacagcgtataagcattcccttttctctgaaacctcgccaacatttgttattttttgactttttaataatagacattctgactggtgtgagatggtatcttgttgtggttttgatttgcatctgtctgattatctaatctcctttaaaagcttcctacatcttcctgaaaatatatattgcttgattaattaatttatttatttttcccttccctttttcacaaaggattgctggctgcttatactaaaaccacatattattaaataaacaacaacaatgtaaaggacacaaatgatgcaaattaatcatataaaagggacaacaattttgctgtgactatttttcttactgtcatttgagcttcctagcagggaatataaaaggcaagacacagtctccaatgcaggactcaacataagataggaagatatgttaattgctgatttcattaaattttatccagccggttcattctaatgcctctgttttttcaactgtgcaatgaagatcatgcctaccttgtagagctactataagtagtctgatagttcagtgacacatatttcagtgtgctcatcacatttatccaagggtagcttccgagatcaccgtcagtttcacaggaccttatctatataaatgatgatgatgatggtggtgatgataattatggtgattacagttagcacttattggtaacttgtaactgggaagtatggtaagtattttcttggcttacctcatttaatcctgaaaacagctctatacagtgggtacttttaaaatgtgcattttgcattgaggagaccttaggctgagtgacttgatgtccacacatataatatgaatctgctatatgtttatatatatagcatttgaatttgtgtatttgaatttgtaatgataaatatgggagaattaccctgttttcttacctcctctcactactgcaacttattaattggacgaaatatgaaagtaataaattcagaagagacagagagcatttttcaatgttcattatttcagtaaaatataaacagctcacagagatatttgaaaaatagtgagccaaacacattcatttcatttttccttgttcttcttttagaataacaagcctagtatgtctctgaaactttttgcaatctatccggttataatgttagcaccaatgtagccataagtaatttttttttgccaagtttgccctaatgcattatatcatttgagtgcatgggaagatattagcgccattaaaaatattagtaaaactgatttcagttcaacaacctgtacattgaagttgttgcatttatctatttacatctctctgttctgtacaaaagcagcaacttaaacgatgtagataaataatagtgacattttatctccctttctaaagttgaattccagaaggtaggaaagatcctttcatgcttacattaccatgacaaactgaaagagataaatccctaacggatgggatgagatgtgggagttagaggattaatgcttagatgcttcctccaatttatttctcctattatatgtgttaaaaatatataccatatgtcatgcagcatgttttaatcccatcaaaatgtctcacacaattccttaggggatatgctttttgctgccaagttttcaccgctggaatgctgacttactattcctttgcagagagcttcatggtttattttatgataacatgttgttataacttctctggctgtaatttttataaggagaattagtcccgggggaatttattttgagagtcatatgcttaatggtgacagaaaaggagagaaatatttccaaaaagcaatgtatccttcagttgttttaatagaacagaaattcctttgacaacatttgtgaaagcctttattatacccagcatttaaattcagtccttgaaatggggttttcccggatcatttgaaggtcaattttggaatagttcttgtgtcctatgacacctttcaatgatagcactttacagagaggaacaaatttaaggcaaaaagtctcttttagtgatactaagtatacatgacttatagcaggtgacaaaaaagctgcatataattgccctagggagaattttctttgtgccacgttgtcgctttaaaaaaaaatgcatgtagcaaaatttcacatgtaccccataaatatatacaaatataacatatcgaacaatttaaaaaatattgaataacaatgtgagcgattaggtaaagaggacaacttgaactaattttcacgtcacaaaaaaacaaggttaaaactttacaccaggaattaacaacatgttaccttcgggttcctctgtgtgatgttttagtttgaaatctcagtatccttaaagttaccatttgttttatacgacattgttcagctaactcatgtaggctagggcccactctggcccccaggtatatgattttcaccaatcagggatcactacaagatttacttaagtactcaaatataataaagccaaagttattatttagttttttttttttagaaattaagttgctccgaaatgtatgcaccctgtttccaatcaagccttctaattgtaataacattcccccacagaggctctgttagcatttatgggctatattaagaagaaaaaatacacacacatgagcacaattccagagatgccctttgggttttgctttccttattggaagatataacctaaatggatgtcaggtgtgcaaatagactatattttttttgttccataaaatctgctgggcatggttcaaatgctgtcttttaagccctttgatggtacttaataaatgcagggatgcaaactgaggagttacttgacacatcatcatgccattggcagtatattgatggtaaatatgaaataatttgtttctcccctccccaactctaacctcataagtttcacacatatcagaccttagcttctctttgtcagactcaaattggatttccttttctatcatctctaggctcagacttcgatgaccctaatttggcagctcttcaaggggtttatggtgtaagccttttctatttctaacaaaaaacacagctcaaatcctcttcacattagtgaatactgtttgaagtttcattttccaaaagataccatactttcttaactcaatttttaaaattatttttactttttctgtactgaatagttagtacattttaattttgagtgaaaaaaagttggtttgaatagaaagtatgcattaaaattctccataactggatttcgtagtcaaatctaggacagaaataatataaactattttatatactattaaataaatgggatatttatttaagcaactgttatttataatttaggtgctacttctacatttagggatttagtatatactcctgttggccagattttaacagagttcaaatttcttaaatggtgttctctttagcttaaataactatatgtcacaaaaatctgaaaaaaacatataagattaatcatgattttaaaatttaattgatgctggataaatgtaattagaaacaaaatttcaaagttgtattactactagaaattctcatctgatctatatattaaaatatagtcaaatatttaaggttgcctacattacagtgggaaaaggtaaattgaagttgcagcttcttatgacatataacctatacatggtatcatgggtcattttgcttgtttcatttcccattagaggaattttaatgaaggaggccagtaaaatgttgattaataagtgttgatgtgaaatacacttactgggccatataaaagtggcaagcttatgtagactaccccccaccattattatattttttaattctatgagtatggaactccagaagactggaaaccatagcttttatctttttcccatgagagttatttatccagcattttcttcaataattctacaagatataactagagacatagatcctattagtttggtaaacagttataattattacagtagccttccttatttttcacctctttgtcccaattcattcttattaagatttaaatgttggggataatttattttaccaaatgttatagaagacagagaaattaaaagcaaatggctaaagccgacataaggtttcaagagctaactgaggataaaactctaatcgtgcagactttagttgctgtattagtctgttctcatggtgctaataaagacatacccaagacagagtaatttataaaggaaagaagtttaacggactcgcagttccacatggctagggaggcctcacaatcatggcagaaggcaaatgaggagcaaagtcatgtcttacatggcagcacacaaaacagcttgtgctgggaaacgcccatttataaaaccatcagatctcctgagacttattcactaccatgaaaacagtatgagggaaaccgcccctatgattcaattatctccacctggccccgcccttgacacatggggattattacaattcaaggtgagatttgagtggggacacagtcaaaccacaccaatcacgtcggtaagggtgagtcaaatggctagtgttccctcaaaagtgagtgtgctgcaagagggtatatgtgatatatgtatgtgtgcataagcacaatcacaagattaatggattttaataaaagatgaaaaagtattacccagaatactctatcaccccagtttgcttgattgatcaattggcttccggtatcataacttgcattctcatcccacttatatagttaatttttatatttgtaataaaatgtatagacagtaaaaataatatagtaaatatatatattatatataataaatatagtataactgaacgaataaaataataaaatgtatagacagtaaaaataatatagtcaatatatattatatataataaatatagtataactgaataaataaaataatatttttatttccttgcttttatagatattatctccaagaaaatcataggggaaaactttaaactgttattgttggtcagtcacttaatcattaaagtaccctaaactttttttccaacttgaagtcgactttcctaggtatgattttaatggctgcaacacatgccactgcatgattctccattgttgcctttcagattgctgtgattttttttaaaactacaaccaggtacatgcagataatgtcttcaatgttatctgataaataagataatttgtaggcaaaaaataataataacccttcaggctctttataaatgtttttaatctaagtttccaagagacctggaatcaattccatgccttaggctaaattcttaatcttccttggagacatgttcttcctccagacctcctcaatttagtgagtggtaccaaaacccaccctcttgctcaactcaaaaacctggctgcctctttctccctctcccttacccctgctttttgccgttatacgctatcatgtttctttccttctacttccttgcagtggtttccatcacatttagaataaaatccacctttttaaaaaaatataatctacatgctgcccacccctctaacagatcactaactcccaggcacacggagcagacagactctcctgtacatgctgttcatctgtttggaatgttcttctcgcacttgccatgtctggtttctttttgttcttcaggggtcaattttaatgttccatttgcacagaggccttcctagatgacctcaatctgaagtggctatccttcgcttgcataatacctttcctttctttggtgcctttttgcaatgtataatattatttaatatgtttgttggcttacttgtttaaatatctctctttacaactagatatactcatgaaggttgctaccatgtctgttttgtttaccagcatatatgccatgctaatcatgttgcctgacacattgggttatagtggattggactgcttgggtttttgtcctggctctgaaatgtattaactgctgtccttgagtacaaatgtaagatgggcataatgataatacctaccgtgaataaaccaaattattcatatacagttattagcatagtgcttggcacaatatacattctcaatacattgtagttactattattttgttctagtaggcattcttgaaatattttttgaaagagtgaaataatgagtttattttgtgatataaataagtaagtaattacctctttggtatatgagtatgccatttttatcccaatctttattgctttgagtatcatcctttaagttactaataggtagctgggcatggtgactcaccatggtgacccagcattttgggaggccgaggtcggcagatgacctgaggtcgggagtttgagaccagcctgaccaacatggagaaaccaagtctctactaaaaatacaaaattagccaggcatagtggtgcatgccagtaatcctagctactcgggaggctgaagcaggagaatctcttgaacccaagagacggaggttgcagtgagctgagatcgcgccactgaactccagccttggcaacaagagcgaaactccatctcaaaaaaaaaaaaaaagttgctaatatgctaaaaataagaataatgctcatgtttttacttccatacaattgattgttagaggtgaaaccttttcccatctgcacaaatttctggaagacaataaatgtttcttcttctttcattaatattttaactgtggaggtatctgtttcaaaatgtaaaatccaataggtaatcagtgaggaatataacctagattaacttttttttttcaaaataaccaaagcacactcagtttaagtttcatgttaaagtgagccaaatgccagttaccaaaatattggatggctatgtatataatcctttgctgatgagtaatttagcatcaatttagagatgttattttttttctaccagatgctcgaaagcattaaggcaagattagaagtcattgtcccttcttctgttatcagtggtcccacaatatttgtttatatcaccattagaaacaaattgtactgtattatagttatttttttgtttgtccctcctattagagagtgagttcactaagggcagacattatgttttatactttattgatgtggaaagcaggcagtaaagaaagaatgaaggactgattattggacatttgttattaatgatcttagcttattattttcctccaaatgaaaatgttttagtgaacataaactgggaaaacagcaggagcaattcagttaatactcagttaccttgaagaggttgaagcagaaagtgtttgtgtcagttgttttaacataattgccagtaaagatactgaaagtattccctcatgataatgagaaaaatccagaacacaaggcttgattactcctacaatatttgcctgctttgactctgactgtgcttaagtatatccaggcatgctgtgcaaagtacagaactgaaataaaataatccctagtccaatcataggcttacgttactaggataagtcaagtttgtggtttcacctgaagtaagaaagcattaagtcttcttatcacacccaatcatccatattaggcttgggatagaaaaggcactagagacagtagggataagatttagtccagggagtaagtacttggtttcattaaaactaccctagaattggctcaccagtattaattaagtcctttttatttgtaatctcattcatcattctctctctctctctttctctctctctctcccccccccccgctctcatagagcaatgttaaacaatgtacacttctttttttaaagttatagatttctaaatttaaaatgttctgatatagtctagctctccaattagggagaagtagaaacatatgctgctcagcttttctaaaatcttttaaagtaatcaattagcatatgggctaagttcactttagatggatacacacatgcactatatatatatattttctttagacatgttaaggcagtggataaaatttccttttgcaatcctttgctcatggtatattaatgctgatagtattttatgctattttgtgttgatgctctcagcacaaattggccccaaaatattctgtattcaaaagcatgtatttttttcctaagcgtactatgattttaatagaagcagaaatgagtgtttccttcttttgtgaatttttgggagggcatgcttccctgcagtctctggagtgtgtgttgacattttttgtgccatgatttcccataagtaacacactcttttgatagtgaagcagtgagggaaagttgctaagttccatctgtaagaaagcattatcagaagtggaagaagggaaatttactaagttccatctgtaagaaagcattatcagaagtggaagaagggaagtgacaagaaaagattcaaagttgttttgttttagctccagtagatgctttataacacactcctaaaaagagtgtgaatataatatagttaatataaaatttattttatataaataatttataatcttcaaatataaatttgtttttactatataagcaatgtaacattgacctaaaaattgaattgaaaaaatataaactttcttctcagaaactgggttctcaattactctctatgtacctgtttataaaatacaaaccatctagataatcattgcaccacaatttgtatcaaactctgtttcttagccatcctagagtacaatcaatatcattgatcttttcgaaaaaccagcttttggtttcattaattttctttattgtagagttctgtttctttaatttttttattattatttttgagaccgagttttcctcttattgcccaggctggagtgcagtggcgctatctgggctcactgcaacctccgcctcccgggttcaagcgattctcgtgccccagcttcccgagtagctgggattgcaggcatacgccacgacacccagctaattttttgtattttagaagagtcggaatttcaccatgttggtcaggctggtctcgaactcctggcctcaggtgatccgcccacctcggcctcccaaagtgctgggattacaggcatgagccaccacgcctggccctgtttctttaatttttagataaggatctacctttaacttatgaatataatatataatatgaattatgaatattatgaatataatatgaattatgaatattatgaatataatatgaatggcattgttgtagggtgataactattttaattcaccttcttgaaatagataacatttggcttttggttagattttagatttatctgttaatgttcagaaaaagataaaagataaatcatggaatctttttttttatttttttattttattattattatactttaagttttatggtacatgtgcacaatgtgcaggttagttacatatgtatacatgtgccatgctggtgtgctgcacccattaacttgtcatttagcattaggtatatctcctaatgctatccctcccccctccccccaccccacaacagtccccagagtgtgatgttccccttcctgtgtccacgtgttctcattgttcaattcccacctatgagtgagaatatgcggtgtttggttttttgttcttgcgatagtttactgagaatgatgatttccagtttcatccatgtccccacaaaggacatgaactcatcattttttatggctgcacagtattccatggtgtatatgtgccaccatccatggtgtaaaaatgctcaccatcactggccatcagagaaatgcaaatcaaaaccacaatgagatactatctcacaccagttagaatggcagtcattaaaaagtcaggaaacaacaggtgctggagaggatgtggagaaataggaacacttttacactgttggtgggactgtaaactagttcaacccttgtggaggtcagtgtggcgattcctcagggatctagaactagaaataccatttgacccagccatcccattactgggtatatacccaaaggactataaatcatgctgctataaagacacatgcacacgtatatttattgcggcactattcacaatagcaaagacttggaaccaacccaaatgtccaacaatgatagactggattaagaaaatatggtgcaaatcatggaatctttaaaaaagaaattttattcctgtgttaatgtgtagttttaaagatttgtttaacagtgtgtactaatgaagcataatagataccaaaatgttttcattaggaacaaaggtcaattgtgcgagaaggagtcaccatttatgacctgacaggttgaggtaatgcaggcagggtaagacaatacatgagtaagcaagcccccctcccaacagtagtcatcattaataggaactcactgcatttagggttaacagatatatgatgggtttgaaaattaccaaagtggaacccagatggatatgtagatttcagtatcattatatacttggaaattgaggaaatagtgtagaaaaatacataaactggaaaaaatcttatcagtcaagaattaagttctagggacttgctttgacctctcattcattcctttatggcctcttaatttctctactttttctaagcttctctctgcatatatcttcactcttatctccctaagactagctttctctacttattcataggttcctccttatcactttagattacatgtggtcatcacaacttctttggccctaagtctaccttaagccttttgtttatactcagaaaggaggactctgattgggctagctcatcttttctaatgaaaccaagagataggttacttgcctgcataggacttggctgcccttggttaaggggccatcatagcaccaatcagtcatgtctggtctggccatggggatgcataaataaacaaatggtcttacctttccaacctcttcctcaatcactacctaccctaggaccacaaactctatgttctatccaaaccactcttttccacagatacctaatcatttcactattcacagtgttaacctgccttttctcacttcttgaaatttccatcacagaatgcatgattaatctcaaagcctcatcccttgcatgtccccatgaagtactcttttactttcctaggaaaagttaacactctgatagtgctttgtttatgattgaataaggtcacttctggtattgtatttccactatgagagtgatgtacatgaactattgaatataaaaacatacctttgataccattttgttgtatagtttataaaagaaagctatgacaccatagggttattaacattatattacttaaagtagtggtaaaaacaacacacatatacacacacaaacacatacacatacatagcacagccagacttggcattctaacatccccacacatgagaactatcaaagtatcatttctgagctgcgttgtttttctacttgtgccctatttctaatagtggaagaatttttttttaaagcaaagctgttatcttttaaacactggaataaaaaaaaaattccattttctgcatgagtcagttttttcagtgaatattttcagcaaatgaacaagctctgcattaaatccatgctttgttttagtagtttccttgggtggactagtttcaccgaatgccatgtgtaaattggtcacatagaacaagaatttatatttccacaattttatttggaactttgaaacttccattatctcacagaacccagaaattgaattgaggctttgttactaagccaggttgtagcaacagacttaggagtcagtagctcaattttctacttctttgcatcaaattttctcctgagaatgatgcatgcaatacagaggaatggcagggaggagcctctgtgaagtgttaaatgtttggttcactgggtcctatcagcaggtagggcctgtggggagcttgtttatccagcagaacaatctcattatgaggacagtgatgtacaatagtttgcttcataccccaaaaccattcaaggaaacgactgagtgaatgatatttttccgggccctgtattatgctattatgacttgcaataactggcagcatattaaaacagaagtcagggactacagttactctgttgaatgaagttctgaaatttcaaaggtgttgattattcagtattttccaatttacagaataaaagagtatgtgattgactatttcatggcgcagtaatggaaataaagaaagagaatgaacaggcttgattaatttcagagtaaatgcttatttttcataattgcataattctcaagtgggtctctgtgtagaccggggtggccttttctgtcaaatacaaagataagaacttggcattgaaaattaaggaacaataaaaaataaatatgtgtgcatgtgtatatatgtgtgcgtgcacatacccttgtcatcactaagggcaagccaccacacagccttggttagctttgaaaatatctatgaatactacattgaaaaaataaagtaagatttgggacaaacatccatcttcctcatgacaatatgctgggaacagctgtaagcttagaataaagtggggaaccctgcttaatgcgctatgcagtaagcttatcaaatctcagcccagctagaacagtgccctaggatacaacaggcaccttgtaaatatctgttgaaataaaggatgaatcagtgaacgaatcaatgaatgcttctgtccagaagtgacacagactaaatgctgtaaaatcattcatcctctaaaatttcaaatattgttggttgtctgaaacatattaaaggaaagggacatggtatgaccactaagtgtctgaagtcttaacttttgaaggatgcatcaagaaacccagctacatcttttcggtagaaagtagctaaagaaaggattctgaattggatgaaccatgaagtcctaagttcctctttaaagctatttattaaccatacaaaaacatactttcactcactgagaatttaaacttttatttaaatattagtgatttactgcattaagtgttatcatgagatagcatctgctaggccagaaaattcatctagttttgagtttaatcgttgttaatatgcagactgtaaagataatctcactggtaaaccagtgataaaccagcacttgatgatcttttaattgctaagtagcactgaggcagcttacatttggctttggatttagtagatatttatattaacaactggccagtacagcttttcacgtaagtacttcacctcaaatttatcaatcctttaaaatatacatgaatttaccccacacccataagctgcactctcaaagataggggaaaataaaaccaaaagcaacaaagattgaatcaatgtaattttctgctgtttaaacataggtttctacttaccttgattatttaaagaatgcctgaaatcatgccaatgaaaactctggaaagtagagtttaaggttcaaggcaaccttctttttttttttttttctgtgctgccatcatctctcacctgaactattgcagtgatcttctaataggtcttctttttgatgtctgtcacctacattctattgtcaaccaagcaggcagagagcctattcttaacagctttattgaggtataattgatatacaattaatcacatatatttaaagtgagcgatttggtatgttttgacatatatataaactcatgaaactatcatcaccacaatcaagactgtgaacatacccatcacactaaaagtttcctcatggccttttgtaatgctctctccctttcgtcactatcccagacaatcactgactcgctttctgccactatagtttgcattttctagagttttatataaatggaatcaaaacagtatgtactctgttttgtctgacttttttcacttggtgtaattattttgagattcatccatgacatgtataaataattcattcatttttaactagtatttaattatatgactacattcatcatttgcttattcacctgttggtaaaatttacattgtttacaatttggagctactctgaataaggcttctatgaacagttgtgtgcacgtgtatagacgtagagttttcttgtcttagtcaaatacctaggaatggagcagctagatgacgtgaagttagtccatttgttcttttatgagttatgcttttggtgtcttatctaagaaacctttgcctaatccaaagtcacaaagattctctcctgtcttttctaaaagttttatggttttatgctttacatttggatccatgatcctttttaggaaaatttttgtttacagtagaatgtatgaatcaaagtttagattttgtcatatgggtacccaaatactccagcaccatttgtctaaaagagtatcttgtctgcactgaattgcctttttgctttgttgaaaatcagtggcaaatatatgtgtggatctatttctggactctaattttgttacatttatctatttttctatcttgatgacaagactttgattatgtttgattagtttgattatggtaactgtgataaatcttgaaatcaggtagcataagacttcacgctttgttctttgaaaaagttattttgaatatagcaggtacttaacattttcatgtgaattttagaattagtatgcccatttgattgtcattgtattaaatctatataacattttggagataattgactaattttttttaaacttctgttttacattcagggttacatgtgcagctttgttatataggtaaattgcgtgtcatgggagtttgctatacaggttatttcatcaccaaagtaataagcatagtagctgataggtagtttttcaatgttcacactcctcccaccctccaccctcaagtagaccttgttatctgttgttctattctttgtatccatgtatacttcatgtttagctcccactttataagtgagaacaggcagtatttggttttctgttcctgcattagtttgcttaggatgatgacctccagcttcattgatgttgctgcaaaggacatgatctcactcttctttacggctgtgtagtattccatgatgtatatgtaccacattttctttatccagtctaccattggtgggcatgtaggttgattctatgtctttgttattgtgaatagtgctgcgatgaacatatgcatacatgtgtctttatgacagaacgatttatattcctttggatatatacccgataatgggattgctggatcaaatgatagttctgctttaaattctttgagaaatcaccacactgctttccacagtagctgaactaatttaccttcccaccagatgtgtataagcattcccttttctccacaactttgccagcatcttttgttttttaacttttaaataataaccattctgactggtgtgaaataatatctcattgtggttttgatttgtatttctctaaggattagtaatgttgagcattttttcatgtgcttgttggctgtgtgtatgtcttcttttgaagagtgtctgttcatgtcctttgcccagttttgaatgctgttgtttgttttttgcttgttaatttgtttaggttctatatagattctggatattacacctttgttggatgcacagtttgcaaatactttctcccattctgtgtgttgtatgtttactctcttgatagtttggtttttgctttttgttttttatttttatttatttatatatttttgccgtgcagaagctctttagtttaattaggtcccatttgtttacttttgcttttgttgcatttgcttttggtgtccttattatgtaatctttgctagggcctatttccagaatggaatgtcctagattatcttccagagtttttatacttttaggcgttacatttaagtctttaattcagcttgagttaatttttgtacatggtgtaaggaaggggtccggttcaatattctgcatattgaaaccagttatttcagtaccatttattgaatagggagtcttttccccattgcttggttttgtcaactttctcaaagatcggatggttgtaggtgtgtggcattatttctagactctattctgttccattggtctgtgtgtctgtttttgtaccagtgccatgctgttttggttactgtagccttgtagtcaggctttattactggttcaatttcagaactcactatggttctgttctgttattgttctgttcaaaaatatggtttctccctggttcaatcacttataaaggcttggtttggctggatatgagattctttgttagaattttttttttaacaattctgaatataggcccccaatctcttctggcttgtagggtttttgctgaaaggtctactgttagcctcacggggttcctttgtaggtgacctgccccttctctctagctgcctttaacattctttcttttatttcaaccttggagaatctgataactatgtgttttggggatggtcgttttgtacagtattgttgcagaggttctctgcatttcctgagcttgaatgctggcctattagcaaggttagggaaactttcatggatgatgtcctcaaatatgatttttctttctgtctttcggggatgccagtgagtcatagatttggtctctttacataattccatatttcttggaggttttgttcattcttctttattcttttttctttatttttgtctgattgacttaattcagataaccagtcttcaagctctttgctcagcttggtctattctgctgttaatacttgtgattgtattatgaaattcttgaagtgaattttttcagctctatctgatcagtttggttctttcttaacatgtctattttgccttccagctcctgtgtctttttattgtattccttagatcccttggtttgggtttcaactttctcctgaatctccataattttcattcctatttatattctgaattacatgtctgtcatttcagccatttcagcctagttaaaaaccattgctggggaactagcacagttgtttggaggtaagaaaacagtctggctctttcagttgccagagatcttgccctggttctttctcatctgtgtgggttgacgttccttcagtctttgaagttgcgtcctttgaatggcactttttgcttttatcttctgtgatgccagtgggggtttgtttgtggtataaggtgggtttcaactggcctcttttctggaagattttagggggccacggctcaacacagcactcctggactgtgtgttctaactctgagggacttttaccgggcccctgcctttgctctcgagccccttgaagttaagatcttgctgtactggagggacctaagtgttcttggtccactggccacaacacgctgttggagagtgccagccaaagcgctttgtccagtggtagcagtgggatctgtgctcactcgggtgtgccagcagccacagcatgtgtggtagggtgcacatttttcagctgaggaggggcaccagtgggggcagggttgctgtcatctgtgctagcatttgcacctgcagtggtgggagtagggcacttgcagaggcagggtttcctgtgcccatacacagattcacaccggtggtggcagaagcagggttggtagcatccatgcgtgtattcgcactggcaggagtgggggcatggtgggggtggggttgccagtgcccatcaaggcaatcttctatacttgaatttgttaatcatttcacaatacatatatatgtatcttaaaacaaaacatcacattgtatgccttaaacatatacaatttttatttgtaaattatgcctcaatacagctggaaaaaaaacacatgcaaagttacataaatatccccatgattttttcctcaagttatcaccccttttttcttacttgagtctgagagtgtttatgaaaatgctatgaaaatgaagaagtactaaaccgataacatggatggatattattatatgtatgacaaaaatgagaaggaaaggtcctgaaggaggtacacagatacatttttgtaataccctgaacaaaatgcagtatgtcaacagataccaatcataatagatatatgattacacatatgaatgtagattaatgcccaaaacagttgtatgtgaagctaatctgtttacaatatattatatatttcatgagacttctctgataaaaatagacttggcatcacttaaaaaatggttctaacctttttaaaagttctcacttagaaattcacttggcggagcagtacacaagctgtgtgtgtctaattttcctctacaatctctgtaagaagttaatcaaataggcaattaatctgtatgatattattcatgtgaaagcatatgcatattaaaatacacaacagacttcattcttattttccttaaatttttctctaatgccaggggcttgaatgtccagcagagctcacaatatgaaaaggatacatggcagtgcttttgttgcacataccagaaagtacaagcaataacgttctgctgtataaacacctgtaatgaaggcagaaaatgtgtagtaagctaacaaacaagactttgaccccaacaacacttatctctcgccttgaatctgcttttgctcctcatttccattaatagtgccacaatcttctctggaatcctgatttgaaatctcagagtcatcctagactccttctcctccttcatctcgcccttctgatcaatttcagcatcctgttgattctgactacaattcttcccacatttccttgtcatatcctttgctacttcttttttttttttgtaacctctattttaagaactttctgagttgtctccttactcctagctatccccttccaatccatccttgatattgtcctgaaagtgatatttctaaaatgtgaatcagataataacacttcgtttgcagacatttaccactgtcaacattggttttagcagtgggtttcaaagtgtcatccctggaccagcagcatcacctgctttgtagtaactactttgtagtaacgcagatccttaggtcccaatccagaccttctgaatctgaaactctgagaggggagcacaaaactctgtgttttaaaaagtcctccaggtgattctgatgcacacgaaaacttgaaaactacggggctacagaattaagttcaagttttttggcatggtgtcttgccaaacctgtcttttctgcacttattttcacctccttacactcttctgtactcctcaccactccactatttcagaaccttaccatatactgtcctattaactgggataaaccattggcttgcaattttctcttccaaattatcaggttttgaacgaagcacatttttaatttcatctctttcttaaatcctttttgatcttcctagacatatttcctgctccattatttcatctgtgaaatggaaaacagttctgggttgagaggtaaaacaaacttcttgctttgtgtttcctcagtaatgttatctttgctctcagaatttattcgtttttcttgtgctatacatggtttttgacaagtctgttcccacttatagatgatatcttcaagggtgatgcaagtctcagtaatctttgtcatagaagagtgagttgcacatcatatgcggtctataacatgttgtctcacaccaatatatgacttgaactttaatgcatgattattttatatgttcattgctgaaaacaatccattagtccatttgggattgttataaaatttaaagaccttttgtaacttactatcttgaaaagtgtaattctgttcttttgtctgctctaaaacaaaaacaaaataaaagtaaatctgtgccttgaaccctgttactttctctttaaaggatcaatttgctggctgggtgtcctgccatctaacaggccttccctgtgaggctcctctaaattgggaaaaggattaaattttatcagtgtttgtttggtctgttgctcatcatgttgatatttaatccagtgtccaacaagtgtcccaaaggaataaaatgcctgaagctggcaatactttttgacctatctgtctgaacatattcctatcagtttttacccaaatagagggttttccaggagacatacatgagctaaataaacaatataatagtaagcttaattcagtaaactatgtttaatatatcaacaaggatttattgagttctgaagtacactcaattttgtgaaatcaaattattctgagttagaaaattgtatcactttgcaatattataaaggaaaaatgcatactgctattttttaattatcagggttaaaaatatctacaaacaatagttataagcgattgtgttaacaccaaagatatacattttcaatactcatttaagtgaacagttatttagttaatcactaatttattcaacacacatttattgattgcctattgtgccccaaatatatatagatatggaaatagctctaaatttataattagagctaaatgaggtttttttttcttttttaaagatagggtcttgctatgttgcccagacgagactagaactcctgggcttaaagaatcctcccacatcagccttttgagtagctgggactacaggcacatgctgctgggtccagtttgagatttagatatgtagatgatagatacatagatagataaacagatagctaggcagatatagaaatagagataaagatagagaaagatagagatagatatagagatggcgatagagatacggtaaagtcccacttctcagagtacaccacacttcagtgatcaatgaaatacatgtaagcaaataatgatttaatatgatacatgctaatgaaagtatgtattaactaaagaacatagggtaactaaatagtcaaaagaatgaaaaaagtcttcaaagtcaaagatggaccatatgtaccaagattttacctatctgcatcagtttcttatgcgaaggctaataaaagaaaataagaatccagattttcttgtaggatgacgtgcatctgtttgtgtttgctgaaatagcagggctttttctgctcctgttcagtgtgggaatggaaagcagaacatcccctgtgttccatgtactgtgttaggtactttctcatgtcacttctaaacactaagagaagtaaaaaaagaagattcaaaaacaagtcttaagctgaatttacttaatgcaaggcaggaataacatgatcccacacagatgcatgggaccttcagattaacagttaaagaattgttcagagaaaattaacctaaaacattgaggatttgttcacatatagacacatacaaggaagagcaacccttatgaagactttttctcaggccgaagtcaagtgtagagctttaaaaaggcaaacttagaagtttgggtttgtttgtttgtttctccaacaacaagagttgctgctgcaaagtgagagtcgctctccctactttttagttattattccaagatatctatccaagtagacacaggttgagtatcctttttttctgaaatgcttgggaccagaagtgttttggatatcagatctttttcaaattttagaatacttgcatatacagtatataatgagatatcttggaaatgggacccaagtctgaacataaaattgatttatgtttcatatatagcttatacacatagcctgaaggtaattttatattttccttggggatgctaaataaattgtgttctgtgaatctacattttgactgtaacccatcacctgaggtcaggtgtagaattttccatttgtggcatcatgttggctggcactcaaaaagttttgaattttggagcattttgggtttcggattttctgattagggatgctcaactttactttaaagtaacataatttatccttctataaatatagtattttgttttcatattagtatgcaacatgtataaattatatcattagacttttttgaaagaattcaaacttcaagtttgttaccatgaacatatttttagcttttacataggtagtaacagtgacttaattaaaaatactttttctactcttatttgaatatattgataatagccaatatatgtagttttcttcatagtacatcagtagtgaaggaattacttctgaatcttaattccattactgtcttcatatatgctcccagaactttatgagaggtaacaaaaatgaatgaatatggtacttcttactcccactccccaatgtaacttcatggcttccttcataaactcccattggctgtgaaagaacgtgtactgcagagatatgttgaactggagtatttccatagaatcctcccatcagggaaggagagtaccaatagcaaattttctgagagagacttacagaagggtattttattccgaaagggagaaaaacagattaagtactaccagcatccacaattacctgatgataattttaaaaaacaataacaataaaagttatatgaattacatacaattaatgtgtactgaaatcaacagtgtctagaaatatgcttttggaatgattgttcccaagccaacaaagcttgtgtgctgaagtaagaaaaaactgaatggatcaacagcaattctgttcatcaagagttagattttaagttatcacatatccttttaagatttgaaaagtctcactacacaaggttaaaaaatatactttgtggctatatttttaaagtctttattcacaaggggatacatactgacgtatttggggatgaaatatcattatgtctctaatttcttttcagctggtttagaaacaataatacaatatagaaggtgtgagagagaacatgtgtgcagatgaggcaaaccgttaacaaaggaaaaaaatatatctccttcatcacttctttcatttagtaaaatgttttattgtaactattgaagagagacataggtccatcatttgtttaaatgattttatgcaggccgggcttggtggctcactcctgtaatcccagcactttgggagaccaaggtgggcagatccgagatcaggagtttgatgccagtctgaccaacatggtgaaaccacgtctctactaaaaatacaaaaattagctgggcatggtggcgtgcgcctgtagtcccagctagtcaggaggctgaggcaggagaatcgcttgaacctgggaggcggaggttgcagtgagccaagatcgtgcctctgcactccagcctgggcgacagagcaagactccatctcaaaaaaaaaaaaaagattttattcaaataatttgaatatgccttgaactgttctttatagtgtttaccatcttttcccaggaattattgaaccattttaagtttattttttaacaggatgcatttagtttaatggtagtaaaacctcctaagccatagatcctccctctgtttccatattgaaatgaacaccaagtgtctctaatgtcgtccaaagtgccatttcttcattttgcctctaacttttctttggcacatgacgttgaactgtatgaaacttttttcctgactgatatttaggtatggaataagagtaattttcaggaatatttgtgattttcttccaacattttctcagaaagcatattctgaaagtgtgtagtaatatctatatgcattcccaacacaactctctctctattctcttgatctaatttgttactaactttttaaaactttctagactaaatctttttgcttaccttcaagcattttgttttatactacaaatcttctgagactcgaataattttatcttactgtttatatactgctaacttgaaggtatttcagcctttttcactagcagcgataccctccatgacagatagtcagttatattaacttgattctattgtaatttacatagtggtaaaacaaaataattttacacttataatcaaaattataactgtttaaaaaattaccacctaggattcattttatgtaatgggaaaatatacaaaactgttttgataaatattatatgcaattatataacttggacatctctgtgtagttttttcctcctgtttaacgtggtatgccagctctacagtagtcatgacaggaattatgacaatgactcagacattgatggtgcccaccaagcttccagcatatttactctagatagtacctcaatacagcccttttgtaaaaattttaaacccaaatttggtaattgaaatgaactaaatcaaagaatgctgtgaaattgacacctttattaaaaaacaatatgtgacagtagggagaattaattctaggttcagataaagctgggtgagaaccccagcactcacccttattagctggcatggagtttcttcaactgtataatttggtaattcagttgtttattttgcttatttattcatgcattcattcatttattcatttagtaaatgtatgctgagctggttagcaggcacaattctaggcactgtggctaaaaagggaagtgagaaggacaaagtccctgctctcaaggggtttacattcaaccggggagacagaaagcaaagtggatgcataatataacatcaaatagcaataggtcttgtgaaaaaaataccaaggcatactctggatcaagtgaccaggatgggaaggcaaaaggcctctctgaggaggtgatatttggcaagaaagaaagagaaagccatgcagatggttggcgaaaaatgttccaggcagagggaagagcaagttcaaatgcctcagtttatatttctgtgaatagtaaatgaaagtttatagactcctggcacatcgttaagtgcttattagatgttagatataattttaagataataaatgtggataattaattccacgttattatgtgtcttctttgctgtaatgtacatcctccttttcatctagaccatttttcttctcttgaatattatattatttatcctgttctcagagctgttagattgccctcttattaatttgtagtgactttaaccctgcttgcaatattcaaatgttattactgtcagaggtcctgttttctcagtctttgcccttttgctcaacatttgtatactctgagtaatgccaaattgattttcttgctaagtgttgggcaactgccctctctaaacagtaaaattcacaacttctctgtgatgatgataatgttgatgtacctgccctatggggacctgttgttttgtatgcatgtgcagggagaggggtgatcaaaaaatggtgtcaagatgtcatttggaagatggtacctgcagaaaacacagaaaacccaatcataccccacccccatcctccgcatttcccaccatggtttcttgtttacacttctccgattctcccagaagtcagagcaaagtgactgtttacctctgtctctggctgggaaaaaaccactcccagagctcaactcacttttattgatttctatattgtttggctgtaaaacatttattctcagttgtatcagtttgggtccagttagagaaaaaaacacagtcatttgaacagtgaaagtttttacaaataattattaaatgtaacaggggattatagtaatgaagggattggctagcataaaagaaagatgtattagtttgctcaggctgccgtaacaaaatactatagactgagtggcttaaacaaaagatatttctttctcacagttctagtgactgggaagtccaagatcaaggtaccagccaatttggtttctggcttttggatggctaccttcttgctctgtgctcacatgatctcttttttgtaatcacgatggagagaaagagcaagctctctggtgtctcttcttataagggcactaatcccatcaagagcctcgttctcatgaccctcctcatctaaccctaattacctcccaaagaaaggcctcatctccacgtactgtcatattgagggttaaggcgtcaacatatggattttcaggggagggcacaaacattcagtctatagcaaaagagaaccataaataatagaggaatggctaccattagccctagggctgagatagcacacctgagaaaaagtccctatgttttcatccccaaagcagagatccgcactttattgggaaggtacaaccatagcttaccgaatggcagaaatcgctaagttgctataccagcagaacttgtcagaaatctgtcttcttcaagttaacagagaccctccctctaaggtacctgggaaacatcgccaagctgctggttgccaagcactgtaggagccaggtgctgaagaaggcttgcacgctgtaagagcctgccaagtgagcacattgaaaataggaagcaaatccctttcttcctgaaatgtctcaccagtgccctctccccacaaagcttcagtgccagctagttaagaaaaacatatctcaaaggcccagatctatttttaccgagcaggcagaaaggtacatttagaactaagaggcaataaatcaataaccagcacactgatataaacaaataataaataacagcagaagcagactcagtgaagaatatattgtttgttagcagagtccactactttgcagggccattctcagtttgattcattgctatgtgctctgtgcctagaataaaatctgacccaatatggatgctcagtaaatatttgttggatgaatgaataatctaattgcttattttttttgcctctaatgtttttcctctctttctctgtctctttttttacgatagccgatggatgcactgactggtctatcgatatcaagaaatatcaagttttggtgggagagcctgttcgaatcaaatgtgcactcttttatggttatatcagaacaaattactcccttgcccaaagtgctggactcagtttgatgtggtacaaaagttctggtcctggagactttgaagagccaatagcctttgacggaagtagaatgagcaaagaagaagactccatttggttccggccaacattgctacaggacagtggtctctacgcctgtgtcatcaggtatccctttaattctattactgctgaatcaaagaaagcacaggctgctttctcgtacttaaatgttgctgctatctcttttgcctaaagccgttgtctcaatatttgcatgtgttgctgctttctaaaatttagaatcaaaatcataaaaagatgggattggaatttatattagacattatttctagcttatggagaaaagcgataccatctgggtagctacttatgttaccaagaattactaaaaactatgaaataaaatttatacaggaagtaaaatggtgcaaataaaatgtaagcaaagacttgcagaaaggatgcatagtttcttgctaaatgagttgtaacattttgctattgcccttcgcagacagatagagcatggatacttctggttcacacacatttgcaaagatgatttaggtaatgtgtgtatgtgcacagggagaggaagagagaattaccatgttagagaatatgaaggttgtgttccagattgctttgctaaccaaaacttctgggtcaatacaaaaatcttcccaagtctttcagggccaataccaaagttaataacaaattcagttcctgtatccccaaggatacccaccatacatctacacatctttgtcagcttctggaagaggtatatgcagtttgtttaaagataatgcattgaagcaatgcccatgtaacacattcgcagttaaaaacctcagtttaagcatttagcccctcatagattgtgaatcacatccttcatgaatgatcatgtatgtcattggactattagaacattagcgaagctgggtatagtcatatagagggtgtgtttaaatctatttatttggctttctgtatttgggcttattcagagaaataaagaagaatctaaagtaatggattcccataactcagagaaagtctcagaatcacctagtgtctttttcaaataaaaatttaccgctcctgaaatcctgatcagcagctaacactcctctgtcataaatatcatgcctccctctcaccgtcatctctaataattacctgtaagctgagccatggctacgggtgtgctaggacattgaaataggtcaagttgcataaaagttaaacagaaaggtatctttctaacactagcaacatatattatgttagagttaatgttggaaaatataaatgaatataagtaaagagttgtgcttgggaaaaatgcctaagggattttcaaagaacaaatgcatctggccgggcatggtggctcacgcctgtaatcccagaactttgggaggccgaggcaggcagatcactttaggcgaggagttcgagaccggcctggccaacatggcaaaaccccatctctactaaaaatacaaaaaaattagccgaggatggtggcacgtgcctgtgatcccagctacttgggaggctgaggcaaaagaatcgcttgaacccaggaggcggaggttgcagtgagccaagatcacaccactgtactccagcctgggcaacagagcgagactctgtctcaaaaataaataaataagcaaacaaatgcatcattcctttggcaactcttcttctttctcttagggtttactaatccttttatgattaaacataactcttaataaaagtagaggttttgtaggggtacagatcaataactgtcacactagtacagttaaagaatactgtttggactagctgttcccatttgaccaatagtaattagattttaatttcatatctgctgtgtttctttttaaaaatcattatttctgattgttcatgcatgtcgtaaggtgattcttcaagataggcaaatgtgtgtcctcatttatctgacattagaattgagttggatgtccatagtataatactacatttcgtcacttattattgatggaaaaataatgatgtgttcacattagtaatctgaattttgaaaacactgaggttgcaattctctgatgtatttaaatatacactgtgatccaatactctgagaaactgcattaaaatgcctctggaagggctgggcaccgtggctcatgcctgtaatcccagcactttgggaggccgaggtgggcagatcacctgaggttgggagttcgagaccagcctgaccaacatggagacaccccatctctcctaaaaatacaaaattagccgggcatgatggtgcatgcctgtaatcccagctactcgggaggctgaggcaggagaatcacttgaacccatgaggcagaggttgcagtgagccgagatcgcgccattgcactggcaacaagagccaaactccgtctcaaaaaaaaaaaaaaaaaaaaaaaaaaaaaaaagcctctgaattaccagttgcaataatgaatgaaagattgaaaagtttccaaaatgatgacacttgccatatgttcatatgtctacattttaataaaaggtgaaactaaaagacaaatactttaaagtttatgtgtgtcaagtggcaatctagagaaagggataaactgcaggaagagatacttttgtcactgaaattcaaatatgccaatcaatttgaagggagtgttgttacagctttcttttccaatttggaaaggggtactcaaaagtctttacaaacagcatttgaaatagcacggcttggtgttgacgtgagaggagctcaagggctgtcagttgagtcactgacattttggcatattgttagctatcaggccactaaactgtcaccattagtttttaaataatccacttgcaaagaattttagaggcttgaaaatgttagcatccattctaaggttctagtctttctgataaatattctgagtattaacttgtcaatgaaattgtttatcaagcttttcatatacaactaatttccatttacacttaaatatatgcaattaaatggcatacataatggaaacacctaagactcctatcattataatgaacaagaactttcttatttccttctttaatatctattttggacagaataataccacacaattctttgctccatacttactggctctttactcagtttactcattcttaaatttatattttattttttacatgaaaaagtgaatgaaggaaagctatgtaacaatttcttttgtcttattttatggccatatataaaaacaagtttactcttaaaaaaataaaaatttggtggccaggtgtggtggctcacacctgtaatcccagcactttgggaggcagaggcaggtggattgcttgaggccaggagtccaagaccagcctgcgtaacacagtgagaccccgtgtctacaaaaatgaaactgtttaaaaattagcctggtgtggtggtgtgcacctatagtcctagctactcaggaggataaggtgggaggatttcttgaggccaggagtttgaggctgcagtgagctatgatcacaccactgcacttctgcctgggcaacagagcaagaccttgtctcttaaaaatgaaatgaaataaaataaaataatagttccgtattcttgacctccaactttttaattccccttttcatagttatgccctattagcagtttcatatgcaaagctagctggtatatgtggaagcattccagtgccccccaaatggtagcatgctaagttatttggcaccctatttttaattaaaattttatttttgagataattgcaggttcatattcagttgcaagacataacgtagagagatgccatacccagatttgctcggtggtagcattttgtaaaactgtggtacaatatcataatcgggatattgacattgatacagtcaagatacaaaacaatgccatcacgtctcaagggcccctcctattgttcttttatagctacatccatctctacccaaccccaatcccaaacccctgtcaaccactaatctattctttatatttatagttttgttaatttattaatgcaatattaatgaaatcatacagtatagaaccttatggaattggatttttcactcagcataattcctttgaaatccatccaagttgttgtacatatccatagttcattcctttttattgctgtgtagtattccatggtatggactaccaccatatttattcacttgttgaagggtgtctctattatttccagtttggggatattaaaaaggaaacttctatgaacattcatattcaatttttggtgaacataagtttatttttctggaataaatgcgcaagagtgaacatggattgaatggtagttgtgtgcttagttttatgagaaagaaccaaactatttttcaaagtagctatagcatctgatgttcccaccagcaatgtatgatttctccacatccttgcagcatttgcgattgtcactacttttaattgtagccattctggtaggcatattgtgataactcattatgattttcatttgcattttcctaatggctaatgattaaaattttcatgtgttgatttgccatctctcttcttgtcagtaaaatgtccatatttttgtacattttataattgaattatttatgtcctcctcattgaattttgagaattctttgtatgttctaaatattaattctttttggagatgtagtttgccaatattttctgactgcctgtaggttatctttttgtccttctaacagggtcttttgcaaagcagaagtttttaattatgataagtttcaatttgtgaatttttccagttatggaccatgcttttggtgtgaagtctaaaaattctgccaagtgctaagtcctgaagatttttccttgttttattttttatttttaagatttaaaaaattgttaaaaattcagttgctttacattttacatttaagtctgtaattaattttgaattaatctattttttgaagaaatgcttattttattttttattttttatttttatgtatttatttatttattttaagtcctggggcacatgtgcaggatgtgcagatttgttacataggtaaacgtgtgccatggtggtttgctgcacctatcaacccatcacctaggtattaagtccagcatgcatcagctatttttcctgatgctctccctcccccagcccacctgcccagccccagcaggccccagtgtgtgttgttcccctccctatgttcatgtgttctcatcgttcagttcctacttataagcgagaatatgtggagtttggtttcctgttcctgcattagtttactgaggatactggcttccagctccatccatgtccctgcaaaggacctaagctcattcttctttatggcagcatagtattccatggtgtatatgtaccacattttctttatcccgtctatcattgatgggcatttgggttgattgcatgtttttgctattgtgagtagtgctgcaatgaacatattcatgcatttatctttataatagaatgatttatattcatttgggaatatgcccagtaatgggattgctgcatcaaatggtatttctgtttctatatctttgaggaatcgccacactgtcttccacaatggttgaactaatttacgttcctacccacagtgtaaaagcattccttttttttctgtaacctcgccagcatctgttgtttcttgactttttaataatcgccattctgactggcgtgagatggtacctcattgtggttttgatttgcatttctctaatgataagtaatgttgaacgttttttcatatgtttgttggccgcttaaatgtcttcttttgagaagtatctgttcatatcctttgcccactttttaatggagttgtttgtttttttctcataagtttttttaagttccttgtagactctggatattagacctttgtcaagtggacagattgcaaaaattttctcctattccttaggttgtctgttcactctgatgatagtttcttttgctgtgcaaaactctttagtttaattagatcccatttgtcaatttttgcttttgtcgcaattacttttggcattttcatcatgaaatcttaattttgaattaatatttatttcaggactgatgtttgtttaggttaagtcttagttttatggggttggatgtccagttgtcccagcaccatttgttgaaaaggctatgcttcctccattgaattgcttttgcatctttattcagaatccattgagcatatttttgtaggttaatttctgtgttttttattccatacctttgtctatccctctgccaataccaaactgtattgattagtatagctatatggtggtgaaaatatcaactagagtgattcctcctactttatatgtctttttaaagattgtgtttagctattatagggcctattatttttcatgtaaattatagcataagtttgtctatgtctacaaaaatccttactagaattttgatagcagtttcattaagcctatggatcaatttgaggagaattgatatctttaccatattgagtctcactatctgtgagtacagtatgtgcctccacgtatttaggacttccttctttggtttctttcatcagcatacaaatcctataaacattttgttaaaattttaactaagtatttcattttctttggaatgtttgtaaatgatatcttctgtttaattttggtttcgacatgtacattgttactatgtgaaaatgtgattgatttttgtgttaacattttaaaaacatatttttttcaaatgacatatctataatgtgttatatctagcatgtagttcatttgctcaagtcttgatttttccttttgggactatgtaactcttttttctcattgaaagaacacagtaagtaagcatctatcaaaaagtacttaaagaacatccatttattcactcatgctatgctaatggtaggatttaaaagatttaaagagaagcttttactttcaagtagtttacctaagagaaaataagtgtgtaataaattgctgcagatactatgaaaatagtttagaattcagtggaattctgccgagatagagtagccccgttcctcttaagtcttccttcttacaactaaaaagtctgcatgtaacggcaaacaagcataagaagtctctgaaagatggaagaaatacctctgagaaagacctcagaacttgaagaatgacatggcaacatgtcatgttctcactatcctgtctgctcctcacagattaaggcatgaattcttatcattttttcactttgttccttcatttgaaattcaatattttcattgcctacctgaacaatacatatttatttctggatgaaaatccagtttatgtttactttctttctatctttcctataattacttcaaaaacaattgtttcttctacctattctggggagaaaacacactaaaacttagtgccttaaaacaataaccattttatttgcacgtgactctgcaatgtgggctggactcagctaggtggttcttccagtgatcttgcctgtggtcacctgtggctggagtccactgcaatacagggttggctgagcctgtttctctattatttctgagggcctctccatgtgctttttccatttatctatcaggtgagccagactttttatgtggcaactcagaaagtataactgcttatcaagcatctccttgagtcatgcttactgatgtctcatgagccgagttttgagataataaaggagaagactttacaagggctttgaggtgtggttcattggtaggaccaccaaagtaacagtctaagagtcaacctttgacccttaatactgtcattcatgtccttataaatgcaaagtatagtgaccccattcctaaaacctccaaagtcttatctttctgtggcatcaggattaggttagaagttgatgatcttattatccaagtcagctctgagtgtgaatgaggttcttcctgcttagttccctgaatacaactgctcaggagtggctgctcttcatccaaaactctgtgaactaaaaaggtatataatttggccctcacatagccaacataaatagtgagatagggataacatagctaaaccaaatatccccatttgaaatgggggctgcggataggagatacagagcagtcactggcccatggcaattctaaaattcagctggatacatggcaccagtttattttattcttttcccaaggagagtaaatatactttattttttattttttttattatactttaagttctgggatacacttgtagaacgtgcaggtttgttacataggtatacatgtgccatggtggtttgctgcacccaccaacctgtcatctacattaggtatttctcctaatgctatcactcccctagccccacaccccccgacagaccccggtatgtgatgttcccctccatgtgtccaggtgttcttattgttcaactcccacttcttaattagggctcagttctggttactggaagtggttctctgatattcttgggtccatgctcttcctttctatataaaattaatggcccaggcctctttgcaatttgaactttatcccttttggtataaggtagtatcgttccttaaaatgttgtgaagcttccatgtattaagttgtaatccacttcatgaagcagaagccacacccataaatatcttcaggaaagatgcccctctactttgctgttcaagtcaggatgctggaggacaatgtaccaaagattcttaaatgagttttgcctagctagtcttagggcatgcctcatagaccctcctagctaagaatcttagagtctgccccatagactttcttagctactttctctggatgatggagtatgcattgtataccaaacatattaccacagacatttttccccctcagaatcaatatgaggtgtttgtcaatgagaaagcactcaatacatatttattgaacaaaataatgagtgattgaggttagtgttccttagaataccttgtggaaaacactgctatagacaaaattaaacaattttctgattcctatcattttccataagaaaataaaataattctttttcttatgacatctcttgtctgaaaccaacacaaattatgaatggcttgtcctaaatcatgatttttggtatttcagatgacaattttctgtcttttgacagaatatacctttactgtcacctggtggaaataaaaactaataaagtgttagatctgatagacccaaacaagtaactgctataactgtagtataaacaatttaagtaatttttaaaaatctgtatgatacagtatacttttaatatttatgaatttttatgtaagttatttaaaaaatcaagtcattcttgaatcaaaggatatataatgtcagcattattttagaaagccttaaacatttatgccataaggagtcttcataatttgttcagggcaatcaaagtccgtataaatgttttatatcctacccagtaattttaatgattgtgtgcatatgtgttccaaggatctagtgtagtttcacaatcttggtttcctaatttttaaactatctctcttaattgaaaccatagtatacccttgagaatatcagctataatttataggttataaaaatgcaattaaacctacataagccagtccctttaaaaaaaaaaagtcatatacaagtgaaagtctttaaaataagatttcaagtttggatgtagagtctcttatagataatatatttattttgtaaaactgcacatcaggcactttctgtagttttttggtagagacatctttcttgccatagtaggtttcaatgagatttttcagctggataactctgatgattcttggagatggtgttgaagtttaagccatatttccatgtctgagacacgaagacattttctaatggatcaaactacttttaacagagcaataattagccaaattgctatatttctgggttgtgctcttttcaaaaacaacaaattcaattgatggaagtaaaagccaagagctgtgtgaaatgtctatttgatttactgattttttttaaccatctaggaaatacatgtcttcaacaaaacagcctattttttttttttttttactaagaagatgaaataaattctgctggagtgatcatggggtagtttcttagatcactggattaagaaaagctttgtctaatcttaccaagtcctataggagagacagctttgagaactctttgaaatcaattgtgtcatgttcaaggcagagacttataaattttcttcaaaaagtatcaaattaatatggagtagatagagtactggaaaagatacatttgtaaaataattaggtgcataaagtccaatttgagattttatgtagtcttttttgttttccattttaggtcaaatgaatcaccataggcccttttcaaccatggatataacatgtgtatttatcgtatttcacaaacattactgaaaatctaggacatgacataattggtaattataatgagggaattttaaaaattacaaacaacatatgccaggcaaacaaatcacttacaacccaacaggactttattggtggctatacagggttatactgtgattattactatttgttctttatttgtaaaaaactattctccaaaaaaaataaaatgttaactgctaatattgatgcactaagtgaagagaaattgattaggcttaataaagtagtagctgctgatcagcaaaatttgggataagtgataaggtaatcacttatttgagatcagtgaaaaagaataggaagttaagattattccaggctctttctaaatctaattttgtgtgtggtcctaaagtaaaaaaaaaaaaataaatgaataaaaatctcatggaatgtagagaagacaaaaaggggctgattaaagagcgtatgaaggacttgtgatttgagcagtagtttcaagactaaactcatggctagggaaagtgtaactgggaaagatttctgttaaaaggtttcaggaagactactacaagaaaaattaaataatgaatgaaaacaggggttggcaaactttttctataaagagtaaaattgtgcactttgggaggctgaggtgggcagatcacgaggtcgggagatcgagaccatcctggctaacacggtgaaaccccgtttctactagaaatacaaaaaatgagccgggcgtggtggtgggtgcctgtagtcccagctactcgggaggctgaggcagaagaatggcgtgaacccgggaggcagagcttgcactaagccactgcactccagcctgggtgacagagcgagactccatctcagaaaaaaaaaaaaaaagtaaaattgtaaaaaattttagatttttcaagccatatagtctctattacaactactcaactatgttgtaatagctagacaatatccatacacaagatataaatgagtggacatggctgtgtttcaataaaactttacttacacagacaggtggtgggacggatttgggctgtgggtcacagtttgctgacccctgatctagaaaatgccttgcagctgtcaaatagcaaagccaacagtagcaactgttgttattaacaaagaaaaagctacaatatattcctgataaagcaagtagatcagtgttgttagaaaatgggctttctgtaggtgatagttagaaggatgactgtaaataatggtaaaaaaatgctaagacttcaatgccaagaaatatcaagcagggaatggaaaacagaaagcagttttcctggaagtaccttacaggaattctatgaaaccagagaaattagaaaatggaaaacagacaaggagtgtttacaataaatgaggcataaggcaatggggggcctatgtttagagtattaatggtagaagtgccaaagaaaataaaacagattcaaggtcatttttggaagaaaaaaatccatgagagatgatacttgattggatatattctgagcttcattggatgttgctatgggaaataagtaaaagagacagcaagaggcctatcttaatgcttttcaatacaaacctaaacatttttaccaaaacaactcaagctctgagaaataaaatcgcctacactttaagctattagacagggaaacatgtaaataaagttcccccatcgctggtttgccatagagcatttgaataaataaaggaaggagtttgggggtactttctaggttctctgatggtctgcttattagtctttcccttagatcatcttaaaggcaaaggtgtaactttgcatctttgcatctttgcatctcttattacacatatatgatcactgagatctgaacagagtaaaatcttttgattagttgtcacagtttgggggtggctttgtgtataacaagaatcttagaaataacggtggcttaaacaggagagaactttgtcagggaaaagtccaatatatccaaatttcagagcggatgtattggctgcctaattgtctaggcctcaggattctgccctctatagggtatggtcttcatccttattttcccaagatgaaactctgtccatcatatctacgctattacaagctcgaaggtgtagactgaaaggaacaaaggacatgatccttcccacctttaagaacaagtcccagaggttacttatatcacttttacttacattcataggccagaacttgttcacataactacaccaagctgtagtgatggcttgggtatgtagtttttgttagtaaaacccatgtgcctgataaaaatactactaatttaaggatttcaaattgatttccctaagagaaaagcctaagatagggattcctgtgcaagtgagctatgaagagagtgctctcagaaaaaaacctgcagggaagaagtcaggcagagatgtgttttcaagtctagcttcagcctgatcccacagggagctgtggtgcataaattgcatcacagagtttaatctcacattgaagcaagcctggacatcgcaagtatctctatctgagtggttcttgtcataccaaggtgattatcaagaaaagggtacagctatgggccttgaccagctagtacccacagcagctagagaatgagtacaacagctggtgaagaaattctgggtgggatgtcaaaagcatctgctacactgaagaaggaggacagattttgagggaaaattagtagccatttttgtaagagccaaaagtatcccttcacacatactgagatgactcaatatcctatttctgttttgtacatggttagtactctatcagtatttgtagaatgagtaatgcatattcttggacaaccttctttttttttttttaatttccacagccatcctttaccatttttgaaagtattaagaaatgttaatactttcagtaccaccatacctacccccagtacatacacaagcatcctgccctcaatagctatttcctctactcagattctaagtcacactcacaaccaattgtagaattacctcactggcattctgaagaattagctggcaaatttcctgcattttcaaatattttaagttccggtttccagaaaaattctccttgccctggaaataatagccagacaactatgattagaatatatataacctgcttatattcaccttctttaaatctttggtgaagaataggtatggcttttctcatcggtttgctctggcctagatttatgttggttttacagtgacatttctgactttcaggcaagtatccattgagtaactgttttattatacaaaatctgaggttataaaataaagacttaaatgagcatttcactgatttcattatatctcacaattatagatctggatctatcaattttttctcatgaaggtcccaaaagactgttctataagagccgtgattatggagtgaatgagtcaaatttgaagtctggtccaatggtttcaggaaaatgttttatattgttctaaagccaaaaaataaagaaagaataaagcatcatttcaaagcactatcacaccaggttggattagttaggcttcatattacagaaaagcagcttaagtaagatagtttagtttctcacgtaaagtagttataaggtaggcattcctggacttttatgataatttcaacgttttgcatgacttaggctctaaagctttatgctttgccattctcagcatgtggcttccattcccaatgtcactacgtgctcctaatacaactgaagaactgaatttttaatgttatttaattttaaatagccacatgtggatcttagtctttgttttcaaatagtcattacaagctgtttgtggctactgttttagaatagaaactcttctggatagctcttatttagcctggaatcatgtaatgtaaacatggaaaagattttagatttcactgtaggggttgcttagttttacagataaacaatggaggaagtccaaagaagtattggctttctagaaattcaaaactaatgtttagaaatactgaaaatcgagctggatcttttgatttcttaatcagtgcactcataaaaaataatttattaaaaatattttgtaattgaatttgttgattattcaggtagatcttcctttatttacttaaaaaagtaagattttaatacaattatttttttcaatccattcatttccaatggctaatttatttgaagaatgattgcagcaatctgacaacaaagttttaccccatctactctagatattgaggcttaggctgtgtttctattcttgactctataagccaatccattaaatgataagctaacaattaatttacattaaaacaagactactatttctgttactgtagaagttttagaattagttgcatgtaagttaatgtgattaaattggctaggaatatttgatactgtatctatttaatttattcttttagattattaagtatctattctatgcaagccattaggccagctgttgggagcacagcagtgaattaaaccacagtagaattaagctagaatagaacatgtctcttctggaagtttattctagaaaagagcctttgaaacagtaattacttggatcctaacttttatgaagagaaagaacaaggtgccttaagatcaggcaacaggctggcttagcccacttggtaaatagtctctccctcaaaggctcaacctcttcaaactgaaatctgactacttctgaggttgcacaaaagttccacagactgttccgaaaaaaataatttgaaggaaattcatctccagaacctcaactttcacatgtactcttgtctaaaattgcctgaaatctcagaatagcatttcctccaccttacaaaagaaaggcacacctttcttccttcccaaattgtagcatgatgcattgccccagaacttagggtgccaaacaaagggatagtctaaaatattactttgaaaactcaaggccccttaaactcagagatcttctcctgcctgtgtttcaggaatttttgataacttcagtgcttaatcaaagttggtatattcctaattcagaacagccaaagccttatatagtagtgatactgaattgtgtcagtgtaattggaatgttttataggactatcattttttcaagatgcatttgataaaactcaggaacacactttacttgtgatggttaatactgagtgtcaacttgattggattgaaggatgcaaagtattgatcctgggtgtatctgtgagggtgttgccaaaggagattaacatttgagtcagtgagctaggaaaggcagacccacccttaatctgggtgggcaccatctattcagctgccagcacagctagaatataaagcaggcagaaaaaaaaaaacacgtgaaaggactagactggcctagcctcccagcctacatctttctcccatgctggacccttcctgccctcaaatattggactccaagctcttcagttttgggactcgggctggctctccttgctcctcagcttgcagacagcctattaagggaccttgtgatcatgtgaattaatacttaataaattcccatatatatgtcctattagttctgtccctctagagaaccctgaccaatacatttgttttctttcatatttgatgtgcattgtccaaaaataacacatggaaagcctatttcattaaatcatgtactatgtattccacttagttaattctcatcatattccatttatacaatatatagtattttctctctcctattaacaaataactaaaattatttaaacatacaaaaatagatgtcacctttaaataataggtttttataagtcatttaaggtaaatgtgacacaaaaaagcttggaaaccccttttcagggtttctcaaattataatcgtatgtctaattagattaaaaaaggtcaccaaggtgctagtgaataaaacaaacaaacagattcctagatcctaccacttactgttgaatcagaatttctggggaaacaaggatcagaaatctgatggatcagcatgcatacagatgattcttatccacattaagtttgtgaatttatattcaagtgataacggttactatggtttggatgtttgtttccccaaacctcatgttgaaatttgatcccagagttggaggtcaggtgttactaatgggagtttgagtaatgcgggtgtgtccttcatgaaaagattaatagcctacttcagcagtgaatgagttcttgcttagtttccaggagagctggtgctttaaaagagcctggcacatccaccttttttctcttatttctgctctcatcatgtgatctctgctctcttttgccttccactataagtggaagcagcctgagttcctcaacaaaagcagatactggtgccatgcttttcgtacagccttcaaaactgtaaactaaataagcatcgcttctttacaaactagctaacctcaagtagttctttatagcgacacaaaaaatggactaagacaatgatccttttaagagagttctatcccatactaattcaaagtcaacatggtgtttcatataatcttgttgtaatagtctcttggtggtggacatccggcacctaacacagtgcccagcacatgttggagtgtcaagaattaatgattgaaagtgaatggaaaaaaggtatatatctcctcccaaaacatcaggagattgaatataaaggacacatcttccttctataatgtgacagatgcactctatagttactgtttgagagtttttttagtgcaaactatttacctcttaggctaaatttaatttacaaatggaatcattagtagtgaagatatagcagggtgccttccagattcctctgctgtgatcttcaaatgaataagcactgcagattagtcaaccttctgaaaagttcttaattaaggaaaccaatactgtgcagaataacagcctgtgtgttaaccttgttgacacagtgtagaaatctcatgtagatagctagtacaaaagaataaaaatgttgttctagtttctaaagtggcgtttccaaggaattatacttctaatgaaaattgctgctgtggatgtctgttcaaaggctttggcttacaaagtaaagatttgaaaatatcaaacttgcttaatctctgaatgttgttttcattcattaggtgaatatgacagctctctctttaccctaatcgccccccctggaggaaataacatttttgtttgtctaaacagtacttaatgactactctaaaattagagtttaagatctttaactctagagtgcaaagctctacgtccttgactctgacgtttatcatgaatattaatttctgatcttaaagtcaagccatgaaatttttatatattatcatacatttcccttgacagtttttgtaattgccgtaatttcctcatcagcaagagttgtttgtggctctcctggtctgaggaggctataaatttggcagctttgaattccctcttttgtttgaatgtggaaccatcgacttgtttactctgaacattaactagatctcagatcttaaaagaactatagtttttattggtgcctttacatgacaaaagactcaatatatttgttgccattacatgttttcattgttacctttggattgactttcttgttaggggagatttatgtccatcttcagatacttttcctgctactcacataaaaatgttattttctgccacatagctaccattttctttaaaattgatttattagtagtgtttgattatcgaataccagactgtatatattcacattgtgtataagtatccaacatgaaaattatttagacaatattcatggacatgtatacataaacacacatactttttaatatatgtaattcaactgaaatgttatcttccgtttgtactttcaacaaagatttatcgaacatctactacacatcaggcctggatttttttctgcacacaggaataaaaatagacaagacacaaattggcctgaagatgccacagtcaaccaggcaaacagacagactcataaaaaattatctgtatcactgtacggcaaatgctgttaaaaatatggtgacaaagagctgttgcaaccagagagactcagggatggatacacagaagacaggtctctgaggctacacgagatagatctttcttcccagagaaattgaaagggcatgttattttacacagtaggagtggccagacatggtgatttagtaaaagagcttcagaagggaaaagcaacagatacacgtggctggagtgaaaagtgcaaagtggtgcgtgggaaagaaacagaagctagaaagttaacttttggatagatttgggaagtacccaagaatagaatctcaggttcaggtgtttgactttttttttcttaggacctgaagacagtgatccaggatggcctaaatgtcgcagagaaaattattctatatattcagtcattcagacaattatctaatgaattctttatgagagttgtttttggccaggtgatgaacaagagtcaaagtctctgttcttaggaatcttatagtctttcaagagagaaagttaagtcactcaacgtttaatgtctgatatgacagaggttacaacagagaaaagaacagagtgtaatgggcacatagatgtgatgtgtaattcagaataaaaatcaggtaaggcttcttggagatttaaatattgagttctgatacagaagtaaaacttacctggatgaaataaggagatgaaaaaggagatttggaggagatcctaggtggtaagatagtatatggctacagtcattatatattcttctaattgtccacgactatagtaaagttcccatgacttgggtcatttttagagaagttggaaaggatcagttcatggtcttggggtacaaaacgggagagctgaaactttacacaaaaaggttcagggagacaatgaaaaactttaatcagatggatgacaaaaattggatttgagttttggggcggtcatttagcagcagtgtgtggggatgttgaatggagggcttggagagtagcatctaactacagggttgtcttagattggactcctctagaaacaaaccgcaaggaaacatcactagaggaatggggaagtaagatgtagcagagaagggaagccagtaaagtatgcattataaagctgttttatcccttttggcaactggaaattaggtttactggaaaactctgtgagacaatgtagacatactctcagagttatacccgaagggagaggaaactgggttgtttttctaccagctccctacctgttcctgattgagggtttcttctactaggaatcttagttctctagcatttctggcttgcccttcatgaagaccaaggttggtctcagggccagacaaaagccatcagactgagggtgtcacgtatttgtaagaagcagccttcatacggtagacgtttgggtggggcactgacataatcagctaaagaactaacaagatgggaggtgttgagggtctggacttaggccatgatagtggtaatccggggaagtttgggagtgctactaggccattgttttaataagatttggccatgcattaaatgttaggggtaaattatgaatgatgactttccagagagtagacagatgttgatgatgtaaaatgtgtgtgtttaacaacgtaaaggttttagtataaatatgaaacctatattaaagtctctttataattgtatctattttagaaaagtattataatacagcagtataaaaactctctaaccagaagacctagagtacttcctagatccagatttctaacagcatgaatcttggatgatactcttaatctctcagagcgtctcatgaaaaaaatggaagtaaacatgaaagaagctttgcatatgttacgtaaaccaaagtgtcagtaagccttgtacaaaattttaacttttaaatagaaattacataaagtatttgggccctaggacctaccaagtcgattattattaatgaatgagtaaatctagtcaatcaaagacctttcatttttcccacacctatatttgaacagatgccagttagtgagcatctttgtttgttaatatctgtacttcatacttaatggactaattttttctctatcaaaaaagctgcctttgttaaaacatttcaatcaactaaattacttaactctaatgcctattttgagggaaaaatatacttagagggagaattaaatgtgtaattttatttctgcctcattaaacctcctctgtgtctaggccaacaagagtttcctcctcctccaccggcacacacttattggacgcttcattgtgagaaaatcctcaggtcgctggaacttggtagtgagttacatacctgcccgtcccctccagtatatgtactaattatcttatggaaaataactattttcttgcttttttttttcctcaagaaagccttgagtctcatccagaagtcagatgagtgttagatttcttccttctcttggcttcaatggcaactcttttttttctgattctaaataaatagattgttatacccacatgaatatccacaggaccaacactgcccctttattactcaggaagtatttatttttcagctttctctttcctttctggccctttgaaattcaagcttatttaataatgaattttagtgaaattattttaaaatatcttttaatcacattagcaaacttctagcagagcattgagtttcttcctcagataattcaagttgtcttttctaaaatatgtacttaaaatgactttgaaaaaagagatgtatgatgtcagaaatttctttcaaaagaatctgggtgtggttggggtgatgggtagggatatagatgaaattaaataagcgctatgttgataaatgttgaagttggatgatggtatatgggagttgtgtagtgttttctacttttgtatatgtttgaaattttttctacacttgaaaagataagagaaatttaaaaattaaattggttctcacaattttatttttgtagctgttttttatttgagacgaagtttcactcttcttgcccaggctggagtgcagtggcacgacctcggctcactgaaacctctgcctcctgggttcaggtgattctcctgcctcagggcatgcatgtgtacaagcaatgcccttaccatttatgcattcaactattcttccctctacccattatttaatataagaagtacttatgatgtctgtgctgctgactgtgctaatcattgaagaacctagggtgagcaaaaacacacacagccattgccttcataggactcatagagaaatgagcaagaaacccaatgagaaatcacacaaataaatgtaaaattgcaaaaataacagctgttaaagaggaaagatacatgattttatgtgaaattataaccgggtggtattgacttgatgatttgagaaatcaggggaggcttatctgagtttgtgctgatttaactgagatcaaactttgatcttggtgtgtggagacatagaacataaacctcaattcacccatggtagacatgtagcttgagtgagaaaatgtaactttgttattgaaaaagtcatgacaattttgtaatctggcctatcctgatgaacattcatagggttatgatgggttatccttatatatcttgagaacaccaaggacagtggcagagcttggagtgagaaggaaatccataaaccagatgccaaaccttcctggagtcagcatagacatgaaaatgcacaagagggcaaaagagttatagaaccaactggtatgcatttcaaaagagcaggattgtggagaagagagtggatgaattattatttaggagctggaataggaaggaaggatatcaagcccagtccctatctctgaaatgcaaaaagtatgaggaagtaaataagcaccacctgagatagctgtaggagaagtgataatcacagaggagagctaggtttgattgggtgaataccaagaagagaaggggatactaaggatttagagcggttatatgagtatggaaatattgcatcaaagggtacagtgaaacaatttgagccatgagatgtgtgtgtgggcacagaatatgaataaatgaatgaatgaatgaataatagcattatagaaatgctaatgcagtagaagtgtatgtatatgagtgtgttggagaggggatgcttacaattttggcattgatttgttaaactaaggatgacagacatcctgaattcaaccttaatatctctttgaggaagatgactcacttggttgggggtgatgggaaacccagaggcaatagaatccatatacttttgatggtgggttgatagtaaaccagatcttcagatccccagtgtccattactacctacgttgtagtctaatctctcattaattctcacatgtttaattccctccaatccagctgtcagacatttttattcctctctgcttagaaattgatatttatggggggccgggcgcggtggctcacgcctgtaatcccagcactttgggaggccgaggcaggcggatcacgaggtcaggagatcaagactatcctggccaacatggtgaaaccccatctctactaaaaatacaaacattagctgggcatggtggtgggtgcctgtaatcccagctactcgggaggctgaggcaggagaatggcttgaatctgggaggcagaggttgcagcaagccaagatcgtgccactgcactccagcctggtgacagagcaagactctgtcaaaagaaaaaaaaaaaaaaaaaaaaaaacgaaaaaaccagaaatagtttatttatggccaggcgcagtggctcatgcctataatcccagcattttgggaggccgaggtgggtggatcacaaggtcaggcgttcacgaccagcctggccaatatggtaaaaccccatctctactaaaaatacaaaaattagctgggcgttgtggtgcacgcctatagtcccagctacttgggaggctgaggcaggagaatggcatgaacccgggaggcagaggttgtagtgagctgagatcatgccactgcactccagcctgggtgacagagtgagactctgtctcaaaaaaaaaaaaaaaaaaaaaagaaattgatatttataaaatataaatgtgaacttgttatctcctgtttaaaaatccttcaatgatttttcaagctttccagataatatttaaactgtgttaaaacacaaaagccctttaccgtctctcctgtagctactactttagtgtcccttcaaagcactttcccctactcatctttcatgtcagcaacagaactattttaattttttaaagctttcttgtttcatgctgctgtactggtgtctgtgctattcaatctatctggaacctccatcctaacctctttgtctggttaactcctccccaaagggattaatgactgaattaatgatgccgcatatgtttttctaatgttcttttgaagtaactcaattgactctgaaagtttcagaaaccccttgtcaagtactgatcaagcagcttatttcactgcatattttttaaaattattttttcctgaagtttcagaagtcatgactttatttcctttggaagtgttcaatatttatgaataaaattatgaagataatcatgtaaaaacagcttaataaatttaaataaattttaataaaataaagagatgatgaaaaaaaggagttatgaaaagccataacagcagagaaaaaagaagctacaggaagtgtgaattggaactaagatagaactatacatagcataaatgggaaatgtaagaatgtaaaatttgtgcacttgaagaaactgaacacaattgcaaaagtttattttgataagtggaaaacattgtcatcatttgtacatttttttcccttaatagaaagcttcttaaattatatctaagcacttatcttattgcactgaatgtaagatgccaaatatagtaagagacacaatcaacaatgctttcttatagcaatcataaaagatatacccaattttggagatgataaaatacaagcaaaatgcacatcttagaactgatgaaatctggaaattgatgaaaaaagtcaagtaactaggttattgcatacatggtattagaaaactgccaaaggaaatttttaaaatctttagaaagaaaattatcaatactgcttgatcacatttgatatgaatttttaggaggacacaaatattcagtccataacactctctgagcttgtcttcttcaagattctttcagttgcaagtgacagaaaaccgagatcaaagactgattaagcatagaaagggatttttttgattcacgaactgaaaagtccaaggatagcctggctttttaggcatgtctggatttagattagaggctcacatgataacagctgaaacattctctctttttcccacttctttccttggtgttggctttattcttaggtaggcaaagatgacccctatctcctctagtcttagattctactgtcttagccaccagagccagagaaagacatcatgcattcctaaatctccaacaaaaatccaaagtgtggctctcattggcctcatatgtccatccctgaaccaatcacggtggccagtggaatagaatattcagattgaccagttctcaggcataagaaccagagagaatcagtccaacttgaactacatgctaataacaaaagaagggagaaaatgttggataaggaaaaacagtagaggagccccagtactcactaaataggattaatttcttaaatctgcaaactgggagaagataccaaacctttaggactgctgtgaaacagaattaaacaatatgtgttattatactgaattgcactcatgtgactaaattattacacaccacatacccgtatattgcaaaattctaatttcttaaggatctgtccttgacttcattgtggcgattatacatcccccttgtagcccacgatagaaatgatcaatagaaaacattgtccaagcgtcctggctttcctcaggcaagatgttagttaatgagacctcaacaaggatgagtaactctttccaagggacatcttcagggtctccctaaaggagaaatcaatgccccctaactgatttggatgaggaagccactagggtctcaggaagtcccccattgaaatgcaaattggtctagctagggctttatcttaaacaccagcaaatagctcagttattacttagcacagctgcagggattatcaaaacttgcagttttgttgtcctataggacataagtcaatattgtatctaactttgcaatcttattctatctcttttagtcaaagcgatactgcaccaggcatttgttaaaaaaatggcaaggaaaactttattcaaagctattgtaatatcagttaagactattgcaataggggcaagaaagtatactcaactttattgaaatgaaaggcaggagaggttttaagccttagggtgagctagaggaaaagcactggaagacactagggggaaggtcggtcagggtgattgggcttatcaaaattaggctcctaccctcccacagagactgagaaatgaggatgttatctttcttgatgattggatttcaaaagaatggcttccaggtgcttgagaaagacattccagggatgtagaagatttacatctcaaagggacagagaatacatttacaatggaaagttttctaaaataactgctccaaaaaaagggcggggctgggctcagtggctcacgcctgtaatcccagcactttgggaggccaagtcgactagatcacctgaggtcaggagtttgagaccagcctggccaatatggtgaaaacccatctctattaaaaatacaaaaattagccggacgtggtgacgggcgcctgtaaccccggccactcgggaggcttaggcaggagaatcacttgaacacaggggcggaggttgcaatgagctgagatcacaccactgcactccagcctggggagacactgtctaaaaaaaaaactggccaggcgcggtggctcacgcctgtaatcccagcactttgggtggccgaggtgggtggatcacgaggtcaggagatggagaccatcctggctaacacggtgaaaccctgtctctactaaaaatacaaaaattagccgagcatggtggcgggcgcctgtagtcccagctactcgggaggctgaggcaggagaatggcgtgaaaccgggaggcagagcttgcagtgagccgagattgcaccactgcactccagcttgggcgacagagcgagactccgtctcaaaaaaaaaaaaaaaaaaaaaaaaaaaaaaaaaaaagaaaggaaaaaaaaaaaaacaaaaaaagggtaagtcgggagcttattaaggaaagaatcctagtctctggcattctatttgggccaactttgtcatccttgtaattccctctaaagctttggcatgtgctcacactatatccgtatgaagttcatggctttatatttataaaaattatattttgacttcttttctcttatattagttggtagaataagcagaaatcaaagaagctgaaactagaaaacagaacatagcaaaatagcaacaaaaagacattaaaacacaaattttgaaagggcaaaaaatcatttttggaatctgactaatgagacagcatggggaaggctaatggggtaaggagaagaacaaatagaaataattgtctttggaatgtgaacattaacataatggagagcaatgaataagaagtatgacaatgttaagtattttatgtcattgtcccaagaggtgctcaattgagaaatcacacacacacacacaactttaattataagaaaaatatgtggtaacaaaataacaggaaaactcagaagtcagagaataaattgcttattaccacctcctaagtagcttttaatgctctttctaaattttctttgtaaattcaaaagttaaattgaattttgattcagacataaaatgaaactgggagcatttatttctgtattgccaggagaaatatttaccttgatttatttaaattcttctaggcattcctatttattcaattttataaacatcctcttctttgatgttactctaagtttattgtttcattgtctgagaaaaatcttattgccatttcctaaattggtgtttttttccccatgaaatttccagaagcatccaaatgactggattaaaatgaagtatggcaaattgccttttagaatgactcttcccaattagaaattgccaaaagtagagatcaaagcagtatacagtggttttaaactagctcatataacatcttccatgagctagttatataaagatttttgttttgattacttttatcttataattattcttaccaaattccaaccataaaagatattttgtacataataggtactcaataaatgaacattacatttgaaaagcaatgacctgctttatatttcagtctaaatgtaatcgatatgaatcaagcagtaaagaatatggcagagttgcattacaatttgcagtccaaaaattcttgagtaatctcaggaaaaatgtactctaccagggctttccaaagatcgttttcaggaatactagcctgtctatgtgctgccaaagcgagcacaggaatactagcctgtctagatcaatgcagttaacacaacccagtagatctctgtgcttgatgatgaaaatattctatgtctctgctgttcaatacaatagtcaatagctatctgtggctgttaagcacctaagatgtgactaatgcaactgaataacaatttttttcatagaaattaatgtaaatagccatatgttgctagtggctacggtactggacaacatagctccaaagttctcaagaacaaagaaaaaaatttatttatttttctttaaagaacaaaattttgtctaacctagcatttcccaaatttagttcatcacgaaattcctctttctactttgagaagaacattagggtacacttttcaaaaattttatattattaataaaaaggaataagatgtttaaggccatttacacatgattccttattttatttgctgattcatttatgtatccactcaactaacatctaatgagctaggggcttggcaatattgagatacagttttgttcattattgagttatatctaatgggacaggcagattaatcaagagataattacacacagtctggtaagttctaagaaacacagaggactgtgggaatacacaggtgggtgcagaatcaaaatttgtcatggggaaagtttccagagggagaatggaggacaagtaggacattgtctggttaaaaagaggtccccggccaggcgtggtggctcacgcctgtaatccctgtgctttgggaggccgaggagggtggatcgcctgaggtcaggagttggagaccagcctggccaacatgatgaaaccccatctgtactaaaagtacaaaaaaagaaaaaaattagctgggcgtggtggtgtgggctgaggcaggagaatcacttgaacctgggaggcagagattgcagtcagccgagatcgtaccactgcactccagcctgggcaacaagagcaaaactccatctaaaaaaacaaaaagggtgcctttgcatttttatttctcttattcccctccccagggtttgacacttagtctgtcttattcaagctaagtccttgaatcacaactatgcctagatccttatgggttgcttatttatacctttaaacaaagagaaattcatctgatttttacagattgatttgagaattagaggctgttaatactatttcctttttgccaccccaaccactttttcctgttctaacttcttcatactccagtatacaccacagaaacagaggctgatatggtttggctctgtgtcccacctagatctcatcttgaactgtactcccataattcccatgtgttgtgggagggagcggtggaagataattgaatcatgggggtggtttctcccatactgttctggtggtagtgaataagtctcacgagatctcatggtttcataaggggtttcggctttcgctcctgtcttattctctcttgccaccatgtaagaaatgcctttcaccttctgccataattgtgaggcctccccagccaggtggaactgtgagtccattaaacctatttttcttcccagtctcaggtatgtatttatcagcagcatgaagaaggactaatacagaggccattcgtactttaaatgtattacggctaattatagtcaagagattagaagtcataatacaaatattaaccacagagaggtttaaatttctctatataatctacagtcttctcaaaatagccttcaaaattttgacctgagagcaggaacaggcctttcatgttttaatcctcaataaaacacagacatacaagcctgtgtgtgtgtgtgtgtgtgtgtgtgtgtgtgtgcgcgcgcacatgcattctcacgctcatagtctgtcttttcccaacttcgacaattgtcccactgatttctctgtaccttcctttctattttaatcaaatctccgcaaaataaataagggatattctaaaatgtaaatctcattaagccctcccccagataatactcttcaagagtttcctcagtttccttcaaaatatgttctatggccattagagtagtttaaaattccctgtataatctagtccaagtttatttctccaacctcagagcaaacaattctagaacagtgtctagcatataataaacacccaataagtgttggctattgttttaggaaatggttgtctgtccaggaagcctaaaaaggtgtcaaaccacaatattagggaggcaatgcatagtgcagccaattcacaaaagagaaacaagtcctagaaatgttactaagagctcaccattcatgacaacactaatctcctcccgcaactctgccctcacccttcattctttgaggcttcaaaggatgaagtttatccattcatatcaaaaccttcctttttcacatatcaatgcacatttaaaataatcttgtagacactgttttctccttaagagtctgagagttaggaaacaattctgtaaatattaaaaacacaggtattgtaagactgattggaatcttacaaactaattttgttttactaaccaagacagtgtaggatagttacacgaacccaggtctagtaaataattcattcgcgattgtgggattgagtgcaaataattagtgtaaattgtcactttctcaaaacaaccgccataatagcctgttgattaagcaacgctgagtttattacttagtgcagtaataaagatcaacacttgacacagggtcttagttctctgaagacagtggttgaaggtagatattttttatagagttttgagggggtctaggttcaagtggtttaaagaagttctttgaatgcagagatttgattgaaattgggcaaaatccaagatataatagacaagaattggtggacccagtgagtccaggttcttagaataagtcttgatgagtaaatagctgttgaataagtaagggagttcatcatgttaacaatccattgtcccatgaaagggagctttttctccaaataaacaacttattgtcttaagacagagctacttgatcactgtgtagttcagataaatgcagtttcaggaatttcctgacgctgtatattagtttacaacattatttcctgggaaaatgttttgtggaacaaaatgcaaagttatattgacgtaggggccttgataattaagttgagcgacaacctctctgagtttcctcaattgtaaaatggggataccagtggcacctttttcttttggttgttttgaggatttagtgaaataatgtgcataaagtcctcagcaggatacctggcacttagtaaaagtacaatggctgttaaatatatttttcaactactttcacagtagttactcttaaagtatcaactcattttttcatccactcttctaaaacattcaccaaaatattatatgccatgttctttgctgtgtgttaggagcacagggatgaaagaaccatgtactcaataacttgtacttatagacatgttaccctattactggagactgttttggtaaaaataggaataacatgccaaggcagctcaggggatgtaggaaagtctaaaaacctgtcctagtgaaactgatgcttgacctgggccttaaaggatgagtaataatccattagtcagccaagggtccgatcattccaagctaaaggaaaactatgtacaaaggctaggaactattaatttccatgctgggttccagatataaaggagaaatccatgtgatttcacctaaagggtcagatggatcagcagaagatgagttcggataacaaaaataatagttaatagaattcaatatatgataagaatattcggtgtttataacaaacgggataattccaaccagaggatggaaggatcaaaggttttttttctatcaaggtgtggagctggggtcctatcttacacagtttagtcattctcaaatatttttatacaccagaaaaacatggaaagacttaaaattgcctccgtcttgctcaaaccttccgaagattccaatttaattgatctgggatggagcctgggaatctatattttttatttttgtgtgtgttttatttgtttagtgctctcctagtaatactaatatataagtaggacagaaagctgcctgcagtaagcagtcacaacccaataccagtagttagaagcccaaaatgagtcatttaaacaatattcttaaggtccacgtgcaaaattctggaaacaaggagtcagtagaggttacagaaggtaattttagcagcagtgagaggttgaattaggacagtgagttttcagtcatttctgcttatctggcacttgctttctatgaagaaaaggaaagagcatattcagatactcccagtgatactggagtcatagtctcaggctaagatagtgggcatgagatgagatggactcaaaagacagaagtagatgttgggataaattagagtattgggataaagaagaaagagagagctcaaagaacaatccaaaggttgtaactataggggcaggagcagtaggtctaggatgtagataaagaactaatttgaaagtgttgactataggcagcttcccaataaaccatggctaatacctgagccattatttctttcacagccccaggcacaactgtgtggtgcctcactttctgaaacattttaacagtctcctcctttgtatatgaccccagtgccctcaggccattcccggactgctttcttggtttcaaaatatttcctctacttaagtattggttttagaggagactgaattgagaattgtgctatagggagcatcccagaaccacgaaaatgacagtggttatgaactatcactgatgaacattttaggcaaaagtggccgattttgaagatgacctcgaggtcatccaaacttccctctttcctcattgccaaaggtcctgaggaacattatgaaaaataaaaattaaaggcaggtggaaagcccaaacatacgtctttttatttgtgatattgaattataaagtgagaattactaggctttgttgatggcaaaaccagactctgtaaaatattttaggcagtcagattacagtttggttttatacattttatgaaggcaggagttttaggcaaagacataaatcaatatatggaaggtacacattggtgaggcctaaaagggtgagatatcttgaagcaggggcttacaggtcataggtggattcggagattctttaatttgtgattggttaaaggagtaaaggtttgtctaaaaatttggagtaagcaggaaggaatgttttaagttaagataaggaagtctgttaatcaatacactgggtcagagtgacctgtaggggtgtgcgatttaacccttgtctgacatggccttaggtcctgtttataatttggtatcttaatgttgcagagtccattttgttagtctttgctctctattttacaataacattaatgctagtcagttgtgcctaaactccaaaagggagggggtataaaaaagcgtgtctgacctcctttcttgtcattgccaggaattcagtttttaaggtttctctggggtctcagtggctaagagagggtctggtccatttgtgacgggctaaggattttatttttagtttacagcaggatcaatgattatgtttcctaagggacctaattctagaagtccttcagttctccccaaatattttgggcccttgtgtcacaattgctgaaaccctgactccaaatttgggaggataacattgctgccagctttttactggtatcaagaaaaatgccagaaaatatgcaacatatgttgccattttgtcaaaagcagcaatgttaacatgacaatgaaagcaagttccttttggatttctttttaatccctggaaggtcagagggccaaagttttctagtaattcatctaggaaattaaccacctttggcttttcttactattttaatttacaattatgatttatagatgaacgttggttggaaaatatttttacacataatggcttttttagaatagcatctacagatacatgacagaaggataaaaattgtaactgtgacagcaatttcaatcagaaataaaaaccttaaggagcatcatgaaatttaccaaaatttatgcttctgatttcatggtatgtatttgttgatttgtttcttccccaagggattagtagtgaatatgtaagtaaaaaaggacatgattacacatgaaatacaatatgtcttctgggaaggtggagaaatctttcagccttagtggcattcacgtttgtgtggctgtgtatgtggatgtgtgaatttattcaacaaaaatgataccacttccatttgcatgatattgtaaagatttttttctttcccatatattctctctttttggtctcctgataatcctgcgaggtaacattaatatatgtgatacatttaatgaaagtctttgacaggcagcaacatatttgagaaaacaagcttgggaagtaagcaatattatcttcatttaaataatgagaaaaatgagtctcaaatagggtaagtgatctaccaaccagcacccagctctccaagatagaactgatactcaaaactaagtcttgttaacccagtactgtgcttgattcatagaaaatgttccacaaatatctgaaatttaattcatagtttgtgtaggtacagcatgcaaccaccacaaggaattttggctttctctttaaaatgtggacttttatgtgccaagataaattttctttgtggctgaatgtttttcaggaagagattactcaactaatttgaaccacattgacctatctgtaatttatggaaaagtgcaacataatacaggattatagaggctagagtcacgcttgctgaatacatatgctgtacattattttgaaagaaagaaaacattttaatacaaactatgtgaatttgatgacgcattttccctttatttctgttagtataaacctgcctatatctgataattgttggtgggcatgaagtaaaaggaaattatccccctttctgtaggttgtctgtaaagaaataaagcaaaagggaattagtacaaaataataacggtaatctaagcagacatagagttcagtgtttgttttatttcacagaaagatgcctatgcaacttgtgtaacaaattggtaggctgaaagaataacctcatgtaaatgaagaatgtaattaccatcttcacagttttggtacatgttggaaatgtcatttcaatcagggctaatcataatatgacaggaataactgtgataccataagtgataatgttatgctgctcactttttctaaatttggtggcaaaatatgcaaagataaaactttcaaagagccagtaaaacatgttcaagaattttctcactttaaaaaatattttcagggaagtactcatcattatagatcaacaattattttgataactccattgtttttaaattaaccctgttttagtattttggtcatcttttatggtcaattataaaagaaaaggatccattttaagtgacaataagtatttgatattttactttttccacatatatattcctatattccatatggcacatatgtatattttgtatatattccacatataatccatatatatatattagacacacagatacacacatacgtatgatatctgtctatctgtctgtctatctatctatctatctatctatctatctatctatctatctatagttgagacaaggtcttactctaacagccaggctggagcgcagtggggtgatcacggctcacagcagactccatctcccaggctcaaatgatcctctcacctcagcctcccgagtagctagaactacaagtgcaccccactgcatgtagataaatttaattttttttttttttttttttgtagagacagggtctcactgtgttgcccaagctgtcccctaactcctgggcttaagcaatcctcctacctcagcctcccaaagtgctgggattatagacataagtcaccatgcctggacacatgtgatattttgtatgtatgtatgtatgtatgtatgtatgtatgtatgtatgtatctatctatctatctatccatccatcgatctaaaaatttaaatatagttttcgaaatgttgtctctcattttttttttccgtacatgggcttcttattaacaataaataaagtagctaaaaacaacgaactaagaacttcagcataaagctcaatgggtgttcccattcattgcattgtgaagttgatatgaatgccattttgatgctacctcattttctggctcctgatgaagaaacagattaatgacaaattcctttcattactaatttctgtggttctcatgaagtttatgacattttaatttaattttattttgttacttttctaatccactactttatggacaagtcaacaaatggtttcttaaaagtacctctctactaggaagttggcaataaatacaaataactaactgttgctgtgtggatacagcctcccaacgggagacaacaggggagtcaggggagtgaagaagaaaggaagaagtatgatttgtattttgtttttgttcataatttttggtgttgagtacaaagtttgacccaagacataaataaatgcgttgatttttgaaaactttaaataaaggtatcttattctgtggttcaagaaccactggaaatgtagaggtcatccaaatgtcctgaaattggatgcaaatttttatttctatgtgcatatgtacatttttatggggaaaggatacacgacattattcagattttcctcaacatataagactagcaaataggttcaggaccactgccttatctattaattatattcaggtccaaatgggaaaaagacgtttctaagaaacaagaatataaatgccttaatccatgaatttacttttatttatacaagatattacataaaataatctgaaacaaagcatcttccaaaatagtgttataagaatgaatattatgccgggcacggtggctcatgcctgtaatcccagcgatttgggaggctgaggcaggtagatcacctgaggtcaggagttcgagaccagcctggccaacatggcaaaaccccgtttttactgaaaatacaaaaaaattacccgggcgtggtggcgtgtgcctcaaaaaaattactgaggcaggagagtagcttgaaaccgggaggctgaggttgcagtgagtcgagatcatgccgctgcactccagcctggacaacagagtgagactccatctcaaaaaaaaaaggaatgaatattataatactatgttatttacttaattataagaattaaaaatatatttgagcatatttagggcctcataatcatgcatagaggaaattgatatgatccattttatgttgagtaactcattatcattattattattaataatattgcttactacaaaaaattaggcaaattccttttcttataaaaattaagagttgaatatgttgttatgcctaaactacataacgtctgcaaaggttatggtcttatggatgatgatttttctcaaatattagtgtgaaaataacaagtttctaagttttccaaataacttaatgtgaaggcaaaggatttttaagaggttttgattatactcagagagtggaggactaagtgatgaaagaccaagatgagtggtgatctgtgttcctttaactattatgtgcagttgctgacacaaaatggttttgttctttctaaaaggtagagagagaattttgcccacagacagaaagaaaatgtctttcaagaagtggtttgagaggctggagagaagcagattggttacttgattactgagagggccattaataggagctcatttctagctaaagtgctgacatcactttgaagccatttacaattgttaaaaggaagcaaccctttagtataaataatgagcctgttacagtgaagtgcattggcagatattcataaacacagatacaggaggagctgttattcattacaattactgtttttcgtatgtttgaaaaatgcaaatatatgtgtgtgtgtatgtgtgtagtcgcacagtgatattttgttttagtacgtataatttagaattatcaaaaggaggtttgctccttatatgtaggttatattatgtcatgtgtctacttttggagagagtgataaattgagacaaatattccctaagtttggatttaacaacccaaaatcctctaggatgtcactctacactttatttggcaacttttctatgtgcatattttagggacgcttgcagaaaaggtatgtatggacaagacaagatccttgcctagaaacagaaagaacaaatatgagcagaggcataaatcaaaacataagcaatacaaatcagtgctaatttttttaattaaataaggctttctgattcatgatctaacctttaaaagtagtttctgaagtatattctctgttatgaaacttcgttcttataataaaaatcatattttgcaaaaaaaaaaccctaattttcaattacactatgaaaaaataaactaatgagttttcactattaaaaaaataacagaagccaagttcatggagttgctttttctatgtatgtttattgcttgtagtctttcacaaggatacatatattccaagttcaacatctttctttctcttttctttctctttttttctttctttttctttctttctttctgtctttctttctgtctttctgtctttctctttctctctctctctctttctttcttttttttttgatggagtttctttcttgtcgcccaggctggagtgcaatggcaccagctcggcccactgcaacctctgcctcctgggttcaagtgattctcctgcctcagcctcctgtgtagctgggattacaggcatgcaccaccatgccggctaattttgtatttttagtagagatgaggtttctccatattggtcaggctggtcttgaactcccgagctcaggtgttctgtctgcctcagcctcccaaagtgctgggattacaggcatgagccaccacgcccggctaagttcaacatatttcatattcaaaatatctgtgtcagttagctttggctacataataaactactctaaaactgaatggcttaagacaatttagttcactgttctggtaggtgtttcttctggtctgggcttggctctctcatgcatctttggctcaagtatggctttccacagtgtcttaacccttcaaagactcaggttttacatctaaaaccagagttcgagaacaggaacctcataactgacaaaaaaataaaagttactcctcagtgttgtctgaactcatctctcctgctaaactcccaaaggagaattcaaaactggcctattttcctcaagctccctattcaacccttctcaaccttcccctctccttagccaatatcctacctgatatgtttttaaatattttagaccctcagatatgaatgctcttgccttccctatatcctaatgataaatgtattcatgatcacagccaacctcacgttcttttcctggctttctcagaggagagtctcatcgtccacttaagagatacctatttcacttgcatccttgattttatcaattcttattctctttcaactgtatggtcatcttcatcttttcctctctactgtagaactgccattttatttttcttcttttctgagccaatcttctcgagggagtaatctcaattctctatctccatggcttaatttcccacttcatgctaatctactgtaattcagtctttatttgtcatggtgcaaaaactattatttttataatcaatggtgacttttatattggtaaatctagtgaacatgtgctagttttttttttaactaggtctctcttctgcacttgacactgttcattactctgtcttagtctctacacacttgcctcttattatagtattctctgttttctttcctttgtgaacactgtcaacatccttcacaagtttctcttcctgcagtcaccttttggatagaggtgccaccatgcttccgtcccagttcctttactcttcttatcctgcacatcctcttgctgtcttcattccatctccaacccttgcatttccatcagatacttctctggagtggttccatagggatgccagatgcactacctaccaactcatactgaattttttatatatatatatatatatatatatatatatatatatatatatatatatatatatatatatatatatatatccccttcttctttagcacaatatcctggagaatcacgtagattagaaacaaacgggtcactcttgttcccctacttcctcactttcctattcaattagtcatcaagacttgcacattttgacaactaagatttttcttttgttccatcccctttcagcccatcacagtcccctaagaccacctcttagttcaaatattttgtacctcttgtttactaccacagcacacaacagtttcacataacttcacattacatatacactttcactcaaaaaaggatagcatttttggattttgaagcacggcataccttttaacgtgtgtataagatgtgttttctcatgacttcttatacaatcacatgtactattctgcattgctgctttatacgcttgtgacttatctcatgtaggaatggaaagagggtgatccctttccttcccatcataagggtcacagttgacacctctataaaaagagagaagccatacaaatttattttatcatagtttcttgtggcttgggagggagccttcagaatgaagaccccaagatacagggaagactacctttttatgcttaggttccatgaaggatggacagctgtgtagaactgtgattggacaaaaagggtatgatctaatactaatagactgagtgggaaaaatcagcaaggcctgtctgtccagattcttcttgacctctctgtgcagcgttccttcctcccaggtgtggtgcaggaactctctctggtatgggggatctttgacctatagtcaacaggtaagttagagaatttctttatggccagttcttacacataaaggtagggggtaagttatgatgatatttttaggttttatggctggccttgaggagaaacatttctgatttctatgaccagttttagggaagagggattttaatttcgatggctatcctcagggaagaacaaggggtgagagacaaaagggcaggagggcagaattttgtttctgaaattgcctctgaggacttcactttggggtactgcttcctgtgcctcaatataatcaatgtgatcaattttacattgttggtattattcaatgatactttagatttgtgaaattcactagttagaaccaagctatttattctacattaaaacatttcaatagatagaatatcttacaatagctattgtcaaaaaatcattattattgggtttaacatttttatatttagctctgtgtggaatatcttaattattttttgacttctctctcatgtagcatcagaaattattcacttgaacagattttagattaatttattgatattatgattaccatgcatatccattaaatattttgatattgacaattaaaaagaatgaagtatgcatatatgtctcaatcatccagctgatcctaggaaagggatgtgcatttattaatcatgtttttaacccacagcacttactgtgacatttgtcacatagtaagcactatatatgtttttaaattaatgaagctatcaaagttcaccaaccaatataatttcagaggacagatgaaggctttcacgtcttcatttgttcacaccctatattcttccttatgcagctatttaaaattaattggcaagaattaccactctccttttctcatacttgttttggattctaaactttgttattttatttttgccatctctattctttctacttacttgacaattttaaaatcacacattatctaaaatcaggcagtgttttaattggttgatatattttacaagaaaccattccaccattatgttcttggtgatttaaatgcctatttggctacttacttgcacattatttgcaagaatactgatatctctttgaaatccttatctgtgagtgtgttagtccatttgtgttgctctaaaggaacacctgaggctggataatttataagaaaaaaagtttgttttggctcacagttctgcaggctgtgcaagaagcacggtgctggcatctgctactagtgagggcctcaggaagtttctgatcatggcagaaggtgaagggggagccagtgcatcacgtggttaagagaggaagaatgagggagaaagagtggggaggtgccacagttttaaacaaccagatctcacatgaactgagagtgaggactcattcattattctgagtacagcaccaagccattcatgagggatctgtttccatgacacaaacacctaccactaggccccatctccaacattgaagactatatttcaccataagatttggaggggacaaacatccgaactatcagcaattatgtagctacatagaaacaccaaagctgttctttctattttatttggtagaggttaagataagagaatatgacagtttatttcactcaaggcattttattaattcattgacatttgtctttgaacaaagagggtcatgtacgttcctgccttattcatggtgaattggtttggatgtaatggtacttgtacaacctgaggtcttaccaaggatactatctctccagttcatttgtatgtctttccaaggactctgaaacattttgtccaaggaaaaagtttcttattgaatttgaacttacatcaaatgaggcaaagtacttagcagccactccactttcagcataggaaaattctataatttgtcttgtgcattgtatgcattgttctatttagaatctgtgtttaccttgtaaatgtacttttaataatacctgaaaaagtaatattgagaatgcattgttctatgtcatagccctcattatttcattaaatgaagagctgaaaaagagataatcatttaatttatgttttaaatatctatactgacttgtttgaagaataatatagccaccatttattaaaccttggaagtagtgattttacaaacatttttttctcattcgcacaatgactctgcacataagtggcctattattattttcattgtccagttgacgattcaagggttatacaatttatgtgacttcccattgtcatattggggctggaatctataccaattttgcagaacttgagaatttatgtcctttcctgtataaccgtggttttccatgttttccttctgcttccatatttccacatgggcaacacattcccactcttttacataatatttcttcagaaaaaggcaagaagaaggttgtatgtaatctgaattggctgtcttttacattcccctctcaaaccctagaggttgcaatacccatgatcctcttgagaattgccacactatatagcagtggttggatgctggctccaaattagaatctctaatagtctgatttaattattctgggtactaagatgctggtattttaagagctctctaggtgatttaatatgcagccagagttgaaaaccaaggtttcccttctattgtatttcatgaaatgaaaaagacaaaataaaaaaagaaattcaatttatattgtttgctgtcaatgaaacatatcacataacctcccaattcttaaattacaccagtacttcatatttgaaatatatattcttaataaatcttttaactttcagggctctttccccctaattcttttcagttactttattagctctttgaccttgggcaactttctcttagagtcgattttcttttcttcattctaatttataaattaaactcttagctaggtaatattatttattacttttttgaataggtgactcttataaaatttcatttattttgtttctggtatttacatattggcctagtgaccatactagatacttaatatgctgtatatattttatacacataaataaaaatgtaaatacacactatatatatactatatttatttttagagtaaataaactttttaaacttcaggttatttagcactaacatactctctgatggtcccagtattaacatggtttttaggagtgcacaaacccttttctgcaagagaccagagagtaaatattttaggctttgtaaaacttatggtctcttttgcaacaattcagtatctgtcacaactattcgactccaccattggaatgctaaagcatctgtagacaatatgtaaacaaataggtatgattatgttgcaataaaactatatttatgaatgctagctgtaggctaggtttgacctgcagtctgtcgtttgttgaaccctgctttttatgatgattgtgaccttgattttgttttcctttttcatagcaggtgcttcataagtattgatttatattagtatgtttcctactttcttcctgccacaacacagcagttgttcacaggaattttgttgcttctcctagccttttccataattttttggtattaaccaaagtaatctactatatatggagaaatttgctatggtattacttttgtataggttatgtggtcagctgctctaggttgattattttagctctattgaaatcactttggtagatctaggctgcagcaacaaggtgaaataaagttagaacaatggaaagagtggtaaataaaaggatcaaggccaatgaaaaggcttatataagaagatatcccaaaatattagagttttttagtggctctccctattatacacactgtaccaattaaaataaatttaagagacttcagaagaataacacagttttcagatgggtggatatggacatattctccaatcctcaggtgactacaagtaagaaatccactaattggaaagaaaagaaagtagactgtaatataacaggtaacaacttcatgaaatgagtaatctcaatgagtagtttagactaaaaatacaaataaattatatatgtatatatatatagagagagagagagagagagagagacagagagagagagggagagagagagttcataaatgaataattgtagaaagttggtttgagatttcagtaataacgtcatggagggcagctctgttcatttttcagaatgctctattcaaagtagttatgtctgtgattttatttatactgtgattttttcttaaatgttttgatttctcttaaagtcgtatgcttttcctctcattatttaaatttagatcacggtagtatgatttactattaaaaggttaataaaatgggctgatatttctcattatatatgagatagcttcaaattatgatatagaaaagccattacattgatatagagcattttctgttttatctaacacagaaatttcccaatcacttaatctgcttaatatttatagatcttacattatccatgattactgtttcagcttatttttactttattcatgttgtgaatagatagtacatgctcatggtacaagattctaaacacacacacatacacacactcaaacacacacacacacacaaatgatacagagaaacagtagtctcttttttcttctgtccgtctatatcctgaattcaattactactatgagtctcatctagaaatagttcatatacttacaaacatatttaaattcttatgtaatcccatttgacccagcaattccactcttaggtatatacccaagagaaatgaaaatacatgttcacataaaatcttgtgcacaaacgttcatagcattattcataatagtcaaaagtggaaacaacccaaatattcatcagctgatgaatggataaaacaaaacgtggcctatctttacaatggagtataattaggcaataaaaaatgaactactggcttggcgcagtggctcactcctgtaatcccagcacttcgggaggctgaggcgggcagattatttgaggtcaggagtttgagaccagcctggccaacagggagaaactccatctctactaaaaatacaaaaattagccggtcgtggtggcacacgcctgtagacccagatactcgggaggctgaggcaggagaatcgcttgaacccaggaggcgaaggttgcagtgagccaagattgcaccattgcactccagcctgggcaacaagtatgaaactccgtcttaaaaaaaaaaaaaaaaacaactactgatacatgttacaacattgctgacccttgaaaacattatgctgagctaaagaaggcagctattattaaaagaccacatattattcaatttatgtgaaatgttcagaacaagcaactctatatagagaaaaattactgttacagggctgctgctggtggtggtggagggtgatgcaggaaaggggaaaatgggagtgactggtaataggtaagaggtttcttttggggagggtgaaatgctctgcaattacatggtagtggtggttggacaaccctgtaaatatactaaaaacactgaattatacactttaaatggatgaatgatatggtatatgaattatatctcattaaagctgttttaaaaaatgtatatttgttcaagattttgaaccagcaacatctgtaacatattcaaatgcaatttcattttagcttccaagcatggtcactctacctcataggtgttaattcagtattagaatgactagtccaaggtagcatctaaaactctgaacttaatttagtgttaaattgtgccccttccccggtttagggctactgcagacaggagtattacaacagaaaagacaggcgtggcaggcggcgtctttaaatctgttccttggacttctctcctgcttacaccttgctattctgactgttccaaggtcagagcagaataaagacagaatgaggtgatataaagtgttttctaggcctaatggctggttaagtgttctttctctttgtctctcccctcccagccctacctacctctcctacagtttccttgacccagacaggctcaatctctatctgtgtggagacttgttactctttccttctcttctgaagatctaggcttcacctcaggttcttgttgctgaggttcttatactcccataggtggctactggtcagaacccaagtcaacccagtgttgactctattttctgtgtactttgctgttagggtgcccgtgtaagttatcatccaaactgaaatacatttgtgagtgaaagggggtattactaataattttgatgaggccgggagtggtggctcacgtctgtaatcccagcactttgggaggccaaggcgggcagatcacctgaggtcaggagtttgagaccagcctggccaacatggtgaaaccccatctctactaaaaatgcaaaaattagctgggtgtggtggcacacgcttgtaatcccagctactcgggaggttgaggcgggagaatcgcttcaacccaggaggcggaggttgcagtgagctgagattgcaccattgcactccagcctgggtgtgacagagcgaaactccgtctaaaaaataaaaaaataataattttgatgagacaggcataaaatgggactgttctgagcaaatgggtcttatagatacccactgtatagaaaatactcacatatcctttgcccccaaaggtttggaacactgcctcatctattctgcttgtggccattgctctgcctctctcaggtgtgaggtgagctccattcctccacatcacccaactgcaaagaacacattcagtagatttcaaaggaatctcatagaagacccctttacttggctggagataatagatgagaattctcagctctttcccaaggagatagacaaaatatcttgtcagagaaatatctgcacaaaatccttcctctgcactttcctaaaccatttaaaatctgaaagtcaccaaggagttcaagagtaaggaacagatgcttacccatttcctttaaaaatctctatttagtgatttgtaactcacactagtatttcgcatctgttgtaacatggtgcctagttccaacttcaattttaacatcttattctgtatatattctttttttgtccacacaaatgtgagagttatttttgaaatataatgtcaaaagagatgatttgtcttagtggttcagtgtggcacaggctttgaaatcagaaaaccagtgttattagatttttgactttaggaaagtaacttgacttcttgcagccttaacttcatccccagtaaaatgaggataataatagtacctacctcatgggactattatcataattataagaaatcacatatgtaaagaaattaacataatactcaacttgtggtttgatgtgcaataagttaactattattattactatgattgttatttttaatatctataggaaaccaaataatatgaaatgtcacaaattatttttgaaaatactattctaaggtcttttttttttttttttttttttttttagattctatatcaatttttattccttcattgttacgaaacagatgaataatccttggcagatatacttgagagaagactcttctctcttcctgactggggtccaagtagtcctaatcccatttatccgcatctgtatattccacattggatttgtctcacacatgtccttcttgagatgttacttctgtgtttgagccagattctctgtctagaaaattgtccttggttatacctgctcaatgtttgctattaataatgatatacatcataatcatttaaaaagcccaaaactataacaaccctttagattaaagatacatgctccattggcagccctcaagccatttattttcacaatgtgctgagtttaactcactcattcatttataaattgacttggttgccaatatttggaatcagaagatgtttatcccaaatccagctttccatgggaaatcaggtaacatgggagaacttggcccatattttatttatttatttatttatttatttatttatttatttattttatttttttttttttattgatcattcttgggtgtttctcgcagagggggatttggcagggtcataggacaatagtggagggaaggtcagcagataaacaagtgagcaaaggtctctggttttcctaggcagaggaccctgcggccttccgcagtgtttgtgtccctgggtacttaagattagggagtggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatttttcttagtacagaacaaaatgaaaagtctcccatgtctacttctatccacacagacccggcaaccatccgatttctcaatttttttccccacccttcccgcctttctattccacaaaaccgccattgtcatcatggcccatccccaatgagccgctgggcacacctcccagacggggtcgtggccgggcagaggggctcctcacttcccagtaggggcggccgggcagaagcgcccctcacctcccggatggggcagctggccgggcggggggctgaccccccccaccatcctcccggacggggcggttggccaggcagaggggctcctcacttcccagtaggggcggccgggcagaggcgcccctcacctcctggatagggcggctggccgggcggggggctgacccccccacctccctcccggacggggcggctggccgggcagaggggctcctcacttcccagtaggggcggccgggcagaggcgcccctcacctcccggacggggcggctggccaggcggggggctgatccccccacctccctccaggatggggcggctggccaggcggggggctgacccccccacctccctcccagacggggcggctggccgggcagaggggctcctcacttcccagtaggggcggccgggcagaggcgcccctcacctcccggactgggtggctggccgggcggggggctgacccccccacctccctcccggacggggcggctggccgggtgggggctgaccccccccacctccctcccggacagggcggctggccgacccccccccccgcctccctcccggacggggcggctggccgggcagaggggctcctcacttcccagtaggggcggccgggcagaggcgcccctcacctcccggacggggcggctggccaggcggggggctgatccccccacctccctcccggacggggcggctggccgggcggggggctgacccccccacctccctcccggacggggcggctggccgggcggggggctgatccccccacctccctcccggactgggcggctggccgggcggggggctgaccgccccacctccctcccggacggggcggctggccgggcagaggggtcctcacttcctagtaggggcggccgggcagaggcgcccctcacctcccggacggggcggccggccgggcggggggctgacccccccacctccctcccggacggggcggctggccgggcagaggggctcctcacttcccagtaggggaggccgggcagaggcgcccctcacctcccggactgggtggctggccgggcggggggctgacccccccacctccctcctggacggggcgactggccgggcagaggggctcctcacttcccagtaggggcggccgggcagaggagcccctcacctcccggacggggcggctggccgggcggggggctgaccccccccacctccctcccggacggggtggctgccgggcggagacgctcctcacttcccagacggggtggctgccggacggaggggctcctcacttctcagacggggcggttgccaggcagagggtttcctcacttctcagacggggcggccgggcagagacgctcctcacctcccagacagggttgcggcccagcagaggcgctcctcacatcccagacagggcggcggggcagaggtgctccccacatctcagacgatgggcggccgggcagagacgctcctcacttcctagatgggatggcggccgggcagagacgctcctcactttccagactgtgcagccaggcagagaggctcctcatatcccagacgatggggggccaggcagagacgctcctcacttcccagacgggttggcggctgggcagaggctgcaatctcggcactttggggggccaatgcaggcggctgggaggtggaggttgtagcgagccgagatcacgccactgcactccagcctgggcaccattgagcactgagtgaacgagactccgtctgcaatcccggcacctcgggaggccgaggctggcggatcactcgcggttaggagctggagaccagcccggccaacacagcaaaaccccgtctccaccaaaaaaaaaacgaaaaccagtcaggcgtggcgtcgcaggcactcggcaggctgaggcaggagaatcaggcagggaggttgcagtgagccgagatggcagcagtaccgtccagctttggctcggcatcagagggagaccgtggagggagacggagacggagacggagaggggagaggggagaggggagaggggagaggggagaggggagaggggagaggggagaggggagagggagagctattctaaggtctttagaagcaaacagtgccattgagaattcctcaaagcactaaattacaaaaatattcacatagatttaaaggttaaacctggcttatagcaggtactcaactaatattgaatgaattaaatgaaacaactctttatctatcaggtacctttacaaagtgtacactaccattatgttataatgtattagtctcctgagtctgttgtaaaaagttaccacaaacttggtgacttaaaacaacagaaatgtattctgtcatggatctggaggccacaattccaatatatgttagaaccgcagcttattagaggaaataagcaagtcagaatgcttgactgtacatatcattctaaactgatagacttgacctgaggcctttgacctcttacggaacaaaggacaagtactttgtgacagctatttttctattttattatttgcctatatttgaaagcacatttaaatgatagatgttgaatttgttagaaaagtgtcagtctttaacttttgaaaaaatgccagttaataaaaaggatatataggtatcaagtatccttgattgtgttgtatttaaaaacagtcgtgcgtatgtaaatagttccaaaaatatgtgatagctacagactttttggttgtttatggaaatatatctcaattatagctgttttttataagcctgaccatcatagccaatcactggtattaaaaaaatatatatgtatattatacgtatatattttatatacataaatatacatatatacatatatatctataccttatatacctatattattattctgctttttggtagaaaaggtgtgtgtgtatatatatatatatgtacacacatacacctttaatatatcatatgtatatatacctttaatatattacatatatatgccatatatatatatatatatatatgcaccgttttggggtgtgtgtgtgtgtgtgtgtgtgtgtgtgtgtgtgtgtgtgtgtatatctatgtatatatatacctgatatacctgtatcattctgctttttgaccttatctttgaaaaactttgtcttcttttgtttttaaggatattcacaagaatatgaatagttcgaaatgtaaaatacaaactgctgtagggtagaaaaaactgtagtgccttttcctcagggattccaagcgttgtggccaacactcctatgccaaaagacgttaataagataaaagcataacagaattaatcaaggtattttgtgacatggaaggcttcagaaatgaagacccgaagacccagggaaaactgtatttctgtgcttaagttcgatgaagcatagacaggtgtggagaaatgtgattagacaaaagggtatgatctagtgttaccagattgaggggggaaatccagtgaggcatgtttgttcagattcttctggcctctttgtgcagcattctttcctccaggtacagggcaagacacctgtcacatgtgggttttcaggggagaacagagaaggtcagagagtgacatttcttggttttatggcttgctttgggggagaggagttctagtttctatgacttacctgagagtgtgggtggagaggaattctggtttctatgtcacactttggaggagaaaggggagccggagactggagggtgggagaaggtctgatagacctgcttctaaggtccccccagtctcctccaagtcaaagtactcagcatacaaaggtgccatactttggggtattgtgttctgagttccaacatggcaaacatgcccttttattataaaatggctttggacattttactgcattgccttaaaaaataaccaaggaaatgtgccaacatttataaaatatatgtgtaaataattatatgcattttaatgtttctatcaaaatatagactagtatagataggttttgagtttatcagttgaacactgtcaatcttaaattttaagctgactgtggactattttatcttaaagcattgtctaagagataaaagagtatacatttacaagattactttctaatttaaagggaaaaaagattagtattctcaactttaaatgaaaatcagtagcagtgaggaaatatagtactagctaaaataggcgtcttgcagctcatgacccttgagtttatgcttattatatatgtgaccttagagaagtacctttacctcagttaacttcaatgtccccatctgaaaaataggagttgtgataatgatatatgaattacaagattttttttctgtattaaataagatactatacacaaagggcttaaaacaatatctgacaaatttatttatttattttttttgagatggagtctcactctgtcacccaggctggagtgcagtggcttgatcttggctcactgaaacctctgcctcctgggtttaagtgattctcctgcttcagcttcctgagtagcttggattacaggtgcccgtcaccacgcccggctaatttttgtatttttaggagagacagagtttcaccatgttggccaggctggtctcgaactcctgacctcaagtgatctgcccgccttggcctcccaaagtgatggtattacaggcgtgagccactgcacctggccgacaaatttattcttattattatgcatcatattaaaaattaggctttttaaattttttggtatgcgtcattctctggactgagcatcttaaggacatagaaaccatatcttaatcattttttattgtggcttcatcaattaacactattttatccttaaatgcttgaataaatgattcactgattgagtgaattgtcggctgagttaactataaagtgtgtgagaggcatataaatttaatcactttaggaaatttttagtttcagtattatatgggaaatggcacacacacacatacacacacacacacgcacattgctgagccaaatacatttgaacatagaatgctctatttataatgaatctaaaagtgttaaattatacgtttgattcttttcatttctaagaaggttttgtagatattattaaatctttgtttacgtagttgttaaatatttgcttttaattttagacaacaattggctgaaagaaaagctcatgttatttttaaaaatgttgctttttaacacacatttcctatattacaactctctgagggacaagtgacagaaatctaactgaaaatagttcaaagaaaaatactgactcagtcagtgagcactccagtggtaggactgtcattgtcctcagataaagttgaatccgggagctcagttgatattattagtactttgtttctctctctctgtgtcactctccctcatccccttcttctcttcctgtctctgtctgtctctccatttcttaactgttcatttctctgagtccctgtggtaactttattatctgtgaggccctatctttctggtgattaaaatggcctctggctacctcagacttacatgattcttggtgccccccattttagaaagctccacatttttgtttggtctgattttgatgacatgctttgatcacacgcccacgctggaatcaaccctagtggctaaggggatatgttaccctgattggccagtcttgggtcatatgcccagcactaagataaataatatgttcggcccacccgagccgcaggtactgagaactgtgatctgttctccaagcttatgctgggtaaatacacacacacacacacacacacacacacacacacacacgcacacactcaaatatcacatgttactatgttgatgacactgtgataaaaattggacaagtcttttataagaaaggcaacttgacatattggaaaaatgtaggaggcagatcattttcactcctgtacattttggctatttgctgtcatcagccaagttatataacctttctgagcatcaattacttcactgtaaacataggatagattgtgatgaaaattaaatgatacattatgtaaagaacctaacctagtacttagcacatagtagataatcaatgtatattaaatgtgtaatcactctttgataaaaataccttaggattcagaaaagggaattgaaaagtggggaaggggtatgaaatttaaagaaatactatctgttccctttataaaaaataaactttttaaagaactattctagatatgcagtattattatagttagttctttttaaagaactattctagatatgcagtattatacagttagtttctgtataccctacgcttagttttccctgttactaataacttgcaaaagtatggtacagttgtcataattaatgagccaatatatgttactaactaaagtccacattttattcagctttcctcagttttccttaacattcttcttctgttccaggatctcatccagataatcacattacatttaatcatcatatatcaataggctaaccttggctgtgacagtttttcagattttccttgtttttgaggaccctgacagttttgaagagtactcactaggtattttgtaggatgtccctcaactgggatttgtctttatatgtatattttttcatcagatgtttctgggcaaaatataaggtcagagacttgtcagtcaccttcatccctatagcttagctcattatctgttgcatagtaggtgctgaatacatgtttttctgccaactgaaagaatagatacagtggtagagattactgtttatctagtcaatattctttgtttccttctgccttactgacaagaacatactttaaaaatatatactcaattgtttgttgattgaggtgaaatttgtataacataaaatcagtcattttaaagtgaaacattcagtggcatttagaacattcacagcgctgggcaactaccatctctatctagttccagaatattttcatctacccaggagaagttgctgtacccattaagcaggtgtgttccccatctctcccacttcccctacccccagctcttggcaattaccaatctacattctgtttctacagatttacctattctttatatttaatataaatgaattcacacaatatgtgactttttgtgtctggcttctttcacttagcataatctttttgatgttcatccgcattctgtcgtgtatcaacatttcatttctttttataataaaagcctaattttttttggaatagcaatgaccaagtttaaaactacattccctttcctttggtcgtgtggcactgatgccaccaatgatgtctaggaatcccgataaggcctctaggcaattttcttacagacagctggttcagcctgcaagtaccctgtttgctcttttcccttttccttcttcctttctgaaatacaggtattatggtgagagctatagatctaagcaacataacacaaggatgatggagtgaaaaggtgaaggagctggagtctccgaggacaccatgtagctgccataccagccctgtaatgactactttagccttcattcatgtgaaagagaaatgaacatctagtgcccttaaaaatattagtatagcaattcagattttactatgcattagaaatccagtgaaagctagagacatttcctggccaatgggtttatcataattctgaattaacctatgtaagagaatattcaaatgtccactgaaatcaatgttctaattattattgcccttgtcacccttagcttactattcctgtgttcctagtatggcagaatgaaaaaggctaaaacgttatatctgaaattggaggttgctgacctgtaaaatgagttagttagacaacaatataccattataactccatcttaacacatgttaccacccccttctggaaaataaatccaagatgtctgtagcacctttgtagccctgacggaagagtcaggccctttgtgttgcctgcacattcacttaggagagaatgaagcgtgctaatttgtggagcatataatctattcttttattaaaagtgtatgacaaatggatacagagatacctacctggcatactcatttgcatactaaaaatataatctttatagaagacaaaatagaatacgtccttgagcaaaacagagggaacaatttagtgttggaatggctaagaggttggaataatgatgactaaacttgaaagtgaagatgaaaaagttgagtctgaagggcaatgaaaagccagtgaggatttttaaaaataatagtgtagttggagcaaaggaggaaaaagttattttggtagaaggaacattttctattacgtgaggaaggtaaactaatgaggagactggagcatggagtatgctaatatgtgaatgaaaatagtgagtacattgagagcaaccttaggattgaaaataagcttaaaaatgaaaaaatgaattaatatactgatgtaccgtgattgctttgctttgattctttttttaatttttgagacagagtctcactctctcacccaggctggagtgcagtgggatgatctcggctcacggcaacctctgcctcccgggttcaagagattctcctacctcagcctcctgattagctgggactacaggtgcacctgctaccacgtacggctaatttttatatttttactagagacggggtttcaccatgttggccaggctggtcttgaactcctgacctcgtgatccacccacctcggcctcccaaagtgctgggattacaggcgtgagccactgcacacggccttgttttgtgtgtgtgtgtgtgtgtgtgtgtgtgtgtgtgtgtgtgtgtttgttttgttttgtttgtttgtttttgtaattttagcttcaggaaaaactttctgaggcaaaaaagttaattgggacttaaaaccaaagaccagaataagtcattcatttgaatacatttattgagaatttactatattccaggactctgctaggcattggagattaaattgtgaattaaaaaataaggcttttacccccattgatcttaggttttagtgaaggaaagacagtaaacagataacaagtaaatacttaaagagacagttaatagtgtcacagtttttccaattttagttccatttagcagtaaaaacagaataaaatgaagccacatgtaattggaagagagaggtcaagcatgtaacttttcttgaagatgaatcattcaacaagcatgtttgcatctggtcattagtgatgcgtttgggcagctttgccctcactgtcctcagtcacaagaaaggatggacatgagcagaggaccctgtagaaaaaggcagacatacatgacaatatgaagtatcacttggttgcttttctaattatttatcagtttttaaattgtaaatatgacttagactgcaggctagtatcacctgaattgtctaattatgctaacacgctactaaaaattacgatgttgataatgtgtttctctttaagttcaagtaaacatcattaaaagaagcacaaagcaagtgaaatatgcatggcagagaagcagtataataagggaccattgctaggtcacaggttccaatgttaacagcgaatgaagccgttttcttttttttctggaatagaatttcaagtagatgatgactgaaaagtcgttcttggacagttcagcctcattacttctggaggtctctctcatcagtgcctagtggagatgacaattcctaaactgtctgcaacaagtattaattacttgggtaatcaaaacaatataattgttgatttcttccctgtatttattttataaaatgaaaacagctttaactgtttttctggctgttaaaatacaagctccttggaaaaacctgtaaatgaatagtcaaattatcaataatggttttctcccatggtgagattgtaggtacttttgctttcttgtatttattttccatatttttgttcccagtgagtcccacagggagaagctgagatgccataaaggaaaaattggggctcatgagcaaatagggtaaggacccagaagtggtacaggcctaatggttccctgctttttgttttagcccaggtatccccctttccttgggctaatgtagatgagtcttttcctttgcccccaaagaaccctgctaaaaccgggtggggctacattctacacttgtatttattggtcatcattccacagaaccaagcacacagtagaaactcaagaaataaaatacttgattttattaagtgtcttatttcctgaaagtatgaaataacattacgtggtggagatatggttaaaaacaatatgatcaatttcaggagaaggaaacactccataaagtgcgagtcaacttgatgatattctatgagaaaagattgatttgtagtttttttttacattagaaatctcatatatgtgtctttgtgtgcaatatttatttaaataaaggctaaagattcccaaaaacattagtgagaaactcttcttaattagctttcacttcttggcccacattagtctttctctctctcactttctcacacacatacacacacaccacacacaaatgtaggtaggagagcaagggaggaattccgcattaggacatatcgaaagtagattaatgcaaatgaacaagatgccaagtacagtatgaaaattgacatttatcagcacactctgtatgaagatattttcaaagctttgccatacatatgaaaatattccatttttatgcttatgttttcgttattcaatagcatgcattactttctgttgtttccaaatgcaagttgtaaatctcctcagaaaatttcaccgatgtgagatttcacttagtcttttatggttgggtggatcatttcctttcaaccagaacagtaattccatgtaaaagagtaagaataaattgaaatagaaagccatgttgctttgaaattgaaaaagaaataaattattaattttagtggctttttggccatacttaagttcctattttcatctatggaattatattttaacatcataaacatgaactatgttttatgttcacagaaaagggaaattttcatctagctattcattttacatagctatttgccttgattcactttccttttttaaagtatttataaatttcatacatttttaattagacaaatgatacacacatccattcctattatttaagaaaagtaaaaaaataaaacacacacagggaacatcttaatctcccttggccattactcactctactctccaacttctccagaggtaaccatgttttttttgtttttgtttttgtttttttgaaacagagtctcgctctgtcacccaggctgaagtgcaatggtgcgatcttggctcactgcaacctccacctccctggttcaagcgattctcctgtctcagcctccccagtagctgggactacaggcacatgccaccacgcccagctaatttttgtatttttaatagaggcagggtttcaccatatcggccaggatggtctcgaactcctgacctcgtgatctgcccgccttggcctcccaaagtgttgggattacaggcgtgagccaccacgcctggccaaccatgttttaagaccaggacacgaccaatcagacatttttaatggaaacttgatggattgtttcgtagatcatctttttaactgacagagtatttcacgcttaaactacacaaaagttacatttaatcgtttccttattggtagatatttagaattatccaaatgtttcaccattacaaataatgcttcagttataatccatgaatatgcctcattgtacacataagcaagtatttctctgggataggcactaagaagagaaactgagagtcaaagggtacaggcatcatgaattttaatagatactgccaaattgccctccaaatgtcagtatcgatttattttctcaccagtaggatatgagaattcacagcccctctatcttttggaagcactgagaagagaaaatgctattgacatgttgttgtaatatgcatttctctgatttctcacaagctctggttttcatattcttagtgtctattttgtcttccttctctctgaaatgcccattgataacatttctccatttttgtattggtttgttttatttttcattgatttatagataatattttgtaaattgttcattttaattttgttggattttatatcttgcagatatagtatcttatttatcttctttttactttgcttaggttgttgaaaattcttaaatgtttacaggttaaatgtatcaatctttgtctcatgttttttccccttgctgtgttatttaagaaagccagtatcagactctaaactctggtacatttataggtttttaataaaagcaacttgatttataatccatctagcatttattttgtgaatagtctatgatagaaattgatatatatatatatgtttgtacaaacatgaataatatatgacagtttttcttttaattattaaatcaccttacaaatcaaacaactatggaatattattagcttaactacctgggtgattagcaaaagttttatatttcctttccctatactttttaatatctactctaaaataggaaagttactttctctggctttgagttgtcactaaaatatattcctttttgtttgttaaggccagtcagttcttcgatttgaagcccaaaaggctccaatgaggaaaagattcatttcttctctctttggtgctgttgttaatatcctcactcagatgcagtcaggaatatagtaatgcctgtctcccttataaggaccattatgattacattgggctgatctggctaaacctggataatcttctcatctaaagatccctaatgtaatcacatcaacaatctcccatttgccatgtaaggtaaaacactcacaaatactggggtttagcatgtggacatctttgggaggccattattcttccctccacattgtcaacctctggtccaactcacttgtcatcagtgtaggagtgcctgtggaggcaggtagagtggtaggagttgggaggattcttgattgccttcagctgagcttgaacctgtgctcttagtggagcagtttcatttaaaaggggatgtggctaagcaggcaccataaaatgtacttctagtagcatccctgaattgaaagagtttacatataagactgcatgataaaattaaatgagttacattttgtaaagcaggtagaacaatgcctgagcagagtaggcatcatatacgtatttgtgcttgttaaataaaacccaaaaataatttccacgaggaaaggagtttcaagcagataattaatttgcgaatgtgatatatcctcttgatccagggagctaattgattttgtgaattacatttctcagggtacactaaatcctcactgttggctatcaagaggaaatacaccttgacaggtttctccagtggtggtgaagattgtgtatggattatacacttaattgtcacatttttaatgagaataacagcttaaaatcaagagtgaaacatatacgctgaaaaatggcagtattaattagctcattccatatttattgaacaactacactgtaccagattttacagagcatcagtgataaataacagtccttgtgctcaagccttttgaagtataatagggtgaattcttttgggtttgcaaatacagtctcccccaccccttatttgtaggagataggttctaagacctaccttacccgaccctgtggatgcctgaaaccatggatagtactgaacctgattttgtcaaatggaacatgttttttatcatgtcttccacccacaaatttaatgccttttccatcttaactaagaacttatatactgtggctgtaacttttgcagttagaggtgcaactgcaaaactagcatgcatttctttttctttcttcacaatttctcagatagaaaatttcttcttactgtagatcttagcaaacagtatatggtgattttttttctttcttttcttttctttttttttttttggagagagagggtctctctctatcacccaggctggagtgcagtagcatgatgatggctcactacagcctcaacctccccagctcaagcaatcctcccacatcagcctcccaagtagctgggaccacaggcacatgtcaccacacccagctatttttaaaatttttttgtagttacggggtttccctgtgttgtcctggctggtctcaaactcctgggctcaaccagtcctcccaccttagcttcccaaagtgttgggattacagatgtgagctaccatgtccagccgtttacttattaagttgagaatttttactttttcacttaaaggaagcactttatggcttctctttggcatatccaaattgccagcataactattcttgcattttgggaccctgattaagtaaaatagaggttacttgagcactagcactgtaataccaagacagttaatctgatcaccatgagggctactaagtggctaatgggcaggtagcatgtacagtgaggacacactggacaaaggcatggttcatgttttgggcagaccagagctggacagcatgagatttcatcacaatactcagagcagtgtgcaattgaaaacttaagaattgcttatttcttgaatttcccatttaatattgttggacctctgttgactgtgggcaactaaaaccacagaaagcaaaactgcacgtaagggggactactatacttataatacaaaatgaattacactgtggcccgaagaaaatattaaaacaaagtggtataaagtattataaattagagtaatcactcttgtaaagatgtcttagagtaacaaggtagtatttgaaatgagctttgaccataaaggtgaaaatgagatgggacaccccaggtaaggggttaatattacctaagatagagagagagaaaatccaaacctttaaaataaaacagcttggcagaaatagaggatgttgcacctataattgtagtgagaaagaaaatggaagagttcaatgtaacttttggatcatatctgggtgtaaggagttaacaactcattaacaagtggcctaagtgacaaatagtgaaagctttgactaagatagtaagaatgaactagaaaggaggggctgggtatgagagacattgtgttaaagcagaatccacatgatttagcaactgatttaggaggggagagaggggcccataatgactgctttcctgcttggatgactagaataatgtagtttcagaatagaaacaggaaattggacagatgatgtattcttgtctttaaatgaatggatttaagatgctggaagaattttgagggtgactctttcaaacaagtatttgaaaatgaggttggacattcctgagggagatagagaaagatatttgggagctttagtctaaaataatctcaaaatgggagaggggagactttgtagctcattttgtcctatggactcatcttacttgagttccagccctttccttgtaactgccaaatgtttttctatcctgatttgaactttgagtctatggaggccaaacccgtggccccctggaggttacctcaaaatcactgacatgaggcaaattgatgagtgggataaatggcatacaaatttatttaacttgtatatacgggagccttcagaatgaagacccaaagacacaggggaaattgtccatttttctgcttagattcaacaaagtatagacagccacgcagaaatatgactggacaaaaatgatatgatctaatgctgatagattgagtggggaaacccagcaaggcccatctgtctagattcttcttggcctctctgttcatgtatttcttccttgtgggtatggatcaggaccctctctggaatggaggtcttctgacctatagtcaaacaaggtaagtgagatcatttctttatggccagtttgtacacagataggacagagagaaagttagagtaatatctttaagtttatgagtggctttgggacaaaaggagttctggcttctatgacctgccttggggaagagggattctagtttctatggccagcctccgtggagaatgggatagagagacaggagggtgggaagaggtcaaagaaaaacttttgcttctgaagctgtttttgaggctttcattttggggcattgttttctgagccccaacgagtctatgacatcctgaggcaggcaattctgtttgtaccattcagtttgaaatttcttctttattctgagttgtctaaagttctttccctttgaacctagttctacatcttgggaccctaccctagagcatttgcggttctgtctcacaaaagctcctctgatgttttaagaaagctataaagtccctctttagcctcctcttccagtaacgcagggagtgtaaatggtgctcagcggcagtataatatcttcatgccctcttttgcttgctccctgctagagttttcccagatataaataaattaatagaaaactaaaaacaacttgcataggttctaggctcaattaatctaacatgtgaaattgaaataaaaatccttcacagaaattaatagggtttcaccatagataaatgcctgagggcatatgtccacctctgtcacctctcccgcttccaatgctcctttattcttttataggctaaacatctctacttggcacaatggttcatgtgacagtttccagtcatatcactgtctttggtctaagtagcatggagaagaacaagaccagcccctcccttggtctacatactgttattttatatatatatatatatatatatatatatatatgctaaaatcagttgtgtgtttggatacacccccccccccacctggctcatagacacactgccaccaatgcctgttaatcatctgcagctcgctatgtaaccaagtggaggttcacccttcactgctattatatttcaccttactatccatcaggtcctcagataacatcgttttgttcaatgttgtttcattataacactgatgagaaaaaaaatcaatccccagccaggaccactgtctatgtggaatttgcatttctctgaatgtccgaatgagttttctctgggtactctgttttcctcccacatccaagatctgtgcatgttcaattcattggtgtgtctgagtggttccagtctgagtgagtgtgtgtgtgtgcgtgtgcatgcgtgcacaccacacacacacccagcgatgggctggcatcctggccacagtagatttctacatggcgccctgagctgctgggataggctcccaccacttgtgactcggaactggaataagcaggtaaatcgtgatttacttattttatgaatctttcttaaatgatgtatagctcatatgtatttcaatgtttaatattagaagtacgttggtctttagaagttttgtgatattttatgacaagaaatatgttacaagaacttaaatcttgtttatatcaattagcctatgagaaaattggttgtgtatgaggttgttgcacctaaagtcgcagtttccaagaacctatagatgacattaagtgaggacttactgtagttgaaccttactctaatctgcacgatcatttagatctcaaattgatcatgtttatcagcttgccttttttctctcttgctaagacattgttgatgatgtagaattttaagaaacttacatttaggatagtgtgcttgacaaaacagtatttttccagtttgacattaagttgtcaaaggtctgataaggaattttgggggaactttattgaagtggtatagatgttaaaagtgctttttaaaatgagatgacacttggtttattctgaatttatttatataaaataacactgtcttacgtgttgagaacttagacttttgattcaaaacacccagcatcaagtcctggtctaccatttatagtttatttatgctccctgaatctatttccttaagtgttatatgaggctattaatgccttcttcctaggctattgtgagggtttgaggagacgatgtgaataaaacacttagtaccttgtttggtatataataagtggctgttatttttctatgaaagtctgattacagtataaaatataactttattccctttgcgttcattttcatgccgaaaggttttctttcaatatgaaattggtatttaattgtataatgaatacttaggaagaaatatcgaatgtacatggtaagccttctaatgttttttgtaagaatggattttgatttgccgtacattcttttcattctttgcgtaagcagcaatacttactgattttgaaggtgataaaggccaaggatgtagtctagaaatccatgggcttggtgttcttaacttttgtgcttttatccaagctgccctaccatcatgatctgtaaccttcaaaatccatccctttttataaacagtattccattacccatttgtcatagcttgcctggagtaaagaaggatactgggaagatagtgggcactcttacttcaatgactgaccccttccccaccatttgttctcatcagctgtttttaatgttccattaaatctctcccttgaagttttgatattatttattatatttttcatttctggaagttcaaataattttgttcaaatcaggtaatctttgtagacagacatagaaatatctgcataagctttatgcttatcttttatttctttaacctacttgttttaaaattgctggctgataactccaatattcatagtttcaccacagagagcaatagctgctctctgctctttcatatgattcttgctgtaggtactgtatttctttttgtgtttagttgttttgttttgtttctatttcaatgagctgatcagtttccctggaatgttatttgtggggattctctgaggcctaggttgaagggaattcttgtagagaggatttccattagccttggcaggtgcctaaggtataaccactctgggatcactataaattaaatgaaattcatagcttgaggttttgggggaccatccaagtaataagaatttgtgctgtaaatctatcttaaggatatataaggggtggagatggtcaagtttagttatgtttcattatttttcctgaggatgtagcccttagctttactgggtagaggttctctccaatttgagatttaaccaagcccccaccccccatccccatctctttagcctcctgctaccattaaacctaggctcagactactggaatgtccaggatcagtgtcctcaggaaaaatgtcttcagtgggccacttaaccctttgagctctgattttacttagattttgggcataggaattcctatcttgtgaactatttgataactttagaaaaaaaaaataacccagtgttgttccttattttcagtggaaaggttgctccaattaaccttgcttgccatattaatagaaatagaacttccctgttatttctcacttaggagttttctcaaccagattttatatttaacatttcaaatttcttggcacaattctcattctctgaccctacttacttgctactggcagctttatttttaaactctgctttagcttttcttttctcctttgtataacttatccttcaacaccttgaaatagttaactcctgtgagtgtaataggaaatttacaaaaaataatctttaaaaaccaccagattatttgattgtgtgatccaggaatgaatgcatgtcttagaagaaagagggcaaattgggtgaaataaaagatgttaagcaagaaactcatgggtggaaagagagtattattgagatgattggcaagaccacttaggctgtcagataattaaatgaagccaagaaggggttatgggaaataagctgattacggcaggtaagacaggaaggaatgatggaagaactggaggaaaaggagcacctattaatcttggggaattttatcatgtattcagatttttaaaaaatcaattaatgaacatttgactatagaccatataaatcagggctgattcatagttttcccttttcttaaaactaattagcagatattagctataacaaaggatcttttgacctcaaaagaatacccttggtacattttctcatcaaactaatacttagaaacaatagggaaacaggaaattaatgagacatctgaaactttatgatttcttttcatctggaaatattagggggaaatcaaataaaatatacattttatcatgctgtttttacatcagacttttcccctagtattctttctcatttggaacatgttaatgtactacaaatgaaagaggatgaaacacttgaaaaatttctggattgtaatatgtttaaaaatatatatagttctccatctctcattttctacatttttccagtgttttttttttttttttaaatttgcttagccacgattcattactcattgaggtcctcctctgtccctggcactatggtaagtgttttgtgttttgcatatagtttctcattgaatcctcagaaaacctatgaggttctaattattattgccattttactggcaaaattgagactcataaaaaataagcaaacaaataaccttattgtttataaagtttacctatatttattttgatgtgcgttttaattgttatcttcatatcaagcctatgattttgtcagatactgttattattttttttaatacatgaggacaaagaagctcagagaagtgaagtgacttgtcaaagcttccagtataccgatacagatggtgctttatctcaaagcttctaagtcacactactaattttctacaatgctacacttatttggaagataaacataggatgatgatgatgttgatgacaatgactacttttaaagtggtacaaagcttgagatttagaaaaccattagtatccaacactagttgtatttggtaatacagattctcctctgctcctcatagtttagtgtagcctaccttaaacatgttcagcacacttatgttagcctacagttgggcaaaatcgcttgacacaaaacctattttatgatctcatgtaatttattgaatatgctacactgtagagtacattatccattgtttatccttgtgatcgtgatggtgtggctgactgggaactatgtctcacttctgctgttcagcattctgacagaagatcacacaaatatcactagcccaggaaaagatcaaaatccaaagttcagaatagtatttctactgaatgtgtattgttttacccatcctaaagttgaagaatcacaagtcaaaccatcataagtccaggattatttgtttatatatcttgtagggaagggaaaagtgaaaggaaataatgttctttctacccttctacattattggctggagcccctgtaacaaaagacaaattaacaagagaaaacaaacaggagtttactaacatgtatatctcatatatacatgggtgatacccaaggaaatgagtaaatctcaaagaggtggcttaagaatcagtcttaaatacgatcttcacctaaaaacaaagaaagaagggtatgggggaaaccacttatgggggtgaccaggaaaagtacagtaaacaagagtaaggttttttatgcagatttaagccatttccttcttcattaataagactccagtcttcttggtacagacagaaagagacacccttacaaatgaaaatttacgttataagtgtgaatttgccttacaaaagggtaacttctactttgtttgcagagcttcacatgtgtctgctatttctcaaaataactagttcaaaataatccttatactgaagaggcatattttggggtatcatattctggtctcctacaatcttaatatcaaatgccatagaaataacccaaaggatgggcacagtgtgtgaaaagttctaggaagaatataacaagtagactatataactactaatggcaatctgtgtcccaaccatttatttagctttatcagatatatttttctgaagatacttttctttctcatgtgctccactggttaaaacccagaaatacttgtagcataaagatataacccacaaacagcaatcatttcttttttcttgggtgtcagaaatagctcctttgtaaattcaggtgtgatgattaaagtaaaaacgagcgtgagataaactgttacgctaattatctggaattctttttgagatttttatgttagattgatttaggtgaggaagtatggcatagggccataaaatcagaggaaaaagaccgtatctgtgagttataaataatttttgtattaaaagggaatattcagtatagtacatctcttcaatttctaaaatgtctatagtaatattttaaaatattcacagaagaagttgaagtattattgataaggcttttgaagactattttgttcattaagtaaacagtaaaaaaaaacattttttgttaggtaaattttcaggattactcagaataagaatacttacagatataagggaaaactacctcaaaaggagtttaaagagattatattaaaatatatagtttgtacctaacgattaaaattttgtcctgagctcatcttaaattatctttgaaatcattaactatgtgttctgaaattttattttgggtacaaattgtttgagatggttgtttattttatgtatatatgtattcatgcattaattcatttgttcattcatattttttgtaatcttcagttccttatcatcattggcccaggctagtgctgtttcttcattatatgtgcatatatatgtgtgtacacgtgtgtatccatatatgcccttatacctacgacactaatccctttattctcctacagtgaggcaatcgttttaatgtactcaacgtgtatctttttatttgcacgtgtttttgtaaaatttgtgttgttggtttgtgtgtgtatctttttatgtaaattatgttatatatcatatactgttttctacatctttactaagcactatgttttaaagatccatttatactatatacatacatatatgtatatagacatgcatatatacacacacatatgtatattttgtgcatatatacacacacgtgcgtatgtatgtgtgacacatacacacacacacacacgcacacactcacattctaatttctaaatgcttcgtggttctccatagtgggcatctactacatttgaccctattccctctcccaatatggataaccagttgcctctacatctatacgaccgcaaataatgctacagtgaacatcctctcatgtgtccccttatagatccctgtgagaatttctctgagatatacatgtgggagtggaatggccgtgttataggtaaatatctatttctgtgctttccagaattttgcaccagtctgcactcccactagaagtgcttgaagattcccacgattgctcatttccatcagtatttggcaatgagtagtgttctagttttcgcctcagagaaatgtttaaactattttaaacacaaggttttcaagagtattctagtcactattactctgctgataaacctttattattattcatccaccaaaccaatctcaagaaaacctgtactacatgataatttgctagttatggtgtatgtattgtaaaataataaacttatttccttagaaaaattctttcagatattttattaatactgctaggatttagaattggtgatagtttatcttacattttatttctaatttgctcatagcaaattatattcatgatcaaagaatattttctgtcataattattgtccaaacagtgtttaggttgcacatggaatttaaaagtactcttcagtgagtaaatgacaaaatcctgtttttttacttagaacacttttaatactgtggttcacttttctataagttatactagtgggataggtcacatgcagactaaatgtagaaatataactaggctgtggaattaattagctttgattttgcatttatttgaaaaacaaaaaagaatatgaagaccactgacatatatttccactatttttctttttcaaatcatacaattgagataaagattcagtacttcctccaaataaacagccccgtaatagcagaaatgtaaattacaacacttctaaatctgtttttatcaactattgacctaactttattaaatgtacctaaaaatgtagggctactaagcagctggaaaataatgtattcagtttgtagaggggaaagacacgatacctttcctccgtgtcataaggttcttggctgacactcctataacaaaagacagattaacaagtgaaaagcataacacatttgtttaatcaaaattgtatgtgacacaggggacttcagaaatgaaaactcccaaacccggggaaaacgatgtcattttgtgcttatggttgttgaagagtgaatagctgtgaagaaatgtgactgaacaaaagggtatgatctagtgataatagaccgtggagggaaaccgagcaaggcctgtctgttcagattcttgtgacctctttgtgtagcattccttcttctcaggtaagggcaggaaccccctctgaaatgagggtattcaaggtataaaggaggagagggtgacttttctgggttttatccttgctttgggcaagaggggttctagtttctatgacttaccttggagaaggattctgtttttttataaattgcttcagagacagaaggagggataggagacaagagggcaggaggtcagaaagagaatttgcctctgaggctgcttctgcagccttccaatctcctttggttcaaagtaatcagcatgccaaagcactgttctctggggtgtcattttttgagccccagtaagtaaaagaagaagaaatcatgggcaagaaaatttcattgtctgtgtctctatctctgtctctgtctctctctacgcacccaccccccgccacacacacagagtaacaaattcacataaagaattgtaaagttattgtcaagatattttacttcagtacttaaatattaattgggtacttaccaaaaagcatgaacataaatacatatgtgttattttatatatatattatttataattgacaaataattgtatatagatatggggcacaatatgatgttttaatatatgtatacattatgacatgattaaatcaagctaattaacatatccatcaactctgctacttatcattttgtcacggtgagaacatttaagatttactttttaagcaattttgtaatatacatcaggccgggcacggtggctcacgcctgtaatctcagcactttgggaggccgaggcaggtggatcatttgaggtcaggagttcgagaccagcctggccaacatattgaaaccatccccctgtactaaaaatacaaaaattagccaggcatggtggcacatgcctgtaatcccagccactcgggaggctgaggtgggaggatcgtttgaggctgggaggcagaggttgcagtgagccgagatcacgcatcactgcactccagcttgggcaacagagtgagactccatctcaaaaaaaaaaacaacaatgtaatatacatcgaagaccttcagtctaattaggcaaacatactccaaaagtttattttagcaaaacgtggtttatatactacaataggctagtataaagaaaatatgttcattcagattttttcctcttaaacttatcaatatatctgatgtttttagaacaaattccttactttcattattttagccactactgagaagtcaatcatcaagtcactcatagtttgtctacttagggcctttcaccaatactcagtccctttaactggctacaccaaccaccatcacccttcccaaaaatacaacagaaaataaaataaaacaataattatagctcagtgacttcagagtactatcagtctatcactgtcagtgatttcttaccacttgtgaaatttcaaaagcctgccatgtactatttgtcctgtcaactcataccaggatcgtctgccaaatatctcaacatgaaggctctgtacaattacagacatctccatttgattcctcctctgaaatgtgttatttacatggttttttgtgtgtattttgcccatcattcactaatagtggcttactccaatgatatatagctatcctcccttctttacctagttaaatttcccagatgctcttcataggatccctctcaactattcaaggtctctttctatggtttaagggcttctcataaatgcagcctatcctcattgggtaaactatgggactagttagaggatagcagtaaggtgcatactccagcttttccccccacacggattcagactcatacttgggtaccttctgcctgaaggtgatggtggcagatactttgtaacccctgggttactaaatccttctcaatatttctaggtagccatgttattaccattccatttccacaaagatccctcaagtaccagagccaatattcaaacccagatctgtgggaactccaaatgctattctcatctctatatatgagggggtggggagctcaccaattctcttgacatgccaggagccatcttaccctttattttggtcaattttgttttgttcttcttttctcttgagctaatatttatacgctgattatgtgctaggcattgtgctaaatagtttaattattgcatttcattcccataattttactgaggtgtggctttatgaatgagcaaactgggacttaatgagtttaaataactgacccaaagtcaggcagctaataaatggtggagcttggatttaaacccagtctgctttaccttagcagccatacactaaacctgtaagcattcccaacaggacacatgggtttccatgattcagggtttcgtaaattggttaactgtgtttcttaggatcatgaaaaacctgcaggctttcagatttatttgaattatttttgaccattgagtcacacatggagtggattagttaggaaataattataggagtcagagttaaaataaaattaaatccagattggttataactcacacatttcactcttttatattttagcttccttttttttacataaataccacacatttaatagttttaacttgttattttggtcaaaataaattttgtaacgctgattcttctgttgtgtttagactatttggttgaatcaaggattttaaaatttgagtttaccaagttaagcactaaatcgaagtccaaaaccatatctgctttttatcccagtactttagacaataactagcacatagcagttgctcaataaatatttatttagtgaatatgtggaattactatacatttattattaatttgtacatcaaatgatctttcatcttttccttgaaaagtatttcctcattgaagaaatgctcaaattctgatacatctttcttcctaaaagagtatctttctaaagtccctaagcttttaagggtgctattaaatatatgtaaataatgattaatgaaaaatcaatctaattttaagatagtgatgcataccatctcacacaatgtgttttttcccagcttatgataataaaaaaatgtctctgagatgagaaagcatactgtatctgaaacctagccaaccacagctgacatcctcactgaaggttagctggtgttgactgatgcagggagggtacagatggaacaactgtagagtatagaatctagctctatgcgattttcatcttcctcagactaccttagatatgttagcaggtcaattggagacgggcaccaaaaaatggaagaaatgtgtaagtattaattgaagcctctgctttatgacttcgcattggctcaaacaggtcatttagtgggctcataaccagagtaaagtttccttaggcaaaaggtgcggatacagtcacagatggagtcattaacacaatcaacctatcatataagctaaactaattgtatttatttccataaattacatctggccttcctactacagtcttttgattttctactgagaagtgcatgctaaaaactaccttaaacacacacacacacacacacacacacacacaactttaactttctgcttactttcatttctgctaatattgtactttgtgctaatataattcattagctaaaatattcatttttgtagagactgagcaaaaggatagcagtcttttaaatagaaatatcatacagtatggcctttgtggtcagtatacaagacaaatatccacatggcatttatcaaataaaatttatgtatgtggacattttatttacatgcatatgttggaagaaagccatgtattttaaaaataaaaatgagctgatcattctacaaacgttgcagttgcctattataatgaaattgtgtgttaagtgtcactcttaaatcaatggagatgacatttgcatatcagtttaattgctttggattaaacattgaaagatgagagccaagagagcttattaagctgaaatgagggcaagtgataaaaaagtgatattatgtcaacactacatctggaggtctgttgttgtttccattttaaattctaaattgcagtgtttctaaaaaaattatcatcaaatgccatagttttgaaatatagtacaaaaattaaaacagttaatgcatcaattgtgcttgataaatacaatttgatttgaaagccaagctagggttttctctactttgttgaaatgtatttcttcttaatgtactagattgtaagattttgaaagcttttgaaaaacattatgtcttatttactgctgtatcttcaggactttgacatagtgtgtcctgtaataggtgctcaataaatatttgtgaataaatgagtcaatgcaaagtatggcaacaccttcatagttactgtaaaacactctaagtgagttcctgggtaccgctgattttggttgatgccagaaactgtatccacagctccctaccattcagaagcactgtgtgctcattggccttcttctttgcttgggggaatcatcagtcattattaaatatataaattcctgcaatgatctactttgaagtaggctatgtggactgtggcatgtgtgaagcaatttgattcccaattctgagggtctcctgtaggggtgtttgatttgagactccgcttagaaaccaccatttgtttgctgtgaccacagcatcagaaaactgatgacccatcattatccaacgataatgcagacctctttcatttgcattagagaatttgcatcacttccaggtattccctattgctcatcggagtgatttcatgtttgccagatagactatattgtgttagatcatctaaaacatagccttcaaatttgtttaaattaatccctccattgcagttatattgggggatttattttatggaatatctaagcatcttacaagcattatcttctcaatccttataacaagtgtgtggaaaaagttctatgaaatatcttcattttacagacgagaaaactgaggcacgggaaggttaagtggcatacctacagtatgtggaagagccaggttttgaaattagacagtctggttccagagggtgtgttcttaaccaccgtgctgtgagtaaataggtgcctgaggttcccctaaggtccctgaaaatgaagtattttgtatgccacatctatttcattgttgtttttagcttttaatcatagtacaaaaaaggtaacataaaatttaccatcttaactttttaagtatagagtttcagtagtgttaagtacattcacattattttgcaacagatctttagaactttgagttttaaaaattctatacccattgtacaactcctcatatcccctgtcatatctatttttaagtactatcatcccaaacatagcacctcaatctgatgagaagctatcatactattatcacttcaaatattaataaacagagaaaggagaatttttgtatttgcatagattagtatatgcccagaattcaaaatttagaaaaaatacgaatgcagaagaaatggagttgtattaatccgttctcacatcgctataaggaaatgcctgagactgagtcatttataaagaaagggggtttaattggctcacgattttgcaggctggacaggaagcatagtagcttctgcatctcgggaggcctcaggaaacttataatcatggcagaaggtgaagagaaagcagtcaagtctcacatgcagagcaggagctagcaggggagtgccgcacacttttaaatgaccagatctcgtgagaactctatcactagaacagcaccaaggggatggtgctaaccattcatgatggaccaagcccatgatccaatcacctctcaccaggctccacctccaacactggggattataatgtgacataagatttgggtggggacaaagatccaaaccataccaggagtgatttgaaataaaaagaaatgtcttagtgatttgtcttcctcttgtttctcagtttgaccttggatatttgcagaagaaaacttttctgatgtagtttatctgaatgacctgttcctaaatcatgacttcagaaatatatttttagttaaaagccaagaaaacaaaaagttatatttaatttacttgtttcttaaacacataagtattatgttaacttctgcataaaaataaattctattcaaacattgataaaaacaaaaagtacagttggccctctgcctttatgggttttgcatccatggattcagtcaaccacggattgaaaatatttgggaccaggcatggtggctcacacctgtaatcccagcactttgggaggtcgagatgagcagatcacttgaggccaggatttcgagaccagcctgtccaagatggtgaaaccccatctctactaaaaatacaaaagacaattagccaggcatggtggtgggcacctgtaatcccagctactcgggaggcttaggcaggagagttgcttgaacccgggaggtggaggttgcagtgagccaagattgtgccactgtactccatcctgggctaccgagtgggactctatctcaaaaaaaaaaaaaaaaaaaaagaaaaaatatttggaaaaaaattgtatatgtactgaacatgtacagatatttttcttgtcattattccctaaacaaaacagtgtaacaactatttacacagttggattaggtattgtaagtacatacattggattaggtattgtaagtaatccagaaattacttaaagtatacaggaggatgtgcataagttatatgcaaatactacaccattttataacagggacttgaacatctgtgggtttcagtgtccacaggaggtcctagaaccaattccccacagataacagggatgactgtatagacttttatatatgtatacatatttaaaattctatgtaaactgtagatagaattttaatcagtaaggtaaaaaacacgaatttcatataaatgcatgcaaaattatacaatctacgttgaagaaaataaaaaggactgaaaaagatatttatattaatacatattttcaattcttaattttctttatgtttgccatcatatttaattctcaaaaataaccctatataatagtttgaaatgtgatgtagtaaaggatgctaggaaaatagacttagatgggtggtgctcaggcagagaaggtgaaaggagttcctgggtgagggtcttcatcaacacatagaagtgagggagagcatggcacgtagatagcaccaatcgttacaaatggtcagagccctagatttgtgaatatggaagtggtaggagacagggaggagagataggccaaatccggatcaagaaagatttcctatagccaaataaattaattttaacgtgatttcacatattatagaaatgaaaggaaggggccaggcacattggctcacgcctgtaatcctagcactttgggaagccaaggcgggtggatcacttgaggccaggagtttgagaccagcctggccaacatggtgaaaccccgtctctactaaaaacacaaaaaaattagctgggcatggtgatacatgctattcggggggctgaagtaagaggatcgcttgagcccgggaggtcgaggctgcagtgagccaagatcgtgccactgctgtccagcctgggtgaccaagtgagaccctgtctcaaaaaacaaagaaagaaagaaaataaaggaagaaactaacaggaaaaatacttttttaaaaaagaaagaaatggtccggcgcagtttctcacgcctgtaatcccggcactttgggaggccgaggcgggtggatcacttgaggtcaggagttcaagaccagcctggccagcatggtgaaaccccccatctctactaaaaatacaaaaattagctgggtgtggtggtgcacacctgtaatcccagctactcgggaggctgaggcaggagaattgcttaaacccgggaggtggaggctgcagtgagccaagactgagccactgcactacacactccagcctggatgatagagtgagactgtgtctcaaaaaaaaaaaaaaatagaaatgcaaggaaggatattaattaatcaaaggattgtgtcgtagttagaaatgacacagataaaaatattttatcataaatccctttgctagtgtcaggacccattctgcttccaacttcataatattatattaccttaagttgggggttgatcaaatattaagaagaaagtctgagaatttttctaaggaccccttctaggtccacaagtcagagtagaagtagtttgggataactgtatgctgatagattttgtgtttttaaaaactacttggtaattattttgtcagttattctagcatcaaatattaaaggttctgacagtcgcaaggaagtgatcaatgatatttgcaaatgctaaagagaagatgattaccagccatccacagggatgattcaaatagcaaatatcattatggtaaaaacaaaattttcaacaaaaataactgtttaagaagcacagttttctgatatttttgataggtcaatttttttttttttttttttttttttttttttttgagacagagtctcgctctgtcgcccaggctggagtgcagtggcgcgatctcggctcactgcaagctctgcctcccgggttcatgccattctcctgcctcagcctcctgagtagctgggactacaggtacccggcaccacgcccggctaattttcatatttttagtagagacggggtttcaccatgttagtcaggatggtctcgatttcctggcctcgtgatccgcccgcctcggcctcccaaagtgctgggattgcaggcgtgagccactgcgcccggcctgataggtcattttttaaagtcaccttcaattcgagaaaatcaggaagataacatttttgagtaattttatctttacacttacatataaaatatttttaaagcatatatgcacatatatgaatttattcaagttttttttagggggaaaagagcttgatctagtgatatagtttattaactcactctgttatcttaacatatattgtttagaagctgtggaaatcatgtgtaattagcaaatataatcaaagttattttatatcataattatttattcttcccctgcaattccctgttgtaatttgtttgtttaatcagttcatctaaacttatcatttttcattcatttgtccattataagccatgaaacttttaccttttctctctcttaattataatcttgtctgatgaggacaaaataactgagacagaacagaggagcaagatgaatggcagacagcaggtgcatttgtatattatgaagtgtttgcaaaataataagcaccacatgaataatgcatttgaagaatattgtctggcaaatattattaagagtcatatatccaaatcatcccacaattactgaagaatgaaaaacaaagtgtctaatgcctctggttttgtcagacacagagagaatcaccatatagagcttctaggtagagcaaaagggcttctatttatttttatttatttatttatttatttatttatttatttatttatttattgagatgaagtttcgctctgtcacccatgctggagtgcagtggtgcaatattggctcagtgcaacctctgcctcccgggtttaagcaattctcctgcctcagcctcccaagtagctgggactacaggcgcacgccaccacgccaggcaaatttttgtatttttaggagacaggttttcaccttgttggccaggctggtctcgaactcctgatctcaggtaatccgcccaccttggccacccaaagtgctgggattacaggcgtgaaccaccatgcccagcaccacttattaatagaggactaaaaatttatatatatatctttatacaaatgtatatatctatattttatcatatttatatgtattatttatatatttgtatttactacatatatatgtgtatatataatacagttggccctccatatctgtgggttctgcaattgcagattcaaccaactacatatggcaaatattaataaaaaggatgattatgtttgcactgaacatgtacagtctttattcttgttatacttcatgaaacaatacagtgtaacaactatttacataggatttatattgtgttaggtattgtaagtaatctagagatgatttaaagtacactagaggatgtgtataggttatatgcaaagactgtgctatttttttatatattttatgtatgtatacctagcaaggtaaaatactgacacaattcaaaaaatgaaggaaaacctcagaaacgctttgattcaatgcttgtgtgtatgtgtttctgtttttgtttgtttttgtttgttttgagacaaggtcttgctttgcccaccaggctggagtgcagtggcgcaaccatggctccctgcagcctccacctcgcgggctcaagcaatcctcccacctaaggctgtggagtagctgggatcacaggtatgtgccaccatgctcagctaagtttttttgtttggggtgtttgtttgtttttctttttctttctttttttttttttttttttgtagagacagggtctccctaggttgcccaggctggttttgaactcctgggctcaagttatcctcccacattggtcttccaacatgctggaattacatgtgtgagccaacatgcccagcctctgtgtatgtgtgtgtgtgtgtgtgtgtgttgaaagagagaaaacataaagtaggactcaggattttagagtggttgatatgccactcctcattttgcctcttgactgtcttgctctatgaccactccttggaggtagctgagctgtttgtgttgctagtgttgctgcagccactggctgctgcaagaatctcaactgttctatcttctgttgctgctgctgctgctgctgctgctattgaaaagcagaagacagctgggacctctgctgagggaggctttaccaaatcttttctgggcaaaaccaacctgagatatcatagctgcctgaagctacagaaaacttctgactctggtgagattaatgagaacagctttatgagtccttcaggcctgttcttgattgcttgaaccttgtgcagaaccctgtggccttggctgtggagcatgagaagttgtgtgttgctgaaagtattgttgcagaatcaactgatggagcggcagaagcagcagcagctgctgctggatgttcaaaatgagggaaccaagtggaagctggagtagagttaatggcctgagacctgaggtacttaaaaaaaaatgctaaacacacctgattgaaaaggtgcctgcattctattggactgggccatgcatttggtagcatacctcctgaggaccgagggccactccctttgattctcgaaggaaatggggcattaacagtacagcccagcatggggtttgaaccactccccaaagcccaggctccgcagactgggcccactacattgatgactatttggacagttgagtttgccattacctaggaggctgggattgtttttgaggagttggaggagaccaggcagtgtgggggaaactgaccccatgattcaagtatctccacctggccccacccttgacacttggggattattacaactcaaggggattattacaattcaagatttgggtggggatacggcaaaatcatatcacttagctcaggagaaggtggacaatgagacagctccagatcctaattcagagaagatgtagaatatctcttgcagcattatttcactgagcctgtattcaccttttgctttttataggctgatcatttcagaaattctccctacctcggactccttgtcatgtggtccttatttattcgctgtctctcctgagtttggctagctcatgtcgtatatgttgttgtttgtccttttttatttagagttttaaaaatttatgattcatggtgtctttccaactttgcaatggcttatttaagtataaaatttatttaaaaacaaaacattaaaagttatgagtgaataagaaccagaaaaaattttttcgtaaatttccttttagagtgtcaaaatacaatttttctctgttttaccttgtgtgtggatgtttatctgtgtattgtttttgcaatgtttttatctgcttaattaatattcggctattggctttttttttctcagaacagtaatagaagatacgtttttgaagtggtaggatatgaagatgacatagcttacttaatttcatagttcaagaccagcttcttttgttgccattatgacatgaagtattttttttattgttaactgttgttattggtggtggtggtattttaaataaatagtacacttttccacaagccttgcgtctcctgattctttgacactcttgggtcattaggatccttcaactttagtctgttcttttttttttcccttagccataagtcttcaaagaatacatttcttctcaaaagtgcttccctgttcctaaaaggagatgtttacttctggtcctaaattctttttatgctcctttcttttgattgcccacaaccagtgctctaatctacctagtttcaaatattatctcagtatttcccaatccagcattgggcctcaatcacctcctacaaattattaagaataagaaaaatacctccggaggaaaattaggtcaaaataaatattcattaaaatatataaataatatttacatatatgaaaagatgctcaacctcacaataatagagttgcaagttaagactaaaataaaaggctatatttttgtattttctttttctctttttccttgtattattatttttatttgacacatattaattttacatatttttggggtagagtgtgatatttcaagacatgtatataatgtgcaatgatcaaatcatggtaattagcatatccatcacctcaaacatttatcatttcctgtgttgggaacattcaaaatctgctcttctagctatttgaaaatatacaataaattatttttaattatagtcaccctatagtgcaatagatcactagaacttatttctcctatctaaatgtactttttttttttttttttttttttgagacagagtcttactctgtcgcccaggctggagtgcagtggcacgatcttggctcactgcaacctcctcctaccaggttcaagcgattctcctgtctcagcctcccaagtagctggaattacaggcacctgacactatgcccggctaatttttgtgtctttagtagagacgggatttcacaatgatggccaggctgttctcaaactcctgatttcaggtgatccacctgcctcggcctcccagagtgctgggattacaggcatgagccaccgtgcctggccctaaatgtactttttaaaaaactaaacttagatacagggggtacgtgtgcatatttattacatgggtatattgtgtgatgataagattggggtatggatcccatcacccaggtaagtgagcatagtacccgataggtagtttttcaaagcacactctgtccttccctttccctctagtaatccacagtgtctattgttcccatgtttatgtccatgagtgctcaatatttagctcccacttataaatgagaacatttggtatttgattttctgtttcttcattagttcgctgaggatattggcctctagctgcatccatgttgctacaaaagacatgatttcattctttttaatggctgcatagtattctgtggtgcatatgtacccattttctttatccaatccaccattgatgggcacctaagttgattccatgtctttgctattgtgaatagcatggtgatgaacatataagtgcatgtgtctttttggtagaatgatttattttcctctgggtatataccaaataatgggattgctggattgaatgttctttgagaagtctccaagctgttttccacagcagctgaactaatttacattcccaccaaaagtgcacaagagttctcttttctccagagcctcatcaacatctgttattttttggcattttaataacaaccattctgactggtatgaggtggtatttcattgtggctttgatttgcatttctctgataattagtgatgatgagcatttgttcatatgtttgttggttgcttgtatgtcttcctttgagaagtgtctgttcatatcctttgcccatgtttaattgagttatttgttttttgcctgttgatttaagtttcttatagattctgaatattagactttcgccaaatgcatagttgtgaatattttctcattctgtaggttgcctgttcactctgttgatagtttatgttgctgtgcagaagctctttaattaggtcccacttgtcaatttttggtttcgttgcaattgcttttcaagactttgccagaaattatttgtcagtgcccatgttgagaaggctgtttcctaggttttcttctagaattttcatagtttgaggccttacatttaagtctttaatccatctggggttaatttttgcatatggtgaaaggtaggggtccagtttcattattctgcatatggctagccagttatcccagcaccatttattgaataggaagtccgttccccattgcttttgttagccccatcaaagatcagattgttgtaggtgtgcagctttatttctgagttttctgttctattccattggtctatgtgtctttttttttttttttttttttttgtaccaatacatgctgctttggttactgtagccttatggtatagttcaaagtcaggtagtgtgatgactctggctttgttctttttgcttaggattgctttagctattcaggctctgttttggctccacatggattttagaatcgtttttctaattctgtgaaaaatgacacttgtagtttgatagaaatagcattgagtatgtaaattgctttgggcagtatggctactttaacaatattgattcttccaatccattagcatggaatgttttgcatttatttgtgtaatctcttagttctttcagcaatgttttttagttctccttgtagagatctttcactactctggttaaatatattcctaggtatttttttgttactactgtaaatgggattatgttgtgatctgattcccagcttggatgttattgatgtatagaaatgctactgatttttgtaaattgattttgtatcctgaaactttactgaagttgtttatcagttccaggaggcttttggctgagtctttcggattttctaggtatagaattatatcatcagaaaagagagagagtttgaattcttattttcctgtttggatgccttttgtgtctttctcttgcctgattactctggctaggacttctagtactacattgaataggagtggtcagaatgggtatccttgtcttgttacagtttcgtgggggatggtcccagcttttgtccattcattgtgatgttggctatgggtttgtcatagatggttctcagtactttgaggtatgttccttcaatgcttagttctttgatgttgttgttgttgttttaatcaggaatagattttggattttatcaaaagctttttccagttcaatgaggtgatcatatggtttttgtttttaattatctttatgtggtaaattgcatttattgatttttgtattttgaaccaccttgcatcccaggaacaaagccaacttgattatggtgagttaagtttttaatttttcatttgtttttattttttttaatttttaatgttttgttgtgatgacctctctttttaattttttttttttttttttttttttttgtgacgaggtctctttgttgctgaggctggtctcaaactcctggcctcaggcagtcctccctcctcagcttcccaaagtcccgtgataaaggtttgagccacaatgcctggctgtttttaacgtgctgctggatacagtttggtagtattttgttgagaatttttgtatctattttcatcagtgatataggcctgaagttttctttttttgtcgtgcctctgcttggttttggtagcaggctgatgctaccttcgtataatgagttagggaggggaccttcctccttgattttttgaaatagttccagtaagattggtaccagttcttctttctacatctggtaaaatttgactgtgaatccatctgatccagggctttttctggttggttgctttttttttttttttttttttttttttaacattgaggaggttattttattttattatttattttttgagacaggttctctctgctgctcaggctggagtgcagtggcacaatgggctcaagcaattgaggagttcattttaaatgtatagtgtaatccacatctaagctctgtttgcagaatgagaggttgatgaaagaaagctcaatgaagctgcagagtcttaatcttgcttttggccgcaccagccctggcaggacctcgttcacaaagacagagaattaacatttgtcgaatgaatgaaggagatgccgtacaaagattgtatggttcctttcagagcctaaatatttaataggtgggtcactgagggtctgaactagaatatttgataagcagacatccagggttgagtgttagatgttctgcagggagatggatggaggggtacctacagggttctgcaagctcagtaatagatgttgttgaagaagaaatataagttagagacaggacaggacacacagagaatgcacctctttggggtcaataaaaaaagggaatgagcccagaggaagcactcaagatcagttgcaaattgatatcccaaatgttttggaatacttctaggaaaaaactctcctacatttcaaagtccagataatactgactccaccctctggcacagaggacttctatggcaacatagcacaggagtggtacatgaaggcaaagtccatttgtcttagctcatatcaaatggtaaagcagagcttcttttattttaatttagctattcaagctgctgaagctatacccaaaatccctagccctttctctgatatgagtctctgtgtttccatattgggagcaatttttttttttttttttttgagatggagtctcactcttgttgtccagactggagtgcagtggcatgatcttggctaactgcaacctccgcctcccaggttcaagccattctcgtgccttagcctcctgagtagctgggattacaggcacccgccgccatgcctggctaggttttttttgtatttttagtagagacggggtttcaccatgttggccaggctggtctcaaactcctgacctcaggtgatctgcctgccttggcctcccaaattgctgggattacaggcatgtcccactaggcccagcgcaattgttttttataactagaaatgtgtttggctttcctccaacaaaccaggaaggtcaagagatatgttctagatacctctttgtggttgcttaatgcagagctcatgcagacacatctgcaaacctaaggaaacgaccctctaaggactggttagccacttaaaatgtgggccaagataggctattaaattcgaatcctcactgcttcattacagcttcctcacattgttagcctacaaactaagttaaggacacacttaaattccagaagttgatattagtctattcagagttttaatctcttcttgattcagtcttgggagattgtgtgttttcaggaatttatccatttcccctagattttctaatttgtttgcatagagttgttcatagtagtctctgaggatcttttatatttctgtggaattagttgtaatgtcatctttgtcatttctgattgtacttatttggatcttctgtttttttctttgttaattaagctagtggtctatcgatcttgtttattctttcaaagaaccaactctcagttttattgatctgttgaatggatttttccatcttagtttcatacagttttctctagttttagttatttattttcttttcttctcctagttttagggtttgtttgttcttttatttcctagttcatttaggtacaaagttagatgattgttaatttgagatctttctaacttcttgatgaaggtgtttatcactataaactttcctctaaacaccactttagctgcattccagagattttgataagatatatcccgattttcattaatttcaaagtatattttggtttctgccttcatttcagtgttcacccaggagttattcaggggtaagttgtctaatttttgtgtatttgtatagttttatttttttttttagaaagtgtctcactctgttaaccaggctggagtgcagtggcatgatcatgggtcactgcagcctcaatctccccaggctcaggtgatcctcactagccacccagatagctggagaactataggtgcacatcaccattcctggctactttttttgcatttttttgtagagatggggtttcaccatgtcacccaggctgttcttgaactcctgggctcaaacaatccacccactttggcctcccaaaatgctaggattataagtgtcagccactgtgccctgcttatttgtgtcgttttgagagaccttcttgatagtgatttctatttttattgtactgtggtctgagagtgtgcttgacatgattttgattgttttgaatttactgagacttgctttatgactaagcatgtggtttatcttagaatatgcttcatgtatagatgagaagaatgtatagtctatggttgttggatggagtgttctgtagatgtctgttaggttcaattggttgagtgtcaagtataagccttgatgatctgtttatcaccctgctgtcagtgggtattgacatctcccattattgttgtgtagctgtctcagtctttttgtaggtcaagaagaacttgttttatgaatctgggtgctccaatgttgggtgcatatatattaaggatagttaaggcttcttgttggagtgtaactgttatcattatgtaatgcccttctttgtccttctttattgttattggtttaaaatctgttttatctaatacaagaatgatgactcccactgtcttttgttttctgtttgcatggtaactctttctgcatccctttactttgagtctgtgggggtgtcattagatgtaaagatgggtctcttaaaaacagaagatgattgagtcttttatttgtatccagcttgccactctatgtcttttaagtgggacatgtagcctatttacattcggggttagtattgatagatgagattttgatcctttcatcatgtagttagctggttgttatgtagacttgattgcatagttgctttttagtgtctgtgggctatgtgcttaagtgtgtttttgtggtagcaagtgttgttctttcaatttcatgtttagcattcccttaaggacctcttatgaggctggtctagttaaaactaattccctcagcatttgctcatctaagaaagatcttttttctccttcacttatgaagcttaatttggtaagatataaaattattggttgaaatttattttctctaagagtgctgaaaataggctgccaattttttctggcttgtgagtttctgcatcaaggtctgctgctatcctaatggagttccctctgtacatgacctgagccctctctctagctgcctttacatttttttcttttggattgacctttgtgaatctgatgactatgtgccttggggatggtcatcttgtgtagtatctagctggagttccttgtatttcctgaatttgtacgtcaacttctctagtgagattaagaaaatttttgtgaactatatcctcaaacatattttttaagttgcttattctctcttcttctctctcaggaatgccatattggtcatagatttggccactgcacataattccctatttctttgaggttttttttttttttcattttaaaaattattattttttctttatttttgtctgattgagttgattcaaagaacaagtctttgagctatgagattcttttctcagtttggtctattctgctattaatacttttgattttattataaaattcttctagtaatttttcagctctagaaattcagtttgattctttcttgaaatggttatttatctttcagttcttgcatgattttacttgattcattggattccttggattgggtttcaactgtctcctgaatctcaatgagcttccttgccagccaggttctgaattttatgtctgtcattttagtcgtgtcaggctgtttaagaagcattgctggggagctggtttgcttatttggaagtaagaggatactctggctttttaagttgctacagttattgcactgattctttctcctctgggaggactagtgttcttctatctgtggtgtaagttgggtatagttggttgtctttgtttctgcgtgttttctgagggtcaaggttctgtataatgtctttatttatggcttaattcttgcccatggtttcacaggaggatatattagcaaaatgtttttggtgctgtagtttgggctgcaatcctgtagatggtacataggaataacggtcagtagataggctcttactcagctgtgcagctcctgtgtatttccttgcatttgcagccatgctctgtggtataggggggagaagagatgacctcctcaccaggcctgctcctgggtcttaggaaacccctctgattacttccaccatgcccacatttattttgttaggtattctgggccatgggcctcccttgggcagaggctataacatggagatagactactccctttctggactggccttgcagagggaggcatgcctcactcccatgccagtccatgaacccatgtgtttcacccatttcagtgctgtgagagtgggctcctcccccactagagtgttgcatacagatctcagcttagcattcccgaactgtgcaccacagccttggggcaccaggactggctcgcagctctatcctctagacgttcagggttggtttctgggtgcactgggaaatccaaagtgctcccaggctgctgtgaatgtactcaggtgaagcaaagcatccaggctgggcagcataggctgtgccatgtatacattcctgtgtgggggaatggggggtatccaggtagaggctctgggaagggcttttgggcaggagagcctgcgaagtagacataccctagtcctgcaggaaagccagccccactttctcctggcctggcagtcagttgggcctagagattctcagaggaaaatggggatccctgtgggatgggcacctacctaaggccatgccctactggagctctcccacacagaaaggctcctggctttgcaccagctgaagcgttgtctctacctactctctgggtagattcccctgccagctcaaatgtctgtgggggacatggaatcccctgtagctaggatcccagaggttcacagtgagagtgggcagtcccacagcttctttactcacccctttcccaggagccatttggagccgaaaactagccataacgttcaggtaccttatacacggttcccagattcctctctcttcagcctcagtgcctgcgtcacatttccatccactcttggcatttttctctccaaagatgtattcaaattatgttgctttacttaacattttggtccctcttggcgggaacagtgctttctagctgtgtctagtaagccatcttgtcccacttcctagctgtatttttttttatctgttaaccatcctttggctatccctctcccttccctacccttccctgcctctgataaccactattctactctttacttcatgagatgtattttttagcttccacatacatgtgagacaaatataagcggtatttgtctttctgtacctgacctatttcacttaatgtactccaggctcattcatgttaccatgaaagacagaattttgttctaaaagaccattcttttttttttttttcctactagattactgaagatcggaacatttcatagcttatcatgttagctaatggtgtggggaaacagacacactcaaatgttgttgagggtttattttgtgtttttttgtttgtttttgagatggagttttactcttgttgcccaggctggagtgcaatggcacgatctcagatcactgcaacctccgcctctcgggttcaagtgattctcctgcctcagcctcccaagtagctgggattacaggcatgcgtcaccacgccctgctaattttgtatttttaatagagatggggtttctccatgttggtcaggctggtctcgaactcctgacctcaggtgatccacccgccttggcctcccaaagtgctgggattacaggtgtgagccactgtacctggccattgttgaaggcttgtattggtccaattcctatggataacaaagaaactaggaataggatttaccttcaaggtttttgggaatttctcaccactggcctatagtctcattaaaaatctactactttttaaaccttttaaaaataaatgcaatatttaccttgttgctttgtataccacctgcacaccagtgttactggtcagtggggcagcactactacattccgagtatcacttggtaacatgagagaattcaagaggaaatgtatagcaaggacaaaatcctaggaaaagtctagcatttatgaagaaagaagagaatgaatagaggcatattacaatcaggaatagacttactaataaaatttcaagaagaatgggagtaaatagtattaaatgccatggagtgctcaagccagttaagtattgagccagtgaaactattgaaaccatgtaattgttgaaaagtaggtttttgatagccttagtaacaacattttctgagaaatagtggagaaaaatcagaacatagtagaaaaacagatgagtctgtgttgagaaagtaaagagagtagcttagactgtcctgaaaagtttttgttagtgttgagaaagaagtgagttacaggttaaaatagaggacacacacatgcatacaaaaaaattaatagctttgtgtaaaatctctcaataatgcaataatagaccaggtaaatacaacataaataatgatgttaccaataatgtaattttggaatttttggaattgacataagctttcatggagatttttatatgataaatgaaaaagtaacatacgcaaaagcctctattcaaattaatgacttggctgggtgaggtagcacatccctataaccccagcactttgggaggccgaggtgggaggattgctggatccctggaattagagaccagcctgagtaacatagggagacctcatctctacaaaaaaaaaaaaaaaaaaaaaaaaaaaaaaaaaaaaaacttagctggacatgctggcatgcacctgtagtcccagctactcaggacactgaggcaggaggatctcttgagcccaggagttcaagaacagtctgggcgacatggagagataccgcctctacagaaagtaaaaaaacttatccagatgtggtggcacattcctgcagtctcagctactcaggaggctgagatagaaggatcgcttgaacccagaaggttgaggctgcagcgagccatgattgtgccactgcactctggcctgggtgacagagcaagactgttgccaaaaaaaaaaaaaaaaaaaatatatatatatatatatatatatatatatacatatacttatgtgctttgtacattatagacataataaatggtagataatgacatcagtaaccacaaagtcaaattatacagcaatacttcatgtaattttgattccaaataaatccatattagtaaaagaaagccaggagcattgtaatagcttttgtaaattagccaccaaggtagtcaatttacagttgtatttaatagactagtgaacagaagggttttgagagtgggaatgattacaatgctgttgcataaattggagctttaggaaagcactgaaggaaatggtgtccagttaatcattaagatattcttcacgtgcatatgaagaataatttgggaaaacttgacattcagataagactgaatataattgggttaaactgcaataatacatacatgttctctattttcttgctattatcataatgtacttttaaggaagaggcagatattgtaactgaaaatcatggatacagtaaagccatttcagttctttgttacagttgtttcctatgagaagaacatgagaaatgatcttatagtattgacagaaaaggagtgttgacagctgactgttgcaaagcctccagtgtaattattccacctcccctacggccagggatcagtgtttttcatatgacccatacttctgaaaataatgaatttcaaaatgtctgttccatgtacacagttgttgacatacacaaatatttagctatctagttctagaatccccttggtgtttcatccatctgaaactgagaaaagagagcagagtcagtaacagataagccctcgttgctgttttatttatgtatttgtttatttatttatttatttatttctgtactgctgcatctagggatgccttccactggatgcctctgtgtcaactgcagctctttcaggcaatactatgagacaagattaactgaatttcaaatgtatgagactccactcacagaaagggtgttctattcatactgaatctttctataaaaatgcaaaagttggatctggagaacagaaaaaggaagagagctgcattcacagtaggataaggagattaaataggaagagttatgtgatttatctcttttatgaggtgctgctggaaagcagattaagctttttaaaaagtggtgaccttgatataaatttcatatttagccagtgctgatggattttgaataatgaagggtatgtgcaacaacactgagcctgagaagatgcaagaaatgtagtgaagttgaccataatctgagtgctaatacatcactgcaaacaacagtaacaggaataatacctattgtgtagcagtttgcccattacaaaatacattcacaccaggatgctatttacttctcacaataactctatgagattaagtatccttagaatttgatgatctggtgctgaagttcaagaaagatgttacttgttcatagtcacacaacttgcaaataaattcctctccctgtgaaaatattctcttcttatattcattgtcacattcggataaagattggacccacttgtattttatttctaacacttttaatcatacctctaacataactctatggtattacattctgacaactgaaatgtaaagtgttttatttctgcattgtctctgttgacatgaatccttaatataatgtcatattctgagcatgtttatgtttataaaaaaatacaaatcattaggccattttctttttccaaaaatgaccggttattgccgagtaaagttactaggttgctggtattcaagccattcgttattttaatgaataataggtaattcagattaatggatttccattctagcaagaaatctctaaaaattacatggacttgaactgatattaaaattgtatataaaggaatggaaaggaaaccaactgtgaaatgtgtccaaatcatatagaataaaaaagttcccttccccaaaaacctaactctgcttttaaattctactaattcacagtgtaattctgctctttccttttttcctgtttttggctttagatacataaataagaggctttaatcatagaaaggaagctggaaaagtaccttaacttattacatttaccatgtttgaacactgttatttgtaatatttgcaaatgtacaactatataatttgtttatctttttcttttacctcatgggagacttctaggaatttatatataatgtggattaaacacttagactatttgttccctaagctactgtattggccaggacctagtcagttaaagcaaattcattccagatagttcagtagaagaaacttaacatgggaaacaggatatcaatatgctagaagagctgaaatgacccagaggttagcaacattaggaaaccactaccacccctatatatgaagggacaaagagaagaaggaagtcatgttaccagaacccagaaactgaaaggatagatcccctcttgtaaaaattcatcaccaatgccatttgtgaggagaaactgggaaattgagaaactacgtatgggataaagtggtaaacaaggcagataagactccctcatgcatgactcttacaatgttatggaggagaaaatatataccaatataaagaaagaagacaaagaaaagatcagttagtgataactgagaggataactataaatataaaactgagtgtatgaaaaaattatgagatttattcttgtggattatttttgcattaatttaatttttgaatattgcattgaaatattatctatcttaactagtgagtttatggcaccccctcattcaactcatgctagttccattggggtaagcccatgatgtttcaaaggactttcagctattttgcttgagcaattcggtggatggtgtagtatatgtcacaaataaatgaagcaactttttaagatttcaaaaaggcataataaatagacatttgaatatataaatctagaattcagagctggagatacaaataaaggagacacaacatagaaatggaatttagagtgagagggttaaatgagattacatagagggcaatgaaatgagataatgcattaagtctttttgaaatgatggcttaaatgaaatataattcatatatcatataattcacccatttaaagtgtaccattctaattttttttaactgtggtaaaataccacacaattgaccctttgaatcatttttaagtataaaactagtggcagtaattacattcagagtgttgtgcaaccatcaccactatctatttccgaaattttccatcatccaaaatagaaattatttacccatgggcgcagtggctcaagcctgtaatcccagcacattgggaggccgcagtgggtggatcacctgaggtcgggagttcaagaccagcctgaccaacatggagaaagcccgtctctactaaaaatacaaaattagccgggcatggtggcacatgcctgtaatcccagctgctcagaaggctgaggcaggagaatcgcttgaacctgggaggcggaggttgcggtgagccgagattgtgccattgcactccagcctgggcaacagagcgagactccgtctcaataaaaaaaaaagaaaaagaaattctttacccatgaaacactaactttccattccttcctcccaccagctcctggtaacctctactctactttctgtgtctatgaatttacttatcctagggacctcgaataagtttaatcatacaatatttatccttttgtgactgactgatttcacttagcctaatgttctcaggtttcatccatgttgtatcgtgtatcagaatgtcattgctttttaagtctgaataacattcctattgtatgcatataccacactttttaatcttttcatttgttgatggacatttgaattgtttccaccttttgggtgttgctgctatgaatattggtgtacaaatatctgtttgagtcccttttttcaattattttgtgtgaatacctaggagaggtgttgttggatattctatatttaacattttgaggaactgcgaaactgttttctacagtgactgcaccaatttacattctaccagtaatacacaagggttctaatttctccactccttgccaatacttgttgtccaacccccaacacactttttaaaaattttttttaattattgtcttttgagacggagtctcactctgtttctcaggctggagtacagtagcacgatctcagctcactgcaacctccgcctcctgggttcaagcaattctctgcctcagcctcctgagtagctgggattacaggcgcccaccaccaaacctggttaatttttgtatttttagtagagacggggatttcaccgtcttggccaggctggtcttgaactcctgacctcgtgatccacctgccttggcctcccaaagtgctgggattacagatgtgagccaccgttcctggcctacactttttattttttgataatacccatcccagtgtttgaggtggtattgaaaggtaaagctttctatacaatatttcttccttccccagtttgcctctcaataggatataaactccataaaatcaagtactctgtttattcactgctttatccccagccaggccacgcatatagccattgctcaatacatgtgttgtattgactgagtgaatgattttttttttttttttttgagacagggtctcattctttcaccaggctggagggcagtggtgtgatcttgtctcactgcaacctctgcttccaaggctcaggtgatcctcccacctcagcctccccagtatctgggactacaggcacacaccaccacgtctggctaatttttctattttttgtagaagtggagttttgccatgttgcccaggctggtcttgaactcctgggctcaagtgatctgccaacctgagcctcccaaagtgctgggattagaggcatgagccaccctgcccagccgtgaatgaattttaaatgctcagtaagtgagagttgtattcaattctttaataaataatatcatatatttagtcttatattacattgcatcgccattgctgggcttagtgttttctttttgttttattttgttcttatgaaacaacatcctttttgaattggaaatttaaggaaagatatgctgcatatacatagaatgaaattatttcaaaccatgacaggggaagaggagatgaacacgggatgaaagagttgaaaaatatgaaattaggaagtggtgaagaaagtcaagtaaaatctcatgtcctgccttcaaattagagcatcaagcaggtgctatgaacatgtaatttgagggaagtgcctgtgattctcttcttcagggagcacttctggtttgcgttttcattttctctagaccttttatagatgaagaatatcttgtttttccagatgcagatagtctgttatgttctgtctgtgtctgcagagtatggacccatttctaaatgtgctgagttcaaagatgtcactttttatacgaaactctgatcatgagttttggtaaatattatgaccaccttagaaaaagctgcctttgtaaagcttggagaacaaaaagtgatgtgcaacttacccaaatgtgactcacacatttatcttccctatcccttgtctttcacatcgagaatgtcaactatggttagaagaaggcctgttgtgtgtaggatgaaataagaagatcatcaggtgattgtgtgtagcttttcagtgcagagtatctttacaactctatgtcaattttttgccgggcatggaagacacatctgtttgccgtatatgctatcaaggaatatgtgttatttatagctgggcgcagtggctcatgcctgtaattccagcactttgggaggccaaggtgggtggatcatttgaggtcaggagtttgagaccagcctggccaacagggtgaaaccccgcctctactaaatatacaaaaaccagccaggcgtggtggcaggtgcctgtagtcccagctacttgggaggctgaggcacgataattccttgaacgtaggaggtgaagtttgcagtgagccgaaatcatgccgctgcactccaggctgggcgaaagagcaagactctgtctgaaaaaaaaaaaagaaaaaaagaaatatgcgttatttcaaaaccccagaaaatgaaagatggcaaaaaagtagtatggttgagtttaggtgggagttgtttagaaaggttaagccaaaaaaaaaaaaaaaaaaaaaagcaatcagaactttgtagctattagctaatagttcattcatttattcatgtaatatattgagagtacctcctaaatgcctggtactgtactaggcacttaaggagatcattaggcctttgaagtctttagcctcaacaggtcatcagtgaacaaattcctgtaatgaattaccatccatgtgtcaacagaaactgaaatgttcagaaaaggagaaagagtttaagagattaaaaaaaatatatatatattcctggtccctcaaaaagttaaaccatatgacccagcaattcaaattctagatatataccgaaaagaattaaaagcagggacttaaatatttgttcatgcatgttcatagcagcattattcacaatagctaaaatgtgaaaacaaacccaaatgtccaataagcttatgattggatacatggaatgtgatatatcatacaatgggctaatgttcagccaaaagaaaggaatgaagtactgatgcatactacagcgtggatgaaccttgaaaacattatgctaagtaaaagaagccagatacaaaaggctacatttatatgatgacatttatatgaaatatccagaataagcagatccatagagacagaaagcagatgggtggtttccagttattgtagggagagaggaaagaagaataattgctaatgggtactagcttttctagtcttagaactagatagaggtgatcattccaaatcattatcaatgtattaaatgccacttaattataaactttaaaatagttaatggttcattttatgttgtgtgaattttacctcagttaaaaaaatgtgtgtctaagaattcaaacagcatacagcttacttctttattttacatattatgagaagcatacatattaatagtggatgtagcaaaatgaggataaatactgtaattaaaaattgtgattgttggccaggtgcggtggctcacatctgtaattccagcactttgggaggccgaggcaggtggatcacgaggtcaggagatcaagaccagcctggctaacacggtgaaaccccatctctactaaaaatacaaaaaattagccgggcgtggtggcgggcgcctatagtcccagctacttgggaggctgaggcaggagaatctcctgaacctgggaggtggaggtagcagtgagccgagattgcgccactgcactccagcctgggcaatagagcgagactccatctcaaaaaaaaaaaaaaaaaaaggttaaaacggataaagatcaaagaaatcagccataggccctgaagaaattatatgtaatgtatgtaatcttgaacccatgtcctgggcctcagtttccctcagtgacatggtttttacttcttctccctcttatcttttcccttactcttggaatctacagaggtgaagtttgaaagtgttcatgtccaagaataactcagacagagaaatactggactagaattgtatatgcctaggccttctcaattctagtattccaggaataataggttagaaaaataaaaataggaaaattatattgatcactttctactaaaaaagagaagacaattatcttgaatttacagttagcaaaagactgtaggtggagttcaattcaccagttcaacaaaatgtttaaaaaagaatttcaaatgagaaggcagtaaactggcatttttaggttttaagcatctgctcaatggtctcattctaatcttttcaccaagggctgatttcaaccagggttaaatcaataggccctccagagctcttctgaaaagaaaaactaatccaaacaaatctctcatttagtattagtagctacaaacatactgtgtttaagaaagataagatataagagagggacacatgcatagcttcaggcattaccataaagactgacagaacaataaaaaaggaagaaaatggaaggctttaagattagaaataaactttcaaagtatatttaaggtttaacaaactctaagatgctctttccacaatctaaccttgacactttttgattcctaacactttatgtttacaactaatgattagacacgatggtcaaatttctggttgagaagctgccttccagacagttcacttctgcttgagtctgtagtaactgaaccttcagatctgctgccactctgtgctggttttcagtgccaaaggcttatgacacttgaaaaatattatgtgccttcattcttacaaaaaggaaagctcatgacttgaaaaatgaccagtgaatgttagagtagaccatataaaacacagaggcatagaacaacttaatccttttaaaaagttaatcaaatccctggctttcttacacactacttcatgaagtaggaaaagattgccaaacattatgaaaatggtatttcccttagggacttgaggattagcagaatatacaggtcatgtgtttagtgatcctattagaggatacattttacaatcatgtcactggtaattctgctagagtaagagagagataccaaacactacacattatcgtacatagggcatgtgattacagaataattaaaactgtgctacattaaggtatcacataaatggtttttaatatcctttgtcagtgaatcagtgatatacaaaatttccctttccacacatattttccttttttaccttctgcctgcactacccaaatttctgcactttgatctatagttatgcaatgtagtcatccttttaaaaatgaattttaaaatctctgatagcggccaggcacagtggctcatgcctgtaatcccagcactttgggaggctgaggcaggtagatcaactgagatcaggagtttgagaccagcctgaccaacatggtgaaaccctgtctctacaaaaaatacaaaaattagcctggcgtggtagcatgtgcctgtaatctcagctattccggaggctgaggctggagaatcgcttgaacccgggaggtggaggtttcagtgagctgagattgcaccattgcactccagcctgggcaacaagagcgaaattccatctcaaaaaaaaaaaaaaatctctgatagctcccatgcatatcaactctgaattgtcttctatttcaaagtacaacagtactgagaaacctgtggaggagttcagggtgctgctgtactgacttctggaaactgtatggaagtaattattttgaatttatttttgtgtcatatatcgattacttgtgttcaaaaatatttgggaattcccaatattttcactgaatcagattttttttttcttctttgtaaggcgggactcaaagccagtgcttcagaagtaaatgcttttatatagtagaaaaatatgaagaaaacatagtatttcaggtcatttgctcccttatatcacttatcagattttggggactttaaggacctaaattttcaaaaaaatcaagttagatcatggatttttttgaaaacttgggtcattaaagtcctgaagaaaatttgaaaatttaagtccttaacgtccagaagacgtttattttagactgtaaagtaaagtaaaaccaagggttaagggtaggtaactttcttttgttttaaacaatggtatgtctatatctatatctattatcatctataggtatatagcgtctatgtgtgctaacccagcaccaattgcctcccctagcttatagaagagaccagtgaattagaagtaggagatgtgagttctaaccccatttctaccactaattagataatagaattcgaaaaactcattgacttctttcagcattgggtccctttgctgtaacatgaagacattgaaagaagtaactttatgttagttgtttctccaatatgttgtgtgtgtacctggtgtggacctcacggtcacccttgccagagacaactagattttttttttaagtctatactaatattctttcctcactagaaaggatagtggggtgtttactctcagttgtaaataactctgttttctctgcctgtatgcatgtcctgtctctctagccattttataaatactgaaaccagtaatcatgatttaagtttttgtgtagactgcagctcatctgttataaacaataaaagctgagtaaatatgtgctaatggttttaccataagtcctgtaggagcattctctttaccccatttaccccattccacgttatttccctgacagcagagaaccatagcagttatgtcgcgagtttgatgatggtggaatgtactctttgctttgagagtgtgtaaattcccctcaggggtgtcatatgtttattaatgtgtcacaagttgcttgcttcctgttagctcttctcagtaaataggactatagcattcgttggatactactttatttttagctttttaaatcacctcctgatgaacagaaacagtaaacaagtattaaacatcgaaagtaatttgaaaatagtgccatcctggagagtctggagttccagacattaccagacactcatctcacagagctgaaggagaagttaggaaaataagaatacctaagtgatgctcctctggagccactttctgaagattaggggacatttgtatttaaagaagagaaagaggtgatggctgtggtagggagtccatatttaattcaactttagtcattcttattcaacccactcatatatttcaaatgaaaagtataaggacttatctggatttttaagcttcacactaattagacaccaaagaactgaaggcctcatcatggtagtattttctaatttgttaaacaaacactgtgcgactgtactgcaaaatggaagtataaagaaactgggaatgaaggaggcggtgccgataataagatctaacgcttactgagtgttctaagctctttatgagttttattgtattcgtttcccacagcagcctatggagtctttggtattactttcaccttatcctaataaggaaatgaaagccaaaggagccaagtaactttccctagttttctgttttttgagatggagtctcgctctgtcgcccaggcttgcagtctcgcgatctcggctcactgcaagctccgcctcccgggttcacgccattctcgtgcctcagcctctcgagtagctgggactacaggcgcccgccaccacgcccggctaatttcttgtattttcagtggagacggggtttccccatgttagccaggatggtctcgatctcctgacctcgtgatccgcccgcctcggcctcccaaagtgctgggattacaggcttgagccaccgcgccctgccaactttccctagttctcaaaaataatgagtgattgagcttgaatgagtgattgagattgaacccatgaggttgggctttggagtcttgctcttcacttgaccctgcctctctctctctctctctgtatatgaatgtctcgtattccatacaaagagatatagtacaacagacaaacaaaagtaatcaatagtttgaggagaaaggaaacctaagactcttgtgtctaaacgatttatgtggaagtttcaaaattatgatgcacagatttactttccttaaaaggcctttctgtttttgtttttgtttttttttttaattctgtgttctacaaatctgtatccttccaaaacctaagcattttctgaaagcatatttgaatgtgccctaaaatagttaataggttaatgtagataatttttttctgaaaaaataatcttataatgagcctagaaagagcatgctccagtcagccctggagtaaaattaataaataatgcatgagcagtattgctggcaaacccaaagagggatatctttttcacttgggtgtgaagctcaagctaaaacttaacacactcttttctctcaaagctgtttctttttcagtgttttttatgctgaaagattgactctacctttcatatactcaactgagaaaaattcttgatcatcttggatgcctctctctttcctttgcttcctcactgttacattgattcagtgtcttaagtatattttgaacatgatccctcttttctgtcccaatgtgtattgctttcattggggctgccatttgtttctgagtgaatgcagttgctttctaatttgcctcattgcatttattcttccttacagtcaaatccatttttctcattataatcagaaaaacctttctaagatccaaatttcatcattccttaacataaagtttaaactctttgaagtggcttatgtgactttcagtcttgcttctgtgcatttgtccagtctcaagtcctttatactccagtcactccacattatttgcaattacttaaacacagtaagttgttttatgccttccaggctttgtgcaaaccgttacctcagataacccttcttaaaattgccaaattcttattcagtctctaagatagttcaggtatcatcatttatggagccttcttgtttctttctttgataccactgtggtagttcatatctctttgtagtaattatcatattgaatttcagctgtttatttgcctatctctttccctggattgtgagggcctgaggacagggaatatgccttattctagcaaaattcctgaacacacacgctcaggacttttttcaagcttctgattacctttgtttaatggctaattatttcacctattaagtatctttcatctaattgtaggctaggtattataggaagctagagatgtctacattcaataaagaaccatctaattttgtggaaatattctttgttaccagatataaagcctaataacctacctatctattttctggacattctcactgtgtcatattagcattcaacaaaagcaagaatctaaataagggagctgcttaaatgtcaaagcattagctgaataaggaggaggacttaagagatgttgtgcatgtgtacagacacaaagaggaaccagcagtatcacggagcacctatgacaggccaagcagatttctatccagtatcctttttaatgctcagacaagtgctggctctcccatgagtcccacctgagactcaaaggagttaaataaattgcccagttttgtagagatggtaagcagtgagactcaaatacaggaatttgatggccatgtacatgaataagcagttgggcacttatttaccaaatgggaagttctaaagcaaactttgaattcaatattttattcctctctttcttctcattagccagcaccatgcctgacacatgatcagtgttcattgaatgtcctgagacttaaaaagcaagtagaagtagtgcaatttacccaaaaaacttcatttggtctcaacccttccaaaagatctctgcacaggatttatagcctcacttattccaagttataaacttgatttatgtaccaggaagaaaaaagagatgcttatttaatgacccaattctgtagaatctgtctatcaggatggggttgttcttatgtaacacagtagaatgcttagctctgacaacctggactctaggttccaacccaagtagatatgggtcgataaagatagtaactttgcaatacttttatccaagaatgtgttctgcccagactcagtaactactcgtcttagcaagacaaccaatagtgtaacttttatccaagaatgtgttctgcccagactcagtaactactcgtcttagcaagacaaccaatagtgtaagagtatgcagcattattcctgaacctcactgtgattaataggccagttacacttttctacttctattgaatttgccaattttagcataagcccaggcttgactttattctggacctaaatcttcctttattttttttctaggtacaaaatatctattaaacattttaaaacttaacctgaatgtaaaacaaaactttttctctggcaaataaaaacaaataaatatacatttagcttcacaagagcaagtattgtttagctgggtagcaagagagaaccctgtggaataagtcaagataccataaaattagttaaacagtgaagtttttgcttttcttttaagtgaattaaatacactgccttggcagcacttgctttttgttcacaccaggtcactgtatttattctgctttgttacagaaactccacttactgtatgaaagtatccatctcactgacagtgggtgaaaatgacactggactctgctataattccaagatgaagtattttgaaaaagctgaacttagcaaaagcaaggaaatttcatgccgtgacatagaggattttctactgccaaccagagaacctgaaatcctttggtacaaggtatggactgcgggtggttctatttcctattaacaaattaattgtgccttatattctgggacaaattggatagaaaacttagatgggtgtgatatagtttagctttgcctttctagaataatatagcaagttgtactggtcattatatgttttttaaccaatggctttagtaaattctagtcaatgtttgtattggtaatccactgtaataagctgttgtgtttatgtttatattttatttccatggacaattctttcaagtctactatggtctgggttgataatttcaggaactaaattaccttgaaccttcttttcagggttcttcacattagcatttcaaagtgtccccaaacaaaaggaaaaaggactgatttttttccaggataaaatcgtatactagtttttcatggaatgttctgtttaatggacataattttgtccatattctaatctttttcatgtataaacataaacattttaaagaaataacatctgaggaaattgtatgacaccagaaatataatattgaagtaactttcttccaaaaccagttgaaactttaaacttaaacagaataatccaacctctgactttcctatcaccatcattgatgtttatttactgatattccagatttgaacataattttaagcttgtttatacaataaaagaaatttttgttattgaatgtactcaaaaaataaagtatagatgctgtgaacattcttccagaatattttatacatagtttaaagaatccttatgtaacatttgctttgtctaactcactggaagtgggactttagaaactgggcctctttgtaactagatccacaaatgtcagtatacagaatgtgagccctcatgacagactgaagatgaattcaaaaactgttagaaataaaacaagaaacaaacctttaacaattttaaaaaagatttttccaaaacagcaatgctctttcctaagtaagacttacttttgattcttgataatgtgaaattgtgggttcagaacatcaagggaactgttggaagatttttatacttgtcccttgcttgattttcaatcctagaccatgttaaatggagctcaaatattagtcctgctggtttctgttactgtgggaatgaattttctttttctctttttttaattgttggagtatttcttatccttaaccaccctcacatctcaaaccaccctgtggtttgtctgacttccacaggcagattctgaggcaagccctgatgattgcttcaagggggagtggtattaggggaatttgacccaaagtctccaaataaacccttttttttcttagtactcatgtgtgacatcagcttctaaatatgcagtgtctttgttgttcactaataagtttattttaagagttgtgtttcttttctcaccttttgcaaagagcatcttaaaatttgctgaaagatgagagactacacacacacagtgtaaaaagtggctggtcctttagtcctatttccaacattgccacaataattttgaccttaagctatgcagactagtgaagtggtgggtggggatgcagtatatgtggtatttaaaagtcataacatttcagattatttttccatagtcaaagattagcccctgtagtctaaatagcagagatttaagggctacttctatagtggaatactataaaataatcaatctggctaaatgtagatgtcacacattcagtggaaaatttatgcaattaccacaagtcatgcaactaatatggcatatacagtgtatattttggtcagaaataacacgaaaattgcccccaattacacaaaggcattgagccacataaaataatgttctgcaaaaatttgatttggcaatacaattttttagaaacaatattacccctgaagaatgtcaaatgttttaaagctattttatcctcgttccattgatttcaaatctggctagaggaaattgacttctgttttggcaaaaacagaaatctcctgagccaacatcattattattcaaagcttaattcagagaccataatttgctaagtctattaacaatgaaaacagatatttatggaactctaaagaccttgcatataaatgttgattgtttcatggattatagcatgcatacactatgaagagatttaatttttactaaatgcaaaactaaaatgtttcaaatattgaaatagaatttaggtgcaatcattgaacggtgcaatcttttgtacagcaaattttctgctttccagtaaaataatatggtttgtattttatgttatcaatttcaatatggttgatttcacaataatgaaatgtgaaatatctgtttccaaaatgatgtcacggatagtcttagcatacatctctattcttatatctaataaatcagtacatatctggtttagatatactaatcttagaagttaattgacttttccaaaaaaataatcttcagattgaagtattcattggttcaaaaatgtataatgaccagtgcaacttgccatattattctaggaagcaaattgattccccagagattttgagaagaaatgaaattatttagcattagtttcaaactttttagtccctttaaaatgcaattttagaagcttttgttttagttatttaaaactgttctatatttttccattactatatgtactaccaaaattgtatgttcttcatataggaatgcaggacaaaaacatggaggccaagtattgtattcaaaagagatactctgcttataagagaagtcagagaagatgacattggaaattatacctgtgaattaaaatatggaggctttgttgtgagaagaactactgaattaactgttacaggtaatcacagtcttcaatatttcacttgcaagtgatgaaactactattttaagttagtttttatgctacacattgatatttttactctctaaagaattacataatcaaatgctaagtggattcctataggtgaaatttattcctccttgcttttgaatcatcttccactgaagtccattcaaaaggctagagacaatatgtttagggagttatagaaatgttaacttttgggccgggcaccgtggctcatgcctgtaatcccagcactttgggaggccaaggtgggcgaatcacgaggtcaggggttcaggaccagcctggccaacatggtgaaaccctgtgtctactaaaaatacaaaaattagccaggcgtggtggtgggcgcctgtaatcccagctactcgggaggctgaggcaggagaatcactcgaacccacgaggcagaggttgcagtgagctgagatcgtgccattgcactccagcctgggggacaagagcaagacgaagtctcagaaaaaaaaaaaaaaagaaatgttagcttttgaaagtacttgaaataaaaatgagtttatggtttccaaaaattatgcttatattttataatggtatcgtttttggaaacatttcctagagtggctaaatagaatatatgaaatctacctctgtcttcctgtcttgctccaaattagaaaagtcgcttttctcttttatttatttatcactctatcaatctgacatacatgtcctcatgaacttgaaaatagcataacttcaggtgcagtcattgaataattatgtgagatgtgatgcatagagtcattttcatagctggttgctaaggtggaaggacatgaggacaagattcagaacactacctgtaatcatgaatctacaactcactagtcacataggttggtggagttaccacagccttcagcatattagtttcttcatgtataaaatggtgttgataaaatttgctgttcttatttcatagggtttttgcaaggatcaaatgaagtaaggtaatatgtatgacataaatttgcaaaatgcagaattatatccaaatgtgcataatttttgtccatgaaaattgcattcatacattttttttctttatagtgcatttcttacaaggtggtttcatgagaaaagtggggataataagaacaacattcagaaattaaaaatattattctcatattcttattgagagattcttcttggtgacttttgtgtatgatcatacttgtaaaacttatatagaaaagcataaaaaggacattagctgttttaaattaaacagagttttatttgttcactggtccacttaaaattagttttccctgtatatgaaaagtgttttgtggtagtcacctacatcttataataatttatttcttttaaggtatctggctatacttgagtttctatacaatcaattttgaaatttgtttttcatctgttacttaattttttcctttaatctctactgaagtggtttttcaaccagtagtattgaggcaaaggaatttaaaaatataaagtaaagcaatctatcctgaatagaaaatagaatgcacttctagtctttattcttcagagtggagaactcatctttagtaagcacctctttcccctttctagaaatgctaggattctaaaccagtacctagtatgagacagttggagcacagtatcatggatactgaacactgggctctgaatggtaaaacagcttgtgtaagactattttatagaaccaaaaatagaactctttatatcctaaatgctttccagggcaaccgtactttcctaaacttcatttgtcccaaaatatcttgttttctttatataaaaacaaagagtaattgagtcttgatattcaagaggaagataaagttttaatgaaagttttcattccacttattatcataaatacttatatgtagccttacctgagacaatgatttgggcaaataaattatgaaacagtttgactggatgtgaaattttgggttaatgtagagctacatgccctagaattaagaacagtatatactaaaatgcattttaggtattaacaacaagtctactgggaagatatatttatgtataacattgttttaaatggtgtgacactatagcgcatttactgtggggccaaattaaagagcagttcttaaaacccaaattatattcctcagttaaagcaacaaacatgggcagtatctgaatgataaggaatcactgttttttatcttggttttctgcacatcattatcatattttacttaatgaaaatattatggaaaacataatattatttggttttagtggaatttgaagtttgttataatgtcactttaaaaaaaaaaaaaagaggaatcctatacgtaaaaaggaaatttctggccgaaggaagtggctaaatgtgcaggcagcatcgtgagcttttatgggtgatcgatccttcccttattgaaaatgtatatccttagctaagtgaagtactggttcaacaaaacagatcacagtgaaaggaattataaacctgtccagcacttttggtattttaaacatctttttttttttctttgggaaacagtttctctcttgttgcccaggctagagtgcagtggtgcaatcttggctcactgcaacctctgcctcccaggttcaagagattctcctgcctcagcctcccgagtagctgggattataggcccgtgccaccatgcccagctaatttttgtatttttagtagagaccgggtttaaccatgttggccaggctggtgtcaaactcctgaaacattctcaatttttttcttttaaattaaagatgttacggcaccatctctagcctctatcttttattagccttacccacattgaagttcttactccaaatgtcctccctctgaactcttattcatggttttctccctctggaaggttttttatcttctcctttgtcacatccctgattctcaccctttcttcaaggcacagctaaaatgttatccccttgttgaggcacgtactccatgcatccacagcacttttagcatctctattgcagcacttacctcattgcatcaaactatttaatgacactcctgtattttcataagaatgtgagcaacttagagtcaagggcaatgtcttttattttttaaataagcatttgattttagaacggttttagatttacagaaaaaacatagtagaaatcccatctagcctgcattcagttccccctgttattcacatctaatattaatatggtatattcgttatagttaatgaactgattttggcacattattattaaataaagtccgtagtttatttagatttctgtgctttttacctgatgtccttgtttctgttccaggatcccatctagaatagcacataacatttagttgttatgtctccttaagatactcttggttgtgactgttttacatttttttttatttttgatgacctttacaattttgaggagtattttgtcgaatgtcctatatttgggatttttctgagattttttcatgattaggtgagggttataggtccttggaagaaaaaacacagaggtaaaatcacaacatgtcatatcagcctgacttatcactgttgatgttgatcttgatcacctgaggtagtgttaggtaggtttttccactgtaaagttactctcttccccatttttatactgtagtttttgtcatccatgctatatgtcatccatgctaaaggagtgagaggttatgttccacctctctgagagcagaatgtccacatattttgtgtggtattctgctacatgagatatatgtctgttctcccacatttatctacttattcaattgttgctctataccagtttggacttaacagttattttatactttgctttataatccaaattaccttatttattttgttgctcaaattattacagttttggtcattaagagctcttttagttggctcctttgtccctgtgacatacttatattggggtgtgtgtgtgtgtgtgtgtatgtatgtttgagtactttcctactttctggccctttaagatgctctaagctcatcttgtatatttcctgccccagtccctacatcagatatattttttcaaagatgccatgttgcttttattggagaattataccaaaaatgaataccttcatgttgagagtactcattgctactgggatatagttgttttgaagcttttctaatcgacaaaaaaagaaaaatgtgtatagtaacacataaacatatacacatatctatagatatttatatgtgtaaccacctgtgtttatattaagttaaacatgagttcatactgatgtttccaactctaatttattaccatatggatcattttagcctcttcccctaccttatgtgtaacctcccaatccagtagttagaaaactggttctcaccatctgccattcttttactgaattgttcacttccagtataaatgtatagtgagatcagaatttgttaacctgtgcccatgtgggaaacaactttatcaattagaatatggtgtttacgtacaattgttttagcatttagccttacagacttcactcatttccaaagttgctaaggtcagcacctttcccctcacctgcttcagtgaggttatctcacatatttgtaatatagttagattgttttatcatattctgtatttcccaggatcctctgacctcctgaattatatttaaaatttgcatacattaaggttttctctttgtgctgtgaagttctatgagtttaaacaaatgcatagtgtcatgtattcataattaaaaagtaacagaatagtttcactgccctaaaaaagactctacacttcatatgttcagcccttctttctgccttccgaatccctggaaacaactgatctttttaccataactatagttttgctttttccagaatgtcatataattgaaatcatacagtttttggccttttcagactggcttctttcacttagcaatatgcatttccttcactcctttctgccttccttccttttaattgagcattttatctcttccatttttacatcaattttccttctttttagatatatattttagtgatagccctggatattccaattttaaactaatctcagtccaccttcaaaaaacgctgtgtagtacagataccttattacagagtactcccagttcctctctcctatcctttatgacattgttctcattcatttcacttacccatattgtataatcacccaatatattgttactgttattttaaacaaagttatcttttacatcaatttagaataagagaaataaaatattttattttaccttcatttattccttctctggcactcttctttatgtagatccaagtttctattccatacacttttcttctgcctgaaaaacttcctttggcatttcttgcaatgaaggtccagtggtgatgatgtcccttagttttcatttatcagagaatgcctttatttatttttcccctttgaaaaagaattttgctggatatagaatttttttgtttgtttgtttgttttgttttgttttgagacggagtcttgctctgtcgcccagggtggagtgcagtggcatgatctcggctcactgcaacctctgcttcctgggttcaagtaattctcctgcctcaccctcccgagtagctggaattacagacacgtgccaccatgcccagctaatttttgtattcttagtagagacggggtttcaccatgttggccaggatggtcttgatatcctgaccttgtgatccgcccacctcagcctcccaaagtgctgggattacaggcgtgagctaccgcgcccagtctggatgtagaatttttgattggtacttttttcgttttgtcactttcaatatgccactccactcttttattgcttgcatggtttttgatgagatgttcactctgatacttatctctgtgcctgtatagatatgatattttctctgtgttctttatttatttatttattttttttgagacagagtctcgctctgtcgcccaggctggagtgcagtggcgggatctcggctcactgcaagctccgcctcccgggttcacgccattctcctgcctcagcctcccaagtagctgggactacaggtgcccgccactaggcccagctaattttttgtatttttagtagagacggggtttcaccgttttagccgggatggtctcgatctcctgacctcgtgatccacccgcctcggcctcccaaagtgctggaattacaggcgtgagccaccacgcccaggctctgtgttctttcaagattgtctgtgttttttttttctctgtagattgaatatggtatgcctaggtatagtgattttgttatttatcctactcagtgttttatcagcttcctggatttctggtttgatgtctctcaattttgaaaattccatgaccattattatttcagatatttactctgctccattctttttttttctacttttgatattccgattatacatatattatgccttttgaaattatctctcagttcttggatgttcttttctgtttttatcattcatttttctctttgcatgtcagttgataaagttctactgatctattttcaagctcacacattgtttcctgaactggtgtccagtgtactgatgagaccatcaaagggcttcttcatttctgttacaatgtttgttttttaaaaactctagcatttcctggctgggcacagtggctcacgcctataatcccagcactttgggaggccgaggtgggcggatcacaaggtcaggagatcaagaccatcctggctaacatggtggaaccctgtctctactaaaaatacaaaaaattagccgggcgtggtggtgggcgcctgtagtcccagctactcgggaggctgaggcaggagaatggcgtgaacctgggaggcagagcttgtagtgagccgaaatcgcgacactgcactccagactgggcgacagagcgagactctgtctcaaaaaaaaaaaagcaaatctagcatttcctttcgattctttttaacattgcaatctctcttcttatattacccatctgtgggtatcgtggaggaataataccctccatacagatctcacactctacttttattaatatttaggttggtgcaaacataattgcggtttttgccataactttgcgggtttttgccctggaaagtaaaggcaaaagccgcaattacatttgcacgagtctaatactaccgagttttacataaaccttttcatttcctacattatattgctgatttgtattgagatttaagtcaaataacatcagttttcttatattgttaagtcaaatgcctgcctgtggttgaacttttaggtatgaatacagtgctgagtattcctatagagatgattatgttcatttttaatacgtcatcccagtgtatgaagataggttttatacttgattctgtcttacactataataacttctcttccttgacaaaagtcattacgttttttgttggaagatatgtctgttttgaatggaaacattgtttaaaatgttatatttaaaaggctctgtataaagctgtgtaatatgcttttatattttttctggaatgtattatttcacctctctttagtgagagatttttatcctaataagaaatacagaatccagtacatatttttacttatttcttttaataataacatatataaccaaaaagtgtataaaatgtaaacaagtagctgcttagcatgctatcaaaagaactcaactaggcaaagaaatagaatactgtaggccccatagaagcccccatatgcccttctgattataaaccccttcctctccactactggataggtacctcagtatgtgagttttggggtatttattttcttgcgtgtttaaaagttgtattagctgatagtgtatgacaaagcgatatagctacattttgcctggttttgaaacgtataaattaggacccacatgttgtgtattctgtctggcttcttcaactccaaattttgtttcaaatatgcatgtatgttattccattcatctgtactttattcattattcttatgctatgatattccattatatgaaaatctcagtttgttgatagacattagggcttgttgtaattttttgcttatgtaagtaatattgccattaaccgtcttatgtacacacatatatacacacaaacacttacatatttccttgaacatataagcaagcaattctgtaggatttttacctaggaaaggatttgctcattaaaagtatgtatattttcaaatttactaactattgtttgggctaatttgggtcatgggcgtatcctaaccgaattgactgtagggaggagagaagtactccaaagaaagttggaggtgccaaaataagtggaaattattctaaggaacataaaaagccattttctactacttctacacattatgatttcttaaagattataaaatataatttgatatgcataaaattctgttttgcattgtgtaacaattttctatacttccatattgttaaataaaaatgtgaaaacattcaactttgtattgatatacattgccatatcctaggattccttgcactaaactctaactcacatccagactacactataaccctagtcttctgccagatatatgtgggaatgtgggtatggggaaaacgtcatatccagaggtggtccataagcaatctagtgattccaaaataaattaaatcaccttggctcatcataaataccaactatgtagacaaaaaatacaaatattagtaatgatacatatttttggatttgttaggtctaaggaaaaaaatatacactatataggatttttttagatgtattgattacattacatgattttcatttttgcccatttaatgcttatttccccttctggccaaaacatttttctattattttaaaaagaaagatttaaaacaaagtaacaactgtattgccatcataaagtttggaaatgagtcagaccagttgcaacaccatttaatttctagggtcagatcatagaattaagtaatggtaagggaataccttgttaaaatgttatgtcagaaaaaattttcccaagtaaatttgagagtcagcaagcagagtgaggaagtgaagaaaggaaaactgattcgaaaagaagcaaaaagaatgaggtgattgttacaaggatgtgatagttttagtagcatttttatcctttatataactttttaacagttaatacagcagaatattcaaactacttcccaatcgaccacagactgaatttacgctctcaaaaggtacatcttcctcctcttttaatggatgaggaagctgaggcaaagaaaggttaagtggctttatcaaggtcacaaaacgtcacagtgacaaatttagaaataaaatttaattccctgaacctcagtctatgatttactccactggataattaatagcaaggcattgtagtgttcatattagctctgctgatcgctatgagagatttatattttaagtgcaacggaaacacatttaactgagacctctaattcttctgccatggatgtaattaagcagtgtatttgtggtctagcctggggatggagtattgcttctttttcttcctatttctttcaaaaaattgcgtattttatttctcctttaaaaaaactgtttttgttaaattacttcatggattaaagtgtgctttcactgactacagcctaacaataattgatgaaattgataaaaggggcagatctttccagactttactttgtatgtttgctaacattccaggatccatacccacaaaaaccatcatgtatattatttttgatgaattgacatatactacatttctagctgttttataagtaaatatctgccatatttttgtaactcaaatatcatttagattaattcacacttttgaattaaaagagaaaaatgctcataaatatggtgaaactgaatttaatcaacttggctatctaatgttgatttggagttgaattcctaaaacaaaagagctctttcatgagtggtttccaataactgtcctgaaaccactgacactcattacctttatttattatttaatcttaatatactaaatgggttgttcaaaaatgtatgaatcaaattaacatttattgttaaggtgtagtaagtttgaataaaaacaagatgtttttactcttgagcagaaaacgtatacattttagaacatattcatagcaaggttggaatgtgccatctctggccatggggaaaacaagacatcataaacttgaatgatttccattaatacaagaaaaattaaatattaataattagaatagttaacacctactgagtgttcaccgtgtgccaggatctgttctaaattctttttttttttttttttttgagatggagtttcactcttgttgcccaggctggagtacaatggcacgatatcggctcaccacaacctccgcctcccaggttcaagcgattctcctgcctcagcctccccagtagctgggattataggcatgtgccaccacgcccggctaattttttatttttagtagagacgggttttctccatgttgatcaggctggtctcgaactcccaacctcaggtgatccacccgcctcggcctcccaaagtgctgggattacaggcgtgagccactgtgcccggcctgttctaaattcttccacataacctcaacttactcacccttaaaaatttttccagtgctcgccaggtgcagtggctcacgtctgtaatcccaggactttgggaggctgaggtgggcagatcacaagatcaagagatcgagaccatcctggccaatgtggtgaaaccccgtctctaccaaaaatacaaaaattagctgggtgtggtggtgcgtgcctgtagtcccagctgctcaggaggctgaggcaggagaatcgcttgaaactgggagatggaggttgcagtgagccgagatcacaccactgcactctagcctgggcaacagagcaagactctgtgtcaaaaaaaaaaaaaaattccagtgcttgccaagtacctaatattcttctaggtttcataaattgcacttgaaaataattcactattttatttcccacttcatatggatttttgaatttaataaaagatgaacatccatttctggaaaatgcagtcaattagacctccatttgctgctctgaaacactgagaaaaattagatgaaataaaatagaaataccattttaaatgattagttgagcttgcaagaatgttcttttttaaaaaaagaaaaatctctgggtctaatttttatttagcagtattgaagtacaaaaaagttacataattcaaatcataattttatgaatatcaaatcacattttataatctttaagaaatcatgaagtttagaagtaatagacatctgctgtttatatttcctagaatatgtttcacttcttttgacacctcccattttctttggagtaccactcctctctttccttcagtccttttggttggtagactcttggtcaaaaaaatctccaatttgctgctcaagaagaattgaccagtctccaggaagggccttaacagggtcctcctggttcaagacagcatttaaaaaataaaaagagaccaggctcagtggttcacacctgtaatactggtgctttgggaggctgaagcaggaggattacttgaggccaagagtttgagaccagcctgtgctatatagtcagacattgaatctatccatacatacatacatacctatctgtattatatctctaaaaatgtcaggtactagaatccataaatacagactagaaattagctatgcctaaaatgatgggtcacatttttaaaaatctaaaacaataccagtatttttgatgcctgtgtgagagcataaatattaagaaaggcaattggtcagcaggactttctgccccagtcatatatgcattttgatttcattcaattttctggctgccctattgctgttgttgcctgacatagttcatcagccagaagtagttcttaattttttcactgattttctttgacagcattgaatttcaagtgtactgagagtgttttcattataataaccctgccagtgtaatccaacggattgcttgcctcttagaaatgatacagtcatcctttctgtccgtcccaggtgttagagctgtattacttctagattttcagaccactagctaaacttattcttacctcattgttaaagaaacaactacttttttttttttttttactgctaaccatatggcaggtactgtacacaattatttataggcattactatctatatttatcaaggagaaaagtcaaagtacattttggacacatatttaaacttttaaatacaaatcattatcattatttctaatgaaattcccttctttatttgcactctactgcttcaaattttcaaattctcttatattaattctaacaaactcaattttgagagtcaaaaagctgttcaataaatatcccttgatagaattattggtttatggctgggcatggtggctcacacctgtaatcccagaactttgggaggccgaagtgggtgaatcatctgagatcaggagttcaagaccagcctggccaacatggcaaaaccctgtctctactaaaaatacaaaagttagccaggcgtggtggtccgcgcctgtagtcccagctactcaggaggctgaggcaggagaattgcttgaactcaggaggcagaagttgcagtgagccgagatcaaaccactgtgcttcagcctgggcaacagaacaagactccatcaaaaaaaaagaaaaaaaaaattcttgttttagttagttagagaaaaaaaatatcaacaactgggctgtccaatataatagccacaagcaccatgtgtccactgagcaactgaaatttggctagactggattgagatattttaaatgtaaaatatgtgctaaatatttcaaatgtaaaatatgtgctggattttaaagacttagtttgacaaaaataatgcaaaatatctctttagtaatttttttatattgatatcatgttgaagtgataatatttagttaaataagatatactacaaaattgattttacctcttttcacttttttaaatgtagctgctagaaaatttttaattgtatatgtagttcggcttatatttctgttgcacagagctactcttgaaagtgaagtgtggtatcagcctggagaagtgtaagggaaacacacaagaccaagcatctaagggttgtcttagttccattggtggagctgccatgcctgggctcagtgaccttaactaagttatctgtcttcattaaatgttgtcttagtgttgagactgtgaatagtcatcactcacagtgctttggtgaggggtaaattagcgcagatgcatcaaaccggactgtgaaggaatatacaaatggaagtggctactgccatgatttggtttgatttttgaatctttaccttggtgatatggtttggctatgtcctcacccaaatttcatcttaaattgtagctcccataattcccacatcttgtgggagggaccccgttagaggtaattgagtcatgggggcgggtctttgccatgctgttctggtgatagtgagtaagtctcacgagatctgataggtttagaaaaagggagttcccctgcacacgctctcttgcctgctgccatgtaaggcaccgctttgctcttccttcatcttctgccatgatttcccagccatgtggaactgtgagtccattaaaccgctttcctttataaattacccagtctcaggtatttattagcagcgtgagaacagactaatacacgtggtttgtttcagttaatgtaattttaatatttataatcttttttttattattatactttaagttttagggtacatgtgcacaacgtgcaggtttgttacatatgtatacatgtgccatgttggtgtgctgcacccattaactcgtcatttaacattaggtatatctcctaatgctatccctcccccctacccccaccccacaacaggccccggtgtgtgatgttccccttcctgtgtccatgtgttctcgttgttcagttcccacctatgagtgagaacatgcggtgtttggttttttgtccttgtgatagtttgctgagaatgatggtttccagcttcatccatgtccctataatatttataatattaatctattccgtcaaatgtcactgattatcatcaatacaattattgactaacattcattgaccattaagtaatggtttatatgtgtggagaaaattcagaatatcttatttgtgtgcaagctactaacaaatgaatttcaatgtctttaactggggtaaataatgaatatgtgcatttctacctttgatatgattatatatatttatatgtatacaaatgcatacatacgtatgtatgtgtatatatatgtgtgtgtgtgcccctatattaatatatgtcttattgactattacagtcacttatttgcatctaagaaatcaggggaacatttttctatacttttttttgcaataatattattttctattttacaaaactgatttattttttgtggttaacattccaaagacccatttgatcatgattcctctcatatgaggtacctagaataggcaaattcatagagacagaaaatagagtagagattattaaaggttggggaacaggggaatgggaagttattgttcagtagttagcagagattcagtttgggatgataaaaaaaagttcaagagatggataaaggtgatggtagcacaacattttgaatgtatttaatgccatttaattgtacacttaaaattagttaaaatggtaacttttatcttatatatcttaccacacaaaaaaagattcatttgaaaataaatggctgttcttaatagtttggagcatatttttaaaattatttgccaagtgtggtggcttgcccctgtaaacccatcactttgggaggctgagacgagaggaccacttgagcccaggagtttaagaccagcctgggcaacatggggaaaccctatctctacaaaaaaatacaaagaattagctgggcatggtggtgcatgtctgtagttcctgctactcaggaggctgaggtgggagaatcgcctgagcccaagaggtccaggctatggtaatgagactctcactcaaaaaagaaaaatatcatatcaaagatttttttttaaagatcatcttttctctacttcatgttggctctctactttgacaggtattgatttttctgtaaaacttttgaagctcaaaccattatgtcggcactttatattaactgcttttagttttgacatcagcaaaattgactgaaaactcaatattgcacctgtttcaatacagagtctctggtgtggaaagattagcaagataagctaaagaaacttctattgttcaactttatcttctcagtctcatcaaatcaaagattgaaaatgtactctaggaggatgtatttctggtgaggttagatgactacacatctaaaagtaaaagttttaagagtaaaatataacataataaggatctagaatcttgaagaaagattccaacatattttatgacaattaagtctctaggtaccattaataaagatgactgtaacctcagagctaaaagcatttagttcattattccatgcaaactcgttaaaatatgaagactaaacttagcatctagtgtcaccactaaaaactgtttaaaacttatgtgatattgagtgagatacatttctttatggtttaataagtgaattagatgtctcagtgtgatgatgcctatatctacatgcacgtgaatgtgtgtatacatagatctatataatatatatctataaatatgtattttcattggatagagaattattaaccattttgtttttttttttcttttttgagacagagtctcgctctgttgcccaggctggagtgcagtggtgcaatctcggctcactgcaacctctgcctcccgggttcaagtgattctcctgcctcagcctcccaagtagctgggattacaggcgcgtgccaccacgcccggctaattttttgtatttttagtagaggtggggtttcaccgttttagtcaggacggtcttgaactcctgacgttgtgatccacccactttggcctcccaaagtgctgggattacaggcgtgaaccaccgcgcccagccattaaaccaattttatatatacagctcttatagttttaattttatttttgccacttagtggcaagaaatttgttacttggtataaataaaaccaagttgatttgtttaagcagtaggttcccattagacttaatgatgttgtatcatcccattattaatttgaataaatttctattatgttatttttcaaaatgaacaacagtgcatagaatcaacaattgagtcactgcaatagcagtataaccatgctactccttcaatatgggagtttttgttaacaaactaaactctgacagcttaatgtatgcaagattaagaaaaaaaataaaaccacaagctaatttcttattatactcactttgtgtattatacttaatggggtctcagatttgtttttcttctttcctagacaccagattaccaggaacagtgagaacttaggtagaaatgtggataatggtacactaataactagaggtttacaaaataggaaaggttaaaggaactgagaatattactattatttggattttaaaaaactctgggctgggcgcattggctcactcacgactgtaatcctagcactttgggaggccgaggcaggcagatcacctgagatcaggagttcgagacatggtgacaccttgtttctactaaaaatacaaaaattagctgggtgtggtggcacacacctgtagtcccagctactcgggaagccgaggcatgagaatcacttgaacttgggggggcagaggttgcagtgagccaaaatcgcgccactgcactccagcctgggcgacagagttagactccgtctcaaaacaaacaaacaaacaaacaacaacgaaaacctcaatgatgtgccataataagatgttaagtactggaagtgttcagaataatggaagagcagcaaagggtgactacattaaaaatccagcaggtaatgagtttcatgaggatttacaaattgttttttaaaaaatattgattaaatttattgctctgtgattttagcatttaaggatagttcctggaaaaaacaaacaaacaaaaaacactgctcaataatagggaagacttttggtgctgtattctttggaggttttaaaaatatgacagaaacccatttgaggcatgttcaggcatagacaaattggaggaaggtcactgagactctagtaatttttttattatgttaaaatttttatggttcatttttcctaatattttgtagtttaaaaaatagggagcaatttaaaaaatcaaaacattaggttttgatatgacagtttaataattacataaaggaatttaaaataatgaatgctatttttaaactgttcaaactattttaaagagcttctattactcttacactatgaaaaggtccactaattatatcccagggttagttttcccttgcctttatcacaatattgaaggctctttcttgatgataaaaccaagaggtaactcttaacttgcaattgatgtagatattttgtaacatatatttagaagaatttctaaaaactatttttgagaaaactgcatgaaaatggagttggtttttttcatgtcaaaatatataacttttgcatcataagagatttaatgttttcatttcttaaaatgcttgaccaagtcttttagtcattatattagcatctcttgttccatctggaggacctaaaaatccaatgaactgtaaatgggcagttcaatatgaatatgcaaattaaagacattatgaattctatgtaagatgtaaagaagtagcttactctgtgccttaattagaagaccttactgtatatttctttatcatttgttgggttgatcatcgggttccactccaacatatccaccaggaattctggtatataaatggcatcaaagattgtttacaaatatcgtggacaatgtctcaagtgataattgcaatatgtttctcagggaagaaaaaaatacaacttttgtgaatattatttttaaaacagaaatgctgtatatagtcactactgtcttctgatggtaatgatagaaattttggaacctttaatgagtacttattgttaaagttccattagataattatgttctgtttacatactgccatcatttgaagaacatatttgctttattcaccaaatcttgaagcatactctacacatgaatttaaatgctactatttctattacccaccctcagagtcttctaatttctaatatttacttaaatattttggttttcaaaattttacctatgattataaagcacacactgagcttttattttaaaattgaggcttgtgctgtcaatttaaggatgagagaagcacagagaaacgtgttctttttaaaaaagtaatatatatatatatatatatatatatatatatatatttttttttttttttttgagatggagtcttgctctgtcgcccaggctggagtgcagtggcatgatctcggctcactgcaacctctgcctcccaggtttcaagcgattcttctgcttcagcctcctgagtagctgggattacaggcccacgccaccacgccccactaatttttgtatttttttagtagagatggggtttcaccatgttggtcaggctggactcaaactcctgacctcctgatctgcccacctcagcctcccaaagtgctgggattacaggcgtgagccactgcgcccggccaaaaaaataaaatatattttaaacctttaaaagcaaacttggttatcaatgtatcatgtttctgtgtatcaacttttataagtccactactcaaaatgtaacctgaaaacagaatttttccaattagatattgttgctatggcgtaattgagctagttaatgatataactctttcagaataataagtcaataatagttatcagcaccaaacatgaaggaagtgaagtagaagatatatgaaaaataaccattaatattaaaacaatatattatgggggcagcaaataggtagtaagctatttactattcattagttggttatgacattgctaaaattaaattaaaacaaaaggtgaatacaaatacaatgaagtagtttggatgatgttttccatttggggtatataatcagatcattttatgttaatctaatttgtctttgagttaaataaacccaatagtgttgacctgccttttcatgtgtcattttttcaacattgtcgtttgataaacatttagtaagaaataaaattacactcagagcaataattttatactttcgcaagctatttataaaatctaattgtataaatgaatgtgttctttaaagatctgtatttgttgtttatgatgaagttaagaagttatagctacttctggtgctgttcaaaatgaagattggaaataatacagtgaagtagatctttaacccagatagtttgagatgcactcttctggatggcggatgaaggactgaaacaaaggccaggcagttagtttgcagaaaagaaatatgtaggaagtaagacaaaataattaattacatatacgtaatgacatatacttcttctcattcaaataatctctagtcattaattccaggaaaattactcagataatttttttttttttgagccagagtttcgctcttatcacccaggctggagtgcaatggcatgatctcggctcactgcaacctctgcctcccaggttcaagtgattctccagtctcagcctcccaagtagctgggattacaggtgcccaccaccaggcctggctgatttttgtatttttagtagagatggcgtttcaccatgttggccaagctggtcttgaactcctgacctcaggtgattcacctgcctcggcctcccaaaatgctgggattacaggcatgagccaccgtgcccggcctactcagataatttttaaaatgtgtgctttttttgtttgttcataacattcagagttctagagcataattacagagtatttcaacaatgctcagttagtagtggttaaatcttccacttcagtgcagctgttgctctgtcatgtaaacataccaaatgtaccttcaataggagtttaagattttttttatatgtatttctgtactttggaaatagtttctagtgggtgggtgtggcagaggagactcttgttggttagtatagagctgttgctgtggagcagctgctcagccagaaattcaatttcccagcccctcttgcttctaggtggaaccatgtgactagttcttatcaatgagtataagggaaggaatgtcatttctgagccaatgtaatgacgaagtagatatgctttttccctgtctttctttctccatcaattactggatgcagacaatggcaaggttttaacagatggaaggtgcccaggtctctaaatcacataatggggggaatttggtcactgaccagaaagactgtcattgaatgacttcaggagtgaaaaatgagtctcagttaaattaaatcactgaaatggtgaggtttacttgaatggcagaaagccttaccctaaatagcagtgttaggcaagttttaccaatgcaaagtcatttgaataaaagagaaatttattgtaaagtcacaaatggtctagaactgaaactgctaagctacacagctgccactttcctgtttgaatgcttctttctacacggtttctccatctgctatgcacttaccagatctctgaatgttcagtctatacatttttcaacagccaaatcaaaaacccatctcttctggtcaaccttcagtcctctctcctagatctggacagtcccattttccttagtggtcagtttgctttttgacacttttttctttcccctccacagtgatttggccaattggatatattcctactctttcacactagcctgtaaggccctcgagccacgactttgtcttcagcattatttagcatagagagaaaagatgattaataagtacttttgaaatgtttaataagcaaaagctgagttgggaatgtattttagaaatatatgctattgtagatagctaaatgtgattttagtctttatcacaaacttcttagtaattatttgagagctttcagcatatttataaaaataatttaaaatataactattttacttgaaagtctttgtatattcattgttcttgaattagtaggtaataatcctaatgagccataacaactgttctctcttcaaaataattctgatgatagggttttcttcttaagtcagcacaaaatttattctttatatagggtcaattgaagtgtttttaaaagcatgcacagctctggtaattcattcataaaacacaggaaaatgttttaaagtcaaaagcttcaaaaagattcacaatgtgaaaaacataaattagaacattaaggaaacttgtgttgtaggactttttccttagttcagctagaaaccaggttcttgtcacatgaccaggaaagattaggttcctagacacagtagaagggtgggaaaaatggaatttattgggcaaaaaggaaaaaggaaaaacaacacagcaaagtgagatggggtcctgctaaggggctctccacctcaccaaacgaatcccagggttaccaccccagaacaggagaggccaggctcctccccgctgcaaagggcatgaacttccctcatctccacactcccacacatacccccacccctgttctcccagtttgcaggccagttgtaggttctccaagaacccctttctcctttattacttggctgtctcacttagaagactgatgctagcaaaaaacatacacaggaaaaataagagagtaacagaaaaaaaaatctggcaaagaaggcagaagggaaagagactaagccataagagagagagagaaaaaaaaaatctctggtctgggaagggcatattttctaagcattagtgtgtaagatggagaagcaactcattaagctgtcctttaatgtagtattatccataatagtacaatatgagaaacaactcaaattccccaaaaatgatacagaatggattttataaatcacgtaagccagtgccatagaaaagagtctgaattcgagtggtgtgacttcagttatagtcctgtttgcagcctggtacaggacttaggcaaatattttaattcttacttgtatgtttgggaggcaaggtaaagacttcgccttcaccctctgaagataccctgaaaaatcaactcacagaaagcagattaattggaaaaaagacatatacatttattaacgtgtgcatgaggagaaccagggtggttacccatcttgccagtggagttcagaagcttatatgccatcctggtcaaacaggttatgggagtggagagaagaggaattttggtgagggacaataaaggatccttagggagaacagaacccatctgggagcagagattaattaagttgtaaatagttctctttggaatttgaatgagcctgagagacaggttagtcttccacagaggggaagaaacaacagttatcctttttggtgagtttggactttagacatataaaagaacttcaaagaacagcttcctcctggcttgagagagtcatttgcgggcggggagagggagggaatcagagaggctatgagactgctttttcagttcagcatgttaaagtgccatatttggggtatcggtttttgaaccccatcataggctacagaaccctacagttcctttcaaggctgaaagtttctaatacagtaaagtgtttaaaagtttacactattctgattttagcagatttcccaaatggtatatctcttcatagtgttaggtaaggcagaaagctattctttaaagagcaaatctctgaaagctaatgatgcctgggttgcaatctaaatgatatttttttctttttctaaaatgccaagggcaagttgacttttagagttaatttctttcatttatataaaatggtaatgagagttaaattatatttaggcacctggtacattacctagcctgtaataaactctctgtaaatgctagtttcctccctctgttgcattaaaacaactacaagatgaaaaacctatgtaaaccaaaaataaaagtctaagccccacaaccaacagaatggacccctcctttcggccaagagcattataaaggaaacctgaaatattagttcaggccttgatgaaatggatggttggatatgcctcattatactttcctccctttgatatttaggctaaccagcattagcattaaaacagagacctgaagactgacagaactagactctttaagcctgataagaaacatttacaactgattccctctaaagcctgctacctggaggcttcatctgcataataagaatttgggtctctataatcccttatcttaacccagacattccttctattgattccaagtcttagataaattctttccaccaattgctaatcacagaatctttgaatccacctactacctggaagcacccccacaacacacacacaatggcttcaagttgtcctgcctttctggaccaaaccaaagtacattttccatttatcgatttatgtcttttgtctccctaaaacgtataaagccaagctgtagcccaaccaccttgggcatgtattgtcaggatgtcctgaggttgtgtcatggacatgtcctcaaccttggcaaaagaaacttctaaattgattgagacttgtctcagatactttttggtttacaactgaaaacaatataggttagcgatacatctattctggtgtcaacgccagaatagtttgtcacagtcaaattttattactgtgattcaaaccatggtaaaattataacttaaattttataagatagataaaaacaattcaattaatattccctggttagtttcagtcataatgattatataagttgggtattctcaattacatgagcatctctttaaggcagatgagaatttgatgatgttaatcatgatgatgattactagcatttattgaatgtctactatatgcaccactctaagcaccttgcatatactatctaatttaaactggctcatagatgacatactagtttagagtgtactatttgttgactgcattttaccctgtacttcaatttgatagacagtgtagatgtactaaattcattcttcattccctttacaaaaattgactgagttcttattgatgtgctgtcctggacagtgtgaaaaatcaaaggatgaatcaggcagagacctcttcgagcagatattattgagcagaagaggtaaattatgcacacaatagggtgcaagatgaaaagtggtatgagatgaatgatcataaagggtggtgggaattctgagatgatcatgaaaagtttcctgcccaagtggaatttgaatttgtccttgaaagagagtgaaatctggactgggaatgtcaaattaaaaataaaaatccagactttgtaaggtggggagactattgcaattgggaagctactctaactataagatctacaagcctttcaaagttaggcaaaaggatttttctttcatagggaagagtaaacaaggctggaaagaaaaaaaaaaaaagcagatgtagggaagtgggatgaaaaggagtggcaagatgtgacagtggaccccagaatatttaatcctaaagccagtatagtctctggaagggggctattaagagggattgtatgttgcctcaggctaaggtggtgcaaagctcagggatctagaggaaggacagaatgttaaccgtctttctttaagaagcattatattctgattgatcacttggggcaaaacagttcataattatctatgaggcaaagagtgggaattttgagtctttttgtatggccctgtcataggcaagccaggggaacaactgtgaagcagggtggttctgtgcagtaagccatttcccaaaacacaaaaggatgtggggatttattaaacttcactgttttccaagatcattggtcttgggtaaagttcaacattgtcttgggtatgggaggaaaactcagttaggacttcttaaagaaagagatattcatgggaaggtttcgtttagctgggatgttgacattatgaaggaacgcactaataaatggtgatggttaccctttttgaactgccagttccttttctaaagttaaaaactatcagttcatttaatcttcacagtcatctgatgatacagttacaattatcctccccattttacagacaaagaatctgaatccctcagagtttaagtcacttgatgatactcctagtaagaagtacaacagggactccaacttatgaagccactgtaagcctgacagagccattttagcctcttttcatgacttcagactttccctttataccaaagggaatggaataaaactgcttggacaagagcaagaagacatgcatccatttttcacattccaaaataatggactccaacacatacacataagagaagcagctggacatagaagaacttagaaaaacagaaagtccaagtttggatatggtgcacaagaaacaacagcagccaatggagcttgacaaagcagagtggcgataacaggaaaggttctgagggcagggaacaaaacaatggagctagtcaagacagaagggcccactgtttgtctgctttctgttttttttgagaatgaggatggggtggagattagggttaaatttaacactgttatctttgtaggcccaggtttctctggttcatatctctgtcaatgagactatcacaggtctgtgaagtttttgggggatttggaaaatgcctgctggattagcttttttaaaaaaaagtattattattattttgagacagggtctggttctgtcgcccaggctggagtgcagtggcatgattacggctcactgctacctccgcctcctgggctcaagcaatccgcccacctcagcatcccaagtagctgggactacagttgcacaccaccacaatcagctattttttttttgtagagacagggttttaccatgttgcccaggctaatctcgaactcctgggctcaagtgatccactcgcctcagcctcccaaagtactgggattataggcatgaaccaccgtgcctggcctggattagcttttaagagcaaccctgagctaccctgaagacatctcaactagtacagtttagccctccagagttgaggacagttgctgaatccaacacacattcaactctccttcccttttccctttgccagatacatttgcatttacttctataaatcacagctatcattgtttttcctaataattatcttatgattcaatacactcagtccagtgagcccaggaatacatagtacatggttctaaattttattgaaaatatttataactttgaaatgtaaataattgaactaaattcatcttctataaatcatattttgggaagaaaccctgattgctctaaccaacagagatgttattagaaatgtaatataataataaaagcaattaacctttactgaggccatcctgtgtccctgaactgatggtaggcactttcacatcctttttcatcctcccaggaacctattagtagaagatatggtttctattttacaaacgaaccaattacagttctgagaagttaatctctttgaccaagcagttgtactttaggccttgagccaagttttgaactcagacctctctgactttaaaagtcctctaagccattctacttggaatcaattactcacattttcaagactactcaagggcagctgtgctacctaatacgtgtaatgttgggaacaatatttaactacccgttgacttagtttcttcatctgaaatgtaaaggcaatcagaacttccttagaggattattgtgaagattaaataaattaatacatgtaaactattttaaaggtatacagagctactattttataagtgttagctatgacgattgatgattatgatgacaatgaaatcatactctctttctcaagtgaatagccgtactcaaaatgtcattatgattttgtatgctaaacaaaaactacagaaaattaggagtattagtttgctcttaattaaatttacatgtaagtttcttttaatcataaatttggaaatctcttttgtgcctcccattatacttcttagtctctaaaataaaatttgcattttatttgagaccacagaatggcagttttgataattggattttaaaaacctttttaaaaaaaaaaaaaaaagatttgcatattatttccctggtataaggaatctggatcaccaaaatattaagaacattttctattatttctcatttgtgtggaacatgggggtgttaacattgtcttgacttatttgccccgtatggttgttaggttccagggagcttcagctgagcttaagtgttcctgtctgaaatatctgagtcaaggtgtatgaaccagagatcaaacaaatcagtaaagaagtaacaggcataagactgaagtaaaaaaacaaagatggttccctatcactactaagtatggacagcccagaggtgtgacaaaccctattggttcttcttgcctactgcacagtaaagccaatacactgagacagcagtgttgcagtagaggatgagtttaattctcacaaagcagctgagctgaaggatagtatgcatttctcaaatcgacctccacaagaactcagaaactagggtttttaatgataatttgatggacagggagctagggagtaggtgctactgattggctgggaatcaaaccatagggatgttgaaactgtctttgtgcactgagtcagtttctggtttgaggtcatcacaggaccagtcaagtcagttccttggtatgggtcccaggttcaggtggcatcagtttgtctgccaggatgcaaaaatgtctgaaaattatatccaagaccagtcttgggaagcaactggagaagttataaatcttgtgacctctggccacttgactcctgagcagtaagtaattatagaaaacaagcttgggaccaagggtaggttattgtttaactatgcttgcatcttagcagaattcatgctcctcccataagtctaagcttgtggcctttcattagctttacaaaggtggtttcagtctgaacaaggaggggaagggactgttatcatccttgctttaaatttaaactgtaaactaaattcctcccgtagttatctgggcctacatccaggaatgagcaagggcagttagcttgtgagtttagaagcacaatggagtcacctatgttagatttatttcactgtaataatttcacaaaggcagtttcagtcacaagtatttaagagcagagacaaccacccaggaattcaaatctagattgaagtacaagctgttttaaagcctgcaaggttggtgtgtgtctggatgacaatggcagtgctcatttacctcaacaaaggctttcaacagccatagaagttggtgacaaatttatactctagtaagtatgtggtttacagataaggcaggctgagtttaaaggtttgcagtagggattgcaccggatagtgtgaaaattgtattgaaactgatattaaatatcttaaatataaagcattaaatgacattaatctagatgttccgctatgacttttatactgttatggctttcatctgttgctgccttgaagttgaggagaaaagagcaagcagtggcctctttgtgaggtccatgccgactggaactatcatcacacaaattactactaatatttgctttgttaaaaaaaaactttaggaacaaaaaaaaaatgagtaaaaactttctaagactatgtaaagactatactgacttttttgtattcctgaaacaagaagaactaagatacaaattattcaatcctagacctgaagaaattgtgtcccatggacaaagatgaaggcatttttctgctgccacctgcttcacaccattctctgccctctgaaaccagatgcttaaaagcaatcagtgactcactccacattacccaaaggataaattcccaaatccttagttggtttaccaaaccgtcaatcagtagcccccactcataccccttaccatcatctgtctccatttaccttattacactttaacttcccaaaattgaactttctttagtgtatattgaggaatattctctctgccaagaccactatccaaccacaccatatacattcacttgattaactccaatgtattctttgattctaatttataactccaaggcgaactcttcccttaaccctcaaattaagtgactccccctttgtcctttcataatgtcagggcacatttgtttcaaacacttttatagtgatacctttaaagaaatgtttccaaaacttcagtacacacaggaattatctggagatcttgttaaaatgcagattctgattcagagtgatgccagtgctgctccctgtccccatactacagagtaagtagcagtctgtctgttccactagacctgagagtaggatcctcaaagccccacttatattaggccccgaattaacagctactggaggaatttaagaaaacaatacacaattggcaacacaatttagttttggaatacaagtggtacttacaaatagccatttgagaaaaaccttgttaacttccttccctccttctgtagcttggtatttccaccttttctttccttctctttgcctcagtcttcactcctaaatggaagtggtctctcagttccctccttaatcacggattcttttcatgcccagtagtcaacccttgagatattttcagtggtagcacttcagaaaatgaaaagcaaagggagccaggatagagacatgaagaaaaataaactcctattctcttcctcagtaatcagtgagttactttttctttctccagatctcacctctctggccccatcagactatttattaaagaatcacaagtacatctctagactcctcttcagtgttgcattgctcagaaattcgttgtgtaggtggtgctcagaaatagaaatgaacctcatatcagtcattcatttacataaagacttgtcatatatataattatagtgtatatatatgtgtgtgtgtgtggtgtgtgtgtgtgtgtgtgtgtgtgtgtgtgtatttttttttttaaatagtgatgtggtcttgctctgttgcccaggctgctctgctcttggacttctggcctcaagcagtcctccctcctcagcctcccaaagtgctgggattatagacatgagccactgcatacagtcaagaattgtcttttaacatctaagtagagacttaatcttgttttatgtctctctctgtctgtctctctctctctcccccaacgtgtagtcattttattccaaaggtttgtagttgcatggactataaaaatggaaaaataaaaataacacaaacttcctggggtccccttactacccatatccccataccttgtctcacctacgacaggtaaacagaatcttggagagcaagtgctgtggagtagtcactgcatccaaggtagagagtggtaaaaatgtttcatcgaaaaataatttttctatgaaatggacaggcctcttctccattaggtttaactgtgtttctgactgtgtataggagaaaatgggtcctcagatttccaccacagggtggttctactattagtacatacaaatctttgttaggctttctgtttctttattgttcaaaggcacaatataaggaatagggctagtctgtatttcagtgtaaaatatatgacactttatatatgtgtatatatatatatgtgtgtgtgtgtgtgtgtgtgtatgtgtatgttatgtatataaggttgatttggtctgtatctacataaattacatgatagatatataaatgtgtgtgtgtatatatgtaaataagtctaatgtatacttataatctatatatttgtatttcgtgtgtgtatatgtatatataaacctatattttcatttcttgtaataaaataattaaaataattaacatgaaaaagagatcagaagagaaactcttggtaaatgtataggtttgtctattaataagatgttagatgtgctatagatgtcatagtaaagataacatcccccaaataccaaggagaatagaatgattatactagggtgcgaattctagcaaattaaaataaatatctgcgtgatccatgtttgtaactatctgacagactgtttgctgttaataacttttctggaagccacaaacacagcagtagcactcaattatgatgcggtctacaatataacacaatgcagtttttctgctgccttcaagattacataggcagcagagcctaccataatgaactgtcccgaaaactcaaagtgctgtttgcagcaattttgcatgtgagtattcagattttacagtgtatgaagtctgacttgaatgtgctctacctcagtaattctcatttcaaaatattcacattaaaaacattcacatcttccttttttgattgaagaccatgctaataaaaaagcacatagaatattgcaaataaatagtcatagtgagctaagaactacatggaacactgagattcttcaaggtatgctaatgactttttgtttagtagatttcttgtgctgcagtacgcatgttaataagtatttcatcctcacacaaggtgcttggtgatgaacacactagcccagaattatcagcatacatttattcgattatccgcttgtaatcaagaaaatatattattccttttctcttgatattttggttcatattatctaagtatatgtctaaagcgttaataatattataattcacaaatgtaatgcttaaataggagaaaatattttaaagattctcaaaacctctgtaattttttttcccattaccaacatcattccctttttgctactacatttatcctaattagaaaaagtagcagagggtttgaaagaagaaaaaagaaaaggaaaagtgaagtcttcctaataagaaatattatgttaagtactaccacagcaaattatcattagtgggaattagaaggagcccccttaaatgtgtatataatgctatttttaaaggcttaaaatattttatttcaagttttaacagtatcctatgttactctttaaacattttagaaacttttacaactcagtttgtttcatattaaataagaacttagctgatctcttttggactcactgtggaacattgcattaattgttagccataggacaacaataaaaaaataattttagtaaaccacataacttaggtgactcatgaatgaaagcggtttacagatgtgcttattgaccagaaagccttaatgttcccctcagcttgactaactttagatagatcctttcatgattattggcctccgacctccctttgcttagagcattcactttagaaaatatggaatggtcaattctttctctgcccctttaaggtgtaaatcttctttcagtctcttgccagttttacaccccagaaatgtctttcccaaagatctgggagctagccctttgaaatgtaatcatcaagcaagatagtacccctacctctcaggctctttgggacagtaggagcctaactttgatagataagtgacaatctgcacatatggcctcatctctttgagcaactctccctacacaaagtcctctagtacttttccactagctcaccccaatacttaaaaattatcccaccttttgtactagtggaattgagttctgtctgtgtcacctattgcaagtctttaataaaatctttcttgcctgtttaactctgccttgtgcaatttttctatgacattatttagactccaagtttactgtgcagagtaaaggaatagataagtggagagattttttaaaagggtttaaatgaatgttctaagatatagcaatgactcatttacctgccatcacttgccttacccttttaaaccataatacttctccttctacttttatcattcatgatggaaatattcctaaaatgtagtagcaagccttctgtttctttctcaaaatgaagatttgtttctcaaattgaaagtagttttttgtgtgtgtttaaacaaaaatgtacatgtggaaaataagacactgcaaatcacagattaaagcagtgtttctcaaccttttaaaaatcattactgccccgctaaggagcttttttagttattttttcctgcctcatctccccatgagattttaataccatgaatacatggtatgtctgtttatgtactgctgccttttggggtgccataaacccttacagtatctaagatttgtttgctcccacccaagaaccagtttttgcaccattaggataatattgcctctttgaaaatgcatggtttaaagcacaaagtaaaaatcacttaaaatcccgtaccacagaggtgaccactgtttgcctttagacaaacatccttccagagatctttctaaccatattttatgtgcttttaaaatttgtttttgtgctttaataacaatatggaaatgtttccatattaatatagacatcatccctttcaagtatatataatttatttaaccaatttcctgtgacatacattcttccttcgatttttatattttaagtaatactttgatgaatatcatgtcgtatcacatttgtgcatttgatgtgctgtctttagaaataatttttcaaaatgcaatttctggatagagaggcacatacatttaatttgtttttataaaaatttccaaactatcttcccaaaagattttaccaatatacattctttcatatactgcatgagaatgcctgtttacaacatagggtattatcaatttgtttaatctttgccaaacttatagacacaaagtaagtcttcactattgttttaattctttattcttttatccttaatttgataactaattcattgagtttttaagtaagcatattggctatttgcatatttaaagatttccctcatcttgtaactttttgtcatttttttttactttttttctttgtagtccttattaattacattgcctaaaagataataatcatgtacagtaatgaatgcattttacagttgtgcctttgggaactgtatagggctctgtgcctattcatttcacaaattatttttgctttcttctgaactgacttcatataaaaataaagatgatgataactatggatacattaatgcatgtaagctttatagaaaatatttgtatataaaatagatattttatattaattttatgtgtaggtatttttttaaaaaattaaataatttccagtttttatttatcataaataattctcttttatttaaaaagagctctaacattctaatgtattcttttcatactgaaatttataaaccttctcagttcccttctcaatcacttctgctctatagactttgaactgacatatttatttgatttctttcatctttatctcttttgtaaaatgtcattaggctgagaaaaatataatgagtccatgaagagatattttttaaaaaaacagattttatggaaaggtaaaaatcaaggagaaaactcaggagagtgtgaacacatcagattaatatgatcattgctctcgttccagttaggctcattccaaatattttaacgtgctggtcatgtgaagtaatacttcttttcatagttgtcacactgttttttgccatctaatctgctgtccacttctccaaagttatttatgagatttgttattgatacatcttaatactttgcaaatgccaacattttcctaatattttgagtggaataatatatatttgtaaaacaaatgaaggccaataattatgctttagatttggggactttttgttgagaatcatcgatatagtttgatagtatttcattataccttacagagtatacttaaaaatactcatcaattattgttttaatttatagtttaggttcacaaaagcattatttaatccaaatagatttcacataatataaaatacactattttagccattttaaagtgtacaattcagtggattttagtatattcacagtgttgtgcaaccattaccactgtctaattctagaacatttccattactccaaaaataaaccccacacctttgaattctgcctcttctacctcctgccctatttcctggcaatttctgtctgtggatttgcctattctgaatatttcatgtaaacagaattatacaataggtgatcttttgttactagcttatgcaatagcgtatttttaaggttcatacgtactgtagcatttatcagcgctctattccttttcatggttaaataatattccattgtaaggatgtaccacattttgtttagacattcatcacattgatgaacatttctgttatttccactttttggctattatgaataatgctcccatgaacatttgtgtacaagttgataatgtgaacatgttttaaatttacttgggtatatacataggtgtgaaattgctaaatcataaggtaactgtttaacttcctgaggaactgccaaattgtttcccccaacagttggacattttatattcaaatactacaatccgtatgtttgtagtgtttgaagtttccaatttctccacattcttatcagcacttcctgttttctgggttttttgtttgttttattattgttgtagccatcctagtgaatgcgaagtggtacctcattgtggttttgtgccgttgtttttaaactgcttgatttatgaatgcatttgtggttttattaatagaattgctaaggtcaaaattatttaaaccattttcaaacatggtatgtgtcttgtgacatactacaaaaagttggcaatggttctctattacatttacgaaagaaaaaacctgctgatgaagttgaggctctgactgtatgtattaaactttaacctaagtcactattgacagcagagtatttcaacctctgaagacccagcctcactaaatttgcaaaaatagttttttaaaaattgtactaatacatttctatgttaatggaatggtcactttttcttttcaagtctagtatctaaagtactctgaaatggggaaaagatcatgcttttatagaaattttcttgacctgagcttccattaggggaaaaaacataacttccgattgaaaaatatatttacataataccaatatataaaccattctttcagggtaagccaaacacatctaaaaattccattaagtccattggactggcagttattatgttaaatatattttcatgaaacattttgcttccctggaagcaaggcaacaaaaaagataaaactaattaaaatgatatggggaagaaggagaaggaaagtcacagtcatagtatgttttagatttttcttactgatgaataaaaataactcctttgatttggattatattatagtaattttcatcacttttcaaaaatcttgttcaaaattgtttagttttagtaacaaaatgagcctctttctaccattttcttaggaattctgctactgggacattttgcaaaagctgcaaatgcagctttgattttactaagtaccgtgattttgcctgcattttcaagtacctagatagaagttagggcttaaattgtatttgctaaagttttgaggacttctgagaaaaaaatacaaaagaatataaacatcttataataattcccatactcccccgccctttttttttgttcccacttgtgtaggagacataacccaggaggtgatggagaggagcaaaaacctttccttttctttaatcacttgagaaagagagtcaatctaggaatagctaaaattactgggttctgagtgatgaagacttaagctatttgagaatgaaataaaaattttatgaagtgactgaaggcaaagtcaaaaataaagagttcacaaaggagaatatacagagtactctaataggtcctaaaggagattttagaaaagatattactttatcatactgtgttatttaaaattgccttcatgtttgtctatttttataaagtacatgtgtgtgtgttacaattttttggagatttttgctctcaattctttatatcttacgtgacagcaattagtaccatgtaatttgggcagaaattcctccaagcgacaagcagaatatttcacagtgacattttaatacatgtataaatatattaaaatttgtctctacaaatgcaaaattttaaagtaagatcaaataagaaaattatttaatttttattacttcctacataaacagagaatattttatttgtgggactttttataaatgctgagatgcctctccacctccaaatcagagtgttttaaattttataattctattatagattcaatcatttgggtaagtttacaatacatagctgttaataattattactgagactgaggtacatacaaatagtggaaagctaagatagtccaatatatgtgagcctctgttagcacaggacagtcattttatctgcagataaggacagttttatttcttcctttcctagctacgtatattttatttcgttttcttgccttattacacagactagatctttcagtactatgttgaataagagtagtgagaacagacatttttttgtcttattcctgattttagggggaaaacattcagacaatttgctctttcaccattaaatagcatcttagctgtaggttttttatagatgctcattatcacattgaagatgtgtcccctaatccctttatatttattcttctaagaattcttatcatgaatgggtgttacattttatcaaattcttttctgtattaattgataataatcatgtgatttttctttagtctgttaatatggtggattacactaattttcaattattgaaccagccttccatcctaagaataaactccactttgctctggtgtatacttctttcatatatcactcaatatgacttgttaatcttttgttaaagatttttgtgtttctgtcaatgaggggtgtttgacgtcagattaatactagcttcataaaattaattggaaggcattccatcttctcttttggagagaagaggtagtataagattgatgctaattcttctttaaatgtttcatagaattttccagcaaaatcatctggacatggagatttctttttttggagtagtgttttaattatgaattcagttttcttgatggttatagggctattcaaataattaaattcatattgagtgagttgtcacagttcatgattttggagaatagatccattttatctaagttgccaaattacaaagtgtagaattgttcacgttagtccgttattgtgcttttggtgtctacagggtctatagcaatagtgcctgtttcattcttcgtattggtaacttgtgtcttttctctttttgtctttgtcagttttgctagaggtttatcagtgttattgatcttttcaaagaaccagttcattgcttcgttaactttctctattgcttttctattttgaatttcattgatttctgctcttgtctttgttgtttcctctgtgcagtgtgctttgggttcatcgtgctttttcttttttcaggtttttgaggtgggagattagaatagtgactagagatttttcttcttctctaagtaagcatttagtactgtaaaattttctcttagcactgctttggctacatcccataaatgttgatatactgtgttttcattttcattcatttcaatgcattttttacattccttgaaacattttttggcttatagattatttactagtcgtttggtgtccaaatgtttggagattttcctgttatcttttttgttactgatttgtagctttactccattgtggccaaagaaaacactttgtatgatttcaattattttaaatcaattgtggtttgttttatcccctatctaggtatatgatccatgggaacttaaaaagaatgggttttctgatgtctttgagtggatttttctataaataatgaccagatgctgttgatttatgatgttgtacccagtcagtagatttggatctctagatcctgaagaatcttgccatgtacacagttggtgcttatgaagggtttgttaaactgtttggacctgccatagtattaccctttttcctgttaccacatatacctctcctgtggtctgttaaaatttccagaagaaaggcaagcagcttaggcagactacagtgatagtgtggcatcactaacaacccaaagttaaaaagtttgcaatagcagtcatttatttcatggtcaagggtctggagtttggcttggttttaattgatcttgtctgtgcttacctgtgctctactggactatcctggattctaggttttgggttagattcaaatctgttccatatatctaaattttaggattcatactgaaggagcaatagctgtctagatcatgttcttttcatgggaaaggatgtaagcctcaggagagctggcagaaacttggaatatctcttaaaggcacaatgtcacttctacctgtattccattgtccaaagccagtcacagtaaagtccaaagctaatgcgttaaaggtatatactctgcctattccagtaggaaacacttcaaaattgcgtggcaaaaggcatggatgtataagtctattacaatgagggagtgaagaactggaagctattattcaattttcctttgactttcaatctttaggactttctactctacacagggatcaggaaaatgaaaattaactctccacaggaaaactaatgctccacatgaaaatccctatttggattgaaaactataaagaatgtttcccttgacatatagttaagtcttatatattatattttggataatttgaagaaatggttttagtaaattaatgagaaaatgcttcagaatatactttatagtacatcaaaggcaatgtattttcaaatccaggctgtattatttgtttgtttggttttttttttttttttttttggttttgaactatatgtaggcattttgttgacaggactttttgagaatccattgcaagcctgcacagctacgttaaatatatgaatataaaataggactcaaccttatcaatttgacacgtgtgtgtgtgtgtgtgtgtgtgtgtgtgtgtgtgaatgtggtaaaacatctgcatttgtcatcaatttttggaaatattcgaaagacttttgtgaatcaaaaacctataaattatttggtatttcagatagagatcatggaatcctattaaatgatatatgtccagggttttgcaggtcacaacttgaattttattcgaagagatataatagtcattaaaaaataagagaaaaaaagaaccctggggacagaaattttaatttaaattcagggcaggcatgtagtacctgatattccatgtattcacagaatgacagaaaaccatccttacctgcatggaatgatggcagtgattgtttagtgtccattcaaaacagtaactggttgcagttgaagtagtacttttaatcatatggacacttgttccccaagaattgacctggagccaccaaaacataaacacagactattgagcacagaaggagccagtaattactttcaatcactccttgtcaaaatggtttgaattcaaaccaatcattcataagagaggagctacctcattaatagttttcttagttcaagatcaagaaaaatgataagccatattaaaaattgtttgtgtttgcaagcattcaggagaatgacatttgaaacacaattaccaaaacaaaataaaagcagctaacttataattcaattagagcctttccaatatttgtcaaataaaaaagagcaaatttcagtgaagaaaatcaatgaaggaaaccatttagaacatgcttattgctgtttgacttttgtcagttgcaagaaagggaaatagttgaaatattggcagtaaataaattttacagttattacttgtttcttctaattttctctcccttattgacttctcatttctggtaatatggcaataaacaatatgtaaagagctcagcactggatgtgattaatgtatgcagtatctgcagttaaaacattcttctctactgatgtctgtgtcatgatcctccttttttctcattttccttcaatgttgatttgcctcctcttaccttttttcttctgttattatctactttttacaactttaacaatgaccctgcatatccttcactggcctctctttcaaagaacccatcctacaaatatgcccagctacctactagacatgttcactggaatatgtccatgttaccctaacatctcccctcctttatgttgtgtcctgtctcctatccccttccctctaagtaaccaaaatcaactcattgcttttgattttctaattagttaattctggcacttaagtcaaaatcaccattgtctttgatttttgcctgcagacacttccttgttgaatatgtttgtgcaaacttctatcagataaatgtacctgaaacacacttctcattgtgtcattttactgttccacatgaatgtaaccattgttgatgtatactgggatgtggaaatgtttgggaagcactgatgaatgaattaacatgattacttcttcacaactatgtccctgtactcactggtgctagtctgctagtcttgaagatctggtgggaagaatagctctttcctatactgcacacttcttttcctgttgcggtggatattttctcaaaactttatcctcaggcaaatgattccacgtgcttacttatatccgtaaaatcctcaaatttcatagttagctgatggcaccttattattttattttggtgtgagaatggaaagactcattctcttatacagtttctgccatttcagtatgatttcatttgggaaataaagtaagataaatgttcttatttcagcattttatatatttttaacatctttattttgaaataattttcaacttagaagagttcacaaaataatacatagagttcctgtgtaccctttgtataacttctccaaattttaacttacataatcatagtacaattattgaaataagaaaatgaacattgattttatactattaactaatttacagattagttctggtttgtacagtgtaatgttcaactattagtatattcactacatttatccaaagttttgtttttagagcctgcatagccaaagcaaggctaagcaaaaagaacaaatctggaggcatcacactgcctgatttcaaactatactataatgccatagtcaccaaaacagcatggtgctggtacaaaaataggtacatagaccaatggaacagaatagagaacccagaagtaaacccaaatacttacagccaactgatcttcaacaaagcaaacaaaaacataaagtggggaaaggactcccttttcaacaaatggtgctgggataattgggggaaagagtgggaggggggtgagggatagaaggctacaaatatggtgcagtgtatactgctcaggtgatgggtgcaccaaaatctcacaaatcaccactaaagaatttactcctgtaaccaaatgccacctgtaccccaataacttatggaaaaataaaatgaaaacaaaacaaaaacacacaaagttttgcttttacttaatttaaaacaaagaaattttgtaggctgcatgtggtggctcatgcttgtaatcccagcactttgagaggcttaggcaggaagattgcttaaacccaggagtttgaaaccagcttgtgcgatacagggagactcttgtctctgtagaaaatttaaaaaactagctgggtgtgctggtccatgtctgtggtcccagcttctcaggaggctgaggtaggagggtcacttgggcacaggaggtcaaggctgcagtgagccatgatcacaccactgcagtccaacctgggcatcacggcaagaccctaactatctcaaaaaaaaagaaaaaagaaggaaaagaaattttgcacttgaaaatagttactgatctttagatggataagtaaaataataaaatacctaaaatattttttcattttattctcattttcaaaaattttatcttttacttatctaattattattcatcctagttgactattttcattgtacagagcaatccccaccattatacgatgaaaccttagcaagtttttgttctttgcaacctaaagactaagaatccttagtagaatcatatatatggaaactcttgcacaggaaccaaatgtgtaatgtgtctcattcagagtggaagtgggaccaagaaatttattaggaactgaagtgtgtgctctcgcttgctctctctctctctctctctctctctctgtctcaatcttagtgctcacaaattatttaatattaacctactgaatactgaatatgttaataatttattcagtactcagtagttttttcttcttgtctctatataactcttttacaaaacttttttctccccttacaaatggcaacattatgaccatcataatcaaagtaagtcatcttccagctctattattcgccatagcctagaaacttccctttgtgactctgttcataatgcaaaagaggaatttctgaacatcactggttttgggagggcagaccactgatgtgtcactggcttgtatatcgatgcctttcatcccttatgtcaggttcttacctctgactaaaccaaactagctatatcatttagtctttgctacattgcaaccatctaccccaaatatagtaacttatataataatcattcatttgcttacagtatggtggggtcgtcaatttgggctggactcagaatggcttatctctgctctacatgaggtcaacttatgtgtctgcaagttcaagtatcatggctgagcttctctttttatgtgttctcttatcctcaaggagcttagtctaggctcattcttatgttgatgaaaggggtcccagaaacagcaagagagagcaatccacaatacagaagtaccttttatgtctctccttgtgttacttttgccgatgtcccattgaccaaagcaagttacatgggcaagctcagattcaaggtatagagaaatagattttaccttatgttagaagaagttgcaacaacacattgaaaagagacatgtggctgggcgccgtggctcacgcctgtaatcccagcactttgggaggccaaggcgggcggatcacttgagatcaggagttcaagaccaccctggccaatatggtgaaactccatctctactaaaaatacaaaaattagccggatatggtggtgcacacctgtagtcccagctacttgggagtcagaggtgagagaatcgctttaacccaggacgcagaggttgcagtaagcctagatcatgccattgcactctagcctgggcgacagagtaagactctgtctaaaaaaaaaaaaaaaaagaaaagaaagaaaagaaaagagatatgcatacagaaatggaagaatttgtggccttttgaaaaatctgtcattctaggccaggtatggtggctgtaatcccagcactttgggagggtaaagcgggagaatcacttgagccctggaatcagaccatcctggacaacagaaaacagaaaaaacctatcacactaatatagggaacctgggtgttacaacgtagaacataactatttaggacaaaaggggatgtggacaagcatttccccagccagacttgtgaattagtagctccagaatgtggctgatacaatgagatcagcagggtgttatacttcatttatattgatgcagtttattttattaataattataatgatctcaacgagagtcacgaaacaggttgaggaaagtatataaataaaaggcacacctaccatccacagtcagtcctttgattgtagtctaattaagactagataatgattgaatatcattgtccctgatggtggttttgtagtacagacaaattaaaaaggtggtatacttcctgatgtgaaagaacccactttgggagaaaagacaaaaacatcatcaccatgaacattaattggggtcagtgttggaaaaatgggaatttattctagctttcctttcttcacgttagccctgtgggctgaagttgtacattttttaatttctcttgaaaattgcacagttactgcccactttgtgcttttagattgggtaaacagaagcagtaaattcccagtagctaatgctttgctgtgtaaaggtggaaaatccgtttaaaagtagtcatataaacctctattttctggaatgtttctaagatattagaattggacacatccataaaacagatttctctatgaggtcagcaggatgccatacttctttccatgcactaaaaggcacaccttggttctgaaaggcttaatagtctcaaaaagtgaacactccagtcttcactctgtatagattcactcccagggagagaagggattctactagtgagcagaaaatcaattgctgagtttctgtagctgctttaacttttacttaccagtaggacgccattttctctttgggaaccccactggcctaaacattagctcccttttcaccagcagggtcaggcccttgctgtttctgagttaggagttttatacaatatacagaaatgtccttatttttaaacatataattgcatataaaaatgtgttggtattccttagagatagttgttacaagagaaaacctacaaggaagtaaactgtaattgaccactgcctgacccgttatatggctgtatttaagttttatcctccataaaataattatgatggctttgtgtgttaaaaatagctatttatattcatttgagtgcaatacttgttattctctgccctggttcagtcataggagccctgaaaagcttatggcctgaaggttttgagttctgagttgaacaggataaacactcctttgacttaaaggggaagatgacctttaccattgtagaattcctgtaacaaagttgctgttcattaagtatcatttatgaattccaaaatcaatttgaaaaccacatgatatatttttaataattctagtacacgacatactgtagaaaactgctcaaattgagagaaaattaaactagaaataactaccagttgactgagtacaacttttagttgaaaacagtacagttgtccaagatgtatgatacagtaccaaacggttctcaagactttttgtcctatatattttttttaattagaaaactcactttgaaatttttgacctgtcaaagtgaaagcatatcttgaaaaacaataaagagcaagctggttaaacattgaaaaactgtgaaatgttgaaagcctccccggtgagtaggaacctcattttattacatctgcgacaaaaaacaaatgaaaccaaagatctttgacagtcatttttttataatttatttttagtaagtcatgctgtatattgcgtcttttaaattagggtgtatcagacaatacttagactgttctgtttagaaacttagaaaaccattttttaagggggaaaaagaccaatatgtgctacattaaataatcatctaaaaataaaaagcaattttggttctgctatttcctaaggcttaattaaaccatatatggccaatacagtctagtgactaaggaacaacacataccatgatgtcaggtagcagttttctttctgtgagatgctacttggagggaatatgtttttaggactaacaaagcacctgacaatttattgcaatgaacatattaataatcatttagcaacatacaagtggttacatatagtatgctcttggagaaaccagttatactttgtgtagccgtttcctcaagaaataatgcccagtataatttagaatggccttagaacatttaaaccagtggtgtgctgaagacaacttgtatcagctcgcaagagactggtaaatggtacaaatcactgacctacctccctctcagaaaaaaaagtgattaaatattcatcagtgtattactgaatttttaattatatatagtttaaaaacgattggattctacatgatcttattttgaatgaatatccatctttttattcttactgtggactctcagtgtaagttcctgaaatcaactaaatacatttataaaaataatttatcttaaaaaacatgatccatctatccttgtgcatatttgctattatgtcaaattgtacctcctagttagagtgcccattagtatacatgcatttttattatgccagtgtatgtggaaacccttttgctccccccaaaagacatgctttatcttgcctttgaaaatagaatttccagttgattagtttttattgcaaagctgcctttcacactttcacattgaggtaattatatgcgcctcatattgttttttaaaaaagatgtttcattcattgctttccaaaaaaaaaaaagcaaaataatttatttcctctgaagagggacatgaatttcagtgtttattcatgaagtttacaattgatatatgtattataattgtcctagaaacactttttacaataagatatctttgtaattacgcacctaggataatttggtataaaaagcagtgatattaaagagtgaatagtgtttgcaggtcatagagctttgctctagtattatttgctttactgcaggattcaacataaggcaggtgtcttgtctcatgaagtttattatagaaagagtccttataccatattttcacttatgatgtcgaaacttagaataattttattcaaagaatatcctttgagctccaataacacaaatcaggttataggaagtatcaccctggtacagaattgttcacatactcatttgtcattatttgaagaataaatgaatgaatactaagagcaaaaattagtggcataaatcagaaatccattcattaataaaggagaatacctagcatgtacttgaacagttagggtagacttcattgctttggtaagactttcatgaacatggagtttataagtggaaagacaagaaatgtttttggtagaagaaattgcataagcaagcatgctgaggtataacttcaagtacatttaaagttcagtaaggggccaggatggttgaagccaagattccctgaagttaattctggagagttggaataacattacgtcataggagagactgaaagttaatcctgttggtcatggggaaccactgagattttaccaaaacacttgatttagaaagattcttatattgtgtcaggagtgaaattagagtgggaaaaggaagcgaaagcctggactggttgacttagttccatgagattctctgctatttaaatgtgtcctcagtctccctgctgaaatctaaagaataatctgaaggcaaaattattcccaagtacgaaaatgttttagaccttcttcctaggcaaacatatttctcaattccatgtccatattacagagattgagtatagtagagactcagttttatcacttgtcaacattaatctgttgattgaaatagtaaaaatgtgaagaatttgattcaaaataattttaaacatatacatatactaatatttactaagactctttgacatgcataatacagaatcagagtcatgaaagtaaatgcgtaaaagaaagaaaatacgcaatgggtggttgaggaatacaaagacttttaatagaagtttcaggtatttcagttctcagagggaaatgggaatagctagcatttatccagcagtcctatatagtagtatagaacttgtcatttacagatgtcctagctagggctgctccacaacaataccatagactgggtgacataagcaatagggatttatttctcacagttctggaagctggaaagtccaagatcaaggtgctgatagatttggttccttgtgagggctggcttcctggcttgtagatagactccttctctcttcattctcacatggcggagaaggaggactctggtatcttttcttcttataatggcaccaatcccaccatgaagtcctgcccgcccttatgacatcatgtaaatctaattatctcccaaaggccccacctccaaataccatcacattgggggttagtgcttcaatatatgaattttgagggaacatattcagtccataacaacaggtgttaccatatttaatatttacaacgatccaatgaaaggtactattcttcccatttatacataaggaaaccgcgatagagatagctttaaaactttcccaagattagtggctgcagggtgagggtgttgagaagcagccagggtttgaagccaaacagattcctaggaaaaatattcttaactcattctctgagtttaagtagggtattagcagtttaatgatgatggggtaacagttatatgtaagtatgagtgtgtgaatgtgtttatctgtctatctgagtgaatgagagagtgaagaggcagggagagagagcataagcaataataacagaaggtaggatagtaatttaccactcttactatgaggtgtgggtgtactgttctagatgtgtaactaaaaggaataattttaacctgattattttcatcatacccacttggtggtcattttgtaaactcccacagctcttgtaacagtatatctcaatagtaaaaaagtctttgaaatctatattgggcacgctgagtaaagtgcatcttttttcttccaggaatctctttctaacagtggagaaaccaactggtgaagatcaataaagaatgcttgttttaaacaagagtaacttatgcatacatatgcatacacacacacacacacacacacacacacacacacacacacacagagagagagagagagagaatataaggaagaataaaatcatcttattttacaaaacaccagctgtgttccagtgttctatctattgaaaatgagaaagtatttgactaaaataaaaaaagaggaaggaaataatttaaaaatggaccaaaaaaaaaaacagtcaggagaagaaagctatattgaggaaatcctcttgacagctaatattatttttagcattactaatttgacttccttgataatatcagcacttttactattacaatcttaatgacttgggaaatgcaagctggatagaaaatgtcaaactggaaaggaaaatttcaaatgttttgctttgtaattaaggcctgacaaatataagtcaattttagcataatagatagattatcaagtagggacatttagctaatgttagaggtaaaaaaaattataatttatatttgaatacattctgagatggcttcagtgtgctgacatgttttaaaaagtgtaacaagtcttaacaagattccaggaggggatacacacatgtggacacacacatacattcccaactatctgtaaagggccagagagttcatattttaggattttatgggccacacactcttgatcacaactacttatctctgctgttgtagcatgaaagcagtcttagacaatatataatcaaatgagcatggctgtgttccaataaaattttctttacaaaaccaagcaaagagccagattttgcccccaagccatagtttgataagcacttatctaatacatattcatatgtttcatatagagggatagcttttactagcaagcagtagtaataggtgtgtgcatcattttaagcccttaaagagctaaatcatatccaatcattcaacctttaaaaaaatttgaaaattcatatattttatattttatctgatgcaaccgttcctattaatatttaattcaaatgaaagttgttaaaatgaagtggcattttcatattcaaatctactttaaatgtattcatgcttgtcagtgcctcaaatagaatctgtgaaaaattctcataaaatagatcctaaattttgtcaaataaacttggaaaataattgcagaatacttatttaccacttcccatacatgatttagcttaactaaggtgccgatatctgtgtatgatagcaagttaggtagtaggggggttggcatttatcttaaggagccacagtgacactaataattgatcagaaatagtcaagttcaaaggaagcacgttcaaaaaagatagtgaagtttctttaggtacaagacggaaaatggttgactctctctatacctaatattaaaaaaaaaaaagaatctatggtaattttcttttcttctattcttttttattatttttatttttttattttttattttattttttttttgagaaggagtcttactctgttgcccagactggagtgcagagtgcagtggtgcgatcttggctcactgcaacctccacttcccaggttcaagcgattcttctgattcagccacacaagtagctgggactacaggcgcctgccaccatgcctggctaatttttttatttttaatagagacggggtttcgccatgttggacaggctggtctcgaacttctggcctcaagagatctgcgtgacttggcctcccaaagtgctgggattacaggcatgagccatcacaccaggcctacagtaaatttttaaaaagcattttaattggtaattttacagtaacctgggatgcagaattgaattgttttatgaattaatctccaaggagttacttgaatttgttctctctctctgtctctctctctgtgtgtatatatgtacacatacatgtatatgcatatatatatgtatattctatgtagctctatatgttttgttccattagacaacctggaatacataaatgttaaaaaattttttgtgaaacagtggcccacattaaaaacggttctcatttttgtttgtcattcctcagaacaaaacagtatttggtggttcaacaaaatagaaaattaattttaaaaatagagaggaaaataaatttaaatatgatttttcccagtagtcctataatttatcttaataagaaaggagtacaggtttcaatgcagcattgttctaagactttttgtgcatatcagaatttggattcatgtttttttaaaaaggaaaagaaacacttgtcgtggaaaaagttattcagttagtcaaagtcaaaataacaaaataagaaacgtcaagtaagtaaatataacctgggagttctgaaataaagataacaaaatgattttatcaagtatctaaagtctatcatttctaaagtgggtaaagctatcataaataaagcagaattatatttacttttctaaatactaaattatatgcagtatatgcatacaatttgctttatttaagaagatggctaacttatctgattctttctttatatgttttagattaattttctagagttgactctcactcaggtctaggcagaaaattattggtgtggaaaatatgcccattccagtgaggtcatctattacatgtgcatgtaatatatggcagcaggtaattgagacaatgtctctttgagatggcagtccccttgaagtcattgccagggaatatatttctctttaattttttatgagacaatttagggaggggattttgtgacttatcagttccagaaattatacctagcaatacagaaaatgatatgttttttcttgtggatggtacagctttgttaatttttgattttgagatgctttagggtagagaccaggcttatcagctcaatgagaacatgtgtttttgtatgtttcattcttggccatatcacaagtgcctataacagtgcctggacaagagtacatgctcaataaatacttttgaatcacaggattaacctttacattgccgattgccagcagaaacttaggagaaagccatggtggataatcaaaaagtacgattaaattaagtggaaagagcaattataaataaataactaccttaccattccccacagtgggtctgggaattcatccttgtaaaaccacggagagtgttcctctgagagtgactacagattttttttttttttttttttttttttgagacggagtcttgctctttcacccatgctggagtacactggcgcaatctcggctcactgcaacctctgcctcctgggttcaagcaattctcctgcctcaacctctcaagtagctgggattacaggcgcccgccaccatgcctggctaatttttgtatttttagtagagacagggtttcaccatgttggccagagctggtctcgaactcctgacctcaagtgatccgccacctcggcctcccaaagtgcagattttgtttctcacataatgagaagctgagtgcaatctatatgctgtaagaatatcccattcctactcaatagtgtctttatgactattactttaaagaaatgaagtaaaaggtagttttacttcacatacaatatgtgaagtaaaatgtagttttggtttacatgtatatatgactatatgataatacttcaggaagtcattaatgaggaaaacgattccaagacacatacataatcggattttttagctattgtgtttgtagcttactttcaacattagtaagcagttgtaagagaacagccattaccaattactgtaaccgcagcattacacagggagaaatatgactgttgaccttgaaatgagtataagatcatccccagtagaagatcacagtccaacaactctcaactctggctgcacattgacatcatctgggggagcttttagaaaattttttttattagatctaggccctaccttcggagactcttcactgtttggacgtctgtacatttttaaagcaacccaagtgattctattgtgcaattatggttgagacgatcgaatgctcttcaaattgttttactcagataaatttaaaggaattttgaaaaaacgtgcactatctcccatatttcaactataaaacatttcagcatatgtttaaacagtttcaaagaatatacattcctctgcatcatctatgtgttctaaatatattttggttgaatctttgaattgggtatttaactcattttgtttgtgggaaaagataacattaagacagaggcttgccctgaatttttttccttagacaaaataaagatctgtacctttcaatattttctttaagatatcttcaatggactatcccaaatgctcagcgcattatttaatggtccttttgtttgatgccctggagggttttactccctggagcaatatgctttgataagatttgccatagtgaggtacgtctttcttcttcaaagtaagaaaagtgtggttagataagagaataggcacattatcagatcaattttagatgtgtctgaaagctgaagatctggaaatagattcccttaaatatgttcatgtctgtgtactccttgaaaagtcctcatattttagtgtatgtacctcagttggaaggtagctggattaaacttggagctggtagttttggggaagacagagacaaggggacaggcatgagaattggccaatccctggtgggatctccaaactgaccagcaggttgataggttggttgggaataaggtgagaactttttaatgagggccatgtgtgcaccacatatcatagcaaaataggagttcaaaactaagcagacaagcaacaatctaagcacaaatttataacagcagaagaaccagagttggagagaaacgagggaggtagccaggaatcaagaggaaaaaattctgaagggcaaataaagatgggagaatgaagtagaaaaattgttcaaaaatcagcaaagctatatggggaataaaataatacaataaacatgactacaccaccaatgagagatgccatcaccaaagaggtgagaatacatgaagctcgcctgtcttccgtttgatttttttttttttctgtgtctgccctttggagtaggaacaacttctcatgcatagtagaggcaaaaaccagcatctgatagttccatgtcttcagtgtggagtagaaagcaggaaagagtgggtagatcccgagtgcacaggaaatgcacttatgttcactgaaaagccatacagcatccaactatagatgacattggctggaaatatagaatcacaaaaattattcacagatcttttttttgctgaaatcattttaaataaagtctgacggggagggagagcatcagcataaatagctaatgcatgcagggcttaatacctaggtgatcagttgatagataaaggaaaccaccatggcacacgtttacctatgtaacaaacctgcacgtcctgcacatgtatcctggaacttaaaattttttaaaaaaagaaagtatgtgggaaaaaaaatatcttacagagaccagagatttttttcttttcaatacatttctttagtttttgttttaaccaaaacagagttccaacagttatctcttcagtaaatgaaagcatctccttaagctttaagtggtacttgaaattttaaaagaggattattttttccaactcagtgaggttataatatacactccaacaactttataaaagcaagagaagtagagtgttaattgttaattatatgaaagtgttcaggcaaaggaacttttaccttgaaagcctttactctttagcatcaaaataagcttgaaagttctatggtatttagggaggatattttaaatttcccctacccaagaaaactggataaggattaatacaaaaccccctccagaatattaatttaattaagtagttatccaaagtgttatcacaaatacatgatgtgagttcacacttcaggcccttacatttttatattgcatggcatttgtctttttaattaaaaaaaccccacagttctattgtattgccatggggtttttcatttaattttccatttaaaagtagttttatttctccttttaatttaattaaaaacgttaaaattgttagggaaaaaaagaagaaaatcctgagtcatcactctttccttccttatttattcacattattgatgaaggtctgtctagaacaaaccactgatagcacattatcctttgaaaggcagtgaaacaccgaaaattggagtttgctcactttgaggatcatcgaaaacaaacagctgaaatatttttttccttttagaaaattaaaaaaaaaactgatatgaaatttcctctatttagaagcccatgtctacccaaaaatagaaaaaaatgttttctcaaaagcccggaattagaacatcttacgacatcttcaactctaagttgaatttcattaaaatattttgttgcacgtttttgaagtggcaaacatcttgctttttggaaatctcagttttaagaaatgaaagaggtaaagagtatttgaattataatcattgtctaagccaggatcagttttctggggtgggagtacagagagatgcatcgggtagggggctagtggtcatggctaactgttataaaacttctattgatgccacccatttggatgacatgagattggatatgggctaagacttttgttgaaaggaacgttgtttacttggaagtgttccagtaggcatttgccagtcacagaatacaagaaagaaaaagggagtcattcattttatttcattaaaacatgtgttgaacatctactaaatgctgtaatctgtgctaggtgcagaagatataataataaaaccagccaaaagcgtgattctcatggtcgccagattgaaaaggggcttatcagttacggaagactcaatgcttccaaagctttaataccacccactttttattgaccgtttattaacccattttggctaggaaagggagtgaaagaatgtttacatgcatatttatatcactatttacataagatattttttctaataacacttgaaattgcgtttttaaattgttttatggaagaattttgagcccaagctggtacggtagcttactcctgtaatcccaacactttgtgaggcccaggtgagaggatagcttgagcctggaagttcacgaccagcctgggcaacatagtgggagcttgtctctacaaaaagataaaaaatttagccatgcatggtggcatgcgcctgtggtcccagctactcaggaggccgaggaggaaagatcacttgagcccaggagatctagtttgcagtgagccgtgattgcaccactgtactccatcctgagcaagagagtgatgccctgtcataaaataaaataaaatgaaatagtaatgtataccagcttttatttacctctattcttttttttttttttggtccaaagcatgtgtttcctttaattttttttctttaacttttattttagatatgggagtacatacacaagtttgttacatgggtatattgtacccaggtagtgagcataatacccaataggatgttttttgacccttcttccccaccctaagtagtctgtagtgcctattgttatcatgtttatgttcatgtgtgctcaaagtttagctcccatttatacgtgagaacatgcggtctttggttttctgttcttgcattaattcacttaggatagtggcctccagctgcatccatgttgctacaaaggacacgattttgttcttttttgtgactgcatagtattccatggtgtaccacattttctttatttgatccaccactgatggacacctaatgttgattccatgtctttgctattgtgaatagcatgggtgaagaagatacaagtgcatgtgtctttttggtagaattatttgttttcttttggtagaattatttgttttcttttggatatatatttagtaatgggattactgggtctgttttacattctttgagaaatcttcaaactgctttccacaggggctgaactattttacattcccaccaacagtgtataaacattctcttttctccgcagcctcaccagcatctgttattttttgacttttcaaatagctgttctgacttgtgtggatcatatcttattgtggttttgatttgcatttatctgacaattagtgatgttgaacattttttcctatgtctgttggctgcttgtacatcctttgatctcgaactcctaaccccaagtgatccacctgcctcagcctccccaaagtactgggattacaggcgtgagccactgtgactggccttgtacatcctttgaaaagtgtctgttcatgccctttgtggtttttacttgttgatttgattaggaatcttaagttccttatacattctggatattagacctttgtcagagcatagtttgcaaatattttctgccattctgtagattgtttactctgctgatagtttcttctgctgtgcagaagctctttaattaggtcccagttttcaatgtttgcttttgttgaatttgcctctattctgaaaaattctgtcacgtaccataaatattttgttgtagtaagttaggtaacacatttaaataattagctcaacatcctgaaatatggactactgccaaatggatacaagaatatatacaaagagagttctactccttgactgcccagtcaagttgcacacacacactgttcagatgggtccttggactatgtcaaatcacattgaagtaaacagtagttggtgattagattaggatgaaatataaaatccataaaagtaatcgcataaaacttttaaatggcaaaactgcaattacttttgcaccaacctaataaatagtttctctttattaggacatgcagatataataattagcctttctctgatcggtatggtctagatcagagatcagagaacgtttttgttttttttttttgagacagggtgtcgctgtgttgcctaggctggtcttgaactcctgggctcaagtgatcctcctacctcagccttctaaagtgctgggattacaggtgtgaactaccattcccagcctcagaaaacttttttacgtaaagggctagattgtaaatgttttcagttttatgggtcatgtggtttctgtcacaactattcacattctgtcacaactattcacagtcatgctttgtagcttgaaagcagtcacaaatactaagtaaataaatgcatatggctgtgtttatataaaacatgaggggatagatttggcgtgtggtccatagtttgccaaacactatctagacaacataaaggttcaaaggaggaggatatgacatcaaattggggcaatgagaaagtatttcattgaagaggtagcacttgctattattcttgaagcctggtagatgaggtaagctgacattgtggggtgatttctggtggacagaatgtggatagtttaagaaattgaatttttatgaacactgagcatttcgttatggcagaaatatagactctgtgtagaggagtgactctagatgagttaggaatgtagatttgttcatgttttagagttttcagtaccaggatgaggaacttgtacctagcttgacaggcaattatagaccattaaatagtttatatcacaatgggatttggtagaaaccacactggaagacagtcattctaggagtggtgtgtggaataaattagagaagtaagggactgtaaacaagcgagcggattggaagagtgtcataatagcttaaaaaggagacaatgagggccccaacatagtcaggtaagaggatttctaaaaaagaggttgttgaggtaaactgtaacattctaaaaattatttctttaattgacaaaaatactgtatataattgtgtacaacatgttttgaaatatatatacattgtgaaatacctaaatctagataattaacataagcattacctcacctacttatcacttttgtggtgagaacacataaagtctactctaagcaattctaaagaatctaatgcattgctattaactctagttatcgtgttgtacagtatgtctcttgaacttatttctcttatctaagtaaaattttgtatcttttgaccaacatattgccccccacagccctggtcgctaccattctattctctgcttctaagaattcaacctttttagattccacatataagtgaggtcatgaggtatttgtctttctttggctgtaacatttaaggatgaacaactgggaacctaaattatttccaagctgtagtcccaccatatgcaccagtacttttaacggagcctgcctagttcctgtttctagaaaactattcagtaaaacagccgtcttctatgtattatgtatttttcctaagtcgttacctagggactagaaccctgcctagatccctgtgcccagtgcttcaagccgccttaactatcttgtaatattggcctctatgaatttttaagtagcagaatcagctcccctgagattagtttatatctccccacctggagtggactgcatcttgggtctttgctcaactatcactggagacattcacatttgctgggcggcattgtgccgacccatcatattgatctgtaacgtttagcctgtggttgggcaatttcttcctgcaactattgtatcccactatgtcaaacaaacatcaggtcccatttctacttactccagcctcttgtaagcaactacccatactacaggcctgaatactgagatttgccatacttcagctttttttaaaaactgaggagtaagaattatagacatttgagctactcctccttgtatgtgtactaataccactatgcaacttgtctattaatattattacatacaatttgaaattatattcaaaatagttaacagcctggtcattgacccatcaaaacacttgccagacataaataactgcttgcttaccagctagaaaaatcagccctgcctgtgacacagaaataaaccttcacaaaaacactaaagagaagagctaaaactatgaaatgtccaaaagaaaacataagagataatctctgtgaccttggagtggaccaatatttcttaaatatgacacaaaaagcatgaacaagataataaatattcatgttaaactttatcaaaattaaacactttttttttcttcaagagatattattaagacaacctaaaaccaagccacagacttgggaaaagtattttcaaaatataaatcagatgagggcttttatccagaacatagaaaatgtataactcttgataataataagaaaaacacatttaaaaaaatagcaaaatatttgaatagacacttctcgcaagaagatatacaaatggccaacaagcacataaaaagttattcaataccattagtcattagggaaatgcaaattaaaaccacatagaaataccacattgcacccactagaatggctagaatccaaaagactgacaatactaaatattggcaatgaggtagagaaactaaagttgtcacacattgctggtgtgaatgtaaattgatataaccactttggaaaacacttttgcaatatatttttaaaattaaatatactatggatatactatatacgtaactataaatacactatatacatatataactatacaaaaatgtactgtgtatatatgtggaaatatatgtatattgcataaaacccagcaactccacacctagatatcttcccaagaaacatgtttatacaaacacttgtaatttaatgtttagactagcagtattcagagtagcccaaaactgtaaactctccgaatgtccatcaactagtgaatagataaacaaaatatgatataggcatacaatggcatgctactctccccaaaaagaaataaattactgatatatgcaaagacatggattgatctcacaggcattatactgggtgaaagaatccagacacaaaagtgtaggtattttattatttccattatatgacatttctagaaaggataaaactatagagacagaggcaaaatcagtgggttcctgggaccaggggtagaatcacagattagctacaaattggcatgaagaaactttggggtgatggaagtgttttaaaactgggttattgtgatagttgcacaagtatataagtttactgaaactcattaaactgaacatgtaaaatgggtgaattttattattatatgtaacagaaaagctgttgaaagcatagaatactgttatatgaggagattatttctgtttaaaggtgatttttctagaaagattttataatgtctaaaatataaaactggcacatcatagaatgagtacatataagtaaaactttttttttgcaggcatgcatatgtgaaattgtatggttctatttatggcaaacagaaggaaactttttacagtgaaactatgttcatagttttcaagggaaaaacagctccatgaaataaaatattgcttggggagttctttcataccgcttgtcaccagcattctcactggcttataagttataattgctctgtgataaaggcgtatgctttccttctctcttataaaaattttaatgagaacttggagtgaactctcactgaacctattttcattccaaaaatcttatgattttaatcttatgatcctcctgagacctggcactatggtctgtgacagcatgaatacttcataattattcctcctgtttgtagaaaacaccatgggcatccatcattccctctctcccctgctgcctccagggagtcacagcctctagcaaggtcagtaattgcagttttggttgacagttccaggccagctgaagcaaatccagctggtgaagactagccacaatggatattgactgacttcccttccttctttcacctcatagtcagtttggccttaaaactcttccttagtgatgtgatagatggacttaaatcatcccacaagagattccccagtacagagaaaatgaatggtttctctagagccatgtgtatatgtgtctgtcggtatttgggggacaattgatctaaccgtcctggggtaactgaaaggtctttcccttggggataaggaaaagactgtattggagcttgacatttaatattgtttggcatctcacatctctgtagataacctgcatgaaataaaagattcagccatgtgaattaagatggtattttggaagtggatatgcttcatttggctaacatcgaaaattctaataacagatttgccctgtgcatagaaaaaatagatgctttagatgtcaagcaaataattaagcattaattttttactttattttatgacaaatgcatagagagattcacacaagaaataccaaaggaatgccagatgctttatcaaaaaaaaaaaaacccacattatgaatccaaagaaagatagacaaatagccttcatagtatgtaatattggatggtatagctttacgaaaaagaagataaactttcatgtgaattgctggtgaattccagaaaagaaatgactttcgaaagtggtataatacctttaactctctaacttctcaccatgtggtttactcatagtgtagaccatgactaaagtaccggcagaaacaaacccaattaggcatggcctattgtatagatactgaactagtctagtgtctttaggtttgtaataagtcagggtttatttttttcttgcttttttaccctggtcccttgtttctggacttacttggggtttaaaagatgtatttgcttaagaataacttaattacccattctggataaaaatttaatggaatgtgttagaaggcttaagtgagatattaaaattaattgaaatcacgacccccacactctttgacacacctcccattatgaggtagattgtgagcggccttatagttactccacttaatagaataaagttgatgtgatgttatgtaacttccagactaagttagaaaaggtcatttagcttctacttggttctgtctagagacatactctgggggaaaccaacaccatgtaaaaagctgtcccgtgaccaccatgttgtggaggccccgtgtaggaatttcagccgacactaccgaccaacagttagcctccacttccagccctgtgagtgagtcatcttggatatccagcccagtccagtctttatgtaactacaaacctacctgatatttaactccagtcccctgagaggtgccaagtgagaactcctcagccaattccttctcaaatatttgtctcacaaaatttttagaatatctttaatatatgtgtaatagtaaaactactgtcactcagtaattttgatattaactgtatgtttattttggatattcagtttgttatgtgtctatttaaataattattgaatttctattaggaacacttgttcagcctatctaccatgagacttaaaaagcctaaatcacagtccttgccttagaagaatacaattgtcagtggagtagatgcaggatcatcaagtatcaaaactctggagcacaccattcatattatagtctatgtaaatggtctcccttgagttgtgcaatgggatgtcactggaaagataagacataaagtgttattttagtaataaccattcttatactggtaagcttctcaggattggtatatatgagtggtaaggaatactactaaattttatacttttccaaacttctttacagtactctgttgttgacaaaagtgaaaacaatttagttagaatgtaaaagtaacaaagaagttttaaaggaatatataatgttctgtcataaagacacaggcacatgtatgttcatcatggcactattcacaatagcaaagacatggaatcaaactaaatgcccatcaacagtagaatgaataaagaaatgtgctacatatatacaatggaatactatgcagccataaaaaagaatgagatattgtcctttgtagcagcattcatgtagctgtaggccattatcctaagcaaactaacacagcaacagaaaaccaagtacctaatgttctcacttataagtgggagctaaaccttgaggacatatggataaaaagaagggaacaagggcctactttaagatgaagggtggcaggagggtgaggatggaaaaactacctattgggtactatggttattacctgggtgacaaaataatctgtacaccaaacacctgtgacacagaatttacctgtataacaaacctgcaacatgtaccccttatcctaaaataaaagttgaattcaatttaatttaatgcaaaatataatcaaaattttagtctgggagtagtggcttatacctgtaatcccagcactttgggaggtcaaggcaagaggatagattgagctcaagagtttaaggccagcctgggcaacatagtgagtccctgtctctacaaaaaaatacaaaaatcagccaggcatggtgacatgtgcctatggtcctaagtactttggaggctgagatgggcggatcgcttgagcccatgaggttgaggcagcagtgagccatgattgtgccgctgcactccagcctgggtaacagggtgaggccctgtctcaaaaaaattatattgcactgtatgcaatactttgtaaatgcatatgctattcttctaatgcttttagacacttcagtgcgtgtcatgagaatatgccaagttgactaactataaactgatggttcccaaatttggctatacattgaaatcacctggggagttttaacaaccaactgatgtctggttcccactcccagggattcagatttaatggatcgggggtacagaatgggcattgggattttttaaagatctgaaattgttttaatggacagccacaaccgagaacaactgatatgtatttcttcttttaattaggtagttctcaaactcaactgcccattggaatcatctgtggaacttggcaaactattagtgatttggttccatttctagagactctgatttaattgctctggggtaggtcctcttggtacttttaaaaatgctcactagttaattgtgatttgagatccaccaataggatgctcatactgggtttacagattaatgtttttctgcatatatgtgtcactcagcctcagttaccacatcattactattgggacacagctcaggttgccaaattcagcaaataaaaataacttttcctggataagtttgaatttcagataaacaacaaatacttttttagtgtaagtatgtctcatgcaatatttgggacatacactaaaaagtaagtttttttaatttaaaattcaaatttaaccagataccttgtattttatctggcaactctaaacacagtataatttaggcaagagacagagcaaggcccaaataatgcattatatgaagtgtgaccacaatggtgttcaatccatattccaggacagaactaagatattcttattgtcccccagctgccacagagtaaccattctatcccataatactacttttaggcggtctcatctgtagcatccctcttatttattgagcaaaagcaatggacagatgtaggagacagacagaaaaaacctgaaacctcctgtcccatcagtgttaaatcttttggcaacagagagtgttaaatctattggcagcataagctgaaatcatgggactgaaacttatgacttaaaaaaagacaaacaaacaaaaatcctgtgggtttctattgtttttacttatgcaatttctcaaatattttcatgtaattatagaagagaaaaaaaaacagattagtgctgaagttctgatcactggctgaacttcatagccttagcagccactgttaaacttcgaggttctgtcgcatttatagtgacagccaattccctcagagttacacagcagttgctggcaagtataatctcacatttggcaaatgcttgcatttctgaagctcactttttcattggttcttctcaacaatgctgtgaagtaggcagggaagttatgatatccattatataactaaggaaaattagaatcaggaaagtgttgccttgacctagagtagtatttcttaacgtgtggtcctggacaaactgcctcagcattacctgggaacctgttagagacaaaaattctgaaaccctaccccaaacctactgacttagaaactgcaggataggcccagtaatttgtgtttttataagccttctagtgattctgttgcatggtcaagcttgaaaacccctgccttcaggggtatgtggtcccagctcaaacattactaatactaatgtttatttatttaatttatagtttatttgtccccctggagtttaaaggctgtgaggtcagggatggtgtcacactgcctaggtatataatagatatgcagcaaatattgcaaaataaattaatgaagactagaacgagtgaatgcatgaatcccacatatgggggcttccattgccatgccttgccttaaaagaagtgtcctgtgcttagaaaattccattgcttcgctcattctctcttttgaagaatctcagctaatgggaagaaaaatggttgactgcatgaatttatccacaggcatattgagactagatatttcccttgaccccttagtgggacttgcgaaggggtcgctcacttactcagcctgcagcactcaaaccccttgagggagggggagcacacaggtgagcggatgtgggagagccagggccaagtgcctttgggcaccggcaggaatgaaccttgtactggcctgtggcagagtaccacgtagtacctggaaggcaccttagtttatctagttcagtcctctcattgtatacataaagaaggtaaatttgtgagtggtaaagtctgtatctacgcaataaaatacttcaatagctggggctagaactctgatgcctttattccctttaatatgcaaaggttttgagtacagtgtcctgtgaagaatgcttgaaatctcaccatggggaatgtcaccagtgcaattctgctgtcttttatttttatttttatttattttatttttttagatgcagttttgctcttgtcggcccaggctggagtgcagtggcacaacctccgctcactgcaacctctgcctcctgggttcaagcaattctactgcctcagcctcctgagtagctgggattacaggtgcctgccaccacgcctggctaatttttgtgtttttgttagagacagggtttcactatgttgcccaggctggtctcgaactcctgacctcaagtgatccagcgcctcggcctcccaaagtgctgggattacaggcgagagccactacgtctggccaattctgctgtctttatttctgcttaattattacttttaatttcattattttattacaaaactttaactttttatattgaatggtattattaatatggaattttgtatttataaagtaaagattgaaggaagcgtatttactgctaatggaaagtatcgcttactttttccttcaaagcaggaaaagcaatgtgcaaacatgtaagtgaaggaaaaatccaaccaaatctcttacccgagtatctacattaatattgtttggtgggtgagatatttctgcaattctgcagtattaatccatccttctttattatgtccaccgaaggtgtaacactgattacagtatgttttagggaaaacaatcctcctaggcatagtggcgataattcttcgacttttttactttgctgtcttggctcatcacggtgacctttaattcattttctcttgtctggtcttctttgcagacactacgaagccactctgtggtgtctattgagctaaagtcaattaatcacagggtgacttttaaaaaatcaagattaataataggttatttcatagccagaatgcttgattaagatgggcacatttgtggttcccctcatggctagaaataatttagccaagttacaatatcttgggcaaatttttctctcttataattttcccaatgagaactgctcagtttaaatggacttccctaagcttccatcaggggttctcagaagggttatacaaaatcactttcgttagctactgggtactcctaaatggaagcatctttgtaaagccatgtagcattggcacctcttcacaaaaacttggggggagtccgtgaaaaaaataacgggaagtctgtctttaaagataataacgtctgcctccaacattttacacatctcagtcatgccctgtggtgggagcaaaagaattctcttttctctttagtcttgtgccaaattttcttttcctgttggcctgaatccactaatgtccttggtaggtggatcctggtgtattaaaagattcatagcatttcatatttatattctgcttaacaatatgatggtacaccttagcagtttagcaaaatggcaaatctgtttgcataataaaccatataatgtgctgcatcatcaatttgactttgctggatgaacgaagagaaccagttggctctgatgaagttgagttttacaggtcaatgcaccatccatattaaggaaatccaggacaactatgtacatatatattgtagctagaggctgaatacattttgtacaatatttcatttgctgttataaaagaaaaaaatataagcttgggtacagctaccatagaaatcaatttttaggttttatattattactgcctttctattccccaggtgtgctttttcatagcatctccatcctaaacacaattgcctttgaagtaccaatatatctcttagtggatgacaatttccaaactctactcagaaaatacagtgcaaatcctggtataatataatggaactaccaagagttgttatggggctacatattttctgttctctactctcttgagatcttagcaaaatcccttcttggtaaccttggcttattgaaaagggctaatttatttggcattaatcagaagacatataccatctctcaactagactctctccacaacgttcctttaaaatttttaatctagtgaaaacagggggtagctttattctgtaatagtaatatggttcatgatatggagactgcagaaagaagactgtaaagctgaatttcactgcaagaaaatcgtgacttcaatacttcaggagaaaatcttgttgttcagtttgctggaattaatagttattttacctgtcaaactgtagtaccatcgaagtttcaccagactgtctagaacagactaatttgaagaagtacaatttcccaagtaatgttttattctgcagtccctctcttcagggcaacacacccatgtaggacctctcccactgctagtttagtcatgtgaaagagaatacctcttgttgttgcaagttatttcatcatcatcttgctaaagaaatgtctcactctcctaagtctccaagatcttttattggccagattccatataaggctttgtgttctacatttgtgatctagggaatttaaagcttttcacttctagcttaccagaggcttctgtatgtggtaaatcatacattgatataaaaagtaaataataataatcataataatagttatggcttatgtaacctatctttctcaatagttattggaccatgataagtgatacctcaataccacataccccttcacccaccatccactatctctcatacccttcataaccaagcatctttttttcttatacaattttattaatggagatacaattcacataccataaatctaccattttatttatttttaaaatactttaagtttaaagtttattttatttaatttattttagagatagggtctcactctgtcatggagactagagtgcactggcatgatcatagctcattgcagcctcaaactcctgggcccaagagatcctcctgccccagcctccagaatagatgggactacaagtatgcatcgtgtctggttaatttttttatttcttggcatagacagggtcttctctatgttgcccactctggttttgaactcctggcctcaagcaatccttttgctttggtctcccaaagtgcctggtttattgacatgagccactgtgcctggcctaccattttaaattgtacaatttattgtttttgatatatttacaaagttatgcaactatcactactgtctaattccagaacattttatcacccccaaaacaaaccatgcacctgttcaccaaaaagtgactgaagcaggtatcaatcaatagaagtttatttacccaaagtcgagaaagtaccttggaaaatatacaaatcacaggagcatctgtgatctgggctttttccaaaggagggggtgggggaacttcagtatttgaaggggaaagagcaaataggagggaaaagaaagggagagagggtagcccctgaggtaaatggctaaattctagtgaggctctgtttagcttcagtaaatctacattttacatgtgaaaagaagaactagaggaaaaagtcaattaggcatttgtctcagggtaggcagagggttgataagctggcaattgacattgtcagggttagatttcatagaactgggttttagggctagtatatataggaagggtatgtatcctggaagatttaggtgctcacgaggcaattccttgtgagggaggccatctggggagacatgtgcccttctatagttatgggaaactggcttagagatgaggctatgacacggtgttgctgaattacagctatctgggaacaaaaaggaaggcagcattgtgattccgttcccaagcttaactttgcctttggcatagtaagtttggagtcccaagattctattttctttcacatatccattagcagtcactcctctttccccctccccctaggccctggcaagcacgaatctactttctgtctctatgaatttgcccattttgaatatttcatataaatggaatcatccaatatgtgactttttgcgtctggtttctttcacttatcatcaggatttcatggctcatccatgaaatgtctcagtactttattaccttttatagatgaataatattccattgggtataccaaattttgttatgcacacatcagttgatggaaatttacaattgctttcattttgaggctactatgaataatggtgcatagccagtcatcttgatagagttgtctatactcactttctttttctcctcatttcctatttactcttcagcctactccagtttgatttctgctccagtcacttccctaaaatggctttctctggtgtcaccagtgatggctatacaactaaatcctacccatttttcagtgtatgttgctacctatatctcacagctctaatttgacactgtagtgtagaccatgtcctgtcttcccttgatatgtatgaaagtacactcttctggttttcctcctgtcaccatggctgttgcttctctgtctcttttgcagactcactttttctccttggctagtaaatgtgggatttactcaagactgagtccttgggcaccttttcttttcactcacaagacccattctaggtaatttgacctccacctatgccttcaacaatcatgtatgtgcttttaactacaaatttatgtttataagttagattttggaactgtatacctgtcaaggccagactaatttatttaccctgaatatataaccatcttacatttttttattttcttagaggatgatttccattactcactcagcttgacaaggcacaacatttttaaaaaatctttctgatggataataatcaaatagttaacagctctggacactggctgcctgggttcagatccaaagtctacacatactccccgtgtgaacttggagaagtcacttaacctttctgtgtctgttacctcgtcagtaagatgggtacttttcagggttgatgagatgataacatgaaatgtaaatacgctgaagattttagaatcatgcctggcgtgaactaaatactttaaatgttcaccattttccctctgcctcatctcccatctctaattcttttctttatgtctaaagccagccagacacacagcttcccggtgctttagatataaaggctaaaatgtgtagcctggcctgttgtattagcttcgtagggctgctataccaaaataccacagactgggtggcttcaacaatatcagttaattttctcacagttttggagactagaagtgtgagatcaaggtgttggtggggttggttctttttgagggccatgagggaaggatatgttctaggcttctgtctttggcttgtagaaagccattgttatcttcttgttgtgtcttttcacatcttcttccctctatgtgtgtctctttgtgcaaatttttgttttataataaggacatgagtcagattagattagaggcccaccgtactccagcatgacctcatcttaactaattacatctgtaatgacgttatttccaaataagatcacattctgaggtactaggggttaaagctgcaatatataaatttgagagggatgggacacaattcagcctgtcacgtttggttagtcttctgccagcctctccaggtacatttttactctatgctttctcagcctctcagctagccatccacacagtagccttcttttaaatgggccacaatcttccagcctttccagacctctttctaaaagatatttcttcagctagaacactcttaattccatctcactgccccgccccccaccccccacgacccctcagaacacaggccattttgcatggcttatttctgttcatcattcagatttcaggtcaagatcacttagtgaggaattctctcatcttctaggctggatcaattggattatgaatctatcaaagaatgtaacccctaaagcatttatcttgcttcgtaattgtacatccattacatgtctttttttcaccctgcctatttcaccctgaatgatttgtcttaccctttgatctacagatccttttgagtatataacaggaactcaatcagtatttcttaaatccaaacattacttaagtattgctattttgacaaatcaagatctttactattcactgtaaacagctacttttttcccctcatttttaacacctcatttcctctaataatattgcatgtactttgacatcctttcacttgactgcatccttttgcttgagggaaggtttaagaaaggacgcatttttcatcaggtgttctattcccaacacagaaaagttgactgaatagttcttctttgtttgatatttataatgtcaactgattattatgttcaaggtgatttccaagaataacagacaattagagtcaagccatgtttctgtcccctgaaatcctgaacctatgtgtgttggctaatgtgtgtctttgtatgtacatttttacttactctccaaaaatgtaattgaatgtgaaatttttaactagagccagaattccgtagtaggaatcccaacttctacacttactagctatgcaacctggagtaaactgcctcaggaagtaatagtatttgccctgtagggtgatagtaaaaattaaaggagctaatatttgtgtctggcacggggtatgttaggccattcttgtgttgctataaagaaatacctgaggctgggtaatttataaacaaaagaggtttaattggctcacagttctgcatgctgtacaagcatggcatcaacatcgaagctcaaaatcatggcaagaaggtgaaggaggaagcctgtttatcgcatggtcagagagggaataagagagaaagaagggagaggtcccagactcttttaaacaaccagatctcatgtgaaactaactgaatgagaaagaactcatcaccaagaggatgttgctaaactattcatgagacatctgcccccatgatccaatcatctttcagcaggccccacctccaacactgggaattacatttcaacatgaggtttggagggaatacacatccaaaccatatcgggtagtaagcaccaggtgagtgttatctagtagaaggaggaggagaatacatagaattaacaggactagaagtagtaatatatgtaaagaaatatttcagcacttagaatgacatggtttatccttttatatgcctcacaagaaagaagtctcttttgctcacctttgcatcctcaggacatggcaccatgcctgttagatgctccagaaatatttgttacgtgaatattcattaatttattctttcatttcttaattcatttacaaagagttgctttcattgttttagatttagttgtttatgcttattgtaccagtgcctatttatactacactgcaggtctggaaaaatattacattttaaatttaatttgggtgttgatttggactcactgagcctctgaatacaagcctacttgagacaagtatgtaggatgttcattagttctcaaatacagttgatttatattttataacttgaagtactcctgctttttagcatctatgtgtgaattagcatataaagatatgagtaattgttttaatgaaaatttcacctctgcaccactctactgtgactttattgtgaatgcaattaggtttaccatagcgttctccctgtgagcctgtagataaggcatggaaaaattatttcttttactataatcctcctgcttaaatatgataggaaggcaccaatgaatctaataccattaatgttctctctgaactgaaactccttaaatcataaaatatcacataatgtctttttattaaaatattgacattgtttcaaaatgtgcatttcagagcaagttttatatgcgttcctacaacatatgggcatgttcttcatttggtctttcaattaacatgatgattaagacgaagcgcttatttctgtttctgatgtgttatgtccctaccactagtcacgtttcctataataattcatcacacgttatgaagttttttttttttatgtagtttcttttaagctttcctttaatatatatctgatgatggagacttacatataacagagaagttttcttttggaaacttagcatgactatattttagtttcattagaaagaaagagaattaaaggatggatttttaagaataattcattgtagagttgctatactcaagtactgaagcactttaggactcataagggcatccgtgtcttgcataataaagcagccaagatggagtaaaacgtaaaagcagacatcgaggtcattacctaatctggatggattagccatccagatgcctgaaggtcaaggactgaacaagatatctcaaggtacctacaaattctatgatttcatgttattaggctactgagtataaccagagacaagatggccatgtggttggaaatcatgtagaattacaggttagctcataataaaggcaaaaacaatatgtcggttagaaatttcaagtataagtgaggctaaaagtattttgtgaatggcatcactccatcttttataagataaccctatacatttttctctgtgtacttctattgtaaatgtatagttctattatcacacttgccattttacattattgtcgtgtatttatgtgatgtaaatagttataggtaagtcttatttatctgttctctgtaggacctagcagggtatctggtacagtatgtatcaataatcattagattaatgaactaataaattaaaagtgttataccccattagtaacaaatgacaagtcccaaaatattattttattcaaagtatttgatgccttaatattaactgatttgtacagcccattatacattccaagagggcaagggcagtattaaactgcatccctgaacttaacacgttacctgaaacatagcaggcactcaaaaatactcgaaaaaacaaaccaataatagctttcatttatatagcacttcctatgtgccacacattgttctaggcactttaaatacagtgactcatttactttttacccatattctttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatcccatattcttaactaatacaaaatatgggctctctacatggtatagatcagctgtactttcagtaaatctgtgacttgatttgaaaatggaaaaaataggattcatctcctaagatgttctgtgaatattatataaggcagtgtttgaagcatgcttggcctagcgtctggcatagcagaagttttcaagatatttttactattaagactattattattgctgctattattaaccatctcctccaatagttggcataagagaggttatacaattcagaagacaagaatagagaaagcgaatgctatttgtgtcatcagctatttgttgtgtttacatttctgcccctcatctctatatcctcgtaagcacactccatcttccaagtattcctaggttaggtggcatttaatggtatgtgtagaccctgaagatttgattacattgaaaacagcaatagctaacacttctttagtgcatctctatgtcagtcactcttttaagtactttatatatattaacataaaaacccaaagaggtaaatgcactattattatccccattttatagaagagaaacttgagatactgagtagttatgagaagttacgtgacctgtccagggtcaataagctggtaagcagagcagctggtaggtgaacccaggcagtctggctacaaagttcctatgccatgttgctcagtacatttaaaacttctgtaccaaaaaaatcataaacaaaattttaaaaacagatggcagagtaggaagttgaatttaatagaaaaatatctatgcaaaatacataaagacttgcagcaaaccaaaagaacaaaccacaagtaattcacagaagaaatacaaatagttaaaaataaccaaacaacctcactagcctttaaagatatgcaaattaaaacaagataattttaccctcacaagcaaaaataaaacagaaagaaaagagagcaaaacaaaaaaggaaagtaaaaataggactttgttagtattacctactcaatgtctgcttggtatctccacagggatatgcaatagttatcataagtttaacacacccagaattgagcatctgattccccttcacacctgctccttttacagacttctctatttcagaaaacgtcagctccattcaactagttgcttaggcaaaaatatttagagccctctttgactcctgtcttcctcacaactcacgtgaacccatgagcaaatcctctcagctccattttcaaaatttatccaaaattctgccgtgtagttcagcacctccactcttgcctctgtcatcctgtggctggatggctgtgtccccctgttacatctccccctgcttcagcccttgccctcctatagtcttccgttcaacagccaatcggccagtcgttcctttatgtctcaagacagatcatcactagtccctggtcagaacacccccagggtctttccatctcactaaaagtaaatatagagtccttattaccgtggtcttggagactctgcagacttaaccccatccccttctttcagccccaactcctgcctctctcatcacattttccagccctcttctcccaggtccttctctccactgcgatgactgccttgatctttcttatagttggtttctcatctgctttttctctctgccgggagtgttctttctcttagagctccatgcagttcacatcactgcctccccgtctcaggtcaccgcctgagtagagctccccctactgactgttcctgaagatagcatcctgtcctcacacccttcactgtccgccattccctgcattattttgcttcatcctacttaatattttatatattaaattgttaatttgtttattctcttcttaccccttaaactccttcattgactataatatctgaaagcagaagtttttttttttctttttctctgtctctcactaatgcattcctagcattagcccttagcatgtagtatcttttaaatgaacaaaagaatattcagcatcagctgggctctgtggctcacgtctgtaatcccagcacttggagaggccaaggtgggacaatcacttgagcccaggagtttgagactagcctaggcaacatagggagaccatgtctctacgaaatacaaataaaaataattagcaggtgtggtggcacgtgccttgtggtcccagctactcgggaggctgaagtgggaggatcgcttgagcctgggaggcagaggtagcagtgagtcatggttgcgtcactgcactccagcctgggtgacagagcgagaccctgtctcaaaaaaaaaaaaaaaaattagcattgtaagtgttgcaaaatgtataggaaagtaaattttcacaactttcttggaggattatttgacactacctatagcaatttatttatttatttttaagtttcaatagtttgagaggtacaggttttttttggttacaaggattagttccatagtggtgaattctgaaattttagtgcacccatcacctgcgcagtgtacgctataatgtagtcttttatccctcacccgcctcccaacgttcccccccagtccccagagtccattatatcactctgtgtgtctttgcatcctcatagcttagctcccacctataagtgagaacatatggtatttggttttccattcctgagttacatcacttagaataatggcctccagctccatccaagttgctgcaaaagacactatttcattcctttttatggctaagtagtattccatggtgtatatataccgcattttctttattcactcgctggcccatgggcacttaagttggttctatatctttgcaattgcgaattgtgctgctataaacatgcacatgcatgtgtctttttcatataatgacttttttttttcctttgggtagacacttttacccctctcttgtttggcttcaagccaacaacttcacagaaatcaatctttctttgtcctcgtatgttccctcaatccctaacaaatgttcgatgaccacttcttgtccaaattcaatggctttattgctgttctatatatttctgaccataaaactccatttagtactgtcaatatcaatatttacttttgggggcaataaattagacagtttattaattgaagcatgatatatgtatacacacacatatacatatatatatatatatatatatatatgcatacctttgaatggatctatttatgtacaaactaccaatggaatttggactcacaacatcggttataaccaaaagaatgtgccatcttggcctgatctacccctcctcttttgatatccttctatgcctattcttattaaaaagaataaaattgttttaaaagaaagacaattccactcattatatcacttaatgtaatccttgtgttggcacttttgcctttcattgatatagtttcaaccataataatatatgtaatgaaagtttcaaacttttcagaactgcctatttttggcggggagaggtaatgtgtactaaaggtaatccatattttatgtaaaaagtaaacacaaagaagtaaaaatcagttgcaatctcatcatctctacacatctcttattagtttgatgtttattatctccttttttccattttttcatctaatggagtctgttttacaagctgattttttatatagtacataatagttaatgttattaacataatagtttgctattatgtatactttcatgctatcattttatggctgaatgaaaatgccatttttaaccttgaaaaaaatcttttacttgttctagcagctttcttagttatgttttctttattgcaaaagtaaatattaatagcatccatccttaatacaaattatacttggtgactcagtcaatttaatatataatccaattttaaattttgttgttgttgaattattagatgtttaatgataaataacaaactaaaatattctaaaatcagccaataatttaagtttgtctttacattctctgcttcatttggctaaaatgaatacatctttaaaatgactagataaaatgatagtcatttgtcaattaatgataacctttgaggcttagtatagaagatatattgacaaatgggaggcatgtgccaaagctttttgcattaattgcatcagtatgataactttagtcactacggttccttcaaaatgtattcacataggccaacaaaccttcagtcattttaaaaaagcagtagcatctaatagtccaaggcaatagcaatccatgcacttctgtgacagagagggtgtttcaagaattttggcaaagactcacacttgaggaccaaggcactaaaggtattctaagctcagagagccaacggccattgcctgcttagctgaaatgaggtgctggtgtggagaatctgccctaggttgtataagccttgcacagcctgcttcaaaagagagaactggaggagatctagaggtgttctgagggatgtggtgttataaagagagtccattttaactctgcctcacccctttgtgggcagagctgttaaatggcctggttgctcctgtttttcctgcctcgtggaaactaaccaccacttaagaagtgcaactaccctgatgtgagaagtctacttgcatggtcatgacagaagataactaaatcacaacatctttgtaaattatcacatcatggcctctaactataggttggtgcaaatgtaattgaggtttttgccattggaagtaatggcaaagtaatatttgcaggcaaattgactcacaaaaggctgggcttctgggacacaggaacaattaaatgaagagggaggaaaaggaaaacatttatatgtatatgcttcacctttttaaaaaacaaccgagaatttgttaacattcatattatacttttaaagcattttaatttttcctattctataatacctgaaggatatggaacaattacacataaacatacagaaaattagtttaaaaaaccatccatgttccttctactcatcattaaccactatgaacttggaatataaccttcaaggcatctttctgttcaatttatgtaaatatgtctgattatacacaggtgattagcacagaggcagcataacatattaatgaagaccaaagctctcaagacctattgttcaggttcaagtctcagcatcctctcccccaccatcccttaccagctgtgtgaccttgattcattttcttaacctccctgtatcttatacatatgggtatgatactggtgtttactaatcatggggttgttatgaggatatttaatcacttagacttaagctttctaaagaacttaaaatgttcctggtacatagtatgcacaaagttagtgtttattaaatagaataattacatttcaaaagaaaaatcaaagaataggataaacagtattttaaaacatgctttcttaagaatgtggaataaacattcctcatcagtaaatacacatctatgctattgatttttaaaagctgcatagaatttcattttgtggataaagcatagttcctgattttcatacatttatgtcattccattttttgtttataatacatttcaacttttattacgggactttccaaacatacaaaggtagatcatacagtataatgaaccttcctgtacccatcacccaggtacaataattaccaacacatggtcattccttgtaatatattttaaatactcattttattccatcgattctgataagactaagataatggtcttaaagtgaagagcttccacatcttaagcaacaatattagggtatttgtgtttacgttagaaagacatgccttactctgtcctcaagataatggcttttatctgatgccaaagttaaaaagatcagttcctttattcaactccagtgaacatccttcattatatcttgtttccttctgatatatctgagaagaaaatggaataatttagaagatgccagtgggataaaacactatattcctaaatatagtgcagttttcagagctattttagccactgtaattgaaatcctcttgttctccactgacatattttggaagcccatatgtttagagtctgaaatttcattccaaaaatgatagaaagcctcttgatctcagaatggagagttactgaactgaattaaaatgggcaaaggcttcagtaaacttgaggaagtaatgtatggccttccacgtggattaatttcactctctatcctgggaagtatggtacccaggtagcccgtgtgaaaaatatcatgttggtgatgtccgtatgctaccatattagagacaaagtcatacgttctgcgatgctattttctaggcggtttgtttctttgcattacagtagtatattcggcaccacacagaagttaaaattataagagggaagtaaccttccttagtgagactacaactgtgaagctataactaatagacactaagatagaaataaattattcttatgatatataacataagcatgagcatgtaatattgttgggagctctagcagaaagtactacagtagtagtagttttttttttttttaagacagggcccggctctgtcactcagcaggctggagtgcagtggcacgatctcagctcactgcaacctctacctcctgggctcaagccatccttccacctcagcctcttgagtagctgggactacaggcacacgccaccatacgtggctgatttttgtattttttagtaaagactgtgttttgccatgttgcccaggctgctcttgaactcctggcctcgagcaatccacccgctttggcttcccaaagtgatagtactgcaggcgtgagccactgcacctggcccagtagtccattaaaaaaaaaaaaaaaaaaaaactcattgagcacctactttgtaacaggtactgttgtaggtgctagggataaaatatacttgtttctcctactggatcttgcttttcttggagaaagaaagaaacacaatgtcttagtccattttctgttactataacaaaataccacagacagggtaatttattttcaaaaaagtttattcagctcatagtctggaggatgggaattttaacagcatagtgctggcatctggtgagagccatcttgctatgtgataatatgtcgaagggtatcacatggtgacagggcaagatctttcttcttcctataaagccaccagtcccatcatgggggctcacccttttgactttatctaatcctaattacctcccaaaatccccgcctccaaatacgatcaacatatgaatttgggaattaagtttccaacacataaagtttggggaacacattcacaccatagcacacaataaacgagcaaaaaatactatattagatcataataagtgacatgaagactgatgcaacaaaataaaggaggtaggaggtaccagaggggaagaatggttattgttatttcagatacagtgttccaggaagaaactggtatctgagtagagagttaaaggaagtgagaaagtgcatgttgaaatcggtgacagaggtaaagacaggtgcaaatgtcctgaggcaggaacatatatcatgggcatattctagataaggctttggcttccttatgcttcctttttagtggggaagacagaacgcaaagcaaatgcaaaataaataatatgcagtcaggttgagattagtgttatggaataaaagaagagagagtaaacaatgggggaaggaacaacattaagtaggataatcaggagacttctctggagagatgacccttaccctcagacctaaatgatacactacaaaataaatgcctgtacaatcactaaaggattaacacaaactgaaggtaaaaaccattgtgtaagcgttttcctgaattcaagaattagattattattctgaagctattttaatattgggaaaatcttgttagcatttttttctgacaaagttcaaataatgatttctgaaatttaattctacctaatactaggtgtactttagaaaaataaccaaaatgagctgcagaagtattttactttattataataaatattacagtatgcatcatgaaatgaaagaaaaataatcctttgcctatagttttattatctccaaatgagtagaaactgaatgatgcatttggcaaagcacataaaacttcacttaagagatgtctgttaatacttgctgagtggaaaataatagctagcatttgtttgaacgcttgatgtgtgccaggtgggacactagggattttacaaacactaatccatttaagactcatacacctctgcaaggtatgtagtactattcttcctcctaggtagcctgagtcagtgtcaaagaggattctgtcttgggtctatgtgatttcaagtactgtgctcctttaaccccactcttaattgtgaaaatctttatcacaggactctgaaacttcctgtgattcactttctccatggtgtccacagtcctttcatgctatatgtaccacaaatagcatgaaaggacttccttttaacctaaagcctttttacaattaacccttgcaatttacgctttttgatttttgtggttagtgtctgttcttgtcaaaattgtgaattagagcaagtttctccttgatgtcatcacacttctttgaagtcatcaagcatttagttctcattaggcagaacaggccctggcgactcaaagtgtgagcaggagccagcagcatcagcagcatccccaaatctgctcaacaagagtattaacaagatccccatggaatctgtaggcacattaaagtttgagaagcgcagcgttaggccagcatcagcaacacttgggaccttgctaaaaatgcattatttgtacccgaagctccaggaatgtggcccaagaatctttgttttaacaagccctgcaggtgattctaatgcatgctcctagagagttactctttctcgggattgacatcagcaataccgacctgttgcaataaatcagtcattctcaagtctgtctgcatatgagaatgccctggaaagcttgtagatcccaggttccattccaatatagttggtctcaactatattccaatctgcaggatgggaccatggcattagtgtgttgttcgtttgtgtttgtttgttttcctgtgggctcctcagtgttaaaaatcattgccatagaattagaagatcagtattttaccactctcaagggatttactttttaggagaaattcgaatctccccaaaatagtgcccaaaggactaatctaaacacctgagttaccttcactgactatataactgccacttctgcccttcagcatgacactatgtctctttcctcattgaaaaatacataaaaggggaaattgtaacctctctattcccattggactattgttgagatgaacaaatgagtgtgagagtaggcacttgagaattctcaagtgctatacaaaaaaaaaaaaaaaaaaaaaaaaagctcgtggtctatctgagggtgggatgcagctctgctctgatgtgtaattatggataagtgatcagaagttcagaagttctcagacatcacagggactgcagctttttatttgtttgtggtgtcagctgaaaaagtgctaatgagatacactggggacagcctatggaaaataatctcatgaaatttttagaaaaagggagtatctatgatgatagttctgaaactccaaagctgtgctcctcagactttaatgtacacatgaaactcttggggatcttgttaaacaatactgaatcacaacaacaaattgtgattcagtaagtctagggtgagggctgacagtctgcctttccaacaagctcccaggtgatggcaacaatgctgattcgtagaccacacttttgagtagcgaggggctaaaacatacacaataattaggcctgttattttgcagatgccagtgtgattaatgaatcctgcctatgataacattcacgagtctgccctgaacatttttctgttcttttaaccctgattgcctttgccctgtagctcacatatgatctgtacctcctctttcttgcttacatataatagagcatattttatatatactcatatccagttataattctctaactatgagcaattgttttgttgagttttgttgtcagtgttcatatcataaattgcctcccccaaccttctttcatctctacaattcctttcactcttctttttgaactggcctgtgagtgtgctgttcttgccagattaaatgaatcagtcaatgggaatcttattcttaagtgtattggatcagatatgtacaagtgttgctcatgaggagagaaaagaagatgggcgtgcatgctattgattaatgtagtcacagaaatgcactggtcaatatgatacaagctgtttgcaaccgtaatagtcctgtgctgaggactattaaaaaactgaattggttaccactataaccactacagttatgcttttatttgggtaaaaataatctagcatgttgtggtttagcaacagaatgctgaagaacaccccgatgtgatgtttgaaggagaaaatccaatctattcagcctaatggtttgctacagtagttgaaaaaggcataaaaaatccaatctcctgggtagatgtagctcattgagtggggcatgggctggatttccatacccatcattccttggctagttctcttctgcaggacgtgaccttcacatctcatactgagtattgtgtaatcatcttctggtatctttcttctcttatgtccctttactcattattctttgttccccttttcatctttagtcttcctaagggcttctcagtttttttcacaggggtatatagatcagaaccaagtcctttcctaagcctgtgtctttatttcacaattcaacaaggaaggacactacagatcacatagctcacctccatacatcagagtataggccttactgatacatgcacacatagaaacaacagaagctggcggagcatggtggctcacgcctgtaatcccagcactttgggaggctgaggcgggcggatcatgaggtcaggagatcaagaccatcctggcgaacatggtgaaaccccgtctctactaaaaatacaaaaattagccgggtgtgggggcgtgcgcctgtagtcccagctactcgggaggctgaggcaggagaatcacttgaacccaggaggcagaggttgcagtgagctgagatcatgctactgcactccagtctggtgacagagcaagactccatctcaacaacaacaacaacaaaaaaacagaagccaataaataaattctgcagatctattgtgcagcatggtgactatagttaataataatgtgttgtgtattggaaaattgacaagacagatcttaaatgttctcaccacaaacataactatgagaggtggtgcatatgtaactatgagaggtggtgcatatataactatgagaggtggtgcacatataactatgagaggtggtgcatatataactatgagaggtggtgcatatataactatgagaggtggtgcacatataactatgagaggtggtgcatatataattggcttgattgtggtcattatttcacaatgcatactgttaacaaaagatcatgaaatttgcaggggcaaaaaggagagctttactttcctaaagaaatttgtaggtgggggagacgcccctttgggacagagcaaaagtgtgctccaaggagacactggagagttaaagattataatggcaaaaactgcaagactggggagagggatcagagtcttgattagatgacatttaagcctaaaaccacaaatctctctttgttttctgactctaggtggtcagtggttggtcacatgaggattttccagctgtagtctattttgagattgataacaggaactggtttagcttgattgcagaaaggggagtctcgtgacatttctgcaacattttttgagaacacagtgtatgtgactacctcctcatcttgctgtggcctcccagttctgctttaacttgagcatctcagccacagggggtttattttatctatatgttggggcataatttgacaatacatacttcaaaacattacattgtacactgtacattatacaatttttgtccattacattttggtaaagctggagataagaagaaaggcaagggggtaaaaggagaaacggaatacaagacaagtattaatgaatattttactacatgtaatgtttggttaattataagatgctaagctaaacaaaaaatgattttaaaaatgtcatacacaaaaattattaaaagttttattagatttccattaattcatctttaatgattttacagaatgacaaatgtgatgttttcttcattttaacccagtgtacaagtaatacattttttcttcaaagagtagtttcttataaaaatgtatagttttgttttaattagtaatccaccgaattacatcattataatgttctttataaggggatttattttctattatttaaatttcctctgataaatttttattgtgatatctgccaccaacatcttatagttaaaatagtatgcaaactaatggtcgtgcagatagttactagtataggcttaatactatgcaatacaaggagatgctttcattaggccaatggtttcttatataaaaattacttctttaaaggtctgtacagctagcagaatggcatttgaggggatttaggtctcagcctaattattacctttttagagctaacttctgtgaccaacacagttaaagaagttcaaagatcaccttatttaattttctacataggacttattaatctctgataccatgtggtggtttcatccttgtttaacagtttttctgactctcaatttcaagagggtaggacacttctcattttattattgtatctttaatgtctgtgacaattccaggcagcatggtacataggaactctataaaaattattgaataaatgcatgaatacatggtcaatatattaaaataaaattaaaatttaaaaaaaaagccataaaaaggtaatttgagactgggcacggggcagtggctcacacctgtaatcccagcactttgggaggccgaggtgggcggatcacttgaggccaggagttcaagaccagcccaggcaacatggcaaaaccccgtgtctacaaaaaaatacaaaaattagtcatgtgtggtgacacatgccagtaatcccagctacatgggtggctgatacaggagaatcccttgaactggggaggcagaggttacagtgagccgagattgtgccactgcactccaacctgggtgacagagggagaccgtctcaaaaacaaaaacaaaaaaagataatttgacaaaaatggaagtcgctcaccaaatactttgaataatgtacctactgtgattttgtatttcaagctacaaaataggaaagacattgttcttccttatttttgtttcttttctaacctttttcttttattattctataatatattggcatttcctttagcaaagggagttgtttggccttgcatccttcatacaaatagcaaatatttacacatacacacactcatcgctatgtaagtcccttgaagttcaagtacacagttactcatctgaggtatgtgtgtgtgtgtgtgtgtatatatatatattctgagtgtgtattttgcagctctagttttttataaatgtgtttctcacccctcgtagtcatttgtatgcacttaatgtaattgtcagaagttataaataaatatgtggttgttgtattttcatcattaggttgtaaattccttgtgggcaacaagcatcatataatgaagaaattaaagaaatcagaaccattacattgaaaacatgatgctttcaaatacacttttgaatgttcacctcagtgttctaattaaattctaatttcggtatacatatctccttatctgaatgcctttagcaatttgaagtgactgagtattctgattcatcccatattcaatggaagcatatcaaaattgtctgccatttaactgtgctatcacaagctataaataggacactactctctgccaaaggtgaattaattgtgataaagctatcttgataaaacttattcctcacttaagtgaaacatgcagtacctgattaatttctgcaacagctgtgttaaaagctctgcacttaatatcaaacttctacttcagtatatgtcaccatttttacagaaacagaaagtcccttgcatttgattagcctcaaattatggctcattgatgaatgcaaataatcaaacaaaaaaggactaattgtatagaacaagtaaatattatacatacagtgctcatttgcctacaattacacaggtaatgtctctatttagtttcttaatttctcattatgagacaattgcatctcatctagcagtatttaattgcattgtttctattgctagaataatagcatattcctttttttaagatgttgaatgacaaataaatttagattgtaatcacttattgttccttctctaagcaaaatcgcccaggcgtttcagttgcaatgaaaagttttattttctactaatgatggccaaaatgggagcattctagataagtctgtatcctgtctatcaccttcttcttcagttgtggtcataaccatgatcttaataagtctacttgactaataactttactattttctaaaggtgtcactataaaatcttacaatatttaacctcacataccaaacccctacaataatctttgtttctatttgtaactttacgtgtctgcattggtaaatgtcaggtacatttggaatgacaaacatgcagttacactgagtctagtttgtagtttcttatcctaattctcattctgaccttaacatcaaatcctctactatgagacagcagtattaaataaaactatcacctagcttctgagttatcttgtaagcataagtgaaatcttattcacaaccgtaagtgaagtcttgtaaccgtaagtgaagtcttatttacatgtttacatgtgttttttatgcttcgtgtattttctaaatgattcacttgctcttagccttttgcaaaaagtataattttttattgctgccgtaataaatacaacaaacagtggcttaaactacacaaatttattatcctatagttccataggtcagaaacctggcacaggtctcacttggctaaaatcaaggtatcagtagggcctcatttatttctggaggctctaggaaagaatctatttctttatctttgtcagcttccagaagtttctcacattccttggctcatggtcccttctgctatctttaaaggcagcagttatcagttgagtccttcttacgtggcatcactctgactcttctttcattgtcccttttctccctaactgcagctagaaaagattattcatctttaaagactcatgtgatcagtttgggaccatctgtataattcaggataacctccccactttaaagtctatagccttaatcacattttcaaagtccctttgccatgtacaaggaaatattcatatattttagtgatgaggatgtgggcatctacagggggccattattctgcctactacatatggtctcttattatttagcatgtctagtgcagttgtgtggggatgctggacttcttaacatgtgacattagttaggcttatgaagtcaagcattatagacattgcctgttaatgttgaagcaagcttgaacagagccacgcttcatctctagccttggtttgcttgtttttcctttcatttattattatttttcagtgaaaattgataatagagctgccttttctttttgcactggcattattgcattgcactactgaagaaatcactaaatctgtttattttacagaaaaagattgagggtccagttaaatttgtgtttattcaggacaatgagctctgtttttctcacttgggaattctccctcttgagacagatttcccaggtacgaccaagagttaagagatcaaagttttgtctggtgagaacagaacccaaatctctaggcaactcttgttaactaattttggggataccacagatacagattggagaacttttagaaattcatatcaagtttgatttatttaatattcatatttaatatgttacatgaatgtataatccaatgtaaatacgatttatttattatggaattgtttaatacatgacatgcttatagttataccgttaaggaatatctcttattttgcaacattttacttttttcctctcccaagtgctttgtgaatttcactaaataaatcagggtaaaatgcatgtagtttagtctaaaaatacttaataatccacccagagggaaaatatattttaatgcttgctgcataaccttaataaacagagaatactaatgtgcacttataggttaaagtaatatgtttaaaaatcatttcaacttttattttagagtcaggggatacatgtgcaggtttgttacatgggtatattgcataatgctgaggtttggggtgtgaatgatcccgtcacccaagtagcgagcatagtacccactaggtagtttttcagcccttgtccccttcccccactccccacactagaagtccctagtgtcttctttgtccatctttatgtccttgcgaattcaatgcttagtatcatttttttgaaacagagtctcgctctgttgcccaggctggagtgcagtggcacaatctcagctcacggcaacctctgcctcccaggttcaagtgactcctctgcctcagcctcccgagtagctgggactacaggcacgcaccatcaggcccggctactttttgtatttttttttttttagtggagacggggtttcaccatattggtcaggctcgtctcaaacccctgacctcatgatcttcccgctttggcctcccaaagtgctgggattacaggcgtaagccaccgcgtccggctgcttagtatcatttataagtgagaacatgcaacatttgatttttttgttcatgcattagtttgcctctagttgcatctatgttgctgtaaaggatatgatttaattcttttttatggatgtataatattccatgatgtatgtgtaccacattttctttatccagtccactgttgatgggcacctgggttgattctatgtctttgctattatgaatagcaagatgctggacatttccttaggttttagatggtttcttttgaaatgtatattgttaggtttaatcagtcctttgtatatagttgccttttgtgagaaatacagtaccaggtagcttgatataccattaaaattaagcatatagatttacctgctgtctctaatgccgttatgtgtgacaattcccatatgaggtaaatttaatgagttcgtttcttttaatatctagactaactaatgccttcaggaaagtatgaaagtatattgtgtctctttagtgaattccctttagataggcttaagatagccatatggctctaaacttactaaatgcagaaaatttaacttagctttacttctttcattcttaggaaaacagtcttcattttgttgattaacttccatttaaatgcttattttatactgtctttatttggactatgcttcattaagcctcaatttccatttaattttgcttgtgtcttattgttcgagttcctatgtctcagttcactaatgaaatgttttctaacctgtgaaaattcagaagagcacaaagatccatataaaagtacatttccagtttctaaaagaaaaattaaggtctactgggactctggtacactgcaaaacataaacactattcttactccaaattatagtcattgaggtctttcaattcccagctcccatatgttaaatctacctatctgataatgatattagttgcaaatgctttattgcttccctttgtatcctgtttcagtagctgttccttgtaaccttatcttgacattttcaaattcggtttgaaaatacaactagagtttaccattatttatggaaggtaaatgttaactgacattatatttacatttaggatgaaataggtgaatgctcaggtacaaataaaactaagtttatttatttctctgcttaattcaaaaggtgtataggttcaggtcatagcatagtttagggcaaagaaagtagaaatgagaacacagaacgcaggaatttgtcagttttgtgcatctatctcgtaatctaatctcagctaatgggactttacatttaatcacctttccagaccaagtctccagacccagctgaagttgctgttcatccatgcccaaatctcttttgctgacctcctaatcaagattctagtgtgttagcgataaggtgtggcaggcaataacccagtgatcactattgcttgtttcccccgacagttgtgccctgtttacacacttgagtttctctccttagttctgatttagagccctcggccaggttctcgaaatcactagtgatcttgaattcaaccacatggcttgcattctagcccttgtgcccaaacaacatgatcgaatcatttcaattgaaatacatactatcgctattgcactcagtctccatccctactgtctctgtctctgtccctgtctctgtcttcctctctctctctctctctgtctgtctgtctctccccttgaacaacctggtccttaattccaggcctattctctacaataagttcagacatttttctgcagtccctaagtaggcaaatctgaagacctcctagaacatccagcaagctttgcagttatatcatactgcagctatgaccatgcataacctttatttgacttttatttgaaaccatattttaatatactgtatttattatagagaagtttcttacattcaatgtttctaaatttacctttcacctatatatggtagctccctacatatagaatattaaaatttactgaagtaaaaatgtatttttttctcttttaaagccaccataatttgatacaattaaattatacggtgatatagtttgcatatttatccccatccaaatctcatgttgagttgtaatctccaatgctggaggtgggacctaatgggaggtgtttggatcgtggagacagatccctcatggcttggtgttgtctttgcatcagtgaatgagatctcacaagatccagtcacttaaaagtgtatggcatctccctccacactctttcttattccttttttttttttttttttttgccatgtgatgtacctgctcccccttcaccttctgccatgattgtaaacttccagaagcctccccagaaggtgagcagatgccagcaccacgctccctgtaaagtctgcagaaccatgagccaattaaatccgttttcagtataaattacccagtctccagtatttgtttattaaaatgcaagaatggcctcatacctgtggtttaactgagcacttaattcctttattattttagtgcagatgtctccatttttttcctttgttcatgaaacttttattgggaaaatgctaaatgagagttttactactatgaccacggagagtaggatgcacttgtgcaaagtctgggacctccagaagcttgcaatttaatcagtgaaacagactggacataaacaactctcttaacttctcagtgattggaaatgcaaacagtattctatttaaaaatgccatctggctttcataaggtttggaaaatacttactacttttaaacagcaaatcctccaatatttgaggtttgcaatgctaagcccatagggcatgaggcaacataaccctgatatgagtaattttgatgaattctccatatttagaagtaaattgtgtatcttgataataaattttataatttcattattgagtttcttcatacattttggaaaaaccccacggccctctgatttatttatagctgatttgtcagttagatgtaaaatttcctgcatgttgatcacataacttgcttttcctgtttgatttttttgtcctctataatttttttcagctcctaggtttatagatatttttaatgtagcccatattataataattcaacaattttcaacatctttaaactatgatttaagtatattttgctcattaagaattgctacctcctaaatttaataagaagattgaaagaagaatagctgttgacagtaattaataatattcttccatgtaggagctacatggcaattaattatttttcaggaaattcttttcacttttttgttaagaatatttcattatattatttttcagcactgtcagttttctaacattcatgtagctgttaatttattcataacttgaattcattttcagtgtcattcatgcagctttggctttttttcagcttgcttatattattttgtatatgaaaaatggataactttttgactaatttccttccacattaaaactgtgtagcattcttttctggttctggagaaaatataataatttaaggagatacattatgccatttatttcaatatattttaaaaccagtttattttcatgctatctaaactgctaactggttcatcttaaatttggtgatcctctatagtttaataattgtcagaataaagtgtttgagtaatcaagaatagagctaacaccaatccattagtttatatggtttgtactgattaacatcatcccattctgccatgggccttctcacaaaaatcttaatgagaaagagagacagagacactaaaacagtttagtgagaagtcaccaaaaaatttcttactagttacttggcacgcaataaggttgtccttgccaatgacgctaaccatgatgacatattaatcaatcaagaaatggtcatttatatcaataaatattcagttcttctattatttctcctttgacagtcgtgatttttctgtcagtctacatcaccattgcttccagatgagcctcttttagtccctctctatggtatgcccaagttctattcttcctcactctaggtggctgcaaacagttcttccccctcttggccatgtgtgaaggaggatggaaatgtgatttctgtaaaggctcctgccatttactttgcctgttacattgtctggcatttgcttcatttctatttcatttcttttcattgccctcttcattgtctcttactctcctttcttgtttttgcctcttaatctttattgatttttttctttatttgattccttacgcttagtcctcttcttctgtcattcttaatgaattcattcattttctattgtttcaattgttttctttttttttgttttttaaattgtggttttttcttttttaaaaaaaattttctctttagttttcatcatttaaaaattagcacagatagaatattccttagattaggtgcacacaaatattgaatatgtcattaaataacccgttattttatattatttgtactgattaacaccataccattctgtcccataaattcagaataaacatattgttttttgtatgttgtatgtcgtgtatgtataaagccatcttataagtttcactctgcatatgcctaggttacatattttggcattaagaatatcattaaaagccaactgtttttgagaaaacttttaatgttgggatgtaaaaaataaaccttattgaattcatcataattaaacagatgaatagcagcaataaattcagatcctgaataagaatcaaaccacaaaggttctttgttgactgaaacacaaaaatatgtgtgcattaattttattcttttgtaaagtgttactctaaataaaattactggagataatatcttgggtctcaacaatatcatgctttgcaaagtatttgtcactgctaattgaattttgtgtgtgaatataatgcatatctatacaaatagaacagcctctaattgaatctgggaggatttgaatattgtttgagtgttggccagtctactgacagatttaatcaagaaatggatatttatataaaagaattgtgcttaggagtaataacccatttagtcacagattcagtgttaacggattgaaaggtttgtggtatactctggctctatgagttttaatgaggcttcgtttcctcactttttttttcttttattcaggaagtgttaatgtagcatgcatttcagccttatgattttgtcaaatataatgtttatgttttattcattttggatcccctcctagaactgttattcacatatttgctactacacacatatcagatgagattcattgcagaacacacaactttaggctatatgtcaaatacgaatataaaatacaaatacataggtcagttcatttgtcattcacatttaaaagtggaaggtttaatataatcaattctctaatcccggtacaactgttcccccaaatctgttgaacccagccctctttctgtttgcttcctcaaagtaatgtaatggattttaaaacctatggtaaataaaccagtagaaattgaacttgtctattgaattataatctttgctgtttatttccttctaaacaagtttttattgatatataatatctgtacatattttgggggcatatgtgataatttaatatattcatataatttgtaaagatcaaatcagtgtaattgagatacagtcaccttaaatatttgatctttctttatgctagaaacattagaattcttcttttttctttttctttttcttttttttttgagatggagtctcactctcttgcccagacctggagtgcagtggcacgatcttggctcactgcaacctctgcctcctgggtccaagcaattctccctgcctcagcctcctgagtagctgggattacaggtgcatgccaccacacctggctaattttttttgtatttttagtagagacagggtttcaccatgttggccaggctggtctcaaacacctgatctcaggtgatcctcccatctcggcctcccaaagtgttgggattacaggcgtgagccatcgtgcccagccagaattattcttttgtagttattttgaaatatacaatagattattgttaactatagtcaccctactgatttatcaaacactaagtcttatttcttttatcaaactgtgtgtttgtacccattactcaacttatctttatcccctctttcccttacccctcctggcctcaggtaactgccaatctactctgtatctttatgagatctactttttcagctcccacatatgaatgagaatatgtgatatttatctttctgtgcctggttaatttcacttactaatgacctccatgttcatccatgctgctgaaaatgatttaattattttttatggcggaataatattatataatatgtacacacaatacatggctgaataatatttcattatattatgtatatgtatatatgtcacattttatttatccattcatctattgatgggtacctacactgattccatatttgggctgttttgaatagtgctgcaataaacatggaagtgtagatctctctttgatatatttgtcttttttcttttggatatatacccagtagtgggattgctagataatatggtagctctatttttagttttttttgagaaccctccatacagttttccataatggctatgctaacttacattcccaccttcctctacatccttgccagtgtttgttagtccctgtcattttttaaagaccattttaacatgggtgaaatgatatctcattgttgttttggtttgcatttatttgatgaataatgatattgaaaatttttcatatatctgttggccatttgtatgtcttcttgtgaggaatgtctattctgatcttttgctcatttcttaatcagattatttgtttttttgcggttgaattgtttaaactcctcatgtattctgactattaatcccttgtcagatgggtagtttgcacatattttctcccattctatgtgttgtctctttactttgttgattgttttctttgctgtgcagagctttttaggcggaggtaatcccatttgtctacttttgctacttttgctttggttgcctgggcttttgaggtctcacacaaaaaattctttgcccagagctatgtcctggagcatttccccaatgatttttttttctagtagttttatagctttaggtcttagatttaagtttttaatccattttgatttgatgtttgtgtatggtgagagttagaaatcttttttcattcttctggatgtgattggttatccggttttcccagcgctatttattgaagagactctcctttccccattggatgttcttgttgcgtttgtcaaaaatgagttgtctttaaatgtgtggattaatgcctgtgttctctattttgtaccattgatctgtgtctatctttatgtcagcaccatgctgatttggttactatgtctttgtagtatattttgaagtcaggtaatgtgatgcgtacacctttgttcattttgctcaggattgctttgcttatttgagtttttttttttttttttgtagttccatgtgaattttaagtttttttctatttctgtgaagaatgtgattgatattttgatagggattacattgaatctgtaaatagctttgagtagcattgtcattttaacaatattaacaatattaattcttccaatcaatgagcatgaaaaatctttcattttttatgctttttcaatttatttcgtcagggttttatagttctctttgtgtagaactttcactcctttggctaaattgattcctagatattttatattctttgtagctattataaatgagatttctttcttgatttctttttgagattgcttgctgttggtgtatataaatgctattcatatttatttggtttttttgtatcctgcaaatttactgaatttaccaattctaacagttttttggtgaactctagttttttctaagtataagatcatattgcttgcaaaaaggctaatttgatatcttcctttccaattttgatgcctcttatttctttctcttgcctagttgctctgtctaggacttccattattatatcgaataaaggtagtgaaagtgcgcatccttgtcttgttacagatcttagagaaaatttcaattttttctcacttagtacaatattagctgtgggtttagcatatatgcattttattattttgaggaatgttccttctatacccagtttgatgagaatcttttttatcataaagatatgttggattttatctaatactttttcagtatctattgaaatgatcatgtggtttttgttctcatgtccttgtatcgtatttattgatttgtatatgttgaatcatccttgcatcccaaggatgaatcacacttgatcatggtgaatgatcttttaaatatgttgttgaatttgatttgctagtgctttcttaatgatttttgcatctgttttcatcagcgatattggcctatagttttctttttttgttgtgtccttgtcttgtttttgtattcaggtcttacagaatgagtttggaagtattttctttttgtcaatttttttgaagaatgtaaatagaattagtattggttcttcttcaaatgtttggtagaattcagcagtaaagccattgggtcctgggctattccttggtgggagacatttgattatggctttgatctcattaccagtttcttcacattttctatttcttcatagttcaatattcataggttttatgtgtcccagaatttatccatttcttctaagttttccaatttcttggcatatggttgttcataatagtctctaatgattctttgtatttttgtggtctcaattgttatgttttctttttggttcctgattttatttatttgggccttctgtctttttttcttagtctagctaaaggtttgtcaattttgtttcttttcaaaaagccaactttttgttttgtcgatcttctgtacttttttgccttatgtcctaccattaccagagggtctcctatattccagggttttgtttgtttgtttgtttgtttcaatttcgtttgtttctgcttagatctttattatttctttccttctactaattttgtttttggtttgttattgcttttctagttccgtgaggtgcattgttaagttgtttatttgaagtctttctacttttttgatataggcacttattactatgaactttgctagtagtactgcttttgctgtgtcgcatagattttggtgttgtatttctattttcaatcatttcaagaaagttttcagttgcccttttaatttctttattcattcattgatcattccagagcatgttgctaaattatttttatttttatttttattttattatttgagacagggtttcactctgtcacccaagctggagtgcagtggcacaattacagctcactctagccctgacatcctgggctcaagcaatcctctcacctcagcctcccaagtagctgggactagtggcatgtgccagcatgcccaaccaatttttaaaaatttttgtagagacttatatttcccatcttgcccaggctgctcttgaactcctgggctcaagcagtcttcctgcctcagcctctcaaagtgctaggataataagcaggagccaccaagcccagcctgaatcctttttttttttttttggtatagagtcttgctctgtcaagtgcagacttgacagagtgcagtggcgtgatctcgactcactgcaacctctgcctcctgggttcaagtgattctcctgcctcagtctcctgagttgctgggattacaggcaccccgagcctgaatttttacgtgcttgtgtagtttccaaggttcttcttgttattgatttctagttttattccattgttgtcagaaaatatactgatgtgatttctacttttctgaatttgttgaggcttgttttgtggcctaagagatggtctaccctggctactgtttcatgcactgataataaagaatgtgtacttggtaacagttgggtgaaataatttttcaattctagatagccctatttggtttagtgtgtagtttaactgtgatatttctttgtcgattttctgtctggatgatctgtccattacttatattgaagtgttgaatcccatacttttgttttattgcagtccatctctccttttaaatctattaatgtttgttttatatacttgggagctctggtgttgggtaaataggtatttataattgttccattctcttgctgaacagaaccctttatcatgatgtagtgaccttcttagtctctttttacagtcttttattttcagtctactttatttgatgtaattatagctactgctactcttttttgtttaccagttgcatggaatatcttttcccaacacttcaatttcagtctatgtgtatctttataaatgaagtggaattcttgaaggcagcatatgggtaggacttgtttctttatccattcagcagctttatgccttttaattggataatttagtccatttacgttcaatgttattattgataagtaaggacttactactgccattttgttgcttgtgttctggttgttttagaactcctctctgttcctttcctattgtcttcctttatggttaagtgatttttctctggtagtatgttttaatttgttgctttttcttttcggtgaatgtattattggtttttgctttatagttactatgaggcttatgaaacataattataacattcttttgaagagacgacaacttatcttagataaaaaagaaaagaatagaaacaaataatgaaaatataaaaataaactctacattttagctacatccccccacagtttgactctgttttctcaatttacatagatttatattgcctatctcttaacagcttgctgtaggtattattattatgaaagatttgtcttttgggcttcatactacagttatgtatggtttacacaccaaaattacagtattagagtattctggatttgtttttgtacttaattttaccagtgggttttacaccttcaaatattttctttttgcatgttagttttttttcagatcgaagaactctcttttgcatttcttattaaacagatcgggtcatggttaattctctcaacttttgtttttctgggaaaaacattatttctcattcatacttgatggacagttttgccagataaagtgtttttgaatggcagttttttttttctttcagctctttgaaaaatgtcatcccaccccttcctgtccttattgagaagtctgttgcttatgaacttggaactcctttatgtgttatttgcttcttttctcttgctgcttttaggatctggtatttgtctttgacttttgagagtttgttgattatacaactttgagtaatcttatttgggtcgaatgtattttgtgttctctggccttctcatatgtggatatttgtctcttctcatattttagaaagttttctgttattatttctttgaataagctttctaccccttgaccgactccctcttgaacacaaatagtttttagatttggtctttttaagtaattttctatattttgtgggtgagctatgcttctttttattatgttttctcctctggttattttcaaatactctgtcttcaagctcactgattctttcctctacttgattcattctgctcttgagagcttctcatgaatttttcagtccagcagatatatttctcagtgccagtatttttgtttgatttttaaaattatttctctttgctcaatttttctaataagtttctgaattcactagaaatttttctgtgttatcttggaaatcagtgaatttccttacaactaccattgtgtattcttgttcagagagttcacatatcaccatctcattaaggtcggttactggttccttgcattgtccatttgaggaggtcatagttccctatttgttgtttcttgtggatgtatatctatgtttttggatttaaggatcagttatttattccagtgttccttgttttaatttttattggatgtgtttgcttaaagattcttttaatttacctgttgatttgattttctcttcttcttcttctccttctccttctcctcctcctcctcctcctcctcctccttctcattcttcttcttctttgtgcgtgcgtgcatgtatgctacttccttttcagcaccaggtggttccttaagcacaggtttgctttggttctagtaaaccatcagagtgcttcctgtcctgaatgagggaggtatccaaggggatattgcagtactatgggaaggctatcttgggtttcatgcccagggacctgtggaacaaacttcctacagtatagtactgctgaatggccacctaatttgttgtcttttttttttttgctgagttacagagtagtttccagggctgagaatggtagtctcacctcccctttgtatctctggctgtcctcggggatatttctgtcttcaggtactcctgatgtttccagtgggctgaggcagagacagttctgcccagaaacccaagatggtggggaaagtcattgctcacctcaatctcactttcactagtttggaaaccatgagttgtggggacatttttttttgcatacttggtgccaggtagattagaggagagggagtgtcatggatgtgaaagactgattctcttattctctgtcagagtttcttcacttctctatggccctaagaactgtctcatcctcatatttgagttctgggatattgctggtaataatctcagtgttgtgcatttgtttttggttttctgttgaggggaggaagtaaagccagcttagctctgcatcaccattatgaaaccagaagtctgtgcttatttattattattattttatattttattttttctttctttctttcttttttccttccttccttccttctttccttcctttctttctctctccttccttccttccttcctctctctctctccttccttcatttctcccttctcttccctccccttctctcccctcccttccctccccttcccttccctttccctcccctccccttcccttcccttcccttccttcatcttgctctgtttcccaggctggaatgcagtggctcaatcatggctcactgcacccttgacctcccgggctcaggcagtcctcccatctcagtctcccaagtatcagggactaaaatcgtctctacaattaaaaaaaatgtagagacatagccttgctatgttgcctaggctggatgtgcatctttattcttaaaaaaacaacttacggaaggactcaaaacatatgataccctcaaaagcttccattttagatagtacctatagtgtgttcaagaagctagctaacattctgttgttttctttactgacaaatttaagccaaagtttctaaatatggcattttacatgaggaataagtaggatttagctgtgcctattccagtattgataatacttataatctttaaaaaatagagaaaagtctattgaaaattgtaatagctgggattttcatttactttttttttggacttagcttttgtggtagaaaccacatgacaattagtctgcacaaaatcactgtaaactctatagtatgtacttggagagaacttgtttccttagaaatgctataagatttagggactttaagaaacattttcccacatgacagataacaattttggtggcaaatcttcattgtgaaatcaatctcctccttctactgttttttttaatacttaaaaacattatctggatttatatctctgtcctatagaaagtatgtcaagtgtacctgtggttgtcactcattaatgcacataagaaacacatgaaataagtggattcctgatcccagctcaaatacacttaataagagtatccgactttaggaagcaggatttttccagtttgtggatctgagtctcatgtgaactgttaggtaagaataattgtgatgtatgcaatttgtggacttaactgttcccaaaaagaagggtgtctgtctgaaaggctagcttaaattcaatggttactgaatgaaaataattatttttgtaagatattttctaaaatgtgattggtttatatttgacaactatataaaacaggatttctgaggctaaaattgaattgcatatttggttccaagcctcctaatacccaaagaaaaaaaacaatgaatattatgtgctttacattgtctatataaatttttgaagacatccaggatcatttacaatttctccaagaatattgagccttcataaacttgaaggattgaaacattagaggtgagtcagccctcactaatcccttaagatcaaccagtatgatatggaataagtctttatgtgagaaaaaataaaaataaaaatagaattgatggaggactagagattttgatgctgtaactccttggcagtgtcctacaggtttctaggtacagtcttgcctttctttgattgctaaatgatatttatgtgttattagtcttaccacttttttatatggagaagtcaaaaattagtactctacaaattctaagagtaacttataattctttaaattctttaacatttttgttctgttacaataacatttactaagtacttgcaataccactttatgccagtcacttggttcatatcctcataaaaatgttatagggcagaatatcagtcagagttctaccagggaaacagaacttgtagaagctatatattaagagatttattgcaaggaattgtaccacacagtgatggtggctgataagacaagttcaaaatctgtacggcaggctgtcagaaaatgtagtctggaattctcaggtacaaactgaagctgcagtctacagatggaatttcttcttcagaaaagcctcagctctgctcttaagcccttttactagattgaatcaggcccacccagattatccaggctaatcttccttacttaaactgattatggactttaatctggtctacaaatattttctcagcagcacctagattagtgtttggttgaattaatgggattgtagcctagccacattggcatgtaaaactgaccatcacaggtatgaacttttattgttctaattttacaaaatcaggaaactgactttgaaaaagttaaagtaaattgctacaattgagaaatgatggaacattgaacctaagtttgtccaaacccagaacccatattataaaacccagatggaaagttggcatttgactactaaactattaaagaaatgaatgctgtgtgtgctctggtgcacacacatgcacacacacgcatgcgcccacacgcacacacacacacaccactaccactgccatacagctattcaggaaaaaattataaagggatatttagtacatttgaatgcatgtattaatattgcggagattgaccagcgttttcattaattccgctaggttaattttccttttggaagccatgaaaaatgatctgttcgttataaattagagtaatcttggaagtaatttgacagtcaatcatcatttaataaaattgaaataaaatgtcaagagtaaactgtaaaagacaatgggatcactcatagtaattactgtcagtttaaactgaggaaaacagaatctgatttttaccgttatcagaatgaggtagttagtaatgaaccacaaatgtgaatctgtaaagtattgcatttaatttgttggatttctgcatattggcttaatggatgagtggcataaatttgtaaaaacagttactctcaaacacattatacaatagcacctaaggaaatatttattattctgagattactgattgaatttgtgatacattttattctgctgtgtatgttcagagatagctgtaaagtatgtatctactttgaaaaacaggaaagcctagatggaggacattggctgtcaacagagtgctagaataagcagaaagaaaaataaagcggaaacagaggtacaaacactaaaaaattctttgaaaggtggcatttgttctagagtttcacattttccaatgacacattattttaacttgtccatgaagttgaaatcatttgtgcaagccttgtttcataatttcactattttacttttgttcaaatatcaaaatatttcccaattagaccatacatatacttgcatagcctccctcctttcattatcttctttgtaaaaccaaccatttataatgagcaagacaatatcctcccttgaaaatgttcactttccttatactgtgtctctactcagcatgtgacattgcccatagactgcaaaaaccattctatctcttctagatcacaaactaccatgccatccttaggtcttactaccctccaatacaaacactttcttctagtcatacggggcctttcattcccaccatacttatcctacatatttccagaccaaccaacacctctgctcacattgtgggcctaacagtacactcctgacttcttgccatatatgtgaatactgtcgatctagaagcccagatcctgtaagatttctttattaagcctggtctctttctctactgaactcagataggagatcaaatctgaaagaagcttgaagacaacaggcatctgctgcttgaactccttctttatagtcgagtgagatgatctctacccatggatattatgtttgaaaacctctagtaaaggagaactcattacttttccatcaggttcagtctttggatagttttagaaagtagaaagttcttgtatgtaactattatcatttcttctttacttagctgttcctagatactagactataaacctctttatagcaagagtgtgttttttatttcccaatacttaacacaatactgggcatgcagtagatgttaaaaatactttaaaaaataaataaacctcatttggggttctttcactttcttaaccattcatctctgtataaaccctggtttgcgtatgtgcctcagagcaaatgcacaggtatagtctgacctttctaatccacaatggtctgcacagcctacttcttactcttttctagaaaagcagcctatgttcacattttccaattttccatagcttcataattgctgacaaaaatttctttatacacaattaaatccaaacccaagtattactacttataagacttatttttatttttaccccaagccatatatttcttaccaagtttttgtaacattggtgttttaggatccacatgtagaatacattttattcttattaaatgtatgctattaggcctatgagtctccccatcaagtcctttttgcattttgactctattcttccttattcagtaaacgagccagatttacattactgacaaattgtataataatttctggtgtgaccatattcattttattgacttaaaatattgaatagaagatgaaaacggctggagacctagcattacaagtcagtctctcaatcttggtctgtctttctctctccctctttctcttaaaattgagccattaacatattttagagtcccttagccagttcctatcacataaataaaaattggtgggatgagattcatgataggaatataatgaaatgacatgcactattaaaaataaatggattgatactagaaatgtagcatgtccaatgtaatcatacaacatttcgggggttacatagcacaggcatgttcaaattgttagttatctttattatatatatatataatctctctttctatttagcttcttaattatttaattacaaaatcgagtcttacataaatctgtatatccgtaacatgtaatggtgtaccttatgcataacaggtaaccaactgattgtggtttaatgtgaaaggactcaattgcaatgaaaaagaaagttatttagctacagttttcaagagtaactcccaggaaagaaaaataggtaggataagtactaagaaactctttccgaagctgagtgtaagatttcaagaaaaacgttcaaaaatattattacttcgttctaaaataaaatacattctgaaaaatattaggagccatataaaataatgtaatgatgaatcatactctcaacataaaacaaatgatcagtactttctaattttctataatttgtatgtcaaatctcgttaatatttttttaggtgtgttgtactgttgctgaggttgttttattatttgttttggagaaaaagactgtttagaaggttaaactgatgaattcacagacaattatacaagcttgtgctattaatattgttaaataattgcatacaacttagcacttgagcaagaacaagtgttatttgttactgagtctcttcctgtgatcaggtgattagcattacatattcccaagaataaatgattccacacctcagggatcaggaaaataaccacactttcacagtcagaatgtagataagcgctgtcttgtaaactgtagtaaagccaaacatttatagcatcttttaaagacagtcttatgatctctgaatggttttcatctattagaaattctgtactgtttgtctgacttaatgactcatgaaaatataacctaaaagtgaaaatactgagaacataaaataaataatggttttaaatcagtagtgatattgtcaatttgtgttagtggtctgtacttgcagacaagtaattgggctctcttgtcttaattttgtttcagttaccaatatcactatccaatttcagcagaaaatgtcagcattaaaatatgttatttattacaaagtaatagtttttattgaggaaaatttcaaaaacacagagaggtgtgaaaagaggaaaaaatatgctgtcattctatcaccttgaccactaagtagaatgaaaataaatggttgttattagcatctatagagtgtctttttgcaaaattttgattatcacctacataatgcttggtaacatcacttttaacaatgcattctgaacacttttatgccattagaaagtctcctatcatattatattatttttaagtaataaaattatatgctacagcagaatttatttaaccaatctccaattgatgggcatttaagttgcttttggtctcttgatgaagtaaaaagattgttttaaaaattcctttttaaaatgattgcatacagttctgagcctggtttcgtgtaaggagtgtatatttgttacataggcattcaaaagagcacacttctgttatctatttaaaattgtagaatcatgttaatgtaatgaaacaaatggctagctagaataagatggaaacttgtagatgcctgcattaaatcatagatttggactttgaaagaattgctattgcatatgactaatgtttcttagcatgaaagttgcttattttagaatagctggaactatttatcagtgcatttgtaaagcacaggtaccttaaaatggatccaatatctgttcatatcctcaattaatgtaatacatttttgactaaattttatttaaaaagaatcaacagaattgatacaaacaatgggtaaagatgacaaacttttttaggtcaaaggtagtcttttacaatttctggaagcttctttaaaatgttatctatcttgcctggtttgatttgacatatgaaatatatttctctatatattttctatgttttggggcataggtgatgtgcagggttacgttggttcataatattatcacaattttaatcaaacccaattacaaaagaaaaatgataatgatcaccttataatttatcgtaaaaattatacatatatatttgtgtgatgtttgatagatttgctcttatgtaagagaattatgaaagttagatagaaacagccttctgaaatataaaatatttgtcctaacttttcctgaatagcagaaactaagtatactaaaataaatgtcttcaagattttcttcacacgttcctcagactttgttttaaatcagacactttcagataacatatgtttaatgaaaacacaatgatgtgctgagttttcattttaaaatgtttttacttaaaaatagaaaagaatttggagaaagtcaagttgtattgttttgttttgtttgagacagagtttcaccctgtcgccaaggctggagtgcagtggcactatctcggctcactgcaacctctgcctcctgggttcaagcaattttcatgcctcagcatccccagtagctgggatcacaggtgcgcaccaccacgcccggctaatttttgtgtttttagtagagacagggttttgccatgttggccaggcttgtcttgaactcctgaccttgagtgatccgcctgccttggcctcccaaaagtgctgggattacaggcgtgagccaccgcacctggcaagttgaattgttatatgcagctatatttatccaagttgcacatatttaatataagcacaatctgattaaaaaaaatcaaagttcctgtctaaaacctaaagaattgtagtgaaatcaatcaagttgttgagcttaactgaacttctttaatgccataaccttgatattcactatttcctttgaaatataatattcccttttgcattatttatgcaaatgccatgccagtgtagtggaaggtgtcacctcagtgcagctatagccagtaacatttcctgttctagtcatagaaactttcatttattcatgttgatttgtaataattctcagtcaatttttcctgggtgaagacatgaatttgatgaaacagtagcagcagaattattgttttggatgtattcattaattttttagttaaactttctactttgagataattgtagatttacatgcaattgcaaaagacattacagagatctcatatatcctttaatcagtttccctcaatggaaacatcttccaaaaatttcttacagtggtaacatcttgatagtacaatatcaaacctggatattgaaattgacatagtcaagatagaaaacattttcatcaccacaaggattcctcctgttgccaattagtagccataccacttcccttctgctgtcactctctccttatctctggcaaccactaatctgttctccatttctattattgtgccaagtcaagaatgttccataaatggaatcatacagtttgtaacctttttcactcagcataattctctggagattcacctaggttgttgaatatatcaatagtttgttcctctttattgttggtagtattctctggtatggatatatcacaatttgtttaaccacttacctgatgaagtatatctggattgtttccaatttttgagtgttacaaataaatttgctaaaacagagcctcactctgtctcccaggctgtagaacagtgttgtcagtggtgtgatttggctcactgcaacctccaccccctggattcaagcgatcctcctacctcagcctcccatgaagctgggactacaggcatgtaccaccacgcctggatgagttttgtatttttgtagagatagggtttcgccatgttgcccaggctggtcttgaattcctgagctcaaacaatctgcccaccttggcctcgcaaagtgctgggattataggtgtgagccactgtgcctggccaaatcaattaattttaaattcaaaggtgatatgatgccctctttgtccttctgattttcagtgttttatgaattgattttagttgtttcagtggattaattctacagtatttgcaacagaaagtataacaaagatctctgacaaggtcatgcctatattgggctgtaggaaatacttacttagctacgtattttatacaaaatactggctactagaaaatgtagacatattaattggttgtgaaaaaattatcttgatttactgtaatggcttttatttacctatgtattcttaaaaatctatggaatgtgttctagatacaaaatagtatatatgccatatagagagaacttacagaattagagaaatgaactcctatgtatcagttatgagtttcaaaaatagagtagtacatcaccatattgaaacaccttggagcatggccttctggatgttatctcccattcttcttttggaggtcaccactattctcaatttgatatggtttggttttgcccaattttgttatataaatgtactaatctgattatattcactgttctatgacttattttttttacttatttcacagattatactatgatggtggcagtatcattatttattaatttccattgctatataatattttattgtatgaatatactccaatttaatgtatctcttgtattcttgatggacatttgggctgtttccattttttttctattattaacagtgttgctatgactatccttatacttgtttcctggtgtagatgtggaaaaatgtctccaggttccatatatatctagcagttgaacagctgagtctatatgcatattttaaagtatattaggtaatactaaattattcttcaaaagtggtgtaccaatttacatagccacaagcatgtgttctctcacatctgtaatcaggccctcagcatttgtttgctcacttttatattattggtcttaagcttattgattcaaaagagtacttcgcatattttggatactaggtgtttgacagtaatacatattgcaaatgttttctcccaacttatggcttatctttttactctctttatggtacctatgatcaaacgaagcccttaatttaatcacatttattatctttttcctttctagtttgtactttggaaagctttttgaattttactagggtttatagcttaagttttatatcagtaaaatgcttaccagaataatgttctttatcttgaatagtagcttgcatttatctaaaaattattaggatatatatttcataataatttctatttatagacatatatccttatgatttttatataaacacataccaaatgtatatatatatatatatgtaacaaagtttcttttaaggtttttaatttcagctatcgacctaaacatgcataaactaccttttcttttaaaatacattgctgtagttagctcctgaaaacacttctacttcactgaagcggtgatgatttttgtgaattttcagccatttgtctttgagttttctctttgaaagaccctgagactttattcagtgatatgagagaaactatggaattgttaatattttaagacatcatcatattcatgatttattgttctttgcacaattgattccaacccaaatgtcccatgaaataaaataacacactcagtgtgatttgttttactaattattatatgtagcaatcacttgactgtatagatcaaattttactttctaaaagctccttccattagtgctaatgtgtttgtccctttcaaaaaatacatctagtaatcattgggcaggtggtgaggaggaacagattagaaaatggttcctctctattttttaaatgatgaagtagaaattctgtcttttatgaacttctgctgtttggtttctaggaaagtatatgcttaattgttaaaatattgaagatcttactgttaactctaatttttccagagagaagaggaagaggaaccgtcattggttaaacgctcaatataggttaggcaatattctggccatatgacctctaatattcttcattcatgcattaattcattcaacaaattttttttgagtatgttctatgtgccaagctgtgttctaggaatcgaggtaaagcagtgaataaaacagacaaagaggcaaaaatcatgattttggtagagcttaagcaataaatatgacagattactgccttagaggtatctagaaattgagaaatgctatacaaaatagcatatggctctgcttgtaaaattttaatgtgcatgtgagtcacctggggatctcgttacaatgcagattgtgattccataggtcttgggtggagtcctaagatgctgcatttctagcaagcttctgagtgatgccaatgttgctggtttgggagcacagtttgagtagcaaagagtatatggcaagtgaggtgggggtcgagcgtggagagtgggagagaaactggctgcactttaaaatatgatgattagggtgtgccttattgaaaaggttataagtgagcaaagatatgaagaaggtgggggaatttagctatacacttatctaggtcaatgaaaccagccagtgcagaagggtgttacatgggagtgtgcctgacaaggaggtcagtgtggatggaatggcatgaatgagaagagtagtagtagatcggatttgagagacagtgggaataaagtagatcttgcagggcttcggacaccattataagttctttggcatttacgctgagatgcggaaccactccagaattcggagcagggaggtgacatgctccaacgtacgtatttaaaaaatcactctaactgctgtatagaaaatagactattataaaacaggatagaagcagtgagaccagttaggagtctgcaaaatatatggtagctcagacttaagtttatagcaggtgagatggtgagaagtgctaatattcagaacacattttgaaggtagagcctagtgaacttattgatgtcttaaaatatgcatatacacagatgtaggctgtgaaagaaagaaaggagtcaaggatgactgcaaggtttgtttgttttttgacctgagtttctagaaggatgaagttggcatcacctgaaatggggaagggctaggttttcaggagcatgtcagaggttcattctctgtatgtgttgaatcccatgtagccattagatcttcaaatagagatgtggagtaggcaattgtatatgagagcctggaattcagcgaaaggaccgtgcgagaggtccaaattttctcttatatcattcttaaaacaatcccttgctgctcatcttttatccacattttataattggggaaacatgttcagaggatatagcaaacattcagtttgtaagaggtggagcagagccccaggacaatctgtagctccaaaggccacactgctgttctgcttcaatagtaaaaagaatcaacactggtcactgcagctggttatgtgtttacttagagcaagtcgaaaatatttttaggcagaaaaattgagttggcagttcatctttttaacttccctacttggctactatagacagattttgttaagtcaatgcttggcagctttccatatgttctagagatgcgtgttcatctgggtgtgacagttttttctaagtcacttctgccatagcttgttaaaggtaagaaaaccatgtcttcactgatcttggggtcctagcgaagaaatgtgtgctttctcagtgttggaagggtagagaatggtaaaatgaacattggtggcctccctgtcccccagtggaattccaaggcatagcctaaatgatttctcagaggtccccagcagggttgattcccggttgctcacagcagtaacctgttcattaataccatttattggcttttcatgcatccttgcctcacattcctcattgttcacttcttaggatcacctcccaagtgaattgtctgaacctaagtccatgtctctggctaatctaagaaaggtgataatgtgaaatgtgcttaactggtctatccatgatagttctttctaatttctacaacagtgcctggcaagcagtctcaataagtatttgccacaccagtgaaggactgttattttccttaatgtttattaagtaatagtagtagttgttactattattttaggcaaatatatttttaataggacacagataaattcccctttgtcactaacactgccaatcttagttctttccttacgttcccagaaacaagagttcttaaaactttggtatgtatgcttctgctattttgacttttacctaaatcacatcattttatacatgtgattatgtaatttgcttttttcactcaaatttatgattttgagttctatcgatgctacatattttctgccttctatctgattaaaaatttcccattctgttttcttcctttatggtatttagcgtttttaaattctatttctattttttagtggttccttgtaagtctttaacacaaatatttgaatttacattttaagaggtactaccagtaatgagctaagatttttatcattgcttaaattaatgagcctttctgttcttaatggccaaatgtaggccatagtttaccttgtctcctagctatccctgtttacttccgtgttttctaggattttagtttgttcttgctcccaaataacaaaaggcttattattattattattatctttattggatcttataattaagttttatttctttcatttgcttattgaactcctttctttaaatatacttttcatgttggggaagtgtctgctttagtcactaggctatgatacttaatctaggtcttaacaagtagggttttgccatgaagagggagaaaggatcagtatgcaagggagtagtgtctgaatttgctttgtatgtgccggaatgtctatgagttaccctttgaacacagctttgtgttgctctcatggtttgtaatgtaatccatggtatggtaaatatgtacatcaaaaataaactaataggaaaagatatgaatatcaaattagaaagtgacccaaaatgaagtgttatctaagacaatacatttaatatgtaaaaatacacatagattcatttgaaaatatttgtcgtatttctttcaaacctcatccaatgtcagcataaacaaatataacaaactagttttcaaattaaatttaaaaatataattcttcatacctggagcctcggtgagtaggcattatgcctgaaattttcaatgtcgatggaccatagatctgcctaattactcctagagtcattggagccaaattgctgggatgagccatcattcccccatccccctttcacaccaatgtgattgtatgccttaattggttctctagttattcatgttatatgatctcaccactaccagtgcttctctattagtacctcagtcttcttgttagcattcttaccaaaagattatcagaaaatccaagttactaaaaacatatctaaaacacaaagcccgtgaacagcacatgaaagctggaagcccttgcacttccagaatcctgcttgcatgcctttcagatcacttacagtagcagaaaaggtgtgcaccatcacgctcagctctaacttgctctcttttgtatatgatgcggtaatcctggctcttagtgctttgggattttggtgatagatgtcatcaccagtaattccacagtccccaaagagttcaactctctcaatcaaatcttaagccatattgttggctccctataatactttaaattctactgtacatttcttatagtgtaatcatgttaaagagggggaaataggcttttttcctcttctcaatgcataatctttttaaagttatctattctgatttctcttgaggtctctttccaattacctgcaagtttgcttttactgtggtgttccctgtattgtgtgtgtcttattccttctgcaagaaggaagtggccaagctgacagattgctaatattaccattgtctaattacagctctattatgtctgtacaacagaattgcatatcatttaagaggccactacagcatttatcagtcgttgtggattctagcctaacttgaccattcatttatttttaatttatttttatttttgccttttttgagacagtatctcactctctctctctcacccagggtggaatgcagtggtgtgatctctgctcactgcaacttctgcctcccaggctcaggcaatcctcccatctcagtgtcccgagtggctgggactacaggtgcataccaccacacttggaaaaaattttaaggtttttgtagctacgaggtcgcattatattgcccagactggtctcgaactcctgggctcaagtaatcctcccacctcagtctcccaaagtgctgagattacaggtttgagccactgtgcctggccttgatcattcatttagacttgcagtctgtgccatgggaaatccaaaagctccaccatgacaaattaactccctgttacagacgtagctgttgtctctccgtatctggagaccctcagagcatttttaaaagcatgacattttaaatgttaatttttattgcccagcaaagttaatcacacctatctatgaagagttaatttccaattaaacagttctctgttcactatctataattccctcaaaggaaccaatcatacttaaagggattcagagcctgttatatttcttatcgtctattttcatgagagtatgtacttattataccagatttctggcatttagtgttatagatatgcaaattccattttaactccccttaagatttccaacacccaaatgaacaattaagttttaacttttcatctgtgttctctctctctctcatctgtgttctctctctctctctctctctcagcacatgctgttaaaactttagtttatgctataggtccttgtagcgacaattttagaaacacccctttcttgtgtttatactattataactttggggtctctaaaccaattctaaatatgcattataattataactttatatgttacattcttatcctacttttgtcttaagataatttatgactgaatatttttgtggcatcataatttaagctttaattttactaaaatgtgctttttggttaacagtaaacagttaatatgctatagtctcctggaaacacacgttcacatagctttttatgagccaggtttttggtaattcagcatatactttactattgaacttgcattcttaatgtgcaatctgatcaagaaaaatatcctctaatatttcttttgggttccaagagcactgtcccctttcccaagtactacattttacctgaaaaatatatgagaaagtatgagaattcttgagcctaaagcatttaaatttgattattttcaaaatttgttaagtcatttcaaactgaaattgaaaataaaattaatttccaaatagtaaaaggataaatgaaactaaatactgttactgagaaaattagtccatctttagggcttcaaaaaacacactgaatgtagctttcactgattatatacacttttaaggttgcactttttctaggtgctaggcagaaaatggagcctgaaaaatatcaaattgcagcatagtaaatcacgtttgaatccaagttttaagttatttgaccagtactttattctttgatgagccctgaatatatttttctcagccataaggtaggcatcatgcattcctaaaattggagttgattttctatgatagtttaatttactagctgctcagttcttctaactgtgcatgttatatgggaagattatttttttatttctttgtaaattcatgtcagatctacccatgggaggaaaatgattcctaactcttctccatttcttttagtgtttattcatatgctgtttctgtcttttctttttgcctttcccctagctgaaacaaggatgaatctataaactaaaaaaaaatctttttctttgtaatattagatagacatattatcaataatattatataatctattgcaacaatcaagtcaccattaaaatgtgtagttttctgagtgtttccaagtatgtaatgtaggacaatgctttaagtctggtttattctcatttcacttggcttttttttttttttttgcatactttgagtatatgttcttaagaatattcttaaaatattttccaagacacatttatgtaagctaatcaaaccatgcaatagataagaactcaatgttttagaactctgtcataagaagagatatatttgtgtatgtgtagatacacacatacatttagcacattttcagagacatatacattatggatttttattattgatttaaattctttataatatgcaattacagatatattttatatcagcttaagcattttaattgcaagatttctgtttaatttgtctgcaaagtactcttttttttctggtcatggtaaatttcatattctttgacaatagcttttgtttattactagaaacacttctcttgggctaggttgttaattaactgtcatttttgtacagggtgtaaaagagatatggaaagaagggtacatgagcaaatggaatttcacacattattaactgttttagtgtcttcaaacttcaaaaacatatattaatatttttgtaccacgtaagttcatcagaagcctgactttaatctctgatttattatatttgaacactgtgaagaagcagtttaacactgaacgaaagtgtcgtaatgcagctttcaaagtggccattaaagacagatctctgcttttctattagtacattttctaagatgactatcattgccattgtagtcagctttgtgtacctttatagagattccagtataaacccagaaacatagagcactgagagaaataatatcagaagtgtttcacctttggctactattgtaaattgacaaatgacattattgcttttagatttttaaaacaaacacactaagtagaacatatgcatccaaatcagtagggtcatttcaaataagtcatactttttgttccagtgattcattagcccaagtacacttgaagttcccattttagaattgctttcacaggccagtttatgaagcagaaaataaagattcatttctttctggttaacacctcatttttggccaaaagtgatatagcccaatataccacgaataccttactgaatctgatgcccaatgaattttaactgtttttaaagttcaaagcaatctttaaaagaatgaagactttcagccattgaaactgtctagaagctgagctatgatatttgaaggttcagtatttacaaatggcatcattactttttctttctagagaaggcactagaaggggggctttcatcagaaatacctggaggttttagagaaggcagattctgtctggaaagtcatgggaactagaggcagggtgccatgctatgatcagtcaagtctctaatctctaaaatgtatttcgaagacacagtttgagcaggttgaataagctttttgtcttgtaggcccaggatatactgcgttaccaaagtccaagccccacaaggaggttattcacctgcccataggtccattagaagtcatctgctgatgtgactgtattggtgatgtggaatattaacgtggaacagaaaactccatgggaaggcttagtgctgggggagagatataggcaaaagagatggaggaaagggttgaaataaggatttgtttagacagttcactggtggtgatttattgggtgtgttttactgctaacccacacatgaagcccctgacatcttggctgaggctggtaatttttttctgacaaggatcagcagaaatgaaggtgccatagcttccagtgctagatatagtagctaaacattatcttcagcagagatgggagttcagagtgtcattgtaaaatacatggaaatacctaatgtaaaggagtctaatgaatgaaagaaataccaaatgaatcttcacagagggaggtaaaagaaaagaagataaaatcaaggctggtgacaaggaattattaaaatagaatatgttattgtatatatttgcctcagagtttataattaggagtccgttgaactctgtttcaggatgtcttcatcatttctttaaggatttaaaatatactgcatctagaaataatccaaattaaaattgatttaatacactccaacaccacattataaaaatcattcactatgaccacctgggtttgatattggaaaatctattaatatcaatcactatattaatagatctaagaaaaaaatatacccttactccagtaatgctaaagcctggaataagacaggaatgaaattagaaaagataaattagaggcataagaactagaaaagaagaagtaaaattccctctatttgcagataacatgatagtatacctggaaaaccctagagaataaatggcaaatgtagctcaaacaatgaaataattcaacaagctagcaatatgtaaatttgacagacaaaattcgacagctaccatatgcaaaattaataatgttaaaatagttggagattagttagaataaattacaaaaatctcacaaaataaacagaaaagataaaataggaataaaattaacagaaaatgtgtaaaacatataagaaattataaagcctttctgaaagacacacagaagtagacttgaacaaatagaaagacattccttgttcttcaataggacatcacaacatcattaagatgccacttctctctgaattaatttaaatttaatgtgatgccaataaaaataccaacatgctttgctatatggagctaggcaagttgaaactaaggttaaaatgaaaaaataatgaacaaaaatatctgggaaaaacactaaaaaggaaaagctatgactagccctaccagatattagcatgtactacaaagcctcaacaaataacagtgtcaatagcacatgaatggacagaccaatggaataaaatcaaaagtcctgaaatagaaccaaatacatatagaattgtaatatataatagaggtgacatctcaaataactggggcaaagttgaacttaataataaatggtttcgtataaaagaggaaattagatgtcttcctcaagccatacacgagaataaacttcaaatgaatcagaaaactaaatgtaccaaggaaaactatacaggtactagaagaaaatattggtgaattattttaggacttgcatgtagggaaggactcttttttttttttttttttttttttttttttgagacggagtcttgctttctcaccaggctagagtacagtggtgcgatctcagctcactgcaacctccgcatcccgggttcaagtgatttccctgcctcagcctctcaagtagctgggattacaggcacgtgccaccacgcccagctaattttttgtatttgggtttcaccgtgttggccaagatggtctcgatctcctgacctcgtgatctgcccgcctcatcctcccaaagtgctgggattacaggcgtgagccgctgtgcctggctgggaaggactttctaagtatgactaaaaattcaaatgccacaaataaaaagattaatacattttactatattaaaaacttcgcatgacaaaatcaaaagccaaaagaaaactggaaaaaatgcatatattgtaatgtatatcacagataaagagttaatgtccttaatatataaagaacttttaaaaattaagtgggaacacagatcctgtagaaagatggacaaaaatataaatagacaatttacaaaaaatatataaatgatccttaagcatatgagaagatgattgctttcactaacaataagtaaaagcaaattaaagctattttgaggtacagttctcacccatcagattggcaataatatgaacatttcacaatatactctgttgagaagctgtagagaaacaagcattctcatacagtgttggaatttcgaaatgttctgaaacaaatggagggggaaatagaaatatctaataaaattacatatgcaatcccactttgacctagcaatctcatttctagaaattagcctgaagatatatctcctacaatgcaaatatatgtacatataaagttattcattgcagcattatttgtaattgcaaaatattggaaactacgtaatagtcaaacctaagatatcagctggataaactatagtacatatacacaataaagtactaggcaactaaagcaataatgaggatctcttgatgaactaatattgagtaatttctaagtgaaagcgaagtaaaagaatgtttttctactatgctgcctttgtgtgtaaaagaaactgaaataagaaactgggcatcactttagccaagtgctcaaaattagtatgtttgttttctgtgctgtgtaaaaaattaccacaaatttagcaacttaacatagcatttattttttctttcagtttctgttggacagaagtctgggtatgacataactggaatctctctcagatccttaacacttgacctcctccataaactctctcacacttacaatgtctgatctctggaagggcttggcccctttgaagccagattgggtaaagttcacccaggatacgctccttttttattaacgcaaaggaaaccaatatgggactttatttatactgcaaaacctcttcacctttgttatataacataacttgatcaagggagtgaaatccaccatctacccgttattcctagagtagggattttacagggtttatgtacaaaggcatggggatcttggagcccctctttgaattgggcctatgacagttaatatcaccaaaaaggggcaaacagacatcttgtgtgtgcctccagatgcaatactcttggcaggatataacaccactgagaaggatatgacagcactgatacagtattcccacccaaactgtataacctgaatttagtcataagagagcatcaggcaacacaaatcgaggtacattttataatataattggtctgtagttttaaaaaaatttcatggtcataaatgatatagaaataatgagaagggattccagattaagagaaactaaagagacatgacacccaaatgtagtctataatactggattggataccaaactgaaaaaaagatattgttataaagaatattatttgatcaattaacaaaattagaatatgaactacagttgaaagtatttgggccgggtacaatggctcatgcctgtaatcccagcactttgggggtctgaggtgggcggatcacctgatgtcaggagtttgagaccagcctggccaacatggtgaaaccctgttgctactaaaaatacaaaaattagccgggtgtggtgatgcgcgcctgtaatcccagctacttgggagcttgggaggctgaggcaggagaatggcttgaacccgggaagcagaggttgcagtgagccgagatcgtgccactgcactccagcctgggagacagagtgcctctgtctcaaaaaaaaaaaaaaaacccaacaacaacaaagaaaatattctattagtgttattagtgttagatttcctgagtttgatcactgaactgtggttatataagagaatatcttttgttcttaggaaatacatactgaaatattaaggggtaaaggaatataatatgtacaacatactctcgtggttcagaaaaaaatactatatgtgattgtgtgtgaaagagagagaaagggaagagagaatgataaagcaaatgtggcagaattttgaagattggtgaatatttgtgaagtgttctttggattgttcttgtaacttttctgtaattttgaagttatttcaaaataaaaatcaaattaacaaaaaacaaaaaataaactacacctaaacatcttagcagagggcctgcctggcatataagttctcagtaaatggcagttaataataatatcactattattacctaattcttgcttacaacttgaatccaatcaaatgaacctatttattgccactaccttgggggtttttattgtatttttggtttaagaatacttagtatttttgtttaaagtctaaaataattttataatataaatgtgtagagtaactggtaaccagaattcctgcaaatttaatgccactgcattaattgattgttttagttttggttccccagaagctgacccctagaacccaagacaaggtttcaagttcacatagtttatgtgagaggaaataccaggagatgttagatgtggggagatgagaaagtgaggagaaggaattgaataaagggttcattattaaccaagttaccactgtaggcaaaagggacttaatcctggtggggaaatctaggagacagtgtaatacatgcttcagactttgcctgcccaaggagggatggaggtagggtatttgtacactgacccccatcggtcattgactgagggcttctggagcatgcaaattaaattctaagcacttccagactgctacagtatcatatcagattcctttaggcaatgggttgcaagagctgacatgtgggagacagggctggatgcatgcaaatgatgaattctgagggtatactggtaagtgtctcacagaatctgctgctttggtgaggcagaaatctgctgaatcagtctccctggtattccaggaagcatgtggagtgattgcagctataattatggtgaaatctacactggaactaggtttctaggaacaaacagatctgaactgaattattattttttccagttgctagctgagcgactttggatgagttatttgttcgaacctttggtttcctcatctgtaaaataggggcagtaacagtttgtcttcataaatttactttagaattaaagacattatgcatttgaaaggttgggcctagaaaatactcagtaagtgctagttttattatgtttgcatctcttatagttactattacttttcacttttaatcagtctgttagagatgattgttcttatcttgaactataagatgcactccaatctgctagattaatttgtaccttggctttaaaaaaatctgttttttttttaatagccattgaagactcagaacaatagggactccaatttgctacctgttcttgaaaatgacaatcagttacttaggaaagcaactttgaaaaatacaaaggaaagtcagagagattggaaccaaataatgaaggtcaagcatcatcaaaaacacaagttgtgagtgacacataaagggaagaaaaataagcatcgtaaggactggattagccatgtttagtatgcttttgaaatatttatgaaataatcacagtttaactgtttaattgcatgagctagatttggttgagtacaagcagaacactgcctattctttctcacttcctctttaaatcaagtcatggtcttgtcctttcctacccatgaatgaaaccgaacgcagagtccatagcttaccagtctcaaagtgtatttgtttcctagggttgtcataagaagataccatgaaccgagtggtttaaaacaacagaaatgtattctcacagttttggaagtccagaagtccaaaatcaaagtgttggcacagccatgctctctcttaaggctcttgagggatgattcttccttgcctcttcttaacttctggtggttgccagcagtccttcactttgttagcttatagctgctttactccagcctctgcctttatcttcacatagcattctccctgtatctctgtgtcttcacatggttattttgttaaaaggactccagtcttattggattaggggcttaccccactctagtatgacctcattttaacctaatggactatatttgcaatgaccttatatctgaagatcacattctgatgttcttggaattaggatttcaacatatcttcgcggggagagggggggcgcataattcaaccaataacacatagataattacagtctaagcccatcagtattcaaaccctaaatcttctccaaaataaacatcccccctttcttagctgaggaccactttgtgcctgaaaggctgcattggagtgagagtgacccgagtgtttatttccctgccccaccttgttctgtccctcctcctctctctctgacaaggatatgactgagtcttccaagattagagtaggtagaaagcgtgagctaaggttgggaggaaatgagaagggagaaaaggatgaagagttattttgattgatggaattattttggctttggtgtcctctgaggcagcagattccaaattctgattcttactctcattaggttgttcccttgcctcctcagaagcccacttactctctactctaaatatctctcacttgtagctaaattgatgcaggtagggcctctgacactaataaccaaatcttcagacccttggtgtctcattctgttgcttagttgggatctctgtatcctccaggcagtcatcttgagtggaacctttcttgaaatgaataaaaatttcttccccaggattgacactgatccaacaataaattcatgaatctgtcctgtgcagctgggtcgatctcataaagcatttattggtcaaagttcagccttaaacagttgtttcttgaattttcaagaggcagataccagtgcccatgatggcctttcaggtttactttttaaactcttcaagcatttcttatggaagttctcttacttaacttgcagtaaggtgaagcacctctcttccctaccccattgactcccaagaagcgatgggcaaatatggagaggagattgtaggtattacaggaatgcagagcactaacaactccctctaaagaaagccactctgttgaacatcttcatctgtccaaagatttcttaaactcctatgaacagcctagcctagagacataacagtctaataaaaacctggcagaacttgtcagaactcatcttttaatattttctaaatgcattgtttttaaagtgcttcactgagatataattcatacacttcaccactcacccatttaaagtacacagcacactgttttttagtatattcagagagttatgcaaacatcactacaacctaattttagaaggttttcatcattacaaaaagaaactccattcccattagctgtcactcctcatatctccctcttcctagccgtgggcaaacattactctactttctgttcctgaagatttacttattggggacattttatataaatggaatcatataccatgtggattttttgtgactgatattttagcataatatttgcagggtcatccattgattgtagcatatatcaacatttattttgatttctaaataatattccattgtatggatatatcacattttattcatccatcagttgatagacatatcaattgtttctgctttgagctagtagaaataatgctgctatgaatgtttttgcacactttttatgtggacatatgttatttctcttgggtatttatccaggagtggaattgttgggtcatatgttaactctatatttaactcttgaggaactgctagattgtattctaaagtgactgtaccactttacatccccatcagccatgtgtgaggtttcctaattttcaacattctcaccaacactcgttttcgttttttatttatcatatccactctattgggtgtaaattgattgtttcatactatcttagcttattttcatagataatccatttgctagagttggaatgtgttcccacaaagttcatgttttggaaacttggttgtcattctggtgatggtgggaagtggggcctttgggaggggattaggtcttggaggctccaccctcataaatagattaaggttgttattgcaaaagttgctttgctataaaagcaaactctcttgcatgtactctcttattctcctgcccttccaccatgagatgaccttcaccaaaagctggtctcatgttcttgtactttccagccttcagaaattgagccaaataaacttattttctctgtaaattacagagaaatttacagtgtgtgatattctgtaatagcaagagaaaatggactaagacaccattgcttctctttaggatgtgcaaatagtttgtgcttgctttatttttctgacttacgagccctctgttaaaactcaaaaatcataagaacagtgacatttaacattcagttaaaatgacaacaatttgaccaaaaggcattagaactctatgcctagagttatcgtaataccatgtgcacaataaaatatgtatatgtcataaggaataaaaagtggagtaaacatgagataatctgactatattctgagtgctagatgtctatgagggctttcaggttagttgcttgttttttagtaataaacacaacagtaataatgatgataatacatagcctatattgctccagccaggtgtggtgactcatgcctataatcccagcactttgggaggccaaggcaggaggatggcttgagttcaggagttcaagaccagcctgggcaacatggcaaaacctcatctcgacaaaaaagagaaattaggccgggcgcggtggctcatgcctgtaatcccagcactttgggaggccgaagcgggcagatcacaaggtcaggagatcgagaccatcctggctaacacggtgaaaccccatctctactaaaaatacaaaaaaattagccgggcgtggtggcgggcgcctgtagtcccagctgctcgggaggctgaggcaggagaatggcgtgaacccgggaggcggagcttgcagtgagccgagattgtgccactgcactccagcctgggcgacgagggagactccgtctcaaaaaaaaaaagagaaattaaccgagtgtggtggcccatgcctgtagtccctgctacatgggaagctgaagtgggaggatggcttgggcccaggaggtggaggttgcagtgagtcaagattatggcactgaactccagcctgggcaatggagtcagactctgtctccaaaaaaaaaaaaaaaaaaaaaaaaaaaattaactccctttattcctatgagaaccccactgaatagacactattatctttaccagttgtcagatgagcaaacttcccccagataataagattaatactacctttttacagattaagtaaaactagggggagattgagaggatactaaaaatatctaatgcataaaaatgtataaggttaaggacaattgttttgcctatctctgcccagatcttctcagatcccttttgaagatttttgttgtctaccctctctctggtttctgtgctctcacttttatcaactagcactaaaggctctttgtggggtaccatcctagggctactgaagctgtacccactcctccaggtgggagatcaaaagcctgggaatttcctgtaaattgttggaaattttcctactgataaatcctttcatgtttttactggctttccctggaagcattctttgtttggaatgagtcacttgtacacaaatcttgatctcagggttagcttaaggagaacacaagaaacagagaaaggaggatctcgataaaatattgaactagtacttagtatgtgaagaaaatgagtgatagtatcaaggtaaaaacaagaacagtagaaaattatcttaaaccagggggaattgacattagaaacaaatggattgtcatgatttgaaaatgttagaatgggctatttactcagaaaaagcttcaaacttgctttctgagaagactttataaatgtgcatagctattttcctgggttagtttaaatgtactgcagtccttctggaactgaataactaaatcagtggcttcccagagcctctacagctctaatagttgtataagagcacaacctatggttgtaaccaatggttaacaatcattaacctaaaaagtaaagcctttttgattatgcattgtgctaagggctttagaattattgttaaatggattcagtccctgctttttaggaacttaagagaaaaatttttaaaagtaaataaaagaaatctaccgtttatggtgtactactaagaagcattaaaacaagtatgagaatcacttcagagaaacattaatgaatttacaaatatcagtatttcagaaaagtaatatctactttgattttacaaatgagatatgtatggacaagaaaaatctattcatgacatgtctactccaaatagcttcattagtatttttcaggcgaaaagaagtaacaaaatgaaaaagaaaaagaaacattacactgcattgaggcaaaagattaagaaataagtttgtcagaaaaatgtgaaggtttgatgcttatctttgcagtaattttaagtaaaatgatgaagaaagaaaaatgtttgtggtgagaatattaaaaaaaattgtaggataaaatcccattatatcactggggaaacaaattaatatttcctggtaaagagcttgatgctaggatctagtgtcagaaacttttcttaaataaatactttttcttcttgaacctttaaacatattttgaactaagcaattttgaaacaaattttattcaagtttcttcaagtaataataaaaggaaatagttatcaagtatacaaataactgatctttaaatatatatatatatatggatattaggaaaatatttgagtaggtgggtaggtgttagaggaagcaggaaagataaaatacacacccttgataaaattgtattatataagcaactgcatatattgctttttattgcttcatacaattttattatataagcaatggctttattatataaacaatggcttatataataaaattatataaacaaaggcttagataataaaattatataaacaaattttataattttaaaattggcatgtagagtacacatataatttccttaaaactgtgttattactttccatcaatcacatggatcatgaagttgttttcagttcttctaaacatgctagaaatgtggtcagagactaaaaaacaggtacaaatatattgttttcaaactttacctgtgcgagtacagaataaagacatatttggatatgcagaaacactgaatattttctttcatggcaccctttcttagaatattatttaatgatattgtctatcagaactaaagagtaaaccaaaaaagaggagagcagtgaagagaagcttcacaattatagctatttgttgggtcccaatactgagcaatctgtcccagttaaaaaaggaaggaagacttcagaatagaaatatctgggtgattttattctaccctttattatttggaacaatataaggaaggaataaatgcagaaaataaaaggataatagaataacaagcatacaagatctcagcacccccttttattggagtaaaaggactacctgatgataaaatgcaaacaattaagatcaaatcaagagaaaacagatcaaaacaaaaagttggggaatgatgaatatttggtaaaaaaaaaaaaaacaacctggtgaagagctgtgaatacaaaaaatacaaaattgaaaataaagactatgagggttgtagttgtagaacagaatgtaaatattataaactttgaaaaagtgaatcaatataataaaaatgggaacatgttgaaggaggcaagaagcttattttctctcctttcacagcaggaaataaatcagtctgacttaaaattgaaatactcattttagaatatcataattgtagcaaaaccgatttcttaatgctgttccatattaatttttcctaaacttctaaaacatgtaaactgaccattaagaaactagtaattatttcacttcatattatttcttaatttatttgcagatacaattacattaactatatttcattcagaatatatgaccgtgtttactaaaatcatattttatctttatctctctgtatggattttagagatagctgggaaaatagttacctgatctttattgtttcttgtccatactttaatatcactttaatattgatttttatattaaaaatatattattttgtaaaataaaccattaaaaaaaaagccaattactaaaagtaacttgaaagtcagtacaactttgtataaagtccctagaaaaccacaaagtaaatttgatttatattatagcaaaatgtgtaatatatataatcttaaaggtttttcttttcttttctttttttttttttttttggagacggaatctcgctctttcacctcaggctggagtgaagtggtgatctcggctcactgcaacctccgcctcctgggttcaagcaattctcctgcctcagcctcccgagtagctgggattacaggcgcctgctaccactcccagctaatttttgtatttttagtagagacagggtttcaccattttggccaggctggttttgaactcctgacctcaggtgatacacccacctcggcctcccaaagtgctaggattatagggataagccactgctcctggccaaggttttttttttttttaaagcaatttagtaacctcccaaattaccactatttcttattttacaaatgtgtagtcttcacccctcttttcagctagaaaacaatttaccttaagtgtatgatcactgtcaaaaatgttagttaactaatagaacttcaacataaaagattataaattaaaagcacaaaatacaattttggcaagatataggtcactcggggatgaagttcagtctaaatagctgcctttcttttgcaagatgcttcagattttgtaaactccttttgctcttaaaagaatatctggtggattcatagccaaaaatctaccagacatgaaaagagagactggtaccaatttcaccgaaactattccaaaaaatcaaggaggaagcattcctccgtaactcattctatgaagcaagcatcatcctgataccaaaacctggcaaggacacaatgaataaaacacccaaaaaactacggaccaatatccctgactaatatagacgcagaaatcctcaacagaatactagcaaactgaattcaatagcacatcaaaaagttaattcaccaagatcaagtagatttcattcctgggatgcaacgttggtttaacatactcaaatcaataaatgtgactcactcataaacagaattaaaaacagaaaccatgtgatcatctcaatagatgtgaaaaaagctttcaataaaacccaatattgcttcacgttaaaaaccctcaagaaactagacattgaaggaacatacctcaaaatactatgagggtcaaaaattggatgcatttcccttgagaatttgaacaagacaaggatgccccctctcactgatatggtttggatctatgtccccacccaaatctcatgttcaattgtaattcccaatattgggggtgggtcctgttgggaggtgattggatcatgggggtggagttctcatgaatggtttagcaccgtccccccttaggactgtatagtgagtgggttttcaggagatctggttatttaaaaatgcgtagcacctccccgtctctttcttcttcctgctctgccatgtgaagtaccttactcccctcttgcgttccaccatgattataagtttcctgaggcctccccagaagcagaagccactatgcttcctgtacagcctgcagaactatgagccaattaaacctcttttccttataaattaccaagtcccaggtatttttttatagcagtgcaagaatggactaatatactcactactccaatgtagtactggtgctagccagagcaattaggcaagtaaaagaaataaaaggcatccagattggaaaagaaggagtcaaactatatctcctcatggatgatattattctacacctataaaaccctaaagactttgccaaaaggctcctggaactgattgacttcaataaagttttaagatacaaaaccagtgtacaaaaattagtagcatttctgtacaccaataatattcaagttgagagccaaatcaaggaggcaaccccattttcaatagtgacaaaaaataaaatacataggaacacatctaaccaagaagatgaaagatctctacaaggagaactgtaaaatattgcaaaaaaaaaaaatcatagatgtcacaaacaagtggtgaaacatcccatgctcatgggttggaatagtcaatatcattaaaatggtcatattgtccaaagcaatctacagattccacactattcctatcaaactaccaacatcgtttttcacagaactagaaaaaaactattctaaaatgtatttggaaaccaaaaacagcctgaatagttaaagcaatactaagcaaaaagaacaaagccagaggcatcacactacccaacttcaaattaactataaggctgcagtagcttaaactgcatggtactggtacaagatcagacacatagaccaatggaacagaatagaggaccctgaaataaagccgcatacctacagtcatctgatctttgacaaagttgacaaaaataagcaatggggaaaggactccctattcaataaatggtgctggggtaattggctagccatatgcagaataataatactggacccctgcctttcaccatgtacaaaaattaactcaaaatgggcaaaatatttaaatataagagctcatactctaataatccaaaaagaaaaactaggaaacaccattctggacattggccttggcaaagaatctatgactaagttctgaaaagcaattgcaacaaaaacaaaaattgacaagtgggacctaattaaactcaagagcttctgcacagcagaagaaactgtcagcagagtaaacagacaacctacagaatgggagaaaatatttgcaaatatgcctctgacaaaggtctaatatttagaatccataaggaatgtaaaaagttggacaaactaaaaacaaataaccccattaaaactaggcaaaagacgtgaacagacacttctcaaaagaagacatataagtgaccaataaacacatgaaaaaatgctcaaaatcgctcttagtcagagaaatgcaaatcaaaaccacaatgagacaccatgtcacaccagtcagaatggctgttattaaaaactcaaaaagccacagatgctagtgaggctgtggagaaaagggaatgcttataaactgttagtgggaatgtaaattagttcaaccactgggcaaagtgctttgacggtttctcaaagaacttaaaatggaactaccttgctccccagcaatcctattactaggtatatagccaaaagaaaataagtcattctcccagaaagtcatatgcacccacatgttcatcccagcactattggtaatagcaaagacatggaaacaacctaggtgcccatcaaaggtggattggataaagaaagtataatatatattatctacgctatggaatactacacagccataaaaagaattaaatgttgtcctttgcaacaacgtgggtgccgctggaggccattatcctaagttgattagtgcagtaacagaaaaccaaataccacatgttctcacttgcaagtgggagctaaccattggatacttatggatataaagaaggcaacaatagaaactggggactactaaaggatggaggggttcaagttttgaaaaacgattgggtactatgctcagtacctgtgtgagaggatcgttaaaaccccaaacctgagcctcacgcaatatacccaggtaacaaacccacacgtgtagcccctgaatctaacataaaagttgaaaaaaatgacataaaattaaaaaataattttgatacagaaaagaacatctgggaatggaatatatttgcttttaatatatatctacaaaagtaagcaatgatctctggtaaagtcatgaggcacggtatccttactggctgggataagagcatgcatcagaaaacaccaacatccaaaacatccaagctcaaaacactaatttatagccatctagatgcttttatattcagaattattatagaaagaaagcctaactgaaatcaggtgttctacatgcttttcattcaccagtgaaattagtccaaatagtgtgagactgaaaccagggatatcagctttcatcatcctgggaaagctcgtgctgcttcatttccttccacttcttgctttccagtcaggtctctggttagcagtccatgcagcccataattatgaccaggggtactaagcatgactttttcactttcaataggcctgcactttacagcaagtagttctgagattattatccaaaaatatctaataaccttatacttggaccaatgggcttgtggaataatttgggttcagataaaactacttcttctatctaaccatatgtcagaatacatagcccaccaaaatctttctaactctctgaatccctatggagagtaacacatagtttagcacttaatctttctctaattatttcctacatgctaattttatctccacaactgaaaagtaaattccctgtgtgcagtaacatgccctaatctttatgaggcagtaccataaacagtgttgagcatatttgatgcctgtttaataaatagttgtttatgattatccgatattaagacttagactcctgattgggagctgctttcagttaacataatacagaaatgaaacctcatgtcttttaggaaacatttctagattcctctccagcctcctctgaattactttaacgcttgatttgaatgactaaaactggaacatctttagaaggaaactagagttgtaaatccctgggaatgacttagggtaaataaacaaagacataactcaggtccagaggccaaaaactcagagttcatgttttcaaatattggccagtctgtctttcatacagctgtgtcagctaattgcccaatagcaacctttttgtttgaccatagcaatctgttcgtttctctctctctctctctctctctctctctctctcagcatttactgatgactgtaagtatctttaggtatatttatcttttctctgagtctgcagggtcccttatgatactcagtaactgtgctctcttctccattgcattcttattgctgagtataatgcccagcacttagtaggtgtttaatatatacgttggaagaatgaataattggatggatgaatggatggatgagagatgaaaatactgcctaatgaaagaaggtatcccatcttattaaaataagtagccctccttccttggattgtctggtgttctaaagcgttttttaaaagacatatatgagattaaacctaatctaggctctctccctgtgcgaacacaataattgaaacacatgactttagagaacaaaatgtgacttgactagctgtctgaatcatttcagggtggcatttaatatctttttaaacaaaagacatatatatatatatataactcaacagtcatttaactttctctgtttctcaattctcttatctctaaaatgatgataatatttgcttctttgtacctgtttcgtagttgaattaaaattttgacccctgccatatgattctgcagcccttccacatctttctgcagatactgacataaggtagagaggtcagggaaaggaccattgtagtgacctagtgaggtgtcagcaatgggacgataaggagtagacaatgtaagaaattcatgccagagtgtgggggtgggaatctatagaacttaatgcagatctcaaaggaaacagaagagtccaaatgattaacattgggtttcaaaatccacaccaaaaaaagattttaaaagttgattctttgttcacatgtctcatatatgcttatacaatagcagcattcaaaagtattttgagtcttatagttacatagatatttttacctaaatttctcctgtagcaagggttcagggactttgttaattttatactttttagcttgtcacccagccctttgtttcctctctctggatgtgcagaaagattttaaaatctatccctgccaaacaattctctttcgtgggaatttggtttaaaccagttctgttgctatggtacctagttttcagttaatggaaaaatacaaaaccaaaataatactgaatttgcagtatatatgtccccactcattgcatatcgacttattcatgttgattggattcgtaaacgatcaaaagttgctcagtgctataaaaaaagtatctaacctacttagaattcacatactgacacttatacctttcaagtgttgtgtgtatctgtgtgcatataaatggtagaagagatggcatggagcagtaagagtttttggaggtgaagaaacctgacattgaatttcagcttagccagctaaaagctaattgactttggacaatcacttattgctctggaccttttttccaatctacagagtgggtattcgtaatataactacttttcaggaatgttattaaaattaaagcaatatgttttaattgcctagaacaatgcctggtacttagcaggtttgcagaagcctactagtgttttcaaatgtggagatgatgtgtgtgtgtgtgtgtgtgtgtgtgtatgtgtgtgtgtttgtgtgcatttgtgtgatagggtgaattgtaaccccttaagactcaaatattgaagccctacccccaatacctcagaatgtgactgtatttggagagattgcttttaaagaggtaattacgttaaaaatgaggtccttaggttaggctctaattcagtctgactgtcatccttataagaagatgaaattaggatacttggaggaagcaccaggaggaggcatgcacccaggagagaccatataaagacacaacagaaaggggaccatctgcaagtcaaggagagaggccttagaggaaaccaaacttgctggcaccttgatattggactcctagcctccagaactatgagaaatttccattgcttaagccactcagtctgttgtactttgttactgcagccctggaaaactaatcctatctatctatctatctatctatctatctatctatctatctatctatctatctatctatctattggacaacaaatgttcgtaaaatagaagtgaaaataacatgctagttttcctgagtctttttctcttcatttactgcctccagtgtatagtttgttattatttactttttactaataccttacatggtataaagaaacacaagtcttaaatgtatatcccaatgaatttttgcatatgtgcacatccatgcatccactacccaaatcaagacttagagcattccttgttccctagcagcctctctcatgctcctccaggtaaagagccattcctcttccccacagtaaatacttgtgacttcttgtgttttatatattttgaacttcatataaatgagtcatacatcactcttttgattctggcttctttcacatagcgtcatgtatgtgaaatccattcattttgctctgcgttaaatgttcactttattcattgctgagagcagtattccattgtatgtacatcctccaatttatttattcattttggtgtcgagcatttttgtagtttccattatttataattatgaataaagttgctatgaacattcttgtaactatttttggtggacaaaaccactcttttctcttgggtaagaagtacatgggaattctataaaatgtttctatcttaatgttacttacaggataaagtctatttttctcccttctgagtattgctttttaatctccctactagaaattctcagtgcttcttaacccggggcaggcatttttgctccccaggggatatttggcaatgtctggagacacttttggttgtgacatcttcggggaggatgctactggtagtgggtaaaggccaggattgcagcaatatcctccaatgtgcaggacagccaccaccaacaaagtcaattatctggccccaaatgtcaatagtgctgctgttgagaaaccctgtatctagaccaatagaatttaattttgtatttttactgagtaggtattcattgcttgaccaacccacatattctttctgatacatcttttttagaacccttaggaagaaagagtaatggcagcagcattttccacccttttctattggggttattaattctcaaaaactatacagcctgactttagtgagttcaaggcatcagagcttgtctttatcaataaatatttccagaaaagggaaatagcatgtgtcctttttaagatggtgatgttgcattctgcgaagaaatatatatataaatatgacataaaaatatacatacatatattgcaaatgccatttctttgcctctatttagaaccagctaagatagccaggcacatggatacttgttctatttcaaaatgtctacagaagattcttgaaattcttcctgtcatttttcccagtctctaaaaactgtgatcaatccattcccctgaccgcatgtcatccattgttttctcaggcaacctcttctcaccttcagagtaactgaaggtatattatattcactttagttatcagaagtacctaaaagaaaaaaatgatcaagttatttccatttccatgagcctgagccttctcctctcccatattcctgccagttcttgcttttgaaaactgagcttaagggcaatattgtaacttgcactttttgctgattttatatcattcatctagctataggtctgacagaggtgattacttagctctccaaataggcaatgatgtgattgccttcatttatttcagtgacattgaaatggaggaatgatatttgttggctttgggctttaaagacatgtggtctgctatatttttggctgacagctggaactagtagtgcctgacactagaaaaccaaaaaagtcagcatttgcccttttcattttgaaaattgaaaatcacaggtaattaatcatattaaatgtgaatgtaacccatttcattgctataaaatcacctcttcaattaaaatttttttataaataattatatttgtgcagcttttagcatactaactttttcgtgagttgttttgtaacttacatattaatatgttttaactctgcttccttaactgcattactcattgttattgatatttgatgtctaaggtccgtgatgcccaaagtcttactatgtttgggagagtcttataaaatgaaggactgtctatattaaaataacaatgagaacctcattgatgataagtgatgtaaaaagagagaataactaatttttcaaaatgattctcaaagaaaaaggtactttctatgattatagaatcatggaaaaatgctggaaaagcttagttctacacttaagctcttgggaaatattttatttaagctgataaccaatattatagagaaatgacaattttggcctattttaaaaatactttcatcttcggtagcattatctaaactctaaatctataatatgtcattggaaagaaaagggttccgtgctttcttaaagacaatttgcattttagtaaagagcactatatcaatcagttcactaaataaggttccaaatatgaagaaaagcaagcataacgtgaagccataacagtcattgtttttaattgtgatcaataatctgtgtcgagaacaagtttttgttaattctagaaaaaagatatgacagacaagttgtccttaaacataagagaaacaagatcgatttcatattcactgtcactgtgggtgacattcttctgaataagatttcaaaataaatgctgcaaaatttcaggataaaaaatagaacattagcattaatcatattcatgctcacttctctattttctccacctttgccttctacagtcttcagctatacaggtgatacgcttgttccatttcaagtcaaatgacaccattagttaattagtgttgcaagtctggcaaatgagatctgaaacgaaacacctgtcctttgaccctaacttgttccttgcttatgcaaatgaagagagcagtttaagcattttaaatgttttatttctcgtattatgctgcaggttttatgctgacaaggaacacttaatgtgtgtgaaactagttctgatcatctggtttcagctttttatttattgaatggattttcagtgctgtcattttctttttacctgaagatcacataaaggttgcacaggtttacgtttgcgcataaggaccagtttggttttaagtttagctgtttgagtaacttcatgaaataaattagaaatatatctgttaaatttacccatatgttaaaatagcttttcggtttatgcattatgactattgcaatatgccacactaatatatgaacatttctataactaatatatgtttttaaaatagaaaattaaacgtgaaaggttttttatgaaatatatttatcagcatgaatctttactcactgagcaccatttaataagcatactgattgtaatgattgcattttctccactaaagttctcaataacaacccttggatataaaaataaattcactttcgttattttaaagcaagtcaacaaaataaaattattttggataaattgtataactgaattttcataatgatttatctcagtaagaatagaaaatattattactgtgcagataaggtggcaatggaaatccaatgagaaataaaggctatgaacattgaatgcaatattgttatctgtttgccttgattcatcaaggggtttccaaaatgtttttacaaagttcttattttcaataaatcacatcataaataaaacctcattaacatgaatagagggttattgccttgaaaactgtctattggaattcttggcgggaaagtgagactagtagttatttatttatgtataggtttttctttgcatatacagtagtctctcctggtccctggtttctctttctgtggtttcagttacctgaagtcaactataatctgaaatattaagtggaaaattacagaaatgatttctaaaatgtaaattgcacatcattgtgagtagcatgataaaatcttgcattgtcctgcttgtcctacccgggacataaatcatctctctgtctagtcaccatattcaagctgtacatgctacccactctttcatcatttagtagccttcatggtatcacagtgcttttgttcaaatgaccctttttttacttcataatggcctcaaagcacaagtacagtgatgccggcatactgttgtaattgatctattttattattagttatcgttgttaatatcttactgtgcctgatttataaatttgattttatcatatgtacatatgtataggaaaaacatagtatatataggcttcaatactgtctgcagtttcaggcattgactgggggtcttggaacatatatcctgtgaatagggagggactactgtgttttatggaaaaatggaaattatttttattagaaaagttttaacaaaaggagagcagagcaaatatttcctgtaacagtgggaaacttgttttgttatgcatatggctttctaggtagaaagaatgcttttggggaattttaaataagttgggatgaaaacttgacttctttaactctaaaagatgctttgaagttttagtttttagtttttgtaatgccaatcgtgtaagataaacaactttgaaaccccatatttcagcttatcaaaaatatttaaaatgttcaatcccaccatttaagaattattatatacagaagtatgcattatacagtaattcctactgggaagcttagagcctttagatatttccctctcttaaagagtgggagaaattccaagttataattttttagtattacatatttcagtgtcaaaaaattctcatgaacaactaaatgtacagaattctctttgatataccaagatatgattttacaacttcttttaatgtaatacattttagtgtctaaaaagcatcactaatttaattttagaaattcttttcttttcttttcttttcttttttttgagatggattctcactctgtcgcccaggctggagtgcagtggcgggatctcggctcactgcaagctccgcctcccgggttcacgccattctcctgcctcagcctcccgagtagctgggactacaggcgcccgccaccacgcccggctaattcttttttgtatttttagtagagacggggtttcaccgtggtcttgatctgacctcgtgatccgcccgcctcggcctcccaaagtgctaggattgcaggcgtgagccactgcgcccggcctaattttagaaattctactcaatccaagtaaagtatatgtattccagacctctgccctattaaaaatggagaatcatattcccaattaaaaaaattataagcacaaaggtttctttaaaaatccttaacttttttttttctgttgacttcttcacttaactaaataaataccaattaaaagtttgctctcatggcattgtacagttgatggaagtgggtcaaatgagtgggagctattttactggtccagggaaaagatgatgatcacttaaatttagatggtgcaaaaggaaaacaagaaaagtgcacagattttgtttgtgggtgattgtttttactgtggtaaataatcgcataacataaaatgtaccatttttgccatttccaagtttacagttcagtggtataaagaatattcacatggttgtacaaccattactaccgtcatatcttcaaaactgaaactctgcacccattcaacgtcttcccacttccactccttctagccccaggcaacaaccattctattttctgtctctatgaatttgatttctgtcggtacctcatacaagtggaattatacactatttgtctttttgggtactggcatattttacttatcataatgtcttcaaggcccatgcatgttgtagcatgtatcagatttgcttctttttgaagctgaacaatattccattgcgtatatatacaacattttgttcacccattcatccataaatgagcccttgggttgtttccatgtcttggctattgtgaatagtgctactaggaccgtgggagtagtggacagagttgaaatatattttgttacgtgctgatgaattgaatatgaagactaataaattgtcagaaatacctatccaaaagtatagaatatgatttaaaatttttttcttctgaatatcatatgatcttttaggatactaactattacataatggaagctcaataaatataattttataaattagtccatgaaaggcatctttaaaaactgctttaaatgtctgttaatccgttagggtatcaattttattggccttatttctgcagtttcaaatttgctttatttaattttctcattaaaattgtttatatttaaggtatatagcatgatgttttgatattcatgtacgtaatgaactgattactacaatcaagctcattaatatattcatctctttaaaagatgctttcttggggttcaaaaaccggtaccccacaatatggcactttgacatgttggactaaagaaacattctcaaggtctctctttcaccccaccccacccctcccagcatctctcaaccttctgtctctctcaaagcacaggatgaaggttttctctgaagttcccttatcagcctgaagcctggacccaccaaagaagaaaacagttacctctggtcccttccctgagtttcattaacttaacacatattgcaggaagaaagacaagtctgtcagcacacctggacagactttcaaaaaactatcgtcttctatttcattcccattcaggatttcaaagagaatcatttaccagctattgtctgctctgcaggcccaataggctttgttccaggccattgtatgttttccaggttcactcattttcccttaaaaatatttactatccctcaaattgccacatttcctccacctcccctccccttatgaagaagaatatataaacatttttaccccactgtgttgttgggtcattctcctgtgattcccctttgccatgcacattaaaatacattttatatgccatttctcctattaatatgccttttgtcagttaattttcagcaaaccttcacaggtgaagggtcaatattacccttggcccctacagttttaacttatttttcaggagacgcacatttgtttttttgtgcatgggtacgtaggtttctgtgatgattttactaactaaatgggacaactatatcgttacataccatggtttcactcattcttttaaaattatttttactactctagttaaatataaataccataaaatttgttattttaaccattttaaaatgtatacttcggtggcattagatacattcacattgttgtgcaacagtttcactcgttttaccaaattgaatgttttgtctactggccaggatttattgattgttgtaatgaaaatcttttcactcatagtttagcaatccttttgtaaatgccctaaatctgtatttattgtataattaaataccttagcaaatacttttaaactgaaaatcccggtgtactaagttcattcatgtttttcactctcctttttttttttttttttttttttttgcatttcagtttggcaagtttctattgattaagtgtcaatagacttttcttggttgtgtcaagcctactgatgagctcatcaaaggcattctttatttctgtcataatgtatttgatctctagcatttccttttgagtctttcttagagcctctatctccttttaattactcatttgttcttgaatcttgcctactttttcctatagccatcaacacattaatcacacttattttaaattctctagtaattccaacatcaatgtcatacctgagtctgattctgatgctcgctttgtcttttcagacaatgttttatctttcttttttgtgtgccttgcactttttgttgaaagccagacattttgtcttgggtcataggagctgaataggcctttagtgttaggatttatgttaatatggctaggagttgggctgtatttaatgatttctgtagctgttaggtgcccatggcttccgtttcctctagtgtgtttgtttttagcttcccagttttcttttgtcttccctaagaagtttttctcagatagagtctgtaacttttggttctttcagctgtaatccactgtcattatactggggccccgttagtttggttgtagagtgttgaggagaggaagcattctatcatcataaattaaatcacagtcttttagtgggcctgtgtccctggactgtgaaacacactcataaacgtttcttagctttttgcttcccctcttaggtgagacaggaaaaccagagggagctggagttgggaaaatattcttctttcagatgggataaggctctgataaagctttttcctcctggaaaataggactgtattatggagaacactcatactctgggcatagttcacaatgttttctcatcctgtccccctgccagaaccaccagaggatcaatcttggctcttcactgtgagaacaggaggggtggggttcttagaggtaaagtacagataactgtagaggccaccaggaaatttctgactctcatactaatccacattcagtttccagcaattcataaaaattacggtttaaggattcttacaagtttatggatccagtggccttttttttttttttattcgagggaaactaattgctgctttgactctgtatttgcctgtatctctgcatttcagtgtggaagtttgctttgtgacctcaattttctgatggatccaagaaaagtcaatgatttttagtttctttggctttttcttgtaagcatgacttcctagctctttacatgttggagctcttgggtggccttttaaactactaactagtagaatggaatgcagtaaaaccaacaaaaacgatggaacaacagagcctggaccattaatcgcgccatccaatctagagtagaaaagacaatgtaagtaaggcaagtgaccttttaggtcctaaaagcaactttatcaccagcccctgtaaacttttaggaaaaaaagattcaaaattataataaataatattcatacatatttgagtgagatcaatgatctggcttcttaaattcttcatggaatatcaattttgacatttctttggctcatttccacagtggctgaatctgttctcagtcagaaaggaaactcgtattttcttttttcaaactttgtaattttccaactttctaatgaaacattgtaggccttcattagaaagattacctcagactaacttactgctagccatgtccttcaacagtgcacctaagataatttattgaagtatcttctctcagatggcaaatgtttcttcattcactctcttagcattttaagttccacagtaggagctatgtaagtctcctaaagcccacaatttttagccctaaagagcattaatgtccctctaatatacagttgatccataatggtgtgccttaagctttcttcaaaaattgcctcaaaaaaaaaatcagtgatgtgaatctgcacttactgtaatactgtggtaactgggagtgggccatgtgtatactcatgtacataaacacactacacattcctagtttaactatttgctaaccctgtccattgattttcacagtatatttttttctcctctcaatagtttttaaggcttcctaaaatacaaattgaaataaccttttgctgcagatattatggaatccaggcaggcctgcaagtctgtgcagagtttactctctggcaataagactgagaatcccctttaacaggccctgccagaccacctgttatatttgaataattcacaaacagcttttcccattaattcatgccaggcctctaaatataatccaaaataagtcatgttataaggcatttggattagaaataaagtcattataaccatatgcctgcatttataaatgtacttttagacaacatagtaccattctaaattttcaccacaggatctgtttgacctacagagatatttgggtatctctaacttaaggaaaaaggccgtgaggcaaccattttaaaatacttacagacagtgagtttgaagaactttgaacttgtagtctcctgatgcctcactgatacatccatttcaaggcagacaattgccttccttaagcccaaagttagaaaaaatgaacaggacagtttttcaggttttgtctcaattcctgttcatgcacagtgcaatttttgccacactatcctcatctcttgaagagatggctagccatttcttctgtgatgtctcaaatgtgcttcaaagttcattgtagcccttataacactgaaacctacctgtgtgcacatctgtctctttcagttctttaaatggtatgagaacatgttaagattagctctataatgagtcatttctgcatccctcagatccctggtattgaacttgacacgtaatttgtatttggtgtggttattcagtgagtaattgacaaattcaatgatccatattatgcatgtcacattttagcttcccttaaagaaaagtttttaggaaaggaaaagaacactggggaggggggaaacaaaattaacttggccatgctgagaattgcaggaatgtgcactatgcaaacaagttaagtaagcacagtgtcttccttacttccatcagagaccttgcttggctaaaaagcaagagtggagcccactctctgtattcatttgcataatttgttcacactctgccttagccacagaagtggaaagcctttcctttcctggtagtccctaggacatgtcatctacctccctcgtgagttgtaatatggggaggactggaaggcacagcttagagccccatggtgtccagtcaggggaacatggggataatgtgtccattcactgacactagcgcttttctccaatatggttaacagtcgaaatttgattaaagcaagttaggaaactccagtaaggctaattttctcttgaactatatatggtgtctgttggcaagaaaacaagagttacacatttaagtaggttaatatcaactgagaaactcttaagaatcatagtttaagatcaggccaggcgtagtggctcacgcctgtaatcccagtactttgggatgttgaggaggatggattgctcgaggtcaggagttgagaccagcctaaccaacatagtgaaaccctgtctctactaaaaatacaaaaattagctgggtgtggtgttgggcacctgtaataccaattacatgggaggctgaggcaggaaaatcacttgaacccaggaggcggaggctgcagtgagctgagatcgtgccactgcactccagcctgggcaacaaagcaagactctgcctcaaaaaaaaaaaaaaaagaaaatcatagtttaagatcaaagttgaatgtatattgtgatgagtctacagtgtgggaacaactttttgaaaagtgtaataggtttgagaaaaatggcttaatttaaaatatgtattttctattatatgtgcatgatttttatgaagatatattctcagaattctttaaattagtggttctcaattcagtctatgtatcagaattgcttgtgaagctttcaattaatacatatggatacctaaacctaacccttgattctgattcatttagtctggagaaaggttggacattttttagcaactttgtttttgatttaggattgaatatcactgccccaggattatgaagaaattcatcatcatcctaaaaatattatagtacttcagccctttattatagtcatttttccataagtggcaaataataagaatccaaagaaacatgttgtgtatgcgtggggccatctcgatacagctgatgacaattaagttgttggctgtctggttttaaagatatttggaaagacaattccttttataagaaaaccaaacaaattccagccaatgaatggtcttaggcggtcaagaattttattctggcttactgacatcctcaagatctcaagacacagattagactatgagaagacacagtaaaatactccatctttattcttagagattctattctgaatcccacttttttcagttttattgagatgtagtgacaaaaaattgtatgtatttaaagtgtacaacacgatgtttcgatgtaagcatacattgtgaagtgattgccataatcaagccaattaacatattgatcatcttacatagtagccatattttgtgtgtgtgtggtgagaacacttaagatctattttcttagcaaatttcaggtgcacaatacagtattattaactatagttactagctgtacattaaattgagataacttattcatactgcatcactgaaactttgtacactttgatcaacatctccccattttccctactctcagccactggtaacctccattctactttctgctcttaggagttttaatttttagattccagatataagtgagattatgcagtgtttgtttttctatgtttggcttattttacttagcataatgtcttccaggttaatctgtgttgtcacaaatggcatgatatccttttttttaaaaaaaaatgctaaataatattttattgtgtgtgtgcatgtgtgtgtatatatatcattttctttacgcatttatctgtgaatgacacttctattgtttatgtatatttgctgttgtgaataatactgtaatgaacatgggagtgcagatatctctcccaatcactgatctcatttcctttggatatacacccagaagtaagatgctgaatcatatgataattctattttttcattttttgaggaacctccattatgttttttgtaatagttgtacaaattttcattcccaccatcagtgcacagaggtctctattctccacatccttgccaatacttcttctcttttcacatttgataatagccattgtaacagttgtgcagtgatatctcattgtggttttatttgcatttctctgatgattagtgatattgagcaccttttcatctacctgttgatcacttgtatgtcttcttttgagaaacatatattaaattctttagccaattttaagtaggcttatttgttgttgttgtttgctattgagttgtttgagttccatatatatttggatattaaccttttatcagatgcatggtttggaaataaatttttcctgtttcataggtagtctcttcactctgctaattgtttcctttgctatgcagaaacattttagtttcacacaatcccacctgtttatttttgctcatgttgcctatatttttggagttatgtccaaaaagtaattacccagaccaatgtcaaaaagcatttcccttatgttttcttccagtagttttaaagcttcaggtattaagtatttaatcaattttgagttggttgttgtatgtggtgtaagataagggtccaattttatttttttgagtgtggatatacaattttcccagcatcacttgttgaacagactgccctttccccattgtttcttagcatgcttgttgaagatcagttgactataaatatgtggatttattgctgagatctttattgtgtttcattgctctgtatgtctgtttttatgtcagtatcatactgttttgtttactatagccttgtagtgtattttgagatcaggaaatgtgatgcctccaagtttgttcttgctcaaggttattatggctattcaaagtcctttgtagttacatatgaatttggggaaatgctattgcaaatttgataggcattacattaaatctgtatgtggctttaggtagtatggacatttcaacaatattaattcttccaattgatgaacatggaatatctttccacttatttgcgtccctggaatagatccaactcagtcatgttttaatttgctggtaaattcagtttgctagtattctgttgtggaattttgcatctatgttcattaggaattttggcctgtacctttcttttcttgtagtgtatttctctggcttttgtatcagggtaaggctggccttgtgaaatgattttgtaagtattacccgcttttcaagtttttggaaaagttaacattaacaaaaaattggcattaattcttctttaaaagtttggtagaattccgcagtgaagccatttgatcctgggcttttctttattggaaggtttactttattactgattcagtctccttacttgttagtgttctgctcagattctgtatttcttaatgattcagtcttggtaggctatatgcttttaggaatttattcattccttctgttagacagtctactttgtgatttgacaatgtattttcagtagtatgctttgattcctttctcttagattttgtgtatctactaattttttttttcattgtggttaccatgaggtttacataaaacatctaatagttagttatgtctattttaagctgacaacttaattttgactttgtacaaaagctctatacttttatttccacctttcacattttatgtaattgatgtgacaatttatatctttttatatcatatattcattaagaaattattaaggctctagttatttttaaaacttttctcttttaacttttatattggagttacaagtgacttatgcaccactattacagtattattctgaatttggctatgtacttacctttaccagtgagttttatatttttatatgtcttgatgttactaacaagtgtccttttatttatatttgaataagtatttttcgcatttcttgtaaggcaggtgttgtgatgatgaactccctcagcttttgtttatcttacaaagtctatctcctcttcatttctgaagaattgctttgctggcatagtattcttggttgacatttttttcctcttgtactccggatatataatcccattctcttatggcctggaaggtttctgctgagaaatctgctgatagccttataaagaatccctagtatgtgatgaatcatttccccttattactttcaaaattctttgacttttgataatttgattataatgtcttgatgtaatctttgagtttttgtatttgtgtacttttgagcttcatgaatctaaatatctatatctatctcaatatttgggaagttttcaacaattatttctttaaataaactttctgcccctttctatatctttctggaactcccgtagtgaatgtatcggttctcttcatgggaagctctaaattctgtaggccttctgtactattttttatttctatgtttgtttctcctctgactgtgtaatttcaaataatctttcttaagttcttatatattttcttctgctttatcacgtctgctatttatgctgttcattgtattcattatattcttcagctccagaatttctatttggttctttttttatgatttccatattcattgaactttttttgtgaattgtttttctgattttgttcatttgcctatctgtgttagtttgtacctcactgagctttttgtaaagagttactttgaattatttgtcaggcagttcttagatctttatttatttggtgtcagttactaccaaaattgtgagttgtttttgttgtgttatgtttccttgatttttcatgttccttggagttttgcattgctgccctcacatgtgaacaaggagtcacctcctccttcaatccttactaactgacttcaggatacaaagactttcattagtcagcctgacattctaggggtctcgcagacctttactatggatacacctgccccactcctcttgtttcctcttcaagaagaagctttatgtttgaatgtcttctcttgatcctgcaaagccaggctgggtgctgactgcctctcttttgtttttcctagggcattgccctgaagtactcaaagttaattgccttctcccagtcccagagagttaagccagatgtctgtgtgtgcttgtgcatgatttgcagaggctatgggtagggatggacagaagggcatgcagagtgcttggagacacatacgagaaagttaaatgggtccacaagtgttgcatcttttgatgttcatgggcagggttcatggagttcatgatgcaatgagtagaaacaatggccctttgtttagttctttactgaagttgctgtgagctctcaccccttttccctgttcttagctttcccaagactattcaactgagccagtttcttctgtgttatgggtgaagtgagataaaagtaggcctcttgggcaacattctgactagctatgctttcactttcccctgtgaaacaaatcgtgggccaagaatgtctctcttggcactgagctgtgtgctgccttgggaaaggggtgatgcaagtaaaatgaaactgttttccttaccctcttcaaggtaatcgtggatcatttttttctcccatggtgcgttgggacctctcccctggtccctgggctctacctaatatacttttgtctgtgggtagttgtcaaaattggtgttgctatggggataagaactgaaaactcttatcccaccatctttctaatgtcactcttctctgaatggattacattagaaaagaacaaggtgttcaccttctttaatgatgtagttacaaggaatctacctctgggagagacagttatgttttcataaatcctaaggcaaaacattagatatgaattctttttatttttatattttctttttctttttcaattctatctatctatctatctatctatctatctatctatctatctatctaatctatctgtctatctatctatctatctatctaatctatctatctatctatctatctatctatctatctatctatctatctatctatctatctatctagtagagacagggtcttactgtgttgcccaggctggtctcaaactcctgggctcaagtgatcctcccacctcagcctcacaaaatgctgccaccatgctcagccagatatgagttctttttctaaaggaagggtttatttaaaaggagtcatagaccatcactggattctagtttcctgagagacatagagggtactctggcattgaagagagacactagaaggatggacatttttggaatgtttaacaagtctctcactttacagcatcagcagcagagagtgttaagcttgaaaaaataagaaaaaagtataaaattatgatcttagtgaattaatgacatattgccaagacttaggccatcatttatatattaacattaatgggatgtgaatgtttataataaaagacaaaaagatgagcttaaagaaattagacctattacccaaacataaatatttacttttacatgttgtcagagagtatttgtacctgtcatattgctgttttgcaaattagagagttaaattgactcctttttatagatattctatttccgtcctaaaactctttccatcactaaatctctcactaaactttgtggtgttacataatcctcactttctagttagtggcaatcataaaaacagataaaaaggctttcattattaggagtggcatggatgaagtagttgatactattggcaagatagaacatgacaaagagagcatgaccattatgacttatgcattaagtgaggtgttttgggctctttctggctatgcaccatatggtaaggaaatgatatctctgtcaggatagactagattgtaatgcagtaacaaatgaccctacttaaaaaaaattattgttatttgaatatttgcaaaatttaaggatcatgacatcatgatgaacatctatagaaatacatagctctctacctaagtacaaaatagagatatagagataaagtacaactgattcagatagttaaattattatgctattatttaatgttctcatgtgcagttttatgtattccagataatctttctaaataacttatgtagacatttatattttggtcagtctatttttttatttccaagtaatttaatttttgtcccaattgaattttaagaatagagctaaattaaaactgttactcagagctttttattcacttttatgttaataaagggttccttagagatgatatacctagttttctgtaagtggtttttattttcttggtaatctacaagtcagattttaggcaacacctgttgaaaaaaggttagggcaccatttacatgtttttcaaattgtaaagttctaatgcaggtttctgcagttagaatattcatgacacaaactgtttcaaatacaacttaaattgagattcaggtttaaatgttgatttatgaaagttcttctttaatgaaacttgtttttatgagatctctgaattgcaagaagtaggacttcagctttggaactgaaatagctcttggctatttgttttaatcactttccacacaaacctcacttctgaacggtcatcttatttagagttattatcaacttacttgccttagtgctgacattgttgatggattcgaagaagtgaaattggcaatcctgtatctaatgctagtgtctttggaacaacaaaaggagtttcaaagggaggctgaaattgaacacttaatattataaatcatgatatatgtatttttttgttttgtcttgtcttttactttggagaggggtttctttactgcatggacagttgtattcattaaatatatagaaaggtcatggctttcctaaaactttgggctgttctttaaaaattaatcttattctcatcaggagtttgtcacttctaaactgatctgagttaatttattggaactgtgagtaagagacattacataatttgggcacaaggagagaatctgtgtcctggaacttgctgatggcaccttcaaaggtgacccagttgaccagaaagtgttgatttccactttgtaattttaaaaatatatgacaatcaaagggcatttcatgacccaggagggagtggaagtagcaaataagcatgattattgcaaaagcttactagattgagtagaaggaatatgcactgctgtcaaaaagttgcaatgtaaaatagtcaaaactttttctatggctctgatgatagcaatcaacaaaatgaggaaaatgatgtggcaggattcagaatctgactaaggagtactaacagagaaaattatcatgttcttggctttagagacaaataaatgggccatgtgggcccaatcttttgtaacttaaaaaatgggaaaagctacgggagagttaacgttaccattttatgccttaagtgagatgttttgggctctttctggctacaaggtttggaaccacaattggattaatggtagttggctttaatggtccgtgggaagctaaaggttacaggcaatcatttcatcagcctcctggctggcctcaatggaaataaaattgtcagactgtaactttaaggaggctgagttagcaaatatattaatttcctattgttgttgttataaattattacaaatttagtggcttaaaacaacacaaatatattatgtcacggttctataagtcagaagttcaccatgggtctcactgggctaaatcaaggtatccacaggaggctgcaggaaacacgtttctttgccttttcaggcttctagaaactccgtgcattccttggctcatggcccctttttccatcttccaagtagcagtatagcattaccacaactacttcactgactctgcttctgtggtcatactgccttctctcgtctgtaacctgaccctcatgcatccctcttttcatttactgaaaaagcaatgactgtgacatgactaaataaagaaaatttatcatatttcttaaaataatgtatcaaaataattgtatttatcaaaatgacagcaaattaaaaatttaaaaagaaaacagataacaaatcaatacgcagggtatgaaattactccagatgaaatgaatggacaagtgattagaaaataattatattcatggttgctcaagatataaagagatagcagttactaaaaaaaaaaaacacaaacatttagagtcgctaaaaatctcaaaagaacacaactagtgagtgtgtaaaagaaattctagtcaatatgtataaaacaaaagatcactattcggaatatgcagatacctcttatttattaataatgaacaaatgacctaatagaaaaatggagaaaatatttaagcagataatcaaagcagccaataagcacatgtagtttttcagcttcactgttaatcatgaaaatgtcaattaaatatatatgtactattttctactcaccagattgcgtaaattctaaattgtcagacaattgaaaggttgatgaaaaatggctacaattttgcatattgattaaatctaaaaactaatcacccagaaattaaaacttttggtatttacccttgagaaatactaatacatgtatataaaaagacgtgcacagagatattatttatttttatggttgtttgtggtagggaaaaattaacatcaaaacaaacataaaggccatcaaaatggagtaaataaataaaatgtggtaagacatgtaatgaagaaatactattctgaaattaaatgaaatgcactaaatgtatgtttcaatatgtggggaaattttttgttgttgttttttttttttgagacggagtctcgctctgtcgcccaggctagagtgcagcgtcgcgatttcggctcactgcaagctctgcctcccgggttcacgccattctcctgcctcagcctcccgagtagctgggactacaggcgtccgccaccacacccggctaattttttgtagagacggggtttcaccgtgttagccaggatggtctcgatctcctgacctcgtgatccacccaccttggcctcccaaagtgctgggattacaggtgcgagccaccgcgcccggcccatgtggggaaatttaaaaaagatagtgagtaaatgatatgaaatatttatgtaaactaaagcacagcctttctgtagccagctaggtggtccgcacctataatcccagttatttgggaggctgagaccagaagataacttgagtctaggagtttgaagccaccttgggcaacatagtgaaactccatctcataaaaaaaaaattaaaacacaaaataacactagataatttgattggctacatattcatatgttcagaagtttgaaaactaattgagggataaatagcaaatttctaatagtgtttacaccagtgtagacgaggagtggatcatcaaaggaggtgaggatagaagagagcctggctagatgagtgatatctctaattattttctgtcgaaatatacctgtattcatattttcagtagtttgtgaagtatgcacatggggggaaatgtgtttatgagtaaactaaataaagtataaaaagtggttaattctggaagctagcaatataggttattaatattatttcttttttatgtgttttctaagtttgtaaatattttatcaggataattataccaaaaaaagtagttttaaaaaacagtgcagcagattaacttcagaacatacagagccactgggcaaattcctgagcagaggaatttatatcaaaagcaggatacagaggcaaagagatcttaaaaagacagttaagagatgagtatagcttttgaagctccaacatagatctaactgattattcataagaaattaataaagagaataaaaagaaggaatatttgaattgataatgtcaaataatttttcagaactgaaaaataagagtagagtccactgtttaaaagtatgcattgaatgcccagtatgataagtaaaaataaatccacctatagaaatcaaggttaatgagaacatcttattagataccagaaagaaaagacagactacctacaaaaaaaaaaagacaattagaatgacaccaagcttctcgttagcaaggagagatgccagaaaacaactgaggataaaatatttcaaccttaaattctatgcctacctaaacaattgttaagaagacaaaataaataaattttctgatgttgactaactaagacaacttctgtccataaatttagtggagaggaaggttttttaaagcaccagcaaatgtgaaaccaaaagacaaaaataggattcatgtaacaatgcattttttcttcctcctctcgaaaagaagttaaaacttctatattacagtcaattgaatttccagtaattttccttttgagaacaaataaagtaaggaaaatctttacattttgcctcctgtttcttgataaaatgttaggaaaagtcaaaataagtcgaatatttgatgaaattgatgcagttcatgtcagtatgcagtaattggaagccttggaaccctatgtaggctgacatagaaagcaatgtaaaaatggcacgtgaattttctttcttctttctaaaaagaagagctagatttttagataggaatacaaatgcttcatttgttcataggttatcaagattttctttcatttgaagttttgtttggcagacatcttcctttgaaaatgggagacttgtggaggtttcaaagggacttgtgaggaaaaagttttggacagaaccagaaactggctggattgagagacaacatttttatacaaatgcacattgaaagggaatgaaataacccttaattccaacatgatctgtttcagattactaaaggaaatatattatattgtatggtatataatgagcactcaacaattttatgttgaactagtagcaattatcttgtgctcccgacccactaagcttatttaaagatcaagaataacagattattcttgatttaaagatcaagaataacagattattcttgatttaaagatcaagaataacagattattcttgatttaaagatcaagaataacagattattcttgatttaaagatcaagaataacagattattcttgatttaaagatcaagaataacagattattcttgatttaaagatcaagaataacagattattcattagattatttatgtactagataattaattcagtttaatataagaataatgaaatagattaaaagagagccatgcatgggttaatgatattaaaatgtcacaaacgaataattataccaattgtgtacacaggagctttttgagaaaaaagtagcggattttatgttctgttgaaaactgtaaagttctatataaatgttatttcaacagcattgaaatggtgattttctgagaaaattttctgtactagtttaactaaattatacatggagatcaaatgaattctcaagtgggcctatttattttgaatcaggaattatataaaatatggaggacattattaagaaaaatagcatttaagactaggcctaattaatattttcaatgagggtaatttcataggattgaagagagaataggatttttataactgaatatggtataatagagaccaagagttttctggtcattcattaccaagaaaattttaattatgtggaaaaaagcaaaagaacaagaaagtcaagaggatctgaagcagagtatttatccagcccagtgtcacttgattaaaatagagatgttgtagtcctttagaatgtccatagagacaactgaaactgacctttaaaaagtgttgactataggttttgttgttactgagctttgatagccactttaaatcccttctgatgcaatttatgccctcccttctttatcaaaaaggaaaaaaattgtttagtagataatatggaaatatgcctcatttctctacagtctagcaccactgaactagaaaatataaggcatttatattttctagtttggtgatttcgaccattgaagtgttcttcattccacgctttggaatggaaacttgaaaatgatgtaggaatatagtataaacattctgactagagtatgattgaaaaaaatgtaactagagtggttttctcttttctgtagactgttctttcagtgcacctcttaatatgattatggctccaatctcagagagcctgagaaacttgcccaagtccacatggctagaacataacatgattcattcagggtatattaacaataaggtttattttcgggttaagaataagaaaatgccttatattttttgagtgttcgtttaaagtccacagtcaaaaaatattatatgacttcatcaaggcctaactctcttcactttatcacattgcttcaacaatagactgttaaggcagtggaataatctgggatgattaattttcttgtaatcattgaggaccatgaataaaattgcaaaaaaaaaaaacaactgccattttttccatttatatttttaattagaaagcaggcatttaatgagaaaaattcacgtttgccttgcaactacttatggtcgcgttaaaatgtctatcaatgtaggataaatggaaacatgttaagatttgattattaagctttgcttaattaatatatttccaggaaaatatcagactactgatttgggctacaaataacactgcctggttttttgtagccaggtagtgttatttgcagctgaaatcagtaagtttgtaatttagaacctgttagcctaataaatcatcatgtgttactatgaatatgtgaaggcatttaactaaagtctaagtatgatccatcatatggaaatacgtgaaggcatttccagtctttagtaaggacatggcaatgtcactatcatatagaacagtggaatggctattatttgcctcatcagacggatgcattcttaataaaagataaattagattgaacccataagcggatgtcaggaactgtgagatttacattttagaaacatttcctagaaatatcatgggaaaacttatcaaatggatttttattatcaaaaatagctgagaattgttcgtacatctacatatgctcatgttccttaattctaaatttgcttcagaaacaagtcagtaatttaaatgacaaataaaacattggaaaaatattttcaatgcatataagctaatttttattttaataccaatagacattacatgctttcttagaaaaagaactgaatgtgaaaacgaaacagtttaatctctgctctgatatcacgcatttcactggtgagtctactatttttttctcatacattactacttaaaagtatgggagtttgataaattcaacaaaataccttttattgtagccttaggtggcttcctttgttttctcagttaagaagaggacattaatgagtatgaaaacatctaagattgttgctttatttactaaatgctgggctgattaaatagtaagtctgccaaagatcacagccttgaacaaaaggcatagatgcatatcacagagtaccaggaggggattccattcctattccatttgagtctcccctgacaaatgatactgagcactacgttacattgattcacttgcccacaaaaggttgtgataagagtgtctaatctttatgcttgaattgccttattgtacttgtagaaatgaaagcagaagaaaatatatggaaaacagattgtgtatcttatttgtcttctgtccaaaggatacatttaaaataatttgtctagccaggcgcggtggctcacgcctgtaatcccagcactctgggaggccgaggcgggtggatcacgaggtcagcagatcgagaccatcctggctaatacagtgaaaccccgtctctaccaaaaaatacaaaaaattagccagacgtggtggcgggcgcctatagtcccagctactcaggaggctgaggcaggagaatggcgtgaacccaggaggtggagcttgcagtgagccgagatcgcgccactgcattccagcctgggtgacagagtgaagactccgtctcaaaataataataataataataatttgtctaaacagagttctttcttcagtgtgctcttcacattttaatgctgatttgaagcctgtaaccattaaaattaaaatggaaagattatactttaagagtagaatcctcaaatgcatatagaagtataaacctaatgccctttagcaaagtctaggaggcatcaagataagattagttcctagtagttactctttgttaattaactccctgaagaaacctgagaacatttgatattaaagaaaatatagtagttcattttcagatagattgaagttttccttgctcttctaatagatgtcttcctaatatagtttccataatctctaaatatcataccctgcttttattctcttgtatatttcccctcccatatataaagtatataatgtactgagaaacatagaaataattgcaatatacaatattcctagttacatttcagtaattgttttgtggcatacagttacatattctttctgggagagtgtgatgaaggatatagatgaaagattggtcatttcagtgccaaatcatcttagactttatgtcccttcctccctacaatgtcaccatcctctgtaacgcttttctcagaattgagactccctgaaggtcttagagtttaacgatgccctttttgtccattagtttatttaataaatgattattgagcaactatatggcaagtactgttcttgattgtaaaatctggcaaggacctttaaggtcctcccagggtcttttatcttataagttgtcaaaaaggcttagtagtaattattttatttgagttcacataaggatattacaaggttaagacttttatcgtgacaaaagtttttgtgttttatttttcgtgtctctagttatttttgtttcatttttattctcaaaccagttttgaatcaagggattttatttttgtccagcatttcactttaagacagttagagtttcttacaattcctgtgctcatgaatgaaaattaaagcatataatcattcaactaaagcgtattgcttgtcatcttaaaacctattttaggatgtgaagtattatttattgaaattttaagttagcagtgtttgacgtagtttgtatcagatactctccaaagtcattttctgattaatggagaccatttaaatatataaataactgatacagaatgaatagcactggctattacaatttctttgtctttaaattcacaggagaatggtgttgcctaagaattgttggcattttttaatgaaaatttgtttatacatttacataataaaattaaaaccctttttcaaaggcacttgacatttagaggcattgtttaaaaatattttccagcatcttctagattttacaccaagtgaatgttctgtttaaaaatggttctatggtcaaacaagtttatggaatgatgcctgcttattctccctgtagaaattcataatgcccatttctgtatcagaaaaatcttagagaatcttgcttatctttatgtttccctttagaaaatgaaaactatttcaaacattttattagtatgtagaaaatactatgacagcagaagtattttatcagtctttaaatttttcccaaatagcaatacattccagttgcatgcaaatgtaaataccttctctcaattgcctgaaattaatacattaaaataacagaaaaatagtgttatcttagtctgtttgggctgctataacaaaatactttagacttgtaatttacaaacaataggaatttatttctcacagttctagatgctgggaagtccaagatcaaggcaccagcaatatcagtgtctggtgagagctctctgcttcatagatggtggcttgttgctgtgtcctcacatcatggaaggacaaacaaactctctcaggcttcctttataagggcattaatcccattcaggagggttccaccctcatgatatagtcacttcacaaaggccccacctattaatacatttgggattgcatttcaacatataaatcattgagggacacaacattcagaccataacaagaataagcttggatttggaaagaatttgaaaaggaaagtaggaatacaattgactttcccaagttcataggtagtaacaaagaatgagcaataatcaagatgcctttgttcttatctttccccaactcaaataagttatatataaaaattcatttcttactaggtccattatacttgtctatctcttgaaaacttgagtgtcctaatgaaatgagacttctattttgtaagatgagagaaaggtgaggcaaatattctgaggcaccttctagactgcagagcaacatgcactgagttttttgaaagatttaccagttttaaaaaataaatgctgtcttgttcttcatcatcctcccatcactggcatatcttggtaaaagtgagatgttatcagtgagagccctttaggtagatcctcgtaaaagttaccattttgagaattgtatttatgattgttggtgtgttaacaaaatcatgttgcaagagaaatggacttttggctaactgcctagctctattatcctagaaactagttaaatggtatatgtcaactattttatgataaaaatgtcccccgtggatggatgagatgtatctaggttggaagaaccataaatacttgagaagaagtcacagctttgggtgttcctaggtgcagggactcttgatatggggcatatcccttgaaggtctttggaagctgtattagtccattctcacattgctataaagaactacctgagactgggtaatttataaagaaaagagatttaattgtctcatggttccacagactgtacaggaaacatggctggggaggcctcaggaaacttataatcatggtagaaggcgaaggggaaagcaaacatgtcctatgtggctggagcaggaggaagagagcaaagagcgaggtgctacacaaccagatctcctgagaacttactcactatcatgagaacagcaaggggaaaatctgcctccatgatcatgtctaaattgcatgtcagattgtaattcccaggcccttcctccaatactgggaattacaatttgacatgcaatttagacagtgacacaaatccaaaccataactttccgtccctggcccctcccaaatctcatgtccttctcacatggcaaaatacaagtatcccttctcaacagtcccccaagtcttaacttattccagcattaactcaaaagtccgcagtctgaagtctcatgtgagacaaggcgagtcccttctacctatgagcctgtaaaataaaaaacaagttagttaattccaagatacaatatgtcttggctattagcattcggctcctctttacttatgcaaatctctgcagccagcttgagtactccccagaaaacaggtttttcttttctaccacatgatcaggctgcaacttctccaaacttttaccctctgctacccttttaaatataagttccagtttcagatcatccctttgctcatgcatatgctgttagaagcagccaggcaacatcttgaatgctttgctgcttagaaatttcttccaccagatactctaaatcgtctctctcaagttcaaagttccacagatccctagagcaggggcacagtgctgacagtctctttgctgaagcataacaagagtgacctttgctccagttcccaataagttcctcatcttcatctgagaccacctcagcctgggtttcattgtccatatcactatcagcattttggtcacaacaatttaacaagtctctagaaagttccaatctttccctcagcttcccatcttcttctgagccctccaactgttccaccctctgtccattaaccagtcccgaagctgcttccaccttttcaggtatctttatagcaatgtcccatttcccagtaccacttttctgtattaatcagggttctccagagggacagaactaataggatatgtgtatatatcagaggaagtttattagggagaactggctcacatgaacccaagtcaaagtccccaaaagtctccaagctgggaaaacaaggaaatagtagtggctcagtccgagtccaaaaacctcaaaagcggggaagccagcagtgcagccttcagtctgtggctgaagggctgacagcccccagcaaatcactggtgtatgtccaagagcccaaaggccaaagaacctggagtctgatgtccaagggcagaagactccacaagccagcttatcccaccttcttctgcctgctttgttctagctgcactggcagccagttggatggtgcccacccacattgagggtggatctttctctcctattccactgactaaaatgtcaatctcctctggcaacaccctcacagacacactcagaaacaataccagctagctaggcattctgcaatccaatcaagttgccacctaatattaaccactacagaagctgtcagtggtgttgtcctgaatgacgttggcctgtacctgttagggtgatagctcttctaaatcagaacaatttccccatctcaataatgtggatctgtttccttgaacctaaactgtgtctctgagggtatagcttccagagggctgtgtgagctgtcatacacatgaaatgcagcaaggactcttatggagaggacctctatcacctgacgtagtttctgagaagactcatggcaacagcgcctatcatagttttgagtgtctgaatgtttaattaaatctacagtgaccccttggagggtgattgaatgatatttctctactctccaaatatgcaacttcgttcttaccctctgcatcatcatttataaaatagaaagactagagctggttttctccaggtgtggatctctgataatcctcagcagagtcacttgggatacagattctcaggtctcaaccaagagaaattaaatcaggatctttgaggttagggtcctgtaatcttcttttttaacaccttctcctccccatggtacttgaatacacagctggacaagatgctcattagtttattttctattttagcccttgaccttataattctaatgatttgttcctcccattctacataatgtcttaatgcaattcaaatctcatttcttcagaagaccatcaaggaataaataactgggagtttcagaaatggcaacagtttagggaaaatctctgtagttaagtcaggtttgagaaacccctggaacaatttgttgtaattgtatacttttttaaagatccttttggtcccctgtaatccttatgattattaaaacatacaggtccttagcaccatataacgattctgtttaaactgttggcttttcttttttttcaacatgctatcaccattgtcactgttgccttgactgtagggtagtgacttgctagaaggtcagagattatattaggtcttaccaaacaagtgaaaatcaatattttcactctctttaggagaatgagtttcatatatactcgagatgaaagaaaaattccctttgttgttctgctgaagttgtcaagccttccattagtctaggttaagtttctggggttatgaatttaattttggtttctaatattgatttatatttcataaagactttgttggttacaaaaaaaaaatcctcagtaaatttttctacttcaagggcagtgctttagtttagaaaaagatgtgtttctcagtgatttagtttccatttctggacttaacaataatgagtgaaacaggaaattttgctgtgaattatgaaaggttattatacagtatttccaagccactcaaaattatgcattcatcttaggctcttaaatttaacaaaactgaatgagattcaatactattttctctgttttatcaaaatgttattgaaagttgtttaagattttatactcctcgagggcacatatcttttgtcatctttgcattttcagtagtgtttttatactgcagataatttatgcacattttataaatgagtgaacaaatagatgttatgaaaaaaaagtactgttatcagattccaggataaagtaaaaagcaatatttagcaatcctccatatactacaatgccctacccaagcctgttaattccactcctcatcctcatcctgccacaaacattttcagaagtcctcagacatctctgctatattccctaacttgccccaaactcccgtgatccaaaagtaggcttccctttctcaattaaacttccctttcgctcagtaccccaatctgagcttgctatcctgcggagagttacctgggaaatgaagagatgcagctgtatgatatatatgaacaagtttacccttactggggagatttgtattttaaaagatggtgatggaaaactacagtgatatatacatgctaacttttcccaatgttcaaatttcaggtagtgggacatatggcaaaggtatttttcaatagcaacctaaagacctctcagggaggtgacctccttttctgcctccaagtattgctggttctgctataacctgatatgattttttatttatagagtgctttttataagttgccttcttcaggaaacataaaagagtgggaggggaaatgaataatctctcatgcttttgtatcagttattatcaactttggctgtacattagaatcacctggggagctttaaaaaaatccttgtgtccaggccatcctccaagccaattaaatcagaatctccagggatggagcccaggtatcagtatatataaagttcccaggtaattagattgtgaggcccactaatctaaatgaggatgaggaatgcagtagatctctgatgcttacagaagacaatagttataagaaaaagccatgtgagaaaaattggaaatggttgaccctttgggaactggagagcaaagacagtggctactgagctccaaccaagtgttgcaccatgggagggaaggagcaagatgattaagaggatcagccctagtggcagatcccctgaggttaaagtacttttctgcccttcactatgtgagtttgaatgagtgtcttctttgtacttgttttcttattagcaaagtgaggatgatgattatacctatctcttaaggttgttgtgaggattaaatgaaatcataagcataaatcacttagcattatgttgggcacgtaacaaacatattctacacttttgaactattttgttatgatgatcaactttgaaatactagagttcacttgtcttcttttcagtaggaagttggcttccaatctagggagagagaaggaagagaagcaagagctagggagatgataatcaaatggttctgagaatgatcttaaatttttaagatttttaaatttttaaaaaggctttctatccccttgttcccaccctcagccctcaagaatttcttactgtctttatttcctgccatttcttgttcttttataatcttgtacctctagtttcactatacatcaaaaagatgggaagtgatatgctaacataaatgggtgaatttgtagatgtatcagttgagattttgctgtgtagtaaactacctcagaacaaacaataattattttgtagcttaaaacaactattttgtttgtgcctcattaatgaatgggcaatttgggctgtgttctgctgggtggttgtttttatggccttactcatgtatcagtgtcagctgttggtcatcagggacactctttatttcaggatggactggctgaggctgggatgaaggggttgactgagccatgtgtccctcattatataactagttaaccttggcttatttacatgatggaaacagtttccaggagtggaagattggaagcttttaagatcaaggctgataaccagcactgcatacttctcccaatttcttttgggcataaaaaatcataaggctagcgcatatccaagggaaaagtaagatgagagttgcttcaaagcgttatggccattttttggtaatctttgacaataacctgttgaaataaagcaaatgggaggaaatgaggtcacagtgaggctgatagcattggacatataaaagtcatattatagataggctttggcagatgactgggtatgtgtggtgagagatagaaaaaaattagtggaagttgcagacttagtaattatgagaattgaactttgattaactaaaataggaaagccagaaggtgacaaagtagcacggaggcttacctatatattctcttacagaaaactttgtactgtattccttttctaaaattgcttttgttttttaataaccattttttcccaagggcaagatgtgttttaaaattcattagttaaggactcaaatgaccaattcgatttttctacttcttagttgactccttcatgaacttttggaataataataaaatgtataaatagtgtatgtactttatgctttaaatgaatattcctctaatatcaactccaaagcaggttattcaaagtatgaaaaccaacatatctaactctgtgctcagaccaagatttgtgtagcatctctagagaatctgagagaaatctatgagaataaaagacagtggcactgagacattatctttacatatgtgcttattgaatctgtatagaattcttctataaaaattatagacttttttgttacagatttgctctcatgaatttaattttatattgccttactcttatattgtcactttatataggccactagactgtgaaataaaatcagataaaggtagatgttttccaccactaccccttctccccaatttagtattcacaattattttgctatagcaagatggtctctcctttttactggtattttccctcagaaagtcttttttttttttttcactttgacgtgcattacgttaggtactttaaaaatagcatattttcctaaattaatagtctttaatattcatttataaatacccagcaccacttaacctagtgctttaaaaattgattattatttattattgccattacttaaaatgtgcttttaaataattaaatgactttttaatattcccctctctctctcactaacttgaatacattttaccagccttgatttgtggagatgtctccacatggatagctagctctactggacaggatagcttgtgttactagctcaggcataaataattatttacttttgttctcttacagtattttcctgatctgttactttgctacttccatattattgctgcataataaactatctaagtactcagtggtttccaataacaatccttaattctcactccgttatccgtggatcttctgggggttggctatctgtaaggggcttagctgagttagactctaagatgtaggttgagtctcggtctgtgtcatataactcattctctttaaacccatcataggtttgaacatggtatggtctaggaagatgactctgacagcactttttctctttgccaatttgaacgcagatgactagacatctcaatgtataagatgtgaaacaggaaacaacatgcaaatatacctttattgacttataacagatgacagcaattccattttcctctactattgcattttctactctatttgtgaatgtgagctttcctcatcaatttatagaatctctgtatgactcattctgtcttaatctaaaactgaaataactttatattgtggaaataaaatatcttacatctcaatgtagtctaaaataggttaaatgagatggttcttcctgagcaagcacagcaggtctgcaatacatcttctttctccacatacattatgtcaagtattcctttagcatttatataagttgtatatgtcacacagatatggatctataaatgcaaacagagcacagatgctggcacgatacacacttaaaattgttttatagcttttggattttatttgtgtcgacttaaaagcaaatttataaatattttttatttaagtaaaagatgtgagctgctattaacactgaaagtgattttagagatcatatattctacctcccacattcgtcacattagggagtacaattcagatgtgtcaagtggcttatcagaggttggactgtgagttagtagaagacctggaaatgaactccagctctcctgactacccagttggctttttccatcctattgccatatctcctaggcctctgccaggacagagtgccacagaactgtcagatggggaaatgagacacaattgtttcctggattctattattgttgagatttttaaaaatgtgttttaattcctaacctagctttgcaggcacatcaaagctgagtgcatgtccttccgaaatcttccctggtatcctgtaatggacactgattttttttttaaatcttcgaattcttgtaacacttaaacattttggtgtgaggatagtaaaatcattaagaataggaagcatatctcttgctccttctgcaccctctcacagagattagggcagttctggctgtttaatattattgacaactccccagaaagatgaacacaataaactgttgattgagcacagccaagtttactagatcaactacagtaagagagagcaccatctgaatggagtcttggtaatgtgtcaaaatatgatatttttaagagtttcaagcccaggctgtataattttagggttggtcttgcaaaatgggtagttagttgaggcttgggctgagtttatgtcctaacaggtttgaatgggtgagaacaacactacaagaacccatgatatgattagtgatgggtaaggtattccagtatttttagtgcaagacgaggaaagcatgcatcttcccagaattgcttaacgtgggaaaacatagtggtatcagtttttaatatttgcttatggacaggtcattattacataatcctaaaaatgaaactgggtaaaccccaagttatatgtaggaggcatttctaaataacactcagaaattggaaactatgtaattaatcaattaattaattaatttttggtatacaaatatagctctattaaactaatgataaagatagcatctttttttttttatttttttatttttttatttttatttttattttttatttttttttatcatactttaagttttagggtacatgtgcacattgtgcaggttagttacatatgtatacatgtgccatactggtgcgctgcacccactaacgtgtcatctagcattaggtatatctcccaatgctatccctccccgctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacatgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaagatagcatcttaaaaggatacattgggcatcagattcaggaactagaggcagaaaatttatgggaaaggattgcaggcactcagaagtaattgtggcacaacaaagtgatctctgtgccatatcatttgtcctacagtgcatgctttctagtttcctttgccttgacttcatagtaacctcctagatagagtctaagattgctcctctggcactggtcccttgcttacttgtgcttggcctgtctgttgctgacttcatctcagacttcagcctacagccctgatccctgccttcagtccatatccttggtttggtaacttgtttatgcggtcttcccagtatgtaaccactgtccatactctgtccatatcactgctccaaggtggcttatggtactatatttccaaaagcctgctaaaggtcatcactacagcaattctcctttttctcccatcatcaattttctcttctctactgaatattcctgaaaacatacgaacagtccattgtttttcccattctaaaagaaagaaaacctttcttgactccaatttccattatatttaactccttattatctcttttccataattgcaatatgcctaaaatttcttcaatttctttaattaatttatctcctcccattcttacctgaatctaccccaatcaggccttcaactccaccgctttgctcaaagtgtactggtgaagttgagtcttgatttccatgttgctaaattcagtagtaattctcagtcttcatcttacttaaaattatccaggctggagtgcagtggcaagatcatggctcactgcagcatggacctcccaggctcaagtgatcctcccacctcagcctcatgaatagctaggattacacatgtgcaccaccatgcttggctggtattttttattttttgttgagatggggtctcactatgttgcccggtctagtcttggctcctggactcaagctatcatcccgccttggcctcccaaagtgttgggattacaggcatgagccatcatacctggcccatcctacttaaaatttcaagaacacttcacacacagctgatcaatctgttctctgtgaaacattttatcctcttagcttccaacataatcacttgcctgtttttccttctaggtatctaaatgctcattctcagatttgtttttcttactggtttctcttaatttcctcatcttcttttttaaactgtattttattgtgttgagaacacttaacatgagatctgccctcttaaaaacttttgaatgtacaatacagtattgttgactataggtacaatgttatacaacagatctttatcttatttaactgaaactttatgcatattgattagtaattcccatttatccccacctctatcccctggaaaccatcattccactctgattctatgaatttggctattttagatacttcatgtaagtggaacaattcattatttgtctttctgtgactggcttattttaattagcataatgtcctcaagtttcattcatgttgccatttattacacaatttccttctttttaaaaggtgtattccattgtatatatgtatcacatcctctttatccattcatctgttaatgcacatttaggttgtttccacatcttgctattgtaaataatgctgcgatgagcttggggtcattgatatactgatttccttttctttgaataaatacccagagttggattactggatcatacggtagttctattttcagtttcttgaggaaccttcaaactgttctccataacagctgtaccattttacattcccactaacagtgtgccagggtcctaatttctccacaaccttgccaacacttgttttctttctctatattaaccatcatgacaggtatgaggtgatgtcatatgtcattttgatatgcattttcctgatgattagtgacattgaacatttttctcacatacctgttggccatttgtatgtcttctttaaacatctgttcaagtctttagcccattttaaaaattagattactagtgtgtttttctgtttgtttgtttgtttgtttgctattgagttgtaggagttccttatgtattttggagattaactctttatcagataaatggcttgtaaatattttattccgtgctataagttgcctcttcattctcttgattgttttttgttgttgttgtcgtgtaggagcttttcaattttaagtagtccctcttgtttatttttggtttggttgcctatgcttttggtgtcatattcatgaagcaattggtaagattaatgcatgaaacttttcccctgtgtgttttcatagtagttttacagtttcaggtcttatatttaagtttttaattcattttgagtttatttttctgtatagtgtaaaacaaggatcccattttatgctttcatatgtggatatctagtttccccaatatcatttgttaaatagactgtcctttctccattgtgtattttcggtactcctgtcaaagatcaattggttgtatatacatggatttatttctgggttctctattctgttagattggcctatatggctgtctttatggcattaccatatcttttgaatactgtagatttgtaatatgttataaaatcaggaagtgtgaaacctctaacattttctttcaagactgatttcatcgtttatggtcttttatggttccatatgaattgtagaattttttttacctatttctgtaaaaatgccatggagattttgatatgaattgcattgaatctatagattgctttgggtagtatgaacgttttaacaatattaattcttccaatccatgaacacggatatctatttgtttgtgccttgcttattttttttaatagatgttttgcccttttcagtgtacaactcttttgcctccttaagtttattcctaagtattttgttgtttttggtgctaatgtaaatgggattattttattaatttcttctttagatattttgtttgttagtatatagaaacacagctaatttttgtgtgctgattttgaatcctgcaactttaccaaattcgtgttgtagcaggtttttggtggaatctttaagattttctttatataaaatgttgtcatttgctaatgggaacagtttttttctttcagatttggatgctttttgtttctttttgttgcctaattactctggccaggactttaaaaccatataatttagtctgcagacatcgttagccatgaaattcacaggtcttatgcaaagctgggactgctgaaagtgccatttgaattttaagaaacaacagaggagtttagtcagttattctttcatgtgttattgaaactcagttttgagtgccatctcaaaactaacagaataaaaagaatgtgggaaaattctgtatgtactcaatctcaactttcctccttgaaagttaatatttagtaaaatgtagtctgaaagaaggaagccactagaagtcatagaaacagagagtagaatggtggttaccaggggttgaggttgtgggcggggggttggggggcattggagtatgttggtcaaagggcacaaaatttcaattagataggaagagtaagtttaaacgatgtattgtataacatggtgactgtagttattaacaatattcttgaaaattgctcagagtagattttaagcattttcaatgcaaaaaataagtttgtgagttaatacatctgttaataacttgattagccattccacaatgtatatgtacttcaaaacatcatgttataactataaatataaacaacttgtatttctccatttaaaaaataataaataactatttatagaaaaggaaaccactgggctcccccttgcactattggtcttatctggggaaactgttagcaaaggcgaaataatatgccagatgttccaaatggatacgtgataccaacaggcttctgttagaaactatctcctgcctacaatccaccaactgcagtagtgcttttgtgtcctgcatgtgtactgtcgaatgccaaattatagctccattttccctcagcttttctctattcaaactattgcaggaagttcacttgtacattttgttttgttttatccacccagtgctactatttggctccaattctaccataagcacagatatatccccatgcactgaaatcttgtggcaatgcttacagtggttaatatttttggattatcttcaaaatgaaagcagcacactatttttaaattgttcttgagaaccctcaagcctcaatttgaaagatactgccctagagacctaacataaacatgattctctttttaacatgcaaacattcattccttcagtaaatatttattcagcacctactatgtgtcaggcattgtactttgcactggagattcaatgggaagcaacaatggataaggctgttgccctatgaatttatggtgtaatggataaggctttccttgaataagtcacaattataatgaaccaggcagctaaggacatgttcacatttttatgtagtatgaacagctgtagtacctcaaattgatagaagctatgagttatatgcaacttaaacttgaagtatttttaccactgaaatagtctagaagctgttcctgagagattaagttgttttgcattatcattaccttgtcatcatcagtggtatgtggatgtcatggttaaaagaggaaatataatttcggaatttgtggcttctcagtagagaacacatttaaggaatgatctctaaactactatactacgatggaagagagagttctaagaagtgaaagaggataacaagaagattattaggaggcaacaaagataggcttggcctctgttgatattttctagtgataagtgcctggggatcatctaggtgaagctctaggcgaatagtcagaagttgttgatgtctggtaagttatattaatgtaaaaccaggcaccagctgatttaaaacatacataattcaatagaacacttctatatgttaatcaataacatcaggtctgatcatttaggctacttgggttctatgttatttggagcaagccgtgctccagatcctacgagacaggtacactgaggatacctagcagagtccagctctgctactcctatggtccttgaatcatcctgatggacataattggtaggcatgttaagagtgccgaatcttaggccacatttatactaagtcagaacctgtattataacaagatccccaggtatttggaagaaccttaattaaagtttgagaagcacagatctagtaaactgactctctcttagatctactgataatgcattttccaagccattgattctcatatcaattttacctttttaactcattttatagcattctctgggcttatcatttttccctcattcaacatcactttttaagatccttcattcatactttcatgcattcaatgtattcatagttagcgagcatcttctatgtgtcagtcactgctctaggtgctagggatagaggagtaatccaaacaggccatatccctgactttatgaagattttagattatcatattttccatggcactcctattttcaggtattctttatgatctcagatcattgctcttgatttttggtataaaatgttatgtagcatgacagaataaagttgattatactgagattgaaggaacagaatgctttgagtcatcacagacttttgttacagtcctggatatactatagcctactagctatgtggtcttgggaaagttacttaatctcttcgactcaatttcctaaactgtgctattatatattaattagtaggataaaataaaataatatatattaaatgtctagtaggatatgtggcctaagagactttcaataaattggaggaagaacaactctggctgttcttgtattgctataaagaaacaacagaccaactaatttctaaagaaaagaggtttaattggctcacagttctgcgggctttacaggaggcatggtgctggcatctgctcggcttctggggaagcctcatgaagttcacaatcggcgcagaaggtgaagggggagcggacacgtcacatggcttatgattaacgtatagaagctttctattgaattatgtatgttttcactcagctggtgcctggttttacattaatataacttaccgggcatcaacaacttctgagcaaggagcaagagcaggaacgagagagagagagggaggtgctacctgcctttaaacagatctcacgagaactaactcactatcgcaaggacagcagcaaggggatggtgctgaaccatttgtgataaatccactcccatgagccagtcacctcccaccaggcccactttccaataccagtgattataattcaccatgatatttgggtggggagaaatatataagctacatcagagcttatacaagaaacagcatgaacttgcttggggccagtttattaaatccaatgaagctctattagatacaataaaattagacactttagaaatgtacaaaaggcctaaatttgggtagtctcatgccttcccaagggcaggtattttccctcttcctccctgcctctcccgagtgattccttgcacacgtggaagggagatctggcaggatgctgaactagcctgacgctatgctggtcatggcctccatgtttcctgtgaaacccacaagaatagttgagcacaattcttaataggatggcagtgtctcttgctgacccgcccatgctccttgactctgcagagggcttgtaacaggggctcatccaaggtcaacctcaaaactccacctcagacatcaaatggagtctgaaagagcccaaggaagcctggctccttatagaagtcacagtgatcattggagttgatgactgcataaactataaggtgaccacctgacgacagagtagcactaacctgacatcattaactcacctaccacagcttctctggcctcgaaggaatttttctgcagtactgtgctgtgaagtattcaggaattatgttttgtgctgtaacgtgccatagccataaaccaaaataaagtttttaaaaatgagatagctacttaactaacctgttaagatttaggctaatgattagttctctggcattacacatcctcgaggcatgcaccgtagggtaaaggacaccagaatatgagatatcagtggtctggacaaacagatacttttacttcagagcagtgggaggggagatggaagtgttagtaccatcctgtgatcacataaaggtgactcttcacctgcagttgctagggagaggcttgtttgttactcaaatgaacaggaaattaagagatgagcttagttaatgctaggaatgcttcatggctctctataagtaagcacaaacttgtggggtaggcattgtgacaacgaggtgcctgtaaatatgaagttcagtgcacatgatgtggcaaaaaagacttctgcgattcagacaagcacttcttccaaagagctctaagcacaaccctgacgctgtttccttcattctcaggacacttctgtgaattagccaaaggtcaaacccagtccttctgcttagacagaggtagagggagagcaagtcaccagtcgggaggagcagagggggcaccatagtggggactgcctggctcgtccctctgcccttgtcttcttcctctgccgggcactctcctgtctctccacagggctgagcaggatgtggttctcacagccagtggcctaagtgcccagcagtcaccggagaaccaggcccactgaaccttgggggaagccctctgctgttagggaaggagacagatgcagctgtttattaagggtgaccctgtgcatccactgtgcggagcagcaatttgcaggcccaagtggactcaatctttgggaaaacacagagctagatggattcttattactgccatttcacacaggaagaaacctgctcacagggagtaagtgaaggtccaggatcacatggccagaaagtggtgaacagggatctccaacccaaatcctctgacctgctattgaatctggctgggcagcctctggccagctgtctatgaaaggctggcaggcagcagagtgtggccctagaggatctgatgaacgggtgaaaacctaaaatggggaaactcacacaggatgggttcattttctacaatgcttcaggtgacaccatttttctaagttttaacttaacaaagaacatgagagtgttaataagaattgtatgttcttgggtacatcacgtgggacagaatttacatagaatatatatatatatctttcaaaacatatattcagccattgataactctgttgctttattaaatattatgattcttagattagttgtatcatctgtgaatgagattgataattgtgtttgcaataagatatattcataaattccattcattaataataaccattaagaactgcttgaatttcatgtcttagaccatatagtagcttatatgtaatattatcatttaattcaccagtgtccacagagaggacagagcaacacatgtcacaggaagaatcacaacactatttgataatccctgtcttgggttcttttttggaatgaggtggggtatatataaataaatagtaaatgaagtcaacatgaccatgcttttgtatatttctttctggtttacctcgtttcacctctcttttcatatgaaagttcttgctccattaagttcatatcaactgcaatgccacattctctttcccattgccatcaccttctgacctttagaagttccctatatgaataatgccttcagcacttttgtcatcgttttcagcttcaccccaactgccagcatgattctgagattttatggtgccgagaggagcccccctcaccaatgtcctggcctcacaggccttgatttcctcagagccagtgaggcagtcctctctccccttcctcctcagccagctccttgcaccaggcccacagtttacactgtcactgtaagaaattgctggccttctctgaatctctggtttaaccatcccatgctgatgccaccttctatccctctttcaaggtctctggaggatagtgttcctcctgcagaaggtgatccacgctgcttacagggaacttcacttctgttcttgcagagtgggaaacaagtcagttttgcatacccgttggagctccaacagttcttttccccagccatggtgtttgctaggttttgctcagatgggccctgcttggttgtcgtattagcctgagtgtctaaggacaccagtgttcattcctccctcctcctccactttatcccattctccagcccctcgttagtcaggcttcatgactcctaaactttgtgatgtcattggtgacactgggctctgatcagatcttggcatatggttcctaccaggttcgtggtggaaacctgattaccctaatggccgaatccacttttagaaggaagccttgactttctacattgtaggaaagtaaatgagggtttcagtggaaaactttgccttgtatagagtacatcactctaggttctctgacactaaccttgcatttgtctttgagctcatttctatcattttgtaagttgtaggtcactgacagacatgcttaatatctcgtacagtggaggttcagttgtatctcctttcatgttataataaaaccagttttgcctccatttacacgttcatttcaatatccttgatcaatattctagtatgtattctttatattcttttttgaaccagccacaatttctactcatttactcattagttaaatagactctttaaatacatgttcatttcatatctgtatgagtatcatgattttactctgtttgaaaaatatttttaactgttttggaagtcccagtgagatgcccaatgtattcgcttgccagatccagattatctttaatgacaagaaattgcacctcctatgtggttaaaacccaaatgtgtcttttcttggccctctttaggtgaatccaaagcaatgagagaacattgttcactctctatttttctagctttaatttccctctctactaattttgtgtttctctttggttttgtttcatttacagccaataagttattctcctttgttggcagcaatcgttgtgaacttgattttagggtctgacgatttggagatccctctaagtagataaatggtgtatagaaatctaatgactgttgagtgaaagagaacagagaatctggcttatctttctttttgtctgtcttttttaaatctcaaatcagtgaagaattccatgtcctcttacaggaaaacagctcttctatctagactggggagtttttctgtttctgtgttgaattttgacccatgtctgaacaagaatcgaagctataagttgtacttctctgtgcctgtagggataccttcacctttgattgtgtgaatgtattgtgtttcttagttccatgtggtaataatatatattataaagtctctcaaattaaaggagccctgttctgattggtatatctgaatacttgcttatataaataaaaattgcctaaaattctctgaaataaatgaaattgaactaatactttaaatgtgctagaatacaatatatatattcttcatgaaaccattcagaaccataataaaaaatttaactacacataatttaaataaatatttggcaaaaatgaatggtttactttagaatttattaaaaacagctatatcttttttgatgtcagtgttattacaaaagtgtgttttttaatgagttggggattttttatttgtatttatttatttacttttaatttattttttatttcaataggtttttaaggaacaagtggtgtttggttacatgaataagttcttagtggtgatttctgagattttgatgcacccatcacctgagcagtgtacgctgtacccaatgtgtagtcttttatccctcaccaacccccaccctttcctcccagtccctaaactccaatgtatcattcttatgcctttgtgtccttatagcttagctccaacttatgagtgcaaacatgcgatgtttgattttccattcccaggttacttcacttagaataacagtctccagttccacccaggttgctgcaaatgtcattatttcattgttctttatggctgagtagtattccatcgtatatatacaccacatttttcttttccactcattgattgatgaacatttacatttgggctgattccataattttgcaattgcaaattgtgctgctataaacatggtgtgcaagtatcttttttgtataatgacttcttttcctctgggtagatacctagtagtgggattgctggatcaaatggtagatctacttttagttctttaaggaatgtccacacagttttccatagtggtcgtactagtttatattcccaccagcagtgttacagtgttccctttatactacatccatgctaacatctattattttttgatttttttgattatggccattcttacaggagtgagatggtatcacattgtggttttgatttgcatttccctgataattagtgatgttgagcatttttccgtatgcttgttggccatttatatatcttctttggagagttgtctgtttgtgtccttagcccactttttgatgggattgtttgttttttcttgctaatttgtttgagttctttgtagattctagatattagtcctttgtttcatgtaaggttgtgaagattttctcccactctgtggattttctgttaattctgattatttcttttgctgtgcagaagctttttacttaaattaagtcccatctatttatctttgtttttgttgcatttgcttttgggttcttggtcatgaagtctttgcctaagccaacatctagaagggtttttttcaacgttatcttctagaatctttggttttaggtcttagatttaagtctttgatccatcatgagttgatttttgtataagctgaaagatgaggatccagtttcattcttctgtgtgtagcttgccaattatcccagcaccatttgttaaatagggtgtcctttccccagtttataaaagtttttgtttgttttgtcaaaaatctaagtatttgggtgtgtttctgggttctctattctgttccattggtctatgtgcctatttttataccagtaccatgctgttttggtgactatggccttatagtatagtttgaaatcgggtagtgtgatgcctccagatttgttctttttgcttagtcttgctttggctatgcaggttctttttttggttccatatgaattttaggacggcttttctagttctgtgaagaatggtgttggaattttgatggaaattgcattgaatttgtagtttgcttttggcagtatggtcattttcacaatattgattctactcatccatgagcatagtatgtgtttctatttgtttgtatcatctatgatttctttcagcagcgttttgtatttcatttttagaggtctttcttgtcctcggttaggtatattcctaagtatttgattattttttgcagcttttgtgaaagtggttgggatcttgatttgattctcagcttggtcactgtcggtgtatatagcagagctactgatttgtgtacattaatttgtatcctgcaactttgctgaattcatttaccaattctaggagctttttggatgagtctttaggattttctaagtatacaatcctatcatcagcaagcagtgacagtttgacttctgtttactgattgggatgccctttatttctttctcttgtctgattgcgctggctgggacttccagtattatgttgaatagaagtggtgagagtgggtatccttatcgtgttccagctcttgtgcagaatgctttcaacttttccctgctcagtattatgttggctgtagctttgctatagattgcttttattaccttaaagtatgttctttctatgctgattttgctgagagttttaataataaagggatgatggattttgttaaatgctttttctgcctctattgagatgatcatgtgatttttgtttttaattctgtttatgtgttatatcacatttattgagttgtggatgttaaaccattcctgcattcttggtatgaaacccacttgataatggtggcttatctttttgatatgctgttagaattggttagctactattttgttgaggatttttttttttttttttttttgagactgagttttgctcttgttgcccaggctggagtgcaatggcgcgatatcggctcactgcaacctctgcctcccaggttcaatcgattctcctgcctcagcctcccgagtagctgggattacaggcatgtgccaccacacctggctaattttgtatttttagtagagacggggtttctccatgttggtcagggtggtctcaaactcccagcctcaggtgatccacccgcctcggcctctcaaagtgctgggattacaggcatgagccaccacgcccggccttgttgaggatttttgcatctatgtttatcacggatactggcttgtagttttctttttttgttatgtccttctctggttttggtattagggtgatactgacttcatagaatgatttagggaggattccctctttctctgtcctgtggaatagtgtcgataggattggtattcattcttctttgatataattcagctgtgagtccatctggtcctggactttcattgtttgcagttcttaagttacatttcaatctcactgcttgttattgatctgtttggagtttctttatctttctggtttaatctaggagggtttcaaagaatttatccgtctcatctagattttctagtttatgcacgtaaaggtgttcatagtagccttgaataatcttctgtatttctgtggtatcagtagtaatacctcatgttttgtttctaattgagcttatttgcatcttccttcttcttttcgtggttagttttgttaatggtctgtcagctttatttatcttttcaaagaaccagatttttgtttcatttatcttttgtaattttttgtttctgtttcatttatttctgctctgatctttattgtttcttttcttctgctgggtttgggtttggattgttcttgcttctccagttccttgaggtgtgaccttagattgtctgtttgtgctctcgcaaaccttttgaggcaggcatttaatattatgaactttcctgttagcaccgcttttgctgtagcccagaggttttgataggttgtgtcactattaccgttcagttcaaataattttaaaattttcatcttgatttcgttgttaacccaatgaccattcagaagcagcttatttaacttccatgtatttgcatggttttgagggatccttttggagtcgatttccaattttattccactgtagtctgagagagtactttatataattttggttttcttaaatttactgagacttgttttgtggcctattatgtggtctatcttggagaatgttccatgtgctgatgaatagaaagtatattctgcagttgctgggtagaatgttctgtaaatatcttttaagtccatttgttctaggttatagtttaagtccattttttatttggtgactttctgtcttggtgatctgtccagcgctgtcagtggattattaaagtcacccactattatggtgttgtcatgtatctcatttcttaggtctactagtaatcgttttataaacttgggagctccagtcttaggtgcatatatatttaagattatgatgttttcctgttggactagtacttttagcattatataatgtccctctttgtgttttttaactgttgttgcttcaaagtttgttttgtctgatataagaatagctacccgtactcctcacttttgctgtccatttgcatggaatatctttttcctcccctttaccttaagattatgtgaatccttatgtgtcaggtgaatctcctaaagacagcaaaaacttggttggtgaattgttttccattctgctcttatgtatcttttaaagtggagttttgaggtcatttacattcaaagttagtattgaggtgtgaagtactattctattcattgtgctgtttgctgtttgaatagcttgtgttttcttttcattgtgttattgttatatcggtcatgtgagatttctgttttggtgtatttggaggatttgtttcaagattcagagctccttttagcagttcttgtagtgctggctttgtagtggcaaattccttcagcatttgtttgtctggaaaacactatctttccttcatttataaagcttagtttcactggatacaaaattcttggctgataattgttttatttaaggaggctaaaaatcggaccccaatacttgtagcttgtagggtttctgctaagaaatctgctgttaatctaataggttttcctttataggttacctgatgcttttgcctcacagctcgtaagattctttcctttgcctgactttagataacctcacgattgtgtgcctaggtgatgatcttttgcagtgaatttcctgggtgttctttgagcttcttgtatttggatgtctaaatctctaataaggctggggaagttttcattgattatttcctcaaatatgttttccaaacttttagatttctctttttcctcaagaacaccaattattcttatgtttggacatttaacatagtcccaaacttttcagaggctttgttctcttttttgaaattcttttttctttgtctttgatggattgggttaattcaaaagccctgtcttcaagctctgaagttctttcttctgcttattcatttctattggtgagactttccagtgcattttgcatttctctgtgtgcccttgatttccagaagttgtgattgttttttatttatgttatatattttgctgatgatttttccttttatatcctgtatgatgttttttatttcagttagacttcacctttctctggtgcatccttgattaacttaacaatcgacctgaattctttgaattcttttactggtaatttggagatttcatcttggtttgcctccattgctggtcatctggtgtgatctttttggggtattaaagaaccttgttttgtcatattatcagaattgtttttctggttccttctcatttgggtagactgtgtcagagggaagatctgggactcaagagctgctgttcagattcttttgtcccgcagggtgctcccttgatgtggtgttctcccccttcccctaggaataaagcttcctgagagccaaactgcagtgattgtctttgctcttctgggtctagccacccaatggagctactgggctctgggctggtactggggagtgtctgcaaagagtcctgtgatgtgatctgtcttcaggtttttcagccatggataccagcccttctctggtggaggtatcaggggagtgaagtggactctgttagggtccttggttgtatttttgtttagtgcactggttttgtgttggttggcctccagccaggagctggtgctttcaagagtgcatcagctgtggtaatataaggaggatgcaaacttgccctggagacacgtggttaagtattcaggtttttcaggcggtgggcagggccatagacctcccaagagattatgacctttgtcttaggctaccagggcagtagagaaagaccaccaggtggggggcagggataggagtgtctgagctcagactctctttgggtggggcttgctgaagctgctgtgggggatagcggtgtggttccctgaccaatggagttaagttcccatgggattatggctgcctctgctgagtcctacaggttgccagagaagtcaggaaaagcagacagtcacagatctcaccccgctcccacacagctaccagtcctaaaggctggtctcaatcccaccatgcccctccaacagcactgagcctatttccaggcagctggtgcccagggctgagaatttgccccagaccatgagcctccctactgaaaaagcaagcagactcacagtttttctggtgtctctgggagcctgcagcagtgatcgggttccttcaaagggtctgtggattctctccacaaaggtgtaattttttaacttgggtatgtttttcctgaaagtaaatagatttactaatcacctaaactagcatacttctagttattatttaaaattatgaggaatataaattcatgtttgactaaattgaaccattgtgatgacagtcttttatttccagttataacatttagtagtacgtcaacttaaagaaattttccaagttgtttagataatccttagattgatattgtattagttgatgaacattaactggatgcctagatcattcctatgtaagataaaatactgaaatattaattattaagcataaattgaaatttgtatactttggctttttagtagtaaatcccacagagaggctgtattttaaggtctatcagtgaacatgttcctttctgccatgttgagaattctatagggaaattgtgctgctgtagaaacctgggctgtatgggttccccaaaattacagaatgttcacaattacccaccctttagttttctttataaaacagatgtgactttgtataaaagtcataattaataatatctgaatgagactctgctaggagtcttaaaaaaatgagacatgctttgattaaagtaaaagaatatagaatgcttctgtctataagtgaaatgacttttgttccagaataagaaagaggatggtgaagggcaacacaacatatagagatctgtttgaggttcacagaaagtgaatctgaaagggaccacaaatttgtgttaaaattttgcaaaacctggttcggttttgatgggtgtattcataagatttccaaatgcaaacctagaatttggtttcttttcaaatatagtcacagtttctttggagtattcatttgtttgtttttttgtttgtttgttttttgttttttttgagacggagtctcactcttgttgcccagtctggagtgcagtggtgcgatcttggctcactgcaacctctgcctcccaggttcaagcgattctcctgcctcagcctcccaagtagctgggattacaggcatgcaccaccacaccctgctaattttgtatttttagtatagacggggtttcaccatgttgatcaggctgatctcaaactcctgacctcatgtgatccacctgcctcggccttccaaagtgctgggattacaggtgcaatccattgcgcgtggcctattcttaataagaggttgtaaaagtttgctcttcacattagaggccaatttgcccaaatagcagagatgctatatctcactagaatgacgttccacactgtgtttttgactttgtcatgctcttgattattctcttaaaaatacaaaaaaatacaaaaataaaaataaaaacccacaaatactctcattactgaaagtgttgagtttttgtttatgtaaatattgtattgtcactttgattaataggcagccaagccacagccattcgtacactaagacacccatgatcccaatcttaagtgttcaaatctcctggcaaattttaattttgcctttctcaaatcaaatccttaatggaaaaggaaataaaaaatataaaaccttcacagtgtctttggcacattaaggtttctttaatatttcccaggctatcttaaagactttcccctggaaattcacaaagatttcttttatgcctgatggaaggagaagtaatagaagtaaatatgttcatttgttatgttactattgatgagtttcataattgtccaattaaaagtagatgctacttaatatctaggactaccctgaatttgcatatatcatataatcatcatttgtgaatgaatgagaaagattatgatttttgataatttatttcagtggttataatcaaattttcagataaaatagtgaacaaggccaggtgtggtggtgggcgcctgtaatcccagcactttgggaggccgaggcgggtggatcacccgaggtcaggagttcgagaccagtctggccaagctggtgaaaccctgtcgctattaaaaatacaaaaattagctgggtgtggtgatgggcgcctgtaatcccagctactcaggagtctgaggcaggagaatcacttgaacctgggaggcagaggttgcagtgatccaagactgcgccattgccctccagcctgggtgacaaagtgagactctatctcaaaaaaaaaaaaaaaaaactgaactaaatgtttaataatatttatgaaatgtagcctatgtcactagtatgactttttaaaattatttaaagagattttattttgtccagaatcttggcagtcaggaatcccaaataaatgctgcaactgataagtgcatcattgttagctgatcttaggaaaccatcacaggcatttcaactgtgttttccaacatacggatttgtttgttgaaatgtagctagtcaattttcatttttccacaagtcaaccagctgatctcgcagcccaatcagtttttttatttttatctttccaccaccccccaccacctccactgctggaatacatttgtagagaagttttcaaaagtttagagtttaagaattctgtttctagattgttaattgtgcatatgtgagaattatgggagatgacactgatcctgtttggtgaccacatcacataataatggaaatgtttccaaacataccattttcaaaatattttctccataataaagtttattttttaaagctatattttcattgttaaagtgaaacctccattttgagtaaatagagtatatgtcatttatttattgatttaatatattctaggaagtaaatcactgacgaaaaggtggcaacttttgaattactcctcatttttatgaaaagaaaacatacataacttctgttaaatttgacaactctttgaagtactctacagtgagtgaaataaccagtaagcctccatatggcctgagggatttccatagtcactcttcatttaattgcagagtattgtacagattttacagatttttaaggtaatgaaatccataaattcctttacatggacaatatatcaaaatatgttaaagatgtacaaatgattgaggccacatcaacctctttcccctttcaaacttctactttctcctctgaatagctgctatgatgtgaatgtcttataagtgtctgatgtaaactgggtgaggatcaggatcaatctatatatgaaatattagcaaaactttgaaaactttttgataaaatggatagaggaaaaccaaaagctcttaatattttcttctagtattccaatggatttgacttgtgtgcctcatttttggaagtcagtggaataaattgttactttacttttattttatttatttatttttttgagaggtagtctcactctgtcacttatgctggagtgcagtgatgcgatctccgctcactgtagtctctgccttcctggttcaagcgatttgcctgccacagccttccgagtagctgggattacagacgtgagccaccgtacccggccccaaattattacttttagatgatcacttttcacttcctgttagtggcatattagtaagagtttctgataccataggaatgtacaacatacaagtcatttttgaatattccagtgacataaactcttcagaccatgaacccaaactgagaatggaatagaaagtgcttttttaaccctaaagtaagaagacttcctacagaaggtgctgttggttgcctatcatatttcccagctttgcctttcctaatacaacccgtatttttttcaggatccaccctcctcccataacccatgtgctttcagggtgggctgacccttctccacacccaggccaacatggtgtaaaccaactcatccccaacgtcagtgattcattttggaatggatacgtattacagtttggctaatgaaatcagaggcatagactttttgggagatgcttctgtgctaaaatttcctaagtcttaaacacacacacacacacacacacacacacacacacacacacacacacacacacacacggagggagggagggagggaaggagggagagagagagacagagagaaagagaaaggtctcttttcctcttttgtatattatcaaaggacatgatgcctggagatgcaggtgaataaggctgaagatcacagaatggaaggaagccatcatgtctttagacttacagttatgtgtattaataacttccccttatttgtttaagtagctgaattgaggttttctgtttggtgtaatttataacccactaacacatcataacttaccaatacatggactatatactgttatatggtaaggcttcactcattgttattgagtattattcacctacatttttttttaatgtgcttgtttggttttcctacacatagcaccttcaaagcgggaatccttaagattaatgccaggatatcagatattagaggatgttagaggcaaacaaatgactgtgggggatatgaaagctgacaggctacttttgaaggaagaagatgctaaaaagaaaaagagctgggagacacagacttatactgtaatacacaaaatggatactcgttattatggctttgagacatcaagggaaaagttgaattatcctttttatataaagactgagaagtgtatattttacaaagactttcatcaaaaaattctaaaatgtattaaatgtgtaatgttttttgaagagggaagttatgcagaacattgttaggcaggcaggatattctttatttctcccaacacctagtacagagaaagggatgaaggacatacttaaaatttgttaaaggagtaaagagatggatttcgaagacaaatgatatataacagaaacatttccaaaaacactgttttcgaagtgttttctccgtagtaagaaacctagctctataacctaaatctattttgcagtttcataacccatctaacatctgaatgattacttctaaatatttttctctacttaattttctatgatgtctgttccccaatttatcttctttggatgtttaagaaaaaatattacaaagaagttttgaaggttttcctttttaagttatgcatagaaatgtacctgccaaatttcgaatttcttgtcaaatttcattcatgtagcaagatgagatttcagggtcacagtgaaagtctatgaatgaaaaaaaatgttaaatattcatattagtgatgcatggggtaggaagtagtggggagcggtcctcctaataggcagacaataaagggggaacgtgtttgtagaataatttagaaacaataaggaaactaacaggtgatctactttttatcaccgtacaccagcaattctaaacaatgtctgtgatgaagtattttccccccaaaatattctactggtctatattctaaacaactgatgtggctactgtttgttttaatcatctttatgtgaacttcaaattcgcacattattggtcatccatgaataaacatttaactctacatagcagttaacttgaagacctcccaattgcacatacagtctctaccacacagactcaactacatgcatttattttcagagtaaattcataatagtttggaattgcctgagctacctttgggagaagttactgtattccaaccagtggtactagatttttttttttctttaaacaggagaattcatgtaatgaatgatggcacagtaactttaaagataaagacataaaacatgacttgcttaaattttgacattgtatgacacccctttagaatttttgtgttcagaaagttaaacagtgaagcaggatgtgacctataaggggtagtatttttgtttgtaaggagtacatttttaatgaatgaaatatgttactatattggaaaaagacatttacagtgaaaattattttattgttttgaaactaaggaagaaattcagaaaataatgactatcactgagttttgcatgatttttagtgacactaattttatcatgtagaggaagagggtgttaaaatatgattcactttcgtagtcgggtaccctattacttctctaggtcatccctcctatgtaacatgcacactgttaaggcatgaattaattattttggaagtcaacttaccaaataaaccagtgctaccattttctagtctccatggatcagtttgagagccatgaaaaggattaaaatgatccttacaatatacagatagtcttctagtaagtcatgacacactgtaattaagttgtaactgttagtctctctgcttgttcctttcctatcttgaaatgaatatgttcaagatcaaatatgaacaagcatttactcagtggaagatgaaatgggtatgatatgaatagattaatgacatcacatgtgccttctttgaagaaattaattatccaaatgatgttagtgacgtgaagcctcctgggggcacttctcattctactttcagtaatgagctgtatcctgtcaacttactcagcaaaattcacaggaatgcatgtttctctttcatgggacacttctctgggacttaatgattccacactctttctctttttctactacctttctggattttcttctctgtctcctttgctggctgatatttgttttactagcctttccacatgagagttttttaatactatgtcctagacttcttcctcatctcatgttatattcttatcaaagataatctcatgtatgctcttgacttcaaccagcatgtatgagtggatagcgtcaaaatttctatctccagtctctccataaactccttgtagtcactaacagttggagattgccacctgactgtctcagggacacttcaaactcaacctttatgtttcaattatctattgtcgtgtgaatattatagctaaaacaatgaagatttattatattttaaaattctctgcactgactgggtggtttttaatgctccacttggtgtgggctgtagagttactcgtgcatcagatggaggctggactagttggaacctctaagatgtcccctctttccacatgatgtctcttccatcagggcctcttcatatggcctctttctttaacaagttagcctggactttttaatagcattacagctggatgtcaagattgcaaaagtagaagcttccaggcctcttaaggccttgtcccagaagtggcacagatcagggaagcccattgctttagccaagtgcatgtacctatgaaaatcttaagttttagagataaagtaggtattaccatcatagaaggggtttcaaaaaaaaaaaggaaggaaggaaggatgggagaaagaaaggaagaggaaagggagaaagaaaggaagaggaaaggaagaaagaaaggaggaaaagtaggaaagatggaaaaagaaaagaaaataatctcaaatcagcttcttaaaataagaggaggaggccgggcgcggtggcttatgcctgtaatcccagcattttgggaggccaaggtgggcggatcacgaggtcaggagatcgagaccatcctggctaacacggtgaaaccccgtctctactaaaaatacaaaaaattagccgggcgtggtggcgggcgcctgtagtctcagctactcgggaggctgaggcaggagaatggtgtgaacctgggaggcggagcttgcagtgagccgagatctcaccactgcactccagcctgggcgacagagcgagactccgtctcaaaaaaataaaataaaataaaataagaggaggaacaaatattcagcaatcagcgtcattgacactgacacttgatcagtgtctgaagtgagagcagctgttaggaaatcctacttctatctatcaagaagggtttatttaagaaaatagatgacatacacgctataattatcaatatagtttcttccatgggctaccaagtccaaagtattattgcttttgcataatttatgctgataaccttggaatcatggtttggatggtttaaacctctctctccataccaattgaatcattcatcaaatcatatggaatctccctatgtgtaacctcccgtcaagtcctccattttaatttctgtcaccactactctgctgtattttcctttcgcctcaaatttgaggtattataaaaatcttataatggcctatcccggatctaagctatcttacacattaattacacagattccccattgcttatgtaatacaggccaaacatcttagcctggcattgagtgttctctataaatcgttgctttaactttatttctagctcccttatacacaaacttccctataaggccaactggatgagtttcctgtatttaattggtcaagctcttctccacctgaattgttcttccctcatactaattttcccaaatcctgccttctttgtgtgtcttggctcaagtaccatcacatatctttctggaccaccctagccttcaatgatcatcagtcatctatgttcctcttaaaatcagagccaattggcttttagtgtaaaccagtttactgtttcttaaggtttcacgagtcttaaattaggtaacaaagtcttctggaatgcatcaatataattagtcaaaaataaatgttcaatgtatttgttttctttacttttgaggaaaaaagaaattaacagtctcggattatgtatctcctttatacaaagctgctgtctgccaccaaacttattgggaatgaaatgaacagcataagaatctgcttttagaaccagagacagggcagatctagggatccaggtgtcaagaacctcccagtattttcaggtattgaccatcaggatgaattaaatcttaccatttttttttatttttctgatacattttgttcataaattaatttgaagagagagtgattggcagagcttcaaccacacacactttctacttgaagtatgagggggagtgggtctgatgaaaacttgaatgacttcctatcaagactagtgagagagaggtaattctccaaaacagactagtgaagcagttatcagaaaagaaggaagcaaatgttaggcaagcatgtaattctttctttatattaaatcatatgacttacctgtgtttaatatattcagagcctgacaatgagagagaataacttagaaagcaagggagattagttccagtagaaagactaatatttattttgttgagatggtaggaagtgggagtagaggaacaattcaaaagctgttcttgactcgcttttaaactcttcatggtggccagaattgctttcaaaaatactatatttcccgtagacagcatattaatttgcatttcaagcattttgataactgttaaattatttttgtcttgaatacactattttatagtgttttataatgctagttgagctctctggaatttctaagaaaagttccagaaattaaatctcctgggtaatgtgtgaataacagaaaaggatccaatgtattctcaccaaaagataactgtccctaatgttaaaaagcaggggaagatgtcatcattttattgttaacctgacggtgaaactggagaattccctgaactccttgcaggtcttgtgacaggggtgtgactcgtttgttagtttgcgcaattgctgctgcacaaaccccttacgggatggggagcacacagatgggcaggtgcaggagccggggcaagcacttttgggctcctgccccacagtggcgtctagggttgtgttacaattaatgctcttttagcagttgccatctgcacatggctaagtgttgaggactaagctctgattttttatcttgcccaaattcctacctaaggggcctagggagtcatgccctacaaaccatgaattctcatcagatgggttttatttgaccctatatattgtgacttacttttctatctgactctggcataacattataagacaaggaaaaaatatttaaccccaaaatatatttccttgccataccttgaaattgccctgcaaagtctcttgtgggaaaaatccacattctatagagaatccctttccccctttgttttccttcctttccttcctgatccaggagataatcaactaagagccaggtacccttttaggtccaataagaaacattttacaacctgctctctccctctgaagtcttctgtctgagagcttcctctgcacagtaaaacttggtttccacagtcttatactaacctgaacattcctttccattaatcccaggtcttaggtaaactcaaccaattgtcatttaaacatttaaaccagaaaatgtttaaatttacctgtagcctggaagcccctgctttgagttgtgccacctttctgtaccaaaccaatgtatttcttaaatatatttgattgatgtctcatgccttcctaaaatatataaagccaagctgtaccctgaccaccttgggcacatgttctcaggacttcctgagggctgtgtcatgcgccatggtcactcttatttggctcagaataaatctctaaaaatattttagagttttactcttttctcaacagtgttaaactggctcagtggagagtcatagtgacagccttttgcaccctgccctcttggtacctgggtccttgtctggtgtccaggaagaatcaggtcagacatggacttgaaggatgttgaatgcagggattttattgagtgatggaggtggctctcagtgggatggatggggagctcgaaagggtatggactgggaagatgatcatcccctggagttcagctgtccttgcctgatctcctcttggaccgtccccggcctaactcctattgacattcagacactccttctcttttcttctctgctataccactctgctgctctcctgctcttctgctcatctgtccatggagcctagggtttggggtttatatgtgtacaggataggggggcatagtaggacaaaaggtaacatttggatgcaaaaacaggaatgcctgttcccatttagggctgcaggtttccaggcttgacatgaggcctttgctaaagaaccaccctcttctacccagtatttccctgcctcctgtccgtatcaattctatttaattttgtaatagagcaatgggtaatatttttgagtcaatggaccctttagtaatattttttaagtcaatggaccctttagagttaccgatgacagccccagtattctctccccaaaacatacatttgcaaaatgacacacaattttgcatacaagttcagaggatctacatgtttctgaagcccatctatggatgccagatttaaactcattttattaaaaaaaaaaaaggatattagaactacaatgaaagagcacaggagaaaggataactgtctttcatgggaatgtgcacttttcaattttgctgtattttcctaaattatctctcagctaatacctgacttcatcctttgttatatggcagcaaatctcactaaaatggaactagtacaaggatcctagactttatcactcctcctcccacccatctcccttctgtagtatgtgttaaataagaaagtttttagtgtgtttctgagacttgttcctgatttgatttcacacttcaacagtagtgatccttaattattacttaggaattactttatgatttggtaatatttaaggacttaagctacaggttacttttttaatccttaggtgacatgctacctaacactttctctctgcttattttataattctaatttgagttattagctcttaattactcaataattattcactgaaccctctgtatgtgccagaaactgtcctaggtactgagaataaacaaatgagtaaacacataagtttcctgccctctgggaatgcacattcttaatttactaactgttaaattcaccacatacttttgttaatttgtctgttttagaagtctggctaacttgtttaaaatttattgtactcattctttctgaagtggctcttctacatcagcactatcaaataaaaatataatgacagcccaaagatgtgattttaaatattctagtagtcacattaaaaatcacgtactaagaaacaggtgaaattaattttaatagtatatttagttaacccagtatttacaaaatattgttatttcaacatgtaatcaatgtaaaaatttattgatgagatattttgtcttttttatactaagtctttaaattcgggtcacatttcaagtgttcaacagctacatgtagctactgattaactattggctagatcaggccaaaatgttcaaccctagccacttgctcttcctccgagagcttcaatctctcagcatttcttatgcagagctacttagctccttctcagatcctgtctctaaaatacaataacaattcgatccctcctcaagctccttaatgtcttaattcataaagagactcttgccatgaactatttgcctaggagggcaatgaaaggttataaattcaacattgacaacaaaaacagtttgctataaatgatagataaatgataggactgaaagggataacgtgcttgggtcagcgaaacttgggtgtggtaggacaaatgggagaagctgggtttttttcgtgtgtgtgtgtgtgtgtgtgtgtgtgtgtgtgtgtgtgtgtgtgtttcttttttttttttttttttttgagacagagtctcgctctgttgcccaggctggagtgcagtggcgcaatctcggctcactgcaagctccacctcctgggttcgcaccattctcctgcctcagcctcccgagtagctgggactacaggcgcctgccaccacgcccggctaattttttgtatttttagtagagacagggtttcaccatgttagccaggatggtcttgatctcctgacctcgtgatctgcccacctcggcctcccaaagtcctggattacaggcgtgagccaccgtgcctggcagagaagctggtttttaaaatgctatgttcttatattatggaacacttacttgtcctctggtatactcaaaattatgaccaaggatcttctgagagatttaactcatctggagtaattacatccgctgacaaatgcatatatagtgccaatgtcatacttgccttgttttctcaaccttccaattcctaggcaaattgtcagattctcaaggtaatagctgtcccacatgagactctggtatgtgcagatctttattgtgacagttccttttggggcttctgtgacccaatgaagtgaaaataaagatgaaatatttcaagattttgaaaagtagtttctattaaaagttattcgtctaaaatgatttctgttttatagtatttagtgcataaagactggaataaaatgctgtaaactaactcatttaatatccttctgtgaattcgaatgagaaagacaaattgactggattaaaaggaaacattgagtaacattctgtctttagttaaaaaaagtccaacaccagcaagacttaccttcttttacttacacatatagttaatattagtgtacggtaaagcttctccacacatctaggaaagaaacaggaaaatgcattatttcctttgaaagctgcctaaacacaaatctgttattcttctgagaaagagtgatgcctatacagtaaaaaagttattctaaggaaggaaaaaacaaaatacagtatgtctgttgtttaagccaatagatgtctttaaggaaacattttcttaagaatattctttacaatagtgaggctgaggcaggagaatggcatgaacccgggagacggagcttgcagtgagcggagatcgcgacactgcactccatccagcctgagcaacagagcgagactccgtctcaaaaaaaaaaaaaaaatctttacaataatataattttcaaagttctcagaattctaaaatcttgctggatgatacatagatgtatagacatgtacccaaaggtgctctactaaattaatcactacctccaacaacctaaagattacagtttattgtttaaatgaaggatgcaaaatataggtgtatatacaaaaagcccctgttttatagctcttctaaatgtgagtatcacacacgggaaaaatcgaaaaacaaatgtaagtctaaatctccttacagagaagaaaatgtagtgtggcctggcctaatattacgacttttccaaggagttactatatatggtttaacagaagattatttccatcaaaaatatccattgcttgtgaatcttaagaacaggaagtttttcaatccaaattaagctgaagaaaaacaaaggagaggaggggaggggaggggaggcgaggagaggggacgggagaaaaaagttctctgctagcttcctaagcagttcagctctgagggtatgctttgcagcagcaacagcacacctgcccagaccactgcagcaaaggctttcaacaattcttgggaaactaagtgagggcaaagatacatggtagttccaggacatcccacagtaggatttgtctcacggaggtaactcagggaggaagaagtgagcagttcactctgccttaacagtttacatatatgaactactaaacttaaaaaaaaaagtttttcaatccaaattaagctgaagaaaaacacacctaaatagtatatacccaaagtattatgtggcataatattttaatcataaaaataatatgtatctatttttgtttctcctttatagtcaaagcactgtagaagtacagaaaggattgttctgagagagttcttgaagtagaggttgggggaggcagcctaggattcttatctgtaaaatgtgtggttccaacatcttatgcctacacttgatctcactgctagattgtgggcaaggtgctttgaagggatgggcattaaagggaccctccaataagtgaggcttaatggagtttgcagagatcatcatattctagaaatcacacatgccgtttttgtaggaacagagacagggtcccaaaagtatcactggatactggagcagaaaatgagaaaactcatcttgtgatgccaagagaagcaaagtcttcaagattctttctggtttatttctatagtatagctatcaatgttagtggcataatgtagtatttcatgttcattctgggtcactttagactcatcgtagcactgatttggaggaaaacagtatgaatgggcacaactggatgatccaggagggattcttttttttttttattatattatactttaagttttagggtacatgtgcgcaatgtgtaggttagttacatatgtatacatgtgccgtgttcgtgtgctgcacccattaactcgtcatttaacgttaggtatatctcctaatgccatccctcccccctccccctaccccacaacaggcctcggtgtgtgatgttccccttcccgtgtccatgtgttctcattgttcaattcccacctatgagtgagaacatgcggtgtttggttttttgtccttgtagtagtttgctgagaatgatggtttccagcttcatccatgtccctaccaggagggattctttagggaagccaggcaagtgggagtggtcatgtaggaggaaagtctatcccatagtacctgagaggtgtgcactaaacttgccacaggagacgatgctgactggggaactctattgagggtggcaaagcccacagtttaggtggaaaagcacttgaaaggggaatggattcattgcttttgtcatttttacctagactgttataagggcttctttttttatatctctattatcagtttttttcttttggaagtctgtcttttaagtttactcattaattgtataaccatttattgatcatttatacagcaggcactacgctgtattctcctaatacaacactaagaacaagtccctgtcctcatggagcctccagtccaagcaaccccaatgatgtgagagaactgccacaggatatataggagcatgtagcgctgactcactgtctgattatcatcactcttttaatgatgccaagatcgattagtgggttcaactggttacagcctcatccctgaattgtaaaattccctattagcctaaaggtgcccaggatttaattgttctggataatgatttcttaagaattctgaagaaggtttattcagagtttcctttcattcattgatagagctagtatttattcagcttattctaaacactaggcattatgttgttgctagagatacaaaactaagtgagccaagatgaatatagaggaaacataagtgagtaacttcagtgcaatatgagaaatgtgcagggctagatgcagagtcctctgggaacagaaaggaagcacagtccttaatgacagcaatctctggtgagtcaatgaatctctcgcagtttatttaggtcaggagctattaactgtcatgcattagtgagcagccaacagtgggactgggcagtctgagccctgtattgaaaagccggcaacgaaagaaacttcactagaggcttgatgaaccagttcttaaactaaagctcatgtgtctgcaatggacaatcctgcctcaacctcgtgaaaaacagaccaggattctctatggttatgcactactgcatttgtttctttagcgttcctagagttgttttcatcagttatttaagtaagaatgcccgaggtagtccacttcactccctagatccctattaatacatttcagttgaaaatctgttgtcccttgcctattttactgcttccaacattgagatttgatggaaagaaatcagctctcaaataagaatggtgtcacctgctgctggttcagcggcactgcaaactacagattatgcaaattacataaagatccaatctttctacccggagcctaggaagaggccttcttttcccactgggtcttatattctagagtcagccatttacttaatttcccaaagaatactgcaagagaatactgtgaaagcattatctaaaatacaacaaaagaattctgtaaatgttatctaaaatataataataagaaaaaccaaaagaattcataactaggctgaaagtattctcttaggattttaatattagatacaaaattgctcattagcctttaggttttcttccctctcccaagcactcaacaattgatttccttgcatactaggtaagtgtcctatgacacataatactttcaaatatttatatcttttgtaagataatatttttcatgtaatcctagatggattagtttcctatgactgctttaaaaattgccacaaacttagtgactgcaagccacacacgtttaatttttttcatgtctggaagtcagcagtccgaaatcacttttactggtctaaaatcaggtgtcaacagggctgtgctccctccggaggatctaggggaaaatcattttccttgccttttccagcttctagaggctgcattttcttagcctcgtcttccctcttgttgcagtcgtcccaatgacttttgtctctgtagtcaagtctctctttgcctccgtcttaggaggagatgtgtgattaaattttgcccacctatataatccaggataatcttcccatctcagaatccttaacctagtcatgtctaaaaagtcccttttaccttataaggcaacacaaattccagggattaggatctggatatctttggggaccaggaatcagcctatcacactaggtaatgaagtcattatcttaatctgaagtatctagatcctcatataatctaactcctttagtctatttgagttgttttaattttttctcaagtacattagctgccaaatttaaaattattgcagatggaactcttgtaggtctataatgtacagcttgctgagccacagtaaacagtatcatttttagctttctatcaatgtttgacatacaaaatggtcaactgcagaatgtttcagtgacttctctagaaccctattgaatatttaaaatgtcatacatcatgttgttgagtggtcttcgtggaaaaaatcatgtttttaagaaatctattccccttcgatttagtgcttgggtttgtatattccgatgaactgatatgcaactagagctatataactaatcctgatttttaaaaatttgtcttggcttccaggaagtacagactaaatttagtatataattacagtaactattcttagctagtatttcttgtataattatatattcttcaccccaaccccaataatcatttctcctactccttactaggatgcttttgataatttatcttcatttaaacaagcttattgcatgggttttctttattataatctatctcaaaatcttttttggaagcagatatgaaataaagcaaacaaacaaataaacttggaagatatatagaccctatgaattatagcccatctgcatcttttttgagtgccaaagacataagttcagctatgaatacattctgttactacaaaagcactttaaaattgtgtttctgtgcattatatagctccttagaatagacagatatatttagaggggaaggatatgctaatcaatgccactagagccagtagttttcttgatttcattcaataccttccagttttaataatttgcaactgatatcaatgatcataataaaattttaaattaaaatgtgtgagctgtttttttgttaatacttcatgcattgaagagacataaacaaagttttgaaatcataactacattttctgaaaggcttccacaggaaaaaaggcttcatattgatattattttgtacaattttttggacaattttccctccttcacattcagtttattagaactgaacataatatctgacataagtgattcatatatgggctaaataattcatgtatatcagaggccaagcctattggatatggtggaagttttgaaaccctatctttgtggaacaacaaaaaattaaatgtaagggtcaaaatgtgagggctcctttctcatttgttctgtgaatccagtttctagtggttacttatcatatcaaaatttctcgtggcgttttcagagctacacctccaataaacctaaatgatgactagctttaagacaatagtctatacagttacgtactgcttaaccacagggatgtgttctgaagaatgcgtcgttcagcaatttcattcttgtgtgaacatcctagagtgtacttacacaaacctatatgttttagcctactgaatatctaggctatatagtatagcctattgcttttaggctataaacctgcacggcatgttactgtactgaatactgtaggcagatgtaatacaatgatatttgtgtatctaaacatagaaaaggtacagtcatatttaattttaaatgtattaaagtaacccatttcctcttcccacttgactagctatttcctttttgagaagtagacattatgtttaaaaatgttttaaaatactgcaatattgttgatattattagtttactaaataagacaataaagacagaactcagacaaataaaatgcagcagctgtcagttgatgggggccgccattacttgtagaagaaaccttcagtaagcgttgaactagtggcctgggatagttgattttaagaagacaaataaaaatgcctggagagaaaaaatattttactcattccatatgagtagaaaatatcctttgaaatattatcagtgacttacttacgtcagtctttcttaacttgggttgtctgttaaatactttaatatggcttttgccatagctgggtcattgctataagttaacaaagggctgttttctatatcgctggaactctcctttgttagaaccttctttaaatagaaagaattctcttgcagtacgtggtaattgccatagattattgaaatgaaaaatggctatgattactcctaacaacttgagatgttctgcttacagtggatgttaagaacatatcttagtaatttaaaatttttcttaataggcataagcaagtttttattctttaaatgtacttcaagtggttacaactaataaagattggtatataacaatagagaagaggttccaaagtaaaaatccacattaaaattaaatttaggttacattattgcttagcagtttaaaacaatatgttccatatatacatacatgtgtatatatttatatgcatacaaaacatacatgaacatgtataagtatatggatgcagatgagtatatgtacacatatatatagaataaatgcataaaggtatataaatatatggctgcatttgtgtaattggatatatatgatacatattttatatctgtatgtcatgagtatttttctcattttttcctctttgagaataagtctaggtctatactatcaataaaatattgaaaattaaattaattacccaagtgaaaaaagaaagttctcagagttatgctgttcatacttatgggagaagtgtagattttttctgatttgcttatcttttcctttatttaaatgtaatttttactgatatgtaatagatgtacatttttaagggtacacatgacaatttaatatattcatataatttgtaaagataaaattagcataattggaatatctgtcaccttaaatatttatattttctttatgctagaaatacatgaaatattctcttctagcaattttgaaatatacagtagattattgtaaactgtagtcaccctactgatctatcaaatactaggtcttatttttttctatcaaactctatatttggacccattaaccaatctctctttatctccttctccttcctacgctgtggtaacaaccaatatgctatcttcttgagatccacatttttagctcccacatatgggtgagaacattcaatatttgtctttctgtgctggcttatttcacttaacatattgaccttcagttccatccatgttgctgcaaaagacggatttcattttttatgtctgaataatattccagtgatctgccagaactgaattttaaatggggttttaggcctggattgactttagataagcttataattatagctctctacttgtggtaatcaatagcataggcctgaatgtgttattgtattaaatatttctcattcattgacatcacaattgtggatcaaatctctgtggtttggatatttgacttctgacaattcattgttttgtctgactttaagttgtgtttaagtgattattttcttggtttgctctcattccaaattactggggaatttaactgatgaatgaaccagacatatatttaatatacatctgctgtgtgcaatatattgtactggagggatgggtaggtatagacatgtaagacataatctcttacttcaaccagaatatggtttcactgggttcctaagatcaatatgcataactgcagggacctcgtgctacattggatttgaatctggggctccagttccagtcccattccttcatggccatgtcaccttagcatgtcacttcacctatggcctcttaacagttagataacccaagaccactactatttctgaagagtatttttttaattacaagccaaatcagtatcaaatattatatttataatggttctgtgtaatttactaactcatttaccataaaatgacatatattgtactattagaagaaaattgtgggatttattaaaaacatcaatttattgtaccacacacttgatatgggcttataattgaacacaaatatatagaatatgaatatctttttttagttctgtcattagctctttgagtgagtatataagcatattcataaatgatattgtatctatatttatctatgttttaagaattcttgcagccgggcgcggtggctcacgcctgtaatcccagcgctttgggaggccgaggcgggcggatcacgaggtcaggagatcgagaccatcctggctaacatggcgaaaccctgtctccactaaaaaaaaaaaaaaaaaatgcaaaaattagcctggcctggtggcgggcacctgtagtcccagctactcgggaggctgaggcaggagaatggcatgaacccgggagatggagcttgccagcgagccgagatgcgccactgcactccagcctgggcgacagactgagactccgtctcaaaaaaaaaaaaagaaagaaagaaagaaagaattcttgcatctcaggcatggccaagaagcatattgcccttcatcctttctcaaataccatagaattggctctgacctcacctcagtttacttatgtttcttaagctataagatgatttgtaagatcccattcacacttagtatcctatggttataaagacattctcttgatagttatttgacatggtgtacacattggatcaatttctttggtgaaaacagtctcgccatgaccttgatgtgccatttgatgttcttggaaataccgttcctctactgttaacagtaaagtttcaaagaaaatagattcccagattatttcaaactcattaatataggaataatatttttaattcttcaagatgataagattttacacattttgatgccagtaaataattttgtgataaaagcaaacacctggtttgctagaaaatattggcattccgcaagcctaaattcattagagaggaattccacgtgcatcgcctctgagctgcagctcctgtgaactgaaaaaactgctagttaatgtctcagaagttattaggaaatgtaaagtacatacaattgtcagtgcttcaaaaatagagataacatcttagtccttatgtagcccccatagttagctggagcttggacatattaggaagtcaataagaatactgacaaactggcatgtaagtcaggtttgcctgcatcaggtttgaaaattattctattttagaataatcttatttatcctatcgtttctcaactaaattgatgtgtagtccatagatttcttacctttgctttatattcctttagagctgtgatgcaagctaaatcatttttggggaaaataacttcttaaacatttttgttgttgttaatgcttcggatgggcagttattgtctgaacatcatcaaggcacaagcaactgactgtagcatccatatttttttgacagttttcattgcttatgtgttccaagagctgcctacaggatttctttccttatatgagaaatattgtaatgatactcaattatgtataagagcaagattcctgacttgactaaatacaactactttagtattcactatttaaactacgtggctttttaataagtaaatcaacattaaaaagtgaataggagattgcaatttagttttcttagaaaagcttgactatttttattatctgatattcatgtcacatgtaatcacacatttgatttttaagtaatttttattggcttggcatggtggctcatgcctgtaatcccagcactttgggaggccaaggcaggtggatcacctgagcccaggagttcgagaccagcctgggcaacgtgggggaaaccctgttttttacaaaaaatacaaaaaaaaaaaaaattagctgggcttggttgctacatgcctgtagtcccagctgctagggaggttgaggtaggaggattgcttgagcctgggaggtcaaggttgcaatgagccaagattgcccccactgcactccagcctgggcagcagagtaagaccctgtctcaaaaaaatattattataattgaggtgaattaattgacatctatatttatgaaataactatgaataatacaagatggccacttgaaggtatgccctaagacaggggtctgcaaacttttcctgaagggaccagatagtacatattttaggcttgtgggatacacaaatttagtgctactactatctactatcttctgcctttgtagcacaaaagcagtgatagtcaatactgaatgcaaaaatatgtgcgtggctttgttccaataaaactttctttacaataaataaggatgggccatagtttgttgacccctgccctaataaattcattgacttggcctaattttaagaatcatataattttaataaaagtctgttaagtttctttatataatttgtaacatcagtaatatttttaagaaaaatgtaagtcatctgaaagtataacctaagtaaattttatttgatgatttgaatggaaatacatgatgattttttcttatatttgatttaaatatattgatctaaacctacctgttcttaccataagcctagctattataaaaattatacaataacttaatttttaaaaattattttccctagaatgtactggactcttggacaaatacctccttattattgaactttgggctaaatgactgcaaaataaatgtttggtcttgatttagctaagtgtcttcaaactacacaattctatatttctgtgagtgtcatatcatttgccggtaggactggtgcccttgtttgttgtgttgttttaaaactctctcattgagaatgtcacttctccaagtgatcatattctttttgaaagtcacttctagtttctatataaaaaatgtcttctaaaatcaataccagtgaaagttaatcagtgatataatgattacaggatgccttatttatcattggaaggctaagatggttatctctgtgatgatccttccatgtgatttgaaaggacagaggggtagctttttctggccatgccacttctaatttgtaaaatgcccccattataactcttatgtaagaaggcagcctgcctttattgccatatcctaaaaagattcgttagtattatgcccaagtgctcagtatttcaccagccctgctcccgtcttaaatttattatagattcgacattgtcataaagggcataattagaaaatcatctcacgtctcatctcattatgtaattgtgcataaggaaacaatcattttaaaatataaagaagaaagatttgggtcatgcagctgcttcctaaatgttatatttttatttccattgcgtctgtttttcctcattgaagtgcagagattactcatattgagatacaactatttttccgcaactgagtcttcaatgcctgctattttattagccccaaataagagatgattggaagtgtatcaatgcaagtggcaagtgagaatcagcaggttcattcttcataaacccttctgtagagcatgctcatgtttctggtaactggcttttctttctgctcctctttttgagtggttacagtggaagcaaccacatttttacaaggtgaccatatctcacccatagagatgaagacagaggtttgctcattacataagctgaattaatataagtccattctcaggattttaaagttggaactagaaaatattcacccactgaaactctgagctcttaagtaaaagtgatgcaaactcacaagctgttggcagaagttgttttctgatatgttgtttttaaaaatagaaatattattctaaaaagagagagaagaaggaagaatgaaacacacacagagagacagagttttgatatgaaaaatcaacgtcttgtttctctacagtgtttggatcagtggttccagttcaccccattactcagctggatctctgcctttgggttgtgtgagatagctgtgtatatgtttaataagctcacttttgctaaacttagttcaaatgggtttccataactttgaactgaaaaactaattgtgaagtttatttcatactctacacagcctttataatatagaatgtaaatataacgcctacgtaactgttctctcacaaagtttgatggtaaattattaaaaggaattaattactcatgagatactccccagagaaaaagaccacaaaaagttcatatgtatgtattaagttatttatttttaataatttttgggtcacttctgtgagccaggcaacagtgataagtaggcaacagtgaataaatacaaaagtgaatgtctagtttgttgggggagagatgtattaaccaaataattacccagattagcagatgattttaaaatgtggcaaatgctgtgaaggaggggtgagggacagtgagccaggtagaagaggctgtacgtgaaggccctatggcaaatgcaaacaaagcatttcggcattgataatcggaagggtttttggttttggttttggttttggttttccagaaagccatttattaattaggttggaaaagcattgtttctgtttcctgttcatcatatttagcttttatgtcagaagagcatttttgtttttgtttcaaatgtgtttcaagtcacctaaaaccctctgtccttaacattattcaagaaagtatgtaatgtacaatgttatttacaccatcgatttgtttaacgaactctctctttgtagtcaatgccaaagaaaatttcgtctcacgtatattcatggtttcctgatggattgaccagtaagttactgaagtcctacttagtgtgatgtgactgtggtggtgttccatcacattattctaagccattctcagccccatctaaccccggtggtattcagcaaaggcatacaagcccagaaccatgggaatgttcatctccatcagaattaataggaaaagacactttagtaactgtctttagtaagatacacttaggggagcagcgtgaagtaactctcttggactagcatccctctgttcttaaactgccaccaatgctactgtaacattgcagtcatattctaataaatggtgtcaagcatagaagagagaaaaattctacttttgtgacttctcctgatttctgagtgctgtatgcatgaactatttacctgtgtacacaaacagctgtacatttagttgccatggcaatgcttatctgttatctttacagggaacaaaatggtactttaaccacagttgactcatcccgtgaggtaaaattgataaagctgcctttcttaactttcagccagaatgcttcagttggcaaaagttggttgtttttgttcttcttaaagaaaggctacttgttgacaaaggcaggtttaacccccattctcaataattgatatagcctcgagcaaagatcaaagtttcctggatatcattgttataatttacacttagtaactggacaggagatattaataggatggccatcagagaaattgtgttttcctgacatgtgtcttcttggattacaggtaagtattggtgaatgcgtgacactgataactgctggtattattgatgagggactatcaatgatctgatgcatagggtgcccttgataagaaatctttattgttcatcagcatgttactgaaaagagtccagccaatgttaggtatgtgaggttaagaattccccagtcactatgcaacttggaaatagaaaggacaagtgattctaggacaaatgtgagaatccatgtatgtatttataggcatgatacccaggcagaattattaatatcctcccttgggctcccatagcactgtgtccatacttccatcatgacacttcacttcaaattaattttctttctatcccgttgggttactagctttttgaagtagatggcgctattatttttattgattatcaagtccgaagaaggaagagctcaatacatgcttgttgaataaagtctgctttgagaaagttatgctcattttgctttaatattctgcaagagatacaaagaaaagaaggaaggaaatctgagagctatcagttgactggatactcgaattggattacttttagggcaatgctcttggttgtgcctagacttgtaataatagctctgatttcaacttatctagaaaagcttaaagaaaatagtccaggactgagaaagctatttttcattttcttaaataattggcacctttgaaaggctccagaaactacagttttggaagcctctaggaataaagatttcttatttcctggacctggcatatagttttagtaaaggaaatgaattattctagatcccaaccaattgtcttcaatcaaataactccctgacagaaatgaggcaaaattttaatcactaatttaacctctgcaataaaattcctaagaaagaattttgtcaaaggcagagaaaaaaatctacagtatcaacactgaatatacaaagtgtactaaatgtttttaaatcaggaagtatgcatctttttatctttggtagtttttttttttaattaacaaaacttcaccatcaagactccactcaaattattgtaggttatcctagaagtttgagaaatacaaatgggataatatagaaaagattataaagtttgtattccatgagattttgcaatttactcttcattgatatagaaacaagtattgaaatctctaagctattcaagatagtaatatgtagtgtatttgggaaagtgaaattacagcacacaagcattatctcagtttaaaaagtaggtgtaggtggtgtgttgcatagcttaatgtttgtcttctgaagaaatgcatttagttcccattctttcttgataacctctatgttatcatatctaattctttgtgataaaatgcactctgttttagtttcatgaaccacagtcaattttgttttcctttgcaaacaaagaacgaaaagatcaaatctctctctgtgctagactgtggatctcttcctagcttgggtggccatcccaaagtcatttttgcatcttcctctcccactggcctgaaagagtcaactggaacccgttcaatgctgtttgtattcatcaacacttaatgtatcaggaggattttccaccttctttcctttaaaatattttattatacctaaatgagtatcttagtctgctcaggctgctataacaaaacaccacaaagtggataacctgtaaacaacagaaacttctttctcactgctctggaagctggaaagtcccagatcagtgtgccagcagattcagtgtctggtgaggatgtgcttcctcatagacagccctccctcacatggtgaagggagaagggatctctctcaagactcttttgtaagggtactaactgcctttatgaggacttcatccctatgacctaaccacctcccgaagactcccatctcctaaaaccagcgactctggagtgaggatttccacatatgaattttggggggacataaacatttagatcatagcaatgactatatagtaaaattctattaattcaggtttattgggagaaaggtggtttgaatttagtgggaaggacttcgttgctgtagatatctaaattcaaatcaccttattaagaattgtcaatacaactatttcactaccagtctcttattagaaatgaaacatttaatactccagagaaaatagtttctccagactttttttttttttttgagacagagtcttgctgtgtcacccaggctggagtgcagtggtgcaatctcggctcactgcaagctccacctcccgggttcacaccattctcctgcctcagcctcctgagtagctgggactacaggcgcccaccaccatgcccagctaattttttgtatttttagtagagacagggtttcaccctgttagccaggatggcctcgatctcctgacctcgtgatccgcccacctcggcctcccaaagcgctgggattacaggcgtgagccaccgcgcccagccctctccagacattatttaaatggataccacttttaaatatttaactgttctatcttttttgacatattaaatttgcattttgacttctaaaaatgtaaaatgtgcatcaaaattatacatttttggtttaaatatttgaatcataaatggccaatattgaaaatatgttttttcaatatattgaacatttattcaatatattcctgttctaagaatctgtatagtgatgggttaatacaagtaaatggaagcattagattgtgatctttaactaaacaggcactttttgtcattgtaattgccttgggactaatgtatgtgactgttacatttgtttccaacatgattttatttatttattatttgtatttattttttttccagctcttggttgtgcttagacttgtaataataactctgatttcaccttatctagaaaagtttcaccttatctatctagtttcactctgtcacccagactggagtgcagtggcacaattaggattcactgcggcctcaacctccatgggctcaggtgagcctcccatctcagcctccttggtagctgggactacatacgtgtgccaccatgcccagctatttttttctattttgtaattttttgtagacacagggttttgccatgttgcccaggctgggctcgaactcctgggttcgggcattctgcctgcctcggcccccacaaagttctgggattacaggcatgacccaccatacctggcctcaacatgattttatacctatttgaaaagacatgctatatgtcatagatattcagttaaaataaattagccgggcatggtgttgggcacctgtagtcccacctactcggaggctgaggcaggagaatcgcctgaacccgggaggcggagcttgcagtgagccaagattgtgccactgcactccagcctgggtgacacagcaagactctgtctcaaataataataataataaaatagttcagttgattacagctaattgaatcacacacacaaccacaaaactctattcaagtaatattcagtacaaaactaatggatacaaaaaggagaagatttagtattaagggtcagatagcactgccttgatctttccgagaaattataattattggcaactgaacttctaggtgttaattagtgtgacagaaaaatcaagccctttctcaccttactgtgactaattatatagttatatgagttttaatctcttcccattcaatctcaaaatggtgcctcaaacatgtatttcctcagaagcttaaggataaggcagatatagttttggttgtaacttttttttttttttgagacagagtctcactctgttgcccaggctggagtgcagtggcatgatctctgctcactgcaagctgcgcctcctgggttcacgccattctcctgcctcagcctcctgagtagctgggactacaggcgcccgccaccacaccctgctaatttttttgtattttcagtagagacggggtttcactgtgttagccaggatggtctcgatctcctgaccccgtgatccgcccacctcggcctcccaaagtgctgggattacaggcatgagccaccgcgtccggcctgtaactttcaataaactatttatttcactgaattctaggcttctgagggtgtatactgatatgtgggcagtggaaaaatacatataaaaattaaaatgttttatgttcataagatcataagaatgttattactctggtgatactgaagtccaatgaatctgaaatagcattcttaatcttatgctgacggtgtcttgttagctttgtcatctgtgtaggcaaggaggaacctcacggtcagtcacttcagcaaatctgagctttacgtgggtgatagtttcaggagtagaaaggaatcatgtcatttttttcactcttttccaaacctttatggtgatgtaatattgaacgaatttacagacactaatgattttatgtctgtcaatcctatctcacaaatatttgtctgctacatgatacccattcttaatgataacaccagcaagatacctaaccttcagaaatactctcaagctttgctactgggattgtatattagtaatatcatttttaaaaactgtcagtatctaataaggttgaacatatataattcatccttttctttcctaggtatatttccaacagaaacatatacaatatacacgagtatgttcatagtagcactattggtaataggccaaaatttttaactacctaaaggtccatcaacagtagaataaattgtgatacattcacataatggaataacttacagcaataaaaataaatgagttccgatttcacacaacaatatgagtgactctcacaaacataatattatgtgaaagaagccagaaaaaaagagtatataatatatgatttcatttacctaaatttccaaaacagtaaaattaatcaatattattagaaatcagaatagtacttacctttgctgagaagaggtggaatggaaacagaagagaagagcttctggcatgttgatctaatgttctatttctgaatctggttggtagttatgtgtgtatgttcagtttgtgacaatttatcgatatatatatacacacacacacacacacacacacacacacacacatatatatgatagattgaactcaaatatttaatttgtgcttatattagtttcccagggctgctgtaacaaattaccacaagctgggtggcttgaaacaacagaaatttattccctcacagtgctgatggccagaagtctgaaataaaagttttatcagggttgtttaattctggaggcttgtggagagaatctgttctatgcctgtattcctagcgtctagtgtctgtcagcaatctttgttattcattggcttatagatgtatcactccaatctttgccaccttttccacatgatcttccttcctgtgttctcttctcttctgtctctgataaggccactggccactggttttacccagcacccatctgggtaattgagatttttaacttaattatatccacaagggcgcttttttccaaataaggtcacattcacaggttcctgggtgacatgccattttgggggctactaattaatccactacagtgttccttccccaaaccccacagaaatcatgatagcggaaatataaaaatattgtacagacaagaagatttaagaagggttaaatacagatgagataggttcaagattttgaaagatcgtgagtcgatattacttgattcagcaaaatgcaggaattaaagttagttgccagtgcgaagcaactcaggcagtctcaggatctggagatacgaggtacttctggattcaggggtaaaggctggggcttaacatagtaaatttggttaacaatccacttaagaaagttaaagtcttagatcaatgtccccactctgggcatcaagtgaatataaccatcccatattgaggcagaaagaaaagataattacagctttataaaaaaaataaaacagagaggagtcaaagtggctctggactagtggacatgaagaattgctgagggagggtgagttactgtactcaaacaaggaagtaaagaagcagcctataattttaatggtgtagactccctcctaccacccctctatgcttatctaccaggaccctggcagttgggctcataccctagtcacgagattcttctcagcagaaaacactccaacccaagagaaaagacctgcctttggtgtgggtgtggtgatggtggtggtggcagggggtgtctccaaatgaaaatatcaaaacttccctgatctcataccctggagttcaattagcaatcaccatccttctgcacacaaagcttccattcagcttttcattacctcacttataaatagcagtggtcagccaagagttacaagatatttgaggaaagcttgcattgtaaaagacagagattttttaaaaatgagtgtacagataaaacgaactattagaaaataaaggctattcagggagatgaaaacttcaaaaaattacaatgaatattctcaaatacattaaagaagcactttataacatccagaatgctataaaaatgaacattgagggaactaataagaactcttgagagaataaaatattatggcataaatcccccagaaggtagaataaattatcaaagagatgacaagatttttttcaaaggaggattgatacaggaggtctggttaataggaattttgaatacctgaaaaaaatgagagaaatagagaagggggaaattatcaaataagtgatgcaagaaaaatttatttaattaataagcctggttttccatgtttaaagggttcaacaggtgaccagcaaaaggaaattaaggtaactgacatcaaggcatagtggccagaaatgttaggacaccaagggtaaagattctaaaaacttttccaaaggtgttagaggaaggtgatatacaatatgacacaaatcagagtaccactgacttctcaggagcaacacttgaagcaaaaatcaataaagtaatgtcttcaaagtttcgagagacaattactaattgcttttcacttataattctaaatctgaaagatcagatagatagaaattttcaggccaacaagttctcaaaaaacataactacaatgtatcatttcacaagaaagttctggaggttatatgttaccaaaatgagtgaataaactggcaaagaagagttgagaaccagacagcagggaacacattgataaaaaaatatattaattaaagagaaaacctcttgagagaaatgtgtggattataagcaacagagaaaacagaaacagaaatatatagaagaaaatcattttcagtgaattcaatcattagtaaatttagatgttaaatatgtaaatggatgcttccggaaaaaaaaaaaaacccaaaaactaaagatctctaaacaacttgctatatgtttctgccttttctatttctttgattgatatgccctttctccatcctcattgtaggtacgctagtcattcaaagactcatcttaaaatgtaatcccttcaaaaatataggaagatatccatatgtccttggttaaggagagctttcttagcatagacccaaaatacagcaataaaaatagaaattaaaatctgaccacattataatgttagtcttataacaaagtctaaagcaaaaaaaaaccataaacatgtttaagaggtaaatgacagagtgaaaaattaaatttccagtggataatatgacaaaaaatggtatgtaaaatctgtaaagttttctaagtcaacaggaaagatatcaaacgcaataaaataaactcgtgcaaaaaatggtcaaagttatagtattataattcacggaagataaaatccaattatgagaggatgttcaacttctacttttatcagtaaacaacaacttaaaacaatagtgagttcctatttttcgcccatcagattgacttttaaaatctgtttatcacgtgttagggaacatataaggaacgttttaatctcagatattgccagtaagagtatacatttgcacaaccatttttggaactatttagcaacagctcataaaattgaaaatctggatgccttattacaacattaatcatataatttattattcattctaggacacctttgaacatgaaagagagcactattaaaatgtatgccagaacaaaggcataaactggagttatcccaggccaatctcctatactgtcaccctctgtatgatccacttagtgtatagaacctagttagcttcttgtccatgtgtactatgtgtatgtaaagctactctttgtcacatagtttataacagcaaaaaaaattaggaacaggctgggcactgtggctcacgcctgtaatcccagcactttgggaggccgaggtgggtggatcacctgaggtcaggagttcgagaccagcctggccaacatggagaaaccccgtctctactaaaaatacaaaattagccggtggtacaaatacaaaatacaggtggcacatgcctgtaatacagctactcgggaggctgaggcaggagaatcgcttgaacccaggaggcagaggttgcggtgagctgagatggagccattgcacttcagcctgggcaacaagagggaaactccgtctcaaaaaaaaaaaaaaaaatttaggaacagtctgtcaaaaggaaactcaatagataaaatagataacacagaatagtaaataataaggaaaacagatgaactagatttctctgtatatcagtaccaatagacatccagtacacacacttaggtataaatagaaaattcaaaattccagaatattcattaacatatataacattatatatctcttatgttatatatataacatatatatatatatatatacacatcaaacattacatatgatgttaattgatgtgagtgcaagtataaaaatggaatggaagaatatacctccaatttataacagtggttgtctctggcaatttagaaaagatctggatgtggtttaaggagaattaagctatattaataacgtttaatttctttaaaaataatctgaagcaaatatgacagattttaaagttgatatatatgaattggagaaggtatatatgtatgttttaaatttttttgtatagtgattttttttctcaaagtaaaaacaaaataaatcctctttcacaaagctttccttgatctctttaagccaaacatctctgtgtgtcctctgtatgcctctaacactatagctctcataagaattaagctttctgcctatggagtttatctctcccattacattggaaaagcttaattgaaaaagcagtatctcatccccttttgtatctctccacagcacctgatcagatatctgttgcatagtaaatacccaataagattttattaaacacaatagcaaaggaatagaatggtgtacatagaaacacttgctctttttaggcaactctagaaaaatgttaaatttttcattttttcatgcttttcttcacacagcggacctatgtttgttttacacctatgttatgtttctattgacatacttttagaatgaatacttagaaaatatagtgctttgtaataatatacatggtcctagcatattggagatacaccagacaatctaattgctgaaccaaatgtaggctagcttggtgatcaaagggaattgttttgatttctcctgtctcatatatatctgttatttgtcctaatgctgagctctagactgctgaatgaacggtgacatttttcttggttactccattgtgccacctcacctccatttgtcactctagtaatgttaacatctgctgtcaacaccaattaacttttttttttttttttttttgagatggagtttcactccatcgcgtaggctggagtgcagtggcacaatctcggctcactgcaacccccgcctcccgggttcaagcgattctcctgcctcagcaattaacatttagtaaacaccttctgggtccatagtagaatgtcagttacttgctgctcatttaaagactagttgttaagcaaaacttgaatacagtatggcatttgctttgagtttattttttttaatttcaagtttcatggcttttgtttttccattctcataaataaaacatatgcttttattccttgacagttatcagagtttgttcagttgaacaatgcccaacttgcaaatgaatacttttgcaaatacatatggtggatatacaaatacatatgtgaattcatttggctctaatgtgaacttattgaatgtgctatgtcgagttatcttttatcaaaagaactgttagtaactgaggacatcaaaaaattatgcttgctcatacatacataaatgctatatttaggttttaatgctagcttttaaaatgtcttctttgcccgctacttacactaacaggatttccttgttcttgaaagtgaaatatatttttaagaacaggttttaaggccaggcgcggtggctcacgcctgtaatcccagcactttgggaggctgagacgggtagatcacaaggtcaggagatcgagaccatcctggctaacagggtgaaaccccgtctctactaaaaatacgaaacattagctgggcgtggtggtgggcgcctgtagtcccagctactcggtaggctgaggcaggagaatggcgtgaacccaggaggcggagcttgcagtgagccgagatcgggccattgcactccagcatgggcgacaaagcgagactccgtctcaaaaaaaaaaaaaaaacaggttttaaaaaaatttttagatttgttttttttgtttgtttgtttccagttttctctgctgtttcagacttaggactagacatgcctggctctaattgtcctcttagattgttatccagctttcctttgagacaatattttgcacaaagtgtgttctcttagctggttgattccagtgatggctggaatctatgcatagtgtggtgtttcacagttagacctgactagttatcctggcactttgaaacagttggtttcaggtacccttccacacatacatacaaaagatgtgctgatgatagcactgacttttcagagtggtcttttcatcataattaaaagttttttttttttttttttttttaaagcctgaatacacaatctgtgcatggctttgatgattctgtagttaagaagggcaggaacagccttggggaacacttactaacttggaatcatgaagaaagtcacaagcacctacagatgagcagaaaagcaagattatttcattcattttacgtccacaataccacagggactggctggtcagttacttgcgcatgttgtcaaagctaacctttaaagacagttcatctggctaaaaatcaaataccttatacccagagtattagatatgcatcagcgggtggccagggtcttaaggcaggaagtatattataggtggcctggtattttgcaggctcttctgagccagaagcattttttatcagaaaggttttggaaattatgctcagcccctggcatctttttggtcctctcttgatcgctagtccagctgttgaatgaaaagaaatgaagctgaagagacatcactgtggctacagctggtgttacggaggttggtgtcatgctacaagataacacacacatcatttttactcatgtggaaggctgccttgctgtgcatttccacggctgtcagaaagattgattcctgaaatactttgaaaaaatgctaagtactagctactttgggtgtttacccaggggcaccacagctgcctggcattgtagtatggcagctgaacagtaatcactgctatttctctgatttgtttgtgtctttgtcagcatctgagaggagggaggttcaatcccagagtggggccctcactccacagtgatctcattcagcccatggctttaaatactctctgcaatgctaatgactcccaaatttatgtctgtggccctgatgtcatccctgcatcccagactcatagatccggctgcctattaaatagcactgctttgatgtctatgaggtatctgaaatttaacataagcaaaaccaaatttctgatctgtccacccatatatgacccaacttatcatcccaccatcttcccacaggagtaaatggcaactccattcttgtggttgctccagccaaagccttgtgatcatccttgacccctcccttactttgtatcccacatcccaaggtatccaccttgaaagtggattcagtacatgaacacctctctactgctgctgtcttaatccaaaccaatgacaaatctcatctggacgattgtaattgcctcctaacatgtcaacctgcttccttttcccaatagtgtactttctcatggcagtaaaagggaatccttaaacacaaattacattacattatcttctgcttagaaatcaccagcggccagatgcagtggctcacacctgtaattccagcactttgggaggccaaggcaggaggattgcttgagcacaggattttgagatgagcctgggtcacaaagtgagaaccccatctcttaaaaaaaaaaaaattaaaaattagctaggcatggtggtacgcatctgtagtcccagctaatttggaggctgaggtggaagcatcagctgaacccaggagatcaaggctacagtgagtcacgatcgcgccactgcgctccagcctgggcaacagagtgagaccctgtctcaaaataaacaaacaaacaaacaaacaaacaaacaaacaaaggaaatcactagtgaatttcaatcccaaggttcaaaccacatctgtaaaaccataagcgatcagactgtctcatacttgtttgcttatccttctgttatttccttagccgatttccttaactcattcacctgcgtattcaatggccttttcatttctcttcgaatagtttccacctaagtgcctttgaacttgatcatctctatgactggaatgctcttctcccaggtgtttacatggcctggttcctcttttcatttaaagcccatgcccactcaaaggccatatctccttgtcagtaagatctttcctcaccagcctttataaaatatagcactgctcccaatggtctcttattctgctatattttcttaatggactttataatcctgatgtcttttcccactgagtgaaggctttgtttcgttcactgccagttctccagcaccaagaacagtgcctagtgcacaaagggctttgataagcatctgtggaaagtgcaaacattcacctgactcttctttctatctctatctccaccagctgtaaaactgtgcttagaatccctgaacattttattttaatgaaattacctctgcaatatctttagctcttcagtggaaaaatctttcaaaatccagggtctcatggagctcatgtctccatctctgacttaaatagtccatgaaacacatgattctggaaactgagattgtgaaaagcacatcttgctgcaccctccagtctttgtgtggtctctagcacttggtgccatagtgacagtgtctgggtagaacagatgtttttagtgatctgaaaatcactataaagaaaaggcatttcctacatcttggagagaaacttgaaagttcacaaacatgttaagtctaacaatttcttagacttgccatttgcttttatccactttcaggataaccgtaatgtttgcaactcatcttctgtgtctcccccaaataattcatgtttccttttcctccttgtcttatatttcaatgagtgagaagtgaggcatcttactcttattttgtattaaagccctgcgctaatatttctaacgttctcttttacgatttagtgagatttcagaagtgagagggatagttttgttctgttttccatgagttttctagttctttgagaggaagagggaccacgaaattcaatattagtgtttgtcataatactcagcaaaagccttgcctgtggtatacactcaataatgtctgttcatttgggttttaacttttttcaaatctcctcagtgttataattacctgtccttttcattagaaatccaaacctgattagcaattgtttttccagagaataagccacttgccttctctaatagtattggattggatatcaactaaggcatagcttcccaacggatgtgcagtggcacatgactgtactccacatggatttcaaatgtgctcagacaatgattcctgtaagctctcaggggcagctggaggctctagaccaatcatttctaaccacaagattgtgtattccagggtgctctacaaaaattataatttccattatgtgctacggcatgagaaatgttgagagttagtctagtccagtactgcctaactaaactatctgtgcagtcatggaaatgttctagatcttccttccaataaggtaaccacagtgcagctggaatttaaactctaaactatataaactattaggaaccaaagatgaaaaataagcacaattcagcaatttatcagactcgacaaatattaatttgaggtgttaacaacccacagtggtaccagcaggcagaaattaaattaatatatcactaacttgagaataaaggcatcaaaggaaacctcattttttaatgtggctaacattgttggatattagctggctgatgctagctatgtacgctttttctcttgttgtcttctttttgtttgacgatgtggcaaatgacagtgctgttgcctgaaaatggcttcaaagtcacacttgtatgtcttactgtattgggtttaggtgaattctggtgtctgtgttgttcttctaatggggcctggagcaatctaataatttgcatttgggtcctatagaccatatggtgtttatcacccacttctccatcttagatgatctgccagtcattgatgaggtgaaagctgtgtttggcagtgctttcatgctaggttaatcattgtggaattagctattgtttatagcactttttaatccaagcaagagtattctggagtctgtacatctgtaagtcaaaatttacaacctaacgtcgatttacaatgaggaaaagcaagttagataacatattgcatattcataaattactcctaagagataattagtacctggcctccacttcatgattcctctgtttgttagttcttatgatacaatggttgtggagatgcctatttgatcgtatttctcaaggagactctgatccagtgtgttccactgcctcattaacctctgccctcaaaatacaccaagtcaacctctgtttctttattcatgctgctccctctttctggaatggcccatcccacctttcttctcaggtacattttagccttacttatggaggcattgaaatctttaatattagtattaatgtacactagcatttatggaacacatttttttgtgtgtgtcaggcgtaatacccgccaccttaactaggtatttcacttaaacgtcacaacaggacttcaagatatattttttcaagatatatatgtttaatacctatctcataaatgaggaatctgagcttcaaatatgtgaagcaattttcataaaacaattttgtaatgaagtagagtaaggttttaagctaggacttcctgactctaaagtctttgttctttccattgcaaataaagaagacaaagaagtctattaaaggtatctaatgaaggaatctgttctccattaaccttgtactcacttgagacacagttgaaacacagtaaaacagctttgtagattgcttgcttggcttattgatttccaaatcctgttttctttttgctaccatcttacttcctgtgtcatagtggaaaccaacaaaagaattaattctttgtcaagtgtgtgaggaagagcatggtggaccagaagtcttggtccttcctgggcaaacagatacattgtcttctgcacctatacatgtccctcattcgtgaatttcgccctctgatttatatcctatctgttctatcttttaactaagaactgtgaaatcacccatatccaggactacatggctaatctttttattaaacattgtctatcatgtgtttttttttttgttttgttttcttttgtttttgtttttgagacacgtgctcactctgtcaaccaggctggagtgccgtggcatgatctcggttcactgcaacctccgcctcccatgttcaagtgattctcctgcctcagcctcctgagtagctgggactacaggcatgcgccaccttgcctggctaatttttgtatttttagtagagatgggatttcaccatggcagccaggctggtctcaaactgctgacctcaagcaatccttctgccttggcttccataaatgcagtgattacaggcaagagccaccacgcccagcctctgtcgtatgttgttgaattcttggtcatgcctattcaatcagagtgtaaattgcttgtgtgtagtatcttatttggtcttgccctatggcaccagctcaaatgctaggctaatcactggcagtttttacatattgttgattatgtgaatgattatcttcacattataactagacaaaaagagaagtaaaacaattagatattttccccagagatgagtgaaataactgaataaactaactcttgttcataaatttcttaaagaaggatgacaaatttatcttgtaaacatacaaataactggtacctaatatttttcagtggggtggagggtggagtaggatatcagaataggactctccagccattgtctccctgaagaaactttaatttgaacaactatccatgcatgaaaacatcttcaccagggctaaggaaatcaggtgagcaatcaaagcactaggttatagtgtaatgctaagaaaagacgcatcaaagagggcaagaaaaacagttttattacctctgtcacccctccacaaacccagtaagcatagcatggaaagagattctgtctgcttgggggaaagagagggaagtaagcataagactttgcctgctacaatgaaatctagcatcagtcagaattccatgaccactgactccaggctaaaacctatgtacggagcctttagaaccaacttggcacccgagaggagcctgtagcccctatgaaatggaatcaagttttggtctgcattgtggccagctgactacagtggccttgagctgtgaataacccacagtgataggcaggccttagtggctgtgggtttcaggcatgccccagggctgtgctagcctcagtggccacgggctttaggcacactccaatgctgcaccaacattggtgaccataggattctagccctatgccaagctcagcagccgcaaatccaatcttagtacagcataatttgcagtggtctagggcttagggaattccctagcactgcaatgactgtagtgctcaagggcataggaaccataccggacaaccttttcaaaatgtctggacaggcttactgctgaaagatgttttcagacaaaaccagattgtgaagggcctacttgttcagtgcacagacattgattcatgactacaaggaccaaaaataattaggaaaacatgacatcataaaatagacaaaataaggtgccattgactgaccttaaagagatggagatatatgaactacataacagaaaattcaaaatacctcctttaagggagatctacaaatgtcaagaaaataaagagaaataataaatttcaaggagtaaaacaataagtgaccagtacaataaatttaacagcaaaattgaaatgataataataaaatattcaacagaaaccctggaactgaaagatataaggaatgaaataataaatgcaacagagagaatcaacaaaagtattcatcaagaagaagaatctgtcacttgagaacaacttatttgaaaatatacggtaagatgagaaaaagaaaaaagaataaaatggaatgaagaaagcttactttggggatagtatcaaaaagaaaaagcaaattatgagtcactgacatttaagaggaaacaaaggaatataaagctatagaaagcttatttaaagaaagaaaagcagaaaactgtcaaatctgcagaaagatataaatatccagttacaggaaggtcaaaggtctccaatcagattcagtctaatcagatttaaataaaagccaagtcatattataattaactgttaaagatcaaagacaaagagaagattatatacacagcaagaaaaaaaaaaagaaaataaagggagtttcagtacacttagcagtagcagcacatttctcagcagaaaccttacagaccagaagagagtgggatattttcaaagtgattaaggaaaaacatgcccaccaaaaataccgtaccaagaaaagctgtccttcagaaatgaaggagagataaagacttcccaggcaaacaaaagtcaagggagttcttcaccaccagacctgtcttacaagaaatgccaaaggaacttcttcaagctgaaagaaaagaatgctagtgagtaacacaaaaacatttgaaggtataaaactcactggtacaagtaagtacaaagtcaaattaagaatactctaggccgagcgtggtggctcacacctgtaatcccagcactttgggaggctgaggtgggtggatcacctgaggtcaggagttcaagaccagccaggccaacatggcgaaacctcgtctctaccgaaaatacaaaaagtagctgggcgtggtggcacgcgactgtagtcccagctacttgggaggctgaggcaggagaattgcttgaacatgggaagcggaggttgcagtgagcgagatcatgccactgcactccagcctggtgacagagtgagactctgcctcaaaaaaaaaaaaaaaaaaatactctaatacggtaatgatggcgtgtaaattccttatatctttagtaagaaggttaaaatataaaaatactaaaaataataactacactaacttattatggtacatgtaatataaaaagatgtaaattgtgacatcaaaaattcaaaatatgagtgtgtgtggagttaaagtgaacaatttttttgtgtgtggtcgaagttaaattgttatcaatttaaaataacttataaaatgtttttgtaagcctcatggtaaccacaaagcaaaaaacttataatagatacactaaatgtaaaaagcaaggaatcaaaccatagtactaaagcaaatcacttaaccacaaaggtagacagtaaaagagaaataaattttaaaagcatttacaaaacagctcgaaaacagtgaaaataatggcagtagtaagtccttacctatcagtaactactgtgaattaaattgattaaattatccagtcaaagatatagagtggctgaatggattaaaaaacaagactcttctatatggtacctataaaaaaattcactttactggtaaggacacacagagactgaaagtgaaagtatgaaaaagatattgcatgtaaatagaaataaaaaacaataggagtagctatacttaaatcagataaaatagactttaagtcaaaagctatgaaaagagacaaagtcattatataatgataaaggggccaattcagcaagaggatgtaatgattatagacatatatgtacatcacattggagcacctaaatatacaaagaaaatagtaatagatctgaaaggagagaaagactgcaatacagtaacagtaggggcattcaacaacccactttcagcaatggaaagattatccaaacagaaaaatcattgaattgaaactgtactctagaccaagtggacctaacagacatatacagaacattccatccaacggatgcagaatacagatccttctcaactgcccatggagcatgattcaggatgggtcccatgttagaccacaaaacaggtgttatccagctttagaagactgaagtaatatcaagtatcttttcagaccatgatggtataaaactaggaataaataacaggaggaactttggaaaattcacaaatgcatgaaaattaaacaacatgcccctgaacaagcaattgatcaataaagaagttaaaaggaaaatttaaattttttaagacaaataaaaatggaaatacaacataccaaaagctatgagatatagcaaaaggagttctaataggaaagtttataacaataaatgcctatatcaaaaaagagaaaaatcttaaatagcctaaggttgcactgcaaggaactagaaaaacaagtagaaactcaacccaaaattagtagaaggaagggaataataaagatcagagcagaaaagagtaaaatggagatcagaaaaacaatacaagagatgaatgaagcaaaggctttttgaagacaaaatcaacaaacctttaactagattaagaagagagaatattcaaataaataaaatcagagatgaagaaagagacattacaacctagactgaagaaatgcaaaggatcataagagagtattatgaacaattatatgccaacaaattagataatctaggagaaatgaatatattcctggacaaatacaacctaccaacattgaattatgaagaaatagaaaacctgaacagaccaataacaagaaaattgaatcagtaatagaaagtctcccatcaaatagaagcccaggctttactgctgaattctaccaaatatttaaggaagtaataccaattcttctcaagctattacaaaaaattggagaggagggaatacctcctaaatcattctgtgaggccagcattacactgataccaaaaacagataaggacacaacaacaacagaaaactacaggccaatttccttgatgtttacacatgcaaaaattctcaacaaaataggagaaaaccaaattcaacaacacataaagatattatttacatgatcaattgagattcatcaaatggatacaaggatagttcgcatacacaaatcaataaacatgatacatcacattaacagaaggaaggataaagaccacataatcatttcaatagttgcagaaaaagcatttaataaaattcagtatcctttcaagataaaaactctcaacaaattaggtatagaaattaggtatagaaacagtgcacctcatgaccataaagaccatatgtgacaaacctacagctaacatcatgctgaatggggaaaagttgtaagcttttcctcaaagatctggaacaagatatggatgtccactttcactacttctattcaacatagtactagaaatcctagccagagcaattaggcaagggaaagaaataaagggtatccaaatggaaaaggaagatactaaacttttcatgtttgcagagacatgatcttatatatatagaaaaccctgaagagtccaccaaaaaactttagaactaataaacaagttcagtaaagtggcaagatataaaatcagcatataataattagtaacatttctatacactaacagcaaactatctgaaaaagaaatattattttaaaatctttatttctagtagctacaaaaatgtaaaatacctatgaatacatttaaccaagagggaaaaccatctctacactgaaaactgtagccgttttacattttacagaatcttgatgaaataaactgaagaagacacagataaatgaagaatatttgtattcacaaactggaagaataaatactgttacaatgtccatactactcaaagtgatctacagagtcaatgcaatctctatcaaaatacccatgacactttccacagaaatagaacaaagaatccaataggttttataaactgcaaaagacacaaaagagccaatgcaatcttgagcaaaaagaacaatgctggaggcatcacactacctgacttcaaaatgtactgtgatgcaatagtaaccaaaatagcatgatactggcataaaaacatagaccaatgaagcagaatgaagagcccagaaataaatctacacatttacagctaactcattttttttttttcaaaaactgccaagaatacacaatggggaaaaagcagtctcttcaataaatggttttgggaaaactggatagccacatgcagaaaaatgaaattagactattatatctcactctatacaaaaatcaattcaaaatggattaaagacaaaggtaagacccacaagtgtaaaactattagaagagaacatagggggaaaactccatgacactgttttgggcaatgattttttggatgtgacttcaaaaacagaggcaacaagagcaaaaaaaatagacaaatggaattttatcaaactaagaagcttctgcacagcaaaagaaaaaatcaatagaataaaagcagcctatagaatgaaagaaaatatttgcaaactatacatctgataagggattaatatacaaaatatataaggaattcaaacaactcaatagaaaaaagtcaaataacccattaaaaatgggcaatagacaggtatagacatttctcaaaagaaaacatacaaatagccaacaggtacgtcaaaaaatgttcaccatcactaatcatcagggaaatgcaaatcatgaccacagtgagctatcacctcactcctattagaatggctattgtcaaaaaaaaaaaaagataagttttggttagattgtggagaaaaggaaacccttgtgcactattggtgagaatgtgaattagtgcagccattatggagacagtatggaggttcttaaacaaattaaaaatagagccataatatgatccagtaattccactcctcggtatatatccaaagaaaacgaagtgagtatgtcagaaacatatgcacttctatgtatattgcagcattattcaccatagccaaagtatggaatcaacctaagcatccatcaatggataaatggataaataaaatgtatatagatacacaatgaaatactgtttagccaaaaaaaaataagaaatcttgtcatttgcaacaacatagatgaatctggaaggcataagtttaagtgaaagatcccaggcacaatatgacaagtactacatgatcacactgacgtatggaatctaaaaaactcatctcaaaaaggtagaactttgagtgatggataccagaggctggggtggctgggatgggagtgttggggaaatgttaggcaaaggatatataattatagttagatagaaggaataggttcaagtgatctattgtgcagcatgatgactatcattgatgacagtacattgtattcttgacaaatgcagagactggatgttaggtgctttcaccacaaaaatgacaactacgtgaggtaatgcacttgttgattagttagatttaaccattctacaatggatatatacttcaaaatatcatgttgtacatgatagatacatacaatgttatctgtcaatttaatttgaaaaagaaagaatgagaaaagatacttttcaaagagtattaatagtcatttttctgaattcctgtagtgtattttcaagatgaataagttttctaaagtaactgaagcatatctcattagccatcaaaaattatttttaatggcagtttttaatgtagatcttcagaaaaaaagcacacaattactgccttttaaaatagaatgcatgaaatacaattaaatctttccttgactagtcaaatcaaaaaatttttttggaatatcttctgttttacctgttatgaaaaacactaaaatccagggaaataaaagtttagaaatttattcttagtgcgtttacaatctcaatggaaagttaaatgtgtagaaggaaaagttacaatctggcctcttaaaggcgggacagaggtaaacagattgtgtttaagagtcccagaattagtaaagtttaacctacaagttgacatctgtggtagtcatggaaggatgggttaggatttaagaaggagggatacggaaggatgggttaggatttaaggagggatacagcattctagaagaaaaggaggggcattctaaatgattccaagaaagtggtaaattggggaaatggtaaaatgttcagtgtgcttgattagtagcagcttgagaatagttccagactttacaggagcatgaaaaaaattcaattcggatcacattactttcttgcttacaaaccattgttctgctgttactgagtaaaagtcttagcttgttaaaatgcaaaaaatgtgagcaagcccagccaagatgagcaaagccacatgcttgacctgcagttaaccacagatacataagggagtaaaacaaagatcattcaagcctggccctgatcagttatcttggagacctatgaccaataataagtgaccattattttaagctactaagatttgggatattttgtaactcagtagtatttcactgatgaattgtattagtgcttttctattcttctaccctaaagtaaaaatgtctttgctacttatcacattcaaagaaatgtggagctgtaatagaaacaaattttgccaggcaaataggaccatggtattgctttgggctggcatagatgcaattccatgtaattccatttcttgttataaacttggctctaactgtacaatgtatacttcagtatatggacagatgtagatgtagatactgtgtataggtatgcactatttatacctctcaaaaatttaccaaagtcttcatatccatagcactgatattttttaaattaactcttgttagtatggacaattttagctataatattcacaaacgtagagagaataacataatgaaaccctatgtacttatcaccaagctttagtaatttctaacattttgcatgtgttgttgtttgtaacaggcttttgttttgttttatttttgtttttgttttcctttcttttgacaacatgagtggtgttcaatgctactaagaacaaatttgcagatttttcctgcaatgcttgaaatgattaacctctgtttgttgccaagtaactcttgggtacgtactgatagcaaaagtaatataagaatattcacagcatagttaaatttggatagcaagtattatttaaagggtgcctgatattattgcttataggcatgtttttctttcttgtacctcttatttttggtagtaatcatgtttttaatgacttgtgatagacttgttttatgaaacaatagaaaatcaccataggacctctttagtaagcttttagagtgttgaagctacttgaaatcttctctggtgggagattattatttgctaaataattgtttgcataaactgactcctccaacagtgttagttaaatgaatcataacaattagtataaacagagaaaagtaatgatgatctaggcaagtaacttataggtgttctgtttgttgaacaaaagaatgaatggaaaattagggctcttatttatttatttatttatttatttatttatttatttattttttggctgtatccaggatagaataaataaaatgtttgttttcagtctgccttcacctatacttcttggtaagaaaggaaggatgaaaggaaatggtggattgagggaggatgagaggaagaaggaaaaaagaaaggaagtgagagaggctaattatctggaggttttttttaaaagcagtaatgccaccaaattaaagtagcttttcaatttaatgcacaatatttatattactattatattggcatttcagggtgccaagtgtaaagaggttatcttagatgcacagaatatcaaaaaaaacctgtgctatcatctcccagtgcagcctaatcattgacagaggtcaagaaagttaaagcaagtgctgaagttgaatatattaatatacaaaaatatagtatttgtattagtctgttctcatgctgctaataaagacacacccaagactgggtaatttataaagaaaaagagatttaatggactcacaattccaaatggctcaggaggcctcacaatcatggcagaaggcaaaggagaagcaaagtaacatcttacatggtagcaggcaagaaagcttgtgtagaggaactcccatttataaaaccagtagatgtcgtgagacttattcaccatcacaagaacagcatgggaaagacctgcccccatgattcaattgcctcccactgggtccctcctcccacgacatgtgggaattatgggagctacaattcaagatgagatttggtgggggacacagccaaaccatatcagtatcattacccataaagacacagatcaccaatgaaatttaattcatctagagaaatgcattgtagtagtactaaagttatttggttaactttatgttcctatattttatgcaaatacgaatttttttataagatttgggctgttataaaatgtcattctaaagaacatctctaatattttatgtaattactacaaaaattaaaaatagttttatatttataaaccttgaatttcagtggaggccatgcttattaaaattcactttctttttggttacagcattaaaggggcttctagaatgcttaccttttttcagtccactatcataatgagagcctcaaattgtatgtcatcattgggtcatgtaatcattaaagagttctacttatgagagccaataacagacatgaccctttcttctagtctgttcaggcaagcagatcaaacctcttcaaatcctacagtaaaagtttcactattgtcaaatatagcttagtcctaatgaagtacattaaatttacacaaaactttctgtccttgtttccaaacttcatctaaataagtttctcccacctccctcccacagcattgctcataatcaggaaaaatatggtgtctagtagaaaccatgttggaaaacacaaatgtgaaaaagcaatctacaggctgggcctggtgactcttgcctgtaatcccagcacttttggaggccgaggtgggtggatcacctgaggacaggagttcgagaccagcctggccaacatggcgaaaccaggtctctactaaaaatgcaaaagttatccaggcgtggtggtgggcgcctgtagtcccagctactcaggaggctgaggcaggagaattgcttgaacccgggagacggaggttgcagttagctgagatcatgccactgcactccagcgtgggtgacagtctccaaaaaaaaaaaaaaaaaaaaaaaagcaaactaccgaaatagaaaatatttgaagtatgtgaccattaaaattagaagaggtaggtttgaattctggcttctgtcctcactggacatttgtttttgaagtttctatgtctgttcctttgtagcaaactgacagttttaaataaagtaacgtaaccgcacaccccaaaacataagtgttaattttccctactgcacaccccaaaccacacaccccaaaacatgttaattttccctatgcatatgcttacttgtgatcttatatttatgttcttgtatcttataagccttaaatttatgctgagagttctagccaacaacacatctacttaatgttttgtcagtgaaattaagcagagggtgttatgtcaatatttaatgatagattgatatattgcatgggctactttgtttttaatccttggccagggccgttaaatatttattgacagttaccaaaaaaaatggtttttaggctaacttctttttgtaaatatatgttcagtaattgccaataacttccatactaactgaagtatattagtatataggaagctgttgctatgaaataactgtaatatttcaaaaactaaatgttttttatttcaatagttttgggggaacaggtggtgtttggttacatgggtatggtctttagtggtgatttctgagattttggtgcacccatcacccgagcagtgtatactgaacccaatgtgtagtctttaatcccgcactcccctcccatccttcccccaactccccagagtccattatgtcattcttatgcatttgtgtcctcatatcttagctcccacttataagtgagaacgtacaatgtttggttttctattactgagttacttcacttggaataatggtcttcaactccatccagggtgctgtgaatgccattatttcattcctttttatggctgagtaggtatttcattttatatatatatatatatttatacaccacattttctttatccactcattggttgataggtatgtaggctagttccatatttttgcagttgtgaattgtgtcataagctaaatgtttggaaatacattggaattatttctgaagttccggaatggctttgctattctacattaggtggtttattgaatatttttagagaagaacctcttgattttcagttgtttgtgtggggagaagagatggtggtggtggtcattcttcatatggggatttggaagatgaaagagtaggttactcattctttatatggattttcatcagtccttctcattttggccttgcatctcttccccgtaccctatcatacctgatctttctgggtactaagcctgtacaaggtttctaaacccttcatggcttccttcatggctgtggtccactctatgacagcccaggctgcagtttccaccactatgtatcaacagctccatgttaacaatagctttctgtctaccagaaaattgaactttcctgaccatttctgtttgaaatataggtaataaaaccacttttaatatgtggttatcatagggcagaatttttcaacctcggaattattgagcactattaacatctagggccagataattcttgcgtttgtctttcctgtgcatcgtaagatctttagcagcgtccattgtcaagtaacaccccctaccaattgtgacgatctcagttgagaaccactgtcataaaaccatgccaatgagtaatcatgcaggactgtgtatcacaaacagaataccaagaaatgtaaataccttctgcagaagcgcaagcatatgtaaaccaactcaatataatctggaaggtcattaaattacattatactatactttagaaatataatgtctttgtgatatcctgagacaagcagattatttaaaatgttctgactttcgcagtgacattgtgccttttttgtgttccaaaattttcttttgataagcatttctaaataacttgggatttatcctttttcatttatgaaggccttttatctgctaatagaaagaagaaaaaaagatatgctatgatcattttgcatactgcctcattgctagagatgctttccctcacaggatacataatttcttggaatagactattgttcctagaagataattagtgactgttttttttttttttttttggttttttgcctgtcaatagaagtgaaaacagtagttggcatgctcacctacttgattatagctattacatcaatcagcatccttttcctatgcttcatcatcatttatctcaataattatatattgtttcatttttctcaccattttttctttagcattaactatacacaaatttatttaaaatggctgaaattagtcatgcaatcagttggaattcatcctcacaacatttatgcaaaatctactgcagtaattgttttaaaagtgaaatttaaaaatattgaaccacctttatttattctacatctagtcgtactctcttttgtttaccctccatgtttttctccactcatttggtcagaatcagggtttagtgggtggttaaatgtgttctgggatctgccgtgagtcttggtgcatcaaacagggctgaagacaatgaaagctgtggcataaaggacaaatgtagaaggtgaaaaacgaatagagaccctgaaccttaacattatctccatgttgaccacggtttcctttggtattcttgagtaattctatgacgaaaataatgaatagagtattttcattgtttcttttaccttggaggtttatcaagatgttggacagcaacgaaatgtaaattccgtaactcatgtgttaggacactacttcataataaatattttttaatgagaaaaaactaaatcatgattatatccaatttgccagttaaatatgttccacacatcagtgaactaaggaagtgctggagaattgttcttagtaacttggataagcaggaccccgattgtattagtcaaaaaataaatttgggtgtatactttttattgatgtgtcatagttatacacattttggggtgtatgtgatattttgatgaatgtaggcaatgtgtaatgatcaaatcagggtaatggggatagccctcatctcaaatatttaccaattctttatgttggtgggaacattacaattcttctcttctagctattatgatatatgcaataaagtattcctaattataattttcctgctgtacaatagagtactagaatttattccttctatctaactatatttttgtacatgttaatcaacttctcttcaactgcccaaagcaattgacacattcattgcaatccctatcaaagtactaatgtcatttttcacagaagtagaaaaaaaatcctaaaattcatatggaacgaaatggagcccaaggagccaaagcaatcctaatcagaaagaacaaagttggaggcatcacactacttgagttcaaattgtactacacagcaacagtaaccaatacagaatggaactggcacaaaaacaaacacatacaccaatggaacgaaatagagttgttatgaccaaccattctattctctaccttcataagattgacttgttttgctctcacatatgagtgagaaaatgtgatatttttctttccgtgcctggcttatttcacgtaatataatgactttccatctatcttgctgcaaatgacagattttcatactattttattgctgaatagtattccaatgtgtacatatgccacattttctttttattattttgaggaaactccatagagttttccacaatggcagtactactttacgtttccaccaacagtgtacaggcattcacttttctctgcagcctctccaacatttgttattttttgtctttttgataataaatagcatttctagctgggctgaaatttctcttcgtggtttttgtttgtgtttttgtttttggtttgtttttgaaacggagttttgctcttgttgcccaggctagagtgcaatggcgcgatctcagctcactgcaacctccgccttccgggttcaagcgattctcctacctcagcctcccaagtagctggtattacagctatttgtggttttaatttgcatttctctgatgaagatttttgctgttgagttgtttgagctctttatatattctacttactaatcccgtgtgtattagttcattcttgaattcatataaggaactacctgagactaggtaatttatgaagaaaagaggtttaattgactcacagttctgcaggctgtgcaggaagcatggctagggaggcctcagggaattcacaatcaggcagaagtgaagaagaagcaggcacatcttcatatggcagagcaggagagagacagcgaagggggaagtgctacacacttttaaacaaccagatctcctgcgaactcactcactatcatgagaacagcaagagggaagtccgcccccatgatccagtcacctcccacaaggcccctcctccaacattgaggattacaattcgacatgagatttggatggggatgcagagccaaaccatatcaccttgtcaggtagatcatttgcagataatttcttccattttgtaggttgtctcttcactttgttaactgtttcctttgctgtgcaaaagctttgtagcctaatgtaatctcaattatctgtttttgcattggttgcctgtgcttttgaggtcttaaccaaaaaatctttgctcagagcaatgtcccctagcatatccccaatgtttttgtctagtagttttatactttcaagtcttatatttaagtctttaatccattttgagtttatttttgtatatggtaaaagatgggtatctacttttctgaatatgaatatccatgtttcccacaccatttattaaagagactatcctttccccaatgtatgttcctggtgcctttgtaaaaaatgagttggctgtaagtgcatgggtttgcttctgggctctctattctgttccattggtgtatgtgtttgtttttgtgccagtaccattctgtattggttactattgctttgtagtacaatttgaactcaagtagtgtgatgcctccaactttgttctttctgattaggattgctttggctccttgggctctatttcgttccatatgaattttaggatcttttttctacttctgtgaaaaatgacattagtactttgatagggattgcaatgaatctgtcaattgctttgggcagtatggtcattttaatgatattaattcttccaatgtatgatatgagtgtgggatgtcttttcatttgtgtacatcctcttcaactttcttcatcagtgttttatagttttccttgtagagatctttcatctccttggttaaacttattcataggtattctattttttgtgctattgtaaaggggatttctttctgagctagttaattatttgtgtatagaaatgctactaatttttgtatgttgattattatcctgcaacttcactgaattcatttatcaaatctaagagttttttggtggagtttttagatttttctatgtataagatcgtgtcatcagcaagtaaggataatttgacttctttctttcaaatttgaatgccatgtatttctttctattgcctaattgtttttacaaagacttgcagtactatgttgaatacaagtggtaaaagtggacatctttgtcttgttccagatctgagtggaaaggctttcagtgtttccctattcagtaagtgaaggatagtagagattagccagagcttatctcataataaatgactatgacattagcctaaaatatgaaactttccaagaccacttccctttgggggatcacaaggagatgagtcatcagtcactgccttacatttttgaaatataaatcaacattgaatagtaaaattagccttatggataaaaagaggtgactaaactgatttataaaaacttgtctctggataattaatccaccctaaacttgcttctcttatgttgtctccacatatggttaaatggtaccaccattcatgtgtttgctcaagctcataactagggatcatgccccttaactcatgaacattcgtttataattcacatctagtcagtcagtaaattttgttagttctacttaccaaatagatacttaagggaaaaaaattctaccacttccaccaccaacactgtgccgtcgcctttcagtggactgcctcaacatcttcctccctgccttcctgcctccattctgcctctctgcctccacaccacttcattctcccagacttgaacaccaaaatgccagagtgatacctctggtacaaatgctacttggggctctcttatttttaaaactctccaaagcattcctcttatacttaaaataaaacccaagtcctttccatgttctacaaggcccttcctgcattggccagtggctatctttgaattcattgtcactctttttttacatcattatagatacagtggcattctttgccctctcttaagcatgccaagtatactccatctcagcacctttgaacttgctcttccctctgcctggcataaacatcctccaggttttgctatgactcacttcctcccttctcacagatatgttccaaatgatcatcagagcaagctttcctgacagttttttctaaaatagcatttacattagtctctatctctttagctgctttaattttcatagtacttataatcacctggcattatattgtgtgtgtatcaatttatatgattattttgcatctccttctctggaatgcaggcttcatgaaagcagaagttttgtctgtcttgttcactattatagcccctagtacctggtagagaggaaatattttaaaaatattttttgaatgaataaatgaatatttttatagtttaattacaaaccacacttatcaaattaaatgaacaaaatactaagtatcaaagctagccaaatgaattccttggctttcctaaatacatgtcttttgatggatatattatgagttacttccttggaagtatttgttctgtctccttggcatgactcttaagttaccttgtatatgttgttagtttagtcatcaactgacctccccgcacctttctgttcagttgcttagtcactcctcactctttgaggctcctgaggctccatgactccgtggttagtcaccacaattatttgcaacagaaaggagaaatgttgccaaccccaaagcattagagataagtgaaaaatagagcacccctttcaccccaagtggattcacctagtaaatgttgatgttttcttctgtccatttccttcttctgcaaggaccatgagattgtgtttacattctacagctctcacaagatgtatgctccaatattagaaactaatgtttaaacattccaggccaaagaaagcaaaactgaaattccactcttgagtcattcagaggttgaagcattatgggtgatccaagttcccctgactatctgtgaacacaggcagttgtttgtcaattcttttaagttaaaaaaaaatgcacaaacaacctattgtaaaatggagtgagtcagtgcaattgcacaaagcatgttttattgtcagctgtataaatctgtgaatatttttcgtgaccagttttagttggtggatttaaatgaggtcaccaaaaagttatctctgagtatagcactcgccacagtgcatcataaatatgctctcatctatgaacatccttatgaatgactctatgtcttactcattcttttatctctaaattagtactgactattttaggtccttcataaatgcttttgaaattggattatggaggtatttataattatctagattataagctctttcaggactaaatgctatgttttgtttacatttgatccccttatagtcctgtacattgccttgcatatttaaaagtctttagaatatttttgttgaattgatttgttaagtatagatcaatccccctgctatggaaactaatgtggaaagtgttaatgattcttaaatcagggtctaaaccccttttgatcctttggttggatgtccagttcattatttcacaaatagtaatatttttcttgtcaggctatataggctgctaaatgctattatcccaaactttgatggatataattagaacagatttattttccgtctactatatgcaggaacttaatctgttttcctattaaatcctcacgacaattcatgcaggaagactatgtcacattctccatataaaaagactgagactaagagatgttaagtaatttatccaacttgccaaacaaataaggcagaatcaggaactgttagacctgtttccttgaacactaactgtgtgaaatctttcctactctaccacaatgcttctaagaaacaaagtgggccgggcgcggtggctcacgcctgtaatcccagcactttgggaggccgaggcaggcggatcacgaggtcaggagatcgagaccagcctgactaacgcggtgaaaccccgtctctactaaaaatacaaaaaattagccaggcatggtggcgggtacctgtattcccagctactcgggaggctgaggtaggagaatggcatgaacccaggaggcagagcttgcagtgagcggagatcgcgccactgcactccggcctgggcaacagagcgagactccgtctcaaaaaaaaaaaaaaaaaaaagtgaagggaactagttaaaatacattatgaaaattatatatgactttgaaagaaacattttatggtaggataagtatagatatccaaaatgtatcgaatattctcaatagtatttgagggattagtatgtgaaggattaaaattaacttttaaaggcgtgattgttcaacagagaaagatacatgtattatagacacctcacatttctctccacgttaagaactttaaaaagactcaagaatcttggcctctttaccctggtgttgtcatatttgttttaggaagatagtgttttactttttaccgttccatagctcaagtgtaaaagggatggggaaaagagggagaggctgtatccctttatgaatactcaggaaaagttaatatagatagggaatcaatcctgtacacatcttcatgtgttctgacttctagatgtttctctaactggtagctagtaagaaaaattagtgtccttaaaatgttccttctattatgcagaagctttgtcaactgagacattaataactctgtaagagaggtctgttattatttaaatgtctatagagctttaccgttgttaataggatgttctgaagaataaaatgaggtcttgaaaatacttttgttggtgaatacaaagctatgtttaatgcaaaattagtgagagaaaaatctctactataattgctgtgggtttttgtggacaaaatatgattaggatttaaaattaccctgtgcttcatatcattactgttacactttgtttagttttcaaagtgatttccatttgtgagtgagtgtgcatatgtgtgtataggtgttttcaaggaagagagaaatgtcttcgtaacacaagttgttttcttaactataaaaagccagttggcttagtcatggtctaatgctaagaacgtttcttttaaaattgtaatttgtttgaatttccttctagtttcacctttgccagtgcagaaaataaagagggtttttgtggttgtgtgtatgttcatcttgattggccattaccatagctgcatttgttttccagttctgtgttctgtcaatttaatccaactaatatttatgaaataccataatgttccagaaacattcaaataatggaaaattcagctcatattcttcctttgtgactttgtgacagcaaaattggtcaccctcaagtgactgtagaactgagctacatcttagctttagcagtcacctccttttcacagtcattttgccaatgtgtcaaatcagtggctcagccattgtggtctctggaagtttcccttcacttctatcaaagacaggcaaatcacatgagaaatgtatccaactgatacccatgataataccaaaacatgacacttacagatgatgacagattgcatggcaagagctctctgccgtaggttatgattatttagttgcatgtttccagtcttgtaacagattgcacacaccttgaggggagactgcacagacccatgcaatatttgcttgacagaattttccaaggagcacataacaaagaatggggaggaaaagatctaggaaggattctagtttgaatttgctctgttatttttggcaagccttttgatctttttgtacctcagatccttgatctctaaaataatagagttgaatcagtccagtttttttttaagttattaatattttttattaaattaaaatttatttttaaatttttattaaagttttttaactacaaagcaccgtaaggtataaggacagaaactaaagatattccaaaccctgtatcataatatctggcacattattctgtttaatatatatcagttgaattgaattggatttgtttggtcaacatcttgggtgaaatactgatgtataaggtaaaataaaagcagaactaattttgtcaaagaggaatgggtggcacaacaaggcagggaactgagcccagtgggcacccccaaactccacctactcagaggggcatggtgaaaatcataccatgttagagaacacagtttccaaatcaaagaacttaataaccgtgtaattcttcctggcttcaacattctataattccatgactgagctttaaagaattcctttactaacatctagtttgccacatgaaagtaatatgaaagatgttaaggatgttgtaacattatgccgtcaagtgggtggtgggttatgatggagaaccacaaaaccgttttgtatttctgaacaaatgtactgcatacgggttttattatctttctctgtagatctttattttttgccttactgcaaactaatgtggtatgcgtttgaacagggaacagttctctcaggtgctttctgtaaaaaactgtcaagtcgtctacttgtaactacatagtcacaagattatataaactgacataatttactgaatacaacacttatttagataccatagttgcttttgaaattcactgaaaccatttgataaccagagtctaagaaatgtagatttccaacctattaatggcaaactattttgccaatatttagtgaatataagctgattatttaggcagtagaaaaataaaatccattaagatcactttaggcaggaaataagagtattaaagattaatcagagtgatatcatatctttgagaagaatttcaaagcgattgatctcatcctattacccaaactttcctttgccctttatttctgtcctcttgttaaatagtaataaagatgaatggataattattccatgagctatgaacaaaagctatcaatcatatatgaggttgttcttccaaactaaaactcaaaactcattccttttattctctgacttggggcatgtcattcctttgtacttaatgtgttttcctttaaaaagaagaggaggcaagctgctaaagcttgaattcttgaaccctctggtgataagtatatgtggccaactcttggcaattctgcctagattagccttccagttatcaaccaagctggcatgtcctcttggcaaggaagaaagaaagccctcaaagcaaaaacatttagtttagcaatccttaaatgataatttatatacttgatacagagtagaaatttcggtgacaggtttcaagggacctaggcaattcgatgagagagggcagggcagagtgaggaggctagatgaaggagagctgactaactaaagtccagatatagtctagtttagctaggaatgaagtatgcaatggaaaacctatcttcaagatttctaatggcaaactcttagatttgtgggctgataattgaagttgacgagagcacagagcagaaatgtgtagaagcttaaaatcgaagagagtatatcatgcaaattagcaataaacactataaaatgtaacggataatagaaagagtttagactaaatggaaaatatcatttaaaatattcccttggtgtgggtgtgcatgcttgtactaatttaatgccatatctacctcacttagattatgtatgtaggaaatacttaatgtaataactaaatggcagattttgaaatgatgtgatctaggatatggaaactaggaatggaattaagaataatgagataaatttatgccaaaaaaaatcattgtaatacatgccacatatatcatgtgtagctttaattaacacagaaaaaaatgcaggacatcccattaaaagtaaaacaaagaacaaattgaaaatgctttctgaaacacagttatatgttcacaaggactgaccaatcctgatggtctaattcattagtgtcatgtgactgtcagtctggaagtgttatattttactcacgtacaatctaatagcttttcagcttgcctgaaggtgttatctgcagtatgttcatcgttacttggtagagcactttaacactactttgaaagtgaaaaatatttgggaaaatagactgtattctatcttttagttttatgcagcataactataagtctctgtattattattgttgttgtttttcagcccctctgactgataagccacccaagcttttgtatcctatggaaagtaaactgacaattcaggagacccagctgggtgagtaattccttaattctagttaatatgctgctctcgttacattgtgacagttaataagcctagattgtaacccgatgtaatactcgcagctaaatccatttgtattcatagggaacagaattagaaaatgctagcatacctagccatttcattccttacagtgcgtgccttaggacccagttggacatatggatgtaaaaactcacatgctatttagatggttattggaaaatgagataggctgatgattttagtgatggtattacagcactgtcttacaaggtttgaattggttttcaaacagacactatggaacaatttgatttataatatctattaataggttaagatgcaatttctgaaatttaggggaaagggttcaaatttattaaaataaatgtcaccattatggttaaaaaacattttaagtgtaatcaaatataatataaattttgctagttatattttggataatctattaataaaatatgaccaagtgacttttggttaagggactagcagatttgggacataaggctatagacaaaatatgtattgaaaaaatgtacaattatatacgaatcagaattctgacttatcttagaggttcatctagaaattttgagtttgatttagctatattcagttatactaaattatgaaaaatttccctcttaattataaatatatacatagcaattctgttatattctcttaggtcttattttatttgaaatgtagtatgcaggcatatgccataaactttggcagaagagtttttgtttgtagtggtgcattataaaaggttatcaaaaatatgaatttaaatgaatatccatgtttgttaaggaatttcttcttagattaatcatacaagagtgaaaatgcatgtactgtatataactaaaaagaatcagtataccatcccttaagttattaatgttattcttattcctggagtgagaatttgcatcaaaattgtaaattcattttccaaatgaagattacagatgtgataatctttactaataacatacccaaagttatagtacacaaagatatgatgatggttttagcacctataaaattattgtggtcaatggctttctagcacttgaaatgcttatatttgctaagtttaaagcatgaacatacaggatttatacaagtcagggtgttaatatctttctttgattcaagccttttgaattaatgtcatataaatgcaagtagtattataattgctgttattttgagatggaaggttacagatagcattgaaacagtgccacatatgaagcaaataggtgtactcaaattttatcatgcactttatgcatgccatggcatccttaattacactagaacttattgctacattatgaatacatttttatttataaattcccataagtagccatgctcatactgatctttcaataattcataggaagatgtatttctaaggagttatataaaactattaaacattttgggccgagaatggagggttttatggtaccagttactataatgaacatagtaaaaatgaaattaattgtacgcctttgcttgacaatataatgaaaagaattttatggttgattgttgcccattgggtttctttttactgtccttgaatttgtaataagtcagattgttctctacctcttactacactgttttacaaaatagaataattggtaaagctgtatttaaagctttaccttctcttgaacaaagtcacaaagactaaccacagcaaattaaaaatatggaaatttcttaagcaaattggaagtgactatacattcatttgaagaaatatgggcatgtctgttactaaaatgcttcaaaaaatactcttaaatcctttattgtcactcaaaaaggagcatgaggtctctttaaccactgactaaactagtggattattttaagcaacttttattttgttgtgttttatgattttggttcatagtgtacagataagtcgtttactagttagagaaattcaaccttaatctttggatttgtgagcaacagttgatttgaagtaactaccttaatagtattcttgctactttgctagcattgctagtaagtaggtgaatcaaaaagggtaagtgaaaataggaaagaatattaaagacaaaaaaggcttgagatgaggtgtctaaaatatacgttttttccaaaatatgtatttggacttttcattttcttaaggatttaatttttgccctttccatatttgacaaaactgcctattcaacaggttcaaaatatgatataaatcctaagagggactgagtgaagagtcacgggttgggagtaaagagggtggcctgcgcccatgatggggaacttataacctactctgttgaaaaccttcaacagaattttacggtccaagtattcagaggtttgcctccacttgttcccaaattgagagttgacctcagagggataaccaaactcttgtaagagttacgttataagaaaaatcatcaggaattacacaaagctaagcttgtacatgtctggtgacctaacttgagcatcctagttaagttacacacgtatccaatcaaccctagtaactgtgtgtccatagattctctagtttgctcacaaatatatgtaattcattaataatgaactttgatataatcaggaagtgcatggatttgctcttcatcttcaaattcattttctctgccatttgctagccgtgcctacctttcccattttctatatttctgtattttcttgtgtcctgttcttctaattcctccatcttttcaaactggaaagggtttgatagtggtcatttaaattcttttattgtagaaagaaagcaaaaagcactaaaagcaaagtacttaggaaaaaatcatataatggaaactaaattcatataaaatatgtaaattgtcggctttgaatttgaatcaatacgtggtcacaacctggcatttccattttaagtggcaactgtatgttatttctaaatgtaaaaaaaagaacactgtccatttacataactttcaggcatcagcaaatatgtgaatagcacttttttgggcaaaaggcccagaaatttcactgtacagttctggaagtcaatctgggaggtgagcctgagtattttttcaggctactatagtcaagagaatcaaaagacagccacaattgtcttgctaaacctgagccctgaggatgtcattcagagatgtggcctgcctgttacggccaggagcccactttcagaaccgtccaggacagagagcatattctatcgctaccagactttcaaagagtagaaatccaccctacccttgacctaatggtacaaattatattttacaactcagaattcactgaaaattatcattaattacttacctagatatgtgtatcactttatttaaatgtcagtgttgtctttaaaataattataaaggttaatggtagaaattttggggaaatagagagaagaatctttttcttacactctacattataaacgcattctgctcctattaaatattctcacaaaatatccttttaatggccgatgtgaatgtcatataatttcatatatattgctggaaatttgaattcttcacatttttgttattataaataatgtgatggtctttacctatacactttccctctgactctatagttatctcaacagaacaaattcctaaaagtaaaaatactgggtaaaaagaaataattttgttaaaggttcttagtacatattttcagaattcttaccagagaagttgtataaactcccaccagaagtatgtaataagtataaatactacttaatctttaacaaaattaataaaagtatatctttataacataaaactcttaaagatctctttgatactaaaatcacctctctctcctctcttttacctctttttctctcttcactcattaagtacaagtggatgctctttgagtttatccgtatttgaaagatctagcccatttaggtaaatgtctacccttgagaaaatatacaaacctaatcgaatgtctataatctctatccattttcttctcttgctcatcctaatgctcagctaggaccttcctccagattctatgtttcttaataaagtgcccagtaatttcgtgatgtactgtgggcacatggaatgtcaataaatactaactgacaataagttcttcacagcacaaaggacacacacctctaaattttctgcaagagaatataatgtgtagactgaactgtgtaagctgcccaaccgtgctcttatttttctttactaatttattctcattgttaagcttgttaaaaagcaagcactttttgtatctgagtgggtaataaggattcaccagatattcacatctggaggaaaatggttggggacataaagaaacttcagatttttaaacatagatcttagtaaaaggatacacattttatccaatatatgcaattttatccagtttaactataggctacttaaaataaaatgtcacactagaaattaattagcactccttggcttgttccaccatactgtagttgcagaattttagatttggaatagaccaaaggaaaatgtccatacattttattacagatcataattgaccacaccttttctgaatagttactactctgtgttagtaaacttgggaaatctttttgtttcctctctagggtgagaaaatacttaatataaatatcctagaaacaacattatttaggtgttgaatttgataccgaattctgaaagtgtcatgtaatactgttgagtctaaacattattgttttgctgagttgtacaagtgatgtaaatatgacagttcccagagataggaaagtcagtatcggccagattttctcatctacattcacgctactggttgtcataagcaaatgtaaggccattgatttgattttaccggatcatagagcatataaaggacatattttcaccaacaaactcaaattaaaaaaccgtaaaacttccctttctactacgagaaaaacaataatatcccaagtccaagctttttatggaaaatgtggttctttttgcccatttaagaaagacataccaatcagcatatttctagtgcctgaaataaacctgttagacataaattaaaccttttggacaaatagacatcgtaattaaaccatggaaagataaataaagactggtattataattatttaaactatggcattcaattctactcaatccaaatttatcatcccaaggtaaatgaaagtggtaactcttaacagctctcttagtctgtcttgcttttgaaaccaaaaagcaccctaaaaattgtgactgacctaaaaaggaatacttgtcataccactatttcagttattatcgtatatcattaaacagatgataaatcaataaatggaaactagtattcgtattttgaggtcattgtatgacctaacttacatgattctctcagattctcaaattcagtcactttttggtgacagagaggagaaataggtttggaaaaaaatacaactgcatgtttgctttaaaaactgctatctacgtagaagttgaaattcctttttatgttttaagtggtcagggccagtcacggtagctcactcctggtatcccagcactttgggaggctgaggcaggcaaatcccttgagctcaggaatttgagatcagcctggtcaatatagtgagacctcatctctacaaatatacaaaaattagcttggtgtgttggcatgcgcctgtagtcccagctacttgggaggctgaggtaggaggatcacttgggccgaggtgattgaagctgcagtgagccatgattgtgccactgcgctccagcctcggtgacagagcgagaccttgtctccaaaaataaaaaaaagttttaagtggtcaagccctagttctaggacaggtttgcaatcccataaaaaagatggacgtgaaggtaagaacagttccagtgggccaatgatatccaaaagtttggaagtcagttaaagcacttttttaaaaaaacttttattttaggttcaggggcacatttgtaggtttgttatataagtaaacttgtgtcacaggagtttgttgtatagattattttgtgacccagctgctagtacccaatagttatttttttcttctctctctctctcctcccaccttccaccctcaggtaggccccagtgtgtgttgttcctctctttgtgtccatgtgttctcatcatttagttcccacttataagtgagaacatgcagtatttggttttctgttcctgcattagtttgctaaagataatggactccagctccatccatgttcctgcaaaggacatgatctcattctttttatggccgcatggcattctgtagtgtatatgtaccactttttaaaaaaatcgaatctgctattgatggacatttagactgattctatgtctttgttcttgtgaacagtgctgcaatgaacatatgcattcatgtgtctttatgatagaaggatttatattcctttgggtatatatccagtaatgggattgctgggtcaaatggtagttctgtttttagctctttgtaaacagacaacctacagaatgggagaaagtatttgcaaactatgtatctgacaaaaaaggtctcatatccagcatctataacgaatttaaacaaatttacaatgaagcacttgttaaagtctttaaaaactgggacagagacaagtgagttttcttgttcacttactttccaaaagggccagaagggaaagaagaagaaagaaaaggcccaagaaagagtgctgtcacagagcaatgcagagagtccatttaagcttccaactcctggtctagtccccacgctggacactgacacatattatgcagattactcttttgctgcagcactaagagtactattttatttgttatcagtcagttaagaagctatataggtataaatctttgcaattctaaatgaagaactttaggaggtggagggggtctggaagttatcaggtcaaacctttttctttcttttttttcctttttttgagacagagtcttgctctgtctgcccaggctggagtgcagtggcgccatctcggctcactgcagcctccgcctcctgggttcaagggattctcctgcctcagcctcccgagtagctgggattacaggcatccgccaccatgcccagctaaagtttgtatttttagtagagacggggtttcaccatgttggccaggctggtcttgaactcctgatctcgtgatctacccaccttggcctcccaaagtgctgggattacaggcgtgagccaccacacccggttaaacctttttcatttattgatgagaaaatggagactcaaaatggctacatgttttttacataaaaaatttacaaaagcttgttattgccattatcatcatcctcatgatcatcatattatcactgttagtgtttttgttgttataattaagaggcagtgtacagtagtggctcccagttgaaatctcacacaggcctatgtgacagtttagctccaccatttacttctagtgtgaccttgaacaaccagctttcagtttcctaatcaataaaaaaggtaccaagatagtactgcttctatggaggtaatgtgagtatttgatcggataatgcatgtaaaaattaatagattacttggcatatattaagtagtcaatacatgtttgctgttagtatttgagacatttgaatgctgtaaaagagtactgtatatagaagattcttgaaatgcattttgaatgtcaatgcttatttgatcatgcttatattcttactacagtatcatactatggcagcagatacagccttcattacaggataaataagattttagaaaatttatttccatctcccctttaaggattcaatatgcatactaaatttttgtatttcaatgaaactttttaattatagaaattattgattttagattacttaattcatcaagtctagccaaatgcatatagtaagtacatagttataacagaagaaaactatctctattcttatttaaagaaaatgataatttaaaggacactatgccacatgaatttataaatgaccatcaagacaaaaataagagtaaaaaaatttctcttttgtaaacagaggaaattcaggtataatatttttaaaaacaagagacctggaaaataattttccaccattatgcctgtcaagttcttcatgaaggttttgatgatagtcatatcattttatacaaaaaaatgctgcttttcccctgacaaacactgttatcacaaagctttctaagtcattcttaatgattgaagtttactagcatataaaaatacagtcagtattgtatgttaacaagaactactcctgaatttgcaaagtaaatgccaatttatcagaaataaacctatcaaagaacattacgttgtagaatattgaaagaggttttagaataagagtatgcactgcatgactgatgtccattaaaatagaaactataaaaagacccacatcatttaaagtttgaatataaagagatacattcacccataaatttcctctcaaatttcagctaaataactaaggatttctaaattatatgcagactctccatgaaaaataactagtgcttcaataagattatgaaaataggttaccagtattttatgctttcatgttaaaacacttagcattcctgtcaaaccttactttatcaacttagtatattcccacagatttgtgggtaaattgaatcatcatcatttcagagaagtgttcccttcatttttgattgattttcgattagcagtggcttaacatgtcaggtttaagaggctctgtcccccattctcttttaagcagctaatgatcaatgaaagatttatatgcataaaggaaatatgctatttaaagaaactctgtggtgaataattttatataagaacccttttgtaactgaatgatcacccccataagttttccctgtggtaatgcagatttttacatttttgtaagatgaggttcatcgatatgaaactgcaagttgcatctccaactgatccagaaaaaggatcatccacccattaccatgtgtgacctcccgttgtttattaatggaaacaaatgtcctcattgtgactttctgcctcctctgaggaaatattacattttactcaccagcttcagaatcaacagtatttggttttaatctaattctttgaaaatatattttgtagggtagaatagttaagtaaccagaatatctcatgtccaattatgacaaaatagtttattttcataagggatatgctttgaacgccatcctactaccttatctgccttggttttgttgaaatataccctagtaggataactgcccatggtgtcacttgtttttctataactgtgatgagagttcttatttccaggtttaaaaggaacatcttgtattttgattcttctaaaatttgtatgactctcattttatcattctggcagtcacttctttttatcttaatgtattcatatatgtttaataatttcttttaaatataaaagtatgtacaatgccacttgatttgcagctttatgaatgaggctattaccaaaatgtacttaaacatgtgctccgaaacatgccagatatttacatgagtccaatacatagagtgtccataaggctttaaaacctaagccccatagcaaaacttcatgaagaggcttccttccaattcaccacacacaagttcaacactactttttttttttttttttttttttttttttttgagaaggagtctcgctgtgtcgcccaggctggatgcagtggcgcgatctcggctcaccacaagctccgcctcccgggttcacgccattctcctgcctcagcttcccgagtagctgggactagaggcacccgccaccacgcctggctaattttgtgtgtgtgtgtgtgtgtgtttttagtagacacggggtcccaccatgttagccaggatggtctcgatctcctgacctcgtgatctgcccgcctctgcctcccaaagtcctgggattacaggcgtgagccaccgcgcccggccaacactatttttttagaaatgccaaggatctttatttaattttgtaataaaaatttataaaatctcattataacatatactaattgaattatgaaaggaaaacaatcttgatttaaaaatttttgttttccaaaattaatctgttttaaaataagtcttggcttcatggtcttgtgagaagatacctcccaccgctagatctggtctacaacaagcatgacaaaaagccaggaagttgcttaagagtccaagagagtgaataattttctctcccttccacttctccccagtgaggctaccgactttctcactctctgagtgtttgtttctagtttagtaaaagcagagtacccaccttggacttgcctgttgaagaacttttatagaatggcggctctttgagtaggaaaaaagcaaagcagaatgcattgcttttctggaaaaataaaactgagtgcatcctgtcacatcaagccatcactaggaacaggatacttaacaatacggcaggtcctaggaaaatttgagattattaccacgaatattcagtaagaagccattaccattatgtgaaatagcttagggaaagttcagaaaacaaaatattttttattttctcttcttaaaagaaaaaaatgtaatgtttccgatgaacctgtatttctgatgatgatcatgtcaattatcttggcaactttaagacttcttaattaaatgattaaaagttgttactactttctgtaaatgtacctgtttttgactgaaatatttggggtgcaattagactagttttatgcactctgcttattgtatagcctatttataagtagtatgaatatttctttcagaattacatatcacatacaatattgattaaaagacttaaacaagatattgttcttaggcataaatataatttgttttttaaatcaggttcaccatattcaacatgaatgtaatttgtaatgattattattttaaaaaaaaccctgtctctatttaccataaataatatgttgtcactccaatgctctttattaggacttgctactaattacagagtgagaataaggtttttatgtaatgggagctaaataaaatgagtgaatcttatattagatgaatacatgagatttcagcctcaggagaaattgtgtgtcacagagaacatcggtgactattatgaaagacatgttcagtcaagagggaatcgtactgttgactatcaacagggcagaaagtactggattgtattttctttcagtcactatgtgcatgacctaaaatagagaactgaggcaatatatacataatttagaagggaaataatccagaaattttatttttgtctcaaatagatggctctttcaagcaaaggttaatttggggatttttttttgaggggtcaacttcctatgtctaagcaatttaaacttgaagaatcacaggatttaatacttcatagttagagctctggtcataagtgacaaatcacttaaaagacaggagtggtgctggccttaagaaggattggaataatgctcgactgttctctgtctttcttctctactctttctgcatgtcatcattttgtataggggtggagagtggtgggtctgggtgagtagaggagggcatacagggtgaaggaatacgttgctcagttcttctaaccaggaggaaatgtgggtttggaactttagtgagaacttgaagttccctaaggagaaatcctaattggcctagaatgagatacagatctaaattttggacggatcactatggcattagaggtgaggggcattggctcagtggctgttgtgtgtctctctctcctgtgatgaagcctgtatttttgtgtgagtacgtagatgtggcagttggtgggtgggtggggaggctggtaatggggcttttaacagacaaagataggggaaaaagcaatggttattatggagtccatcttttcatattccatattcaatatttgtttaacatccctggttaatccatctcattaatttagctgtcatctttattatgcctcttcattaacttagtgagggtagaatgacccatcctgattgatgcatttgaatgcagtctctcttgggctgaaaactcttccattgctcttctcccaactaatactgacatcctttcctgtgtatctgtagtgcatacgtctcaactctagacctgcattcatctctctgctgtctctaagcctgcagagtatgttctcttccagccttaaacctaaaccaaatggcagattcttagctgttaaatacatttttaggaaaaaattaatatgctttctagagctagagaatggattataaaatcaacttcacgtaatatgaataagtaaagtgaggccagatgtaatgctataaaggagaatggagaccatgctgaagtggggaaaacattttctacctataaaattttaaatttattgttaataccatcttggccaaataaaacttgtctagtgggtagttttagtccagtggcctgagtgtctgatgtcttgattggtaaatcgagagtttatactacgaaatactgctgcactgtggagccggtaggctctggattcagaatggctatcacgaaatatgaatctgttccatcatattatagattggaacatgacataatatgatttgtaatgtgtttggagtaactaataaaatctcttacccaagaagcaaggagtttagagcagcatagttaattatgaaaggagaatctccccatcaggcgatacaaaaatcatagagttagaatgaaatgggcaaattctctttagcaatctggccccacaaaaaagtagctatgtctattttgtcattacagacttgttaagttaacaaaagtagaaatgtctgttaactctcccagcagacattttcatttactcttctctgcacatttccactggatatatgtttgttcctaaggtcctttactcaaggctaggcattacctaatttacttgtgaaaatgtgccaagaaaaggatcagtgattattcttgcttcattatttaaagcctactttcatgaatgtaatgcagtcatcattcctatgtattgtcatcagagtcgagagttgggacgacagagagtagaaatcctataacaggcattagaatttttagtagataataccaaaaattgaagcagagtcagtatgtcagactctaagtttggcttggtaaaaaatcctctttgtaaattaaaaaaaaaaattaccagactgccagcttaaaaatattatgtgtttccaaatagatgagaaatgtttgaggtgataaatattccaattactctgatttgatcattacacattatatgcatatatcaaaatatcacacatacccctattagtatgtacaattattgcgtattaataaaaaggaaaaacatttgatgcaaatataattcttgtgtatgtgtggtcttaattgatattcttttaaccaagcttactgagatatttatattgagtaaactatatcgtgttcagggtaaaaatgtatatgttatgtgtctgcctgttatctagaagataaaggccactttcttcacagtctgaccccattttgtctttatagtctcatgcactctcctcttaagcccacgccactgaccaggcacccttgaccataccatggacctacataactctatcatttgtacatgctatgcccaccacctgaaatttcctctcctgcctttttcccttgtgcctatctactcaaattttaagaccaacctcaatgtcaccccaatgaactcttccctgactctactcccactaggcagaattaaataccacctctcaattgctagcaaatctctttttcacacctttattagaacatttctctcatcatttttgtacatatttttgtgtgtctatttctcttgttgcatttcggactcttagagcatgtactataatgttttcatctttacatccctgatatgtaggacagtatctgatgcacagaaataaataattcatttagcattcactcagctttaatagtcataaataaaaaccaacatacatatgtcactcttcttttagtagcatatactgcagagtaatggagtaaaccacgctaaaactgttggttttgatttaattgcctggtgtgattgaagattccccttcatggatgagagagacagatagagaaaggcctaggagtctggctagggaagtctagcaataagtcaaatcccgattagacagaggaggaaagatcagatggatattgaaggtcacaacagagcagtaggttgagtttggataaataaataggggttgaaagaacagttatatatcagttcagctagaagactggtcaagggtagagacttttcactggcgtcttgagtttcaggcagatctctaaatttagtaaagtagactccacaatcttagggccctgaatgagaaattggttcgctagttccatttatgactttattactgggcacaaggtctggtcaaatccacataggtggctaggtaggtagataggtagatgaatagatagatagatagcttaacaaacagacgactgtctacaaggagtttatgttataatctcggttaacctctggatgttccttgttccccaagacgccaagacttcctgtctttcctcacagtttcagtcatgaatgtcagctctcgttctaatgagctttttaatcacacagtcgtgatccagtaggtacagctttccttgattagtgatcttaatttatctttgctttgagagtaccttacatctgcaagacatttaagtatgttgtctcatttcatcttttcaacagcctgtgatgtctattttgcctccattttacagataatgatcaaagcttatgtgtggcacttgttgtgacacttctatacattagtgtattgaatgtgattacctgttttgctcctttgttgagttctaattgtgcacaacatgcaatactcccttaaatccataaccttcctgtaatatttaaaatggtctattcttacagactacttgagttctgttttcttccactgttaagagagtctatgtctcatcaagtagaacatctagtaataattccattgaatataaacttgtctttgaaatgtttctgtattatccagttcaggttgctaaaacaaaatgcctttatactattgcttccaaatcttaactattggaaacagtgccgcaacaaacataggagtgtagatatctattacagcataactgggttattattgttaataaaaacattttaaaataacttaaagagtgtaattggattgtttgtaactcaaaggataaatgcttgaggggatggataccctattctccatgatgtgcatatttcacagtgcatgctgtatcaaaacatctcatgtatcctataaatacatacacctactatgtacccacaaaaattttaaaaaactgaaaaatgccttatcctgattgatttataaaccacagaaattaatttctcacagttctggaggatggaagttccaagatcaaggcgccagcagatttggtgcctggccagggttctctgcttcatggatgatgccttctagctgagtcttcccatagtggaggaagcaaagcagctctctaacccctcttttataagggcattaatcccattcacaaaagcagagccctcatcacctccgaaaggcttctaataccttcgtcacctgctgataccatcagcttggtgattaggtttcaatatgtgaattgggtggggggatgaaaatattcagattacagcggtttctcaggtttttggttttgggttttgttttttgtttttctattcagttgcatgtctcttgaatctgcttctgttcatctttgcctcctattttctcattcccattttttttgtacttctgctctttcaagtacattttaagagacacttttcttctttcactgatcttcgagcatgaagttcttttcaaggcacttaggaaaatggaagtacttaggacattcatgaacagaatgtctcgagagctgcaaaagttaacgtgagaaaagctgatagaaaagttgcctagttcatcagagttttactctttaaaaagcagcaagttataatcccttcttaaatagcaagcaaaagcaagtggtctcatttcacttcttgaaatagacaaagtgaaactaataattgacttgtcaatttactacgactattaattccctgcacgcaaagttggacttcgttaatttaggattcacgttttctttctgaatataattatctgactatatacagaaaggtagtttgaagccagctagttattgtttgagcatttaaagttaaaaactatgtagacattagtaaatatccatttagaaaacctgtaacaactggatcaaaattaatcttaactgagaagttaaatttgacttacgatatttttatgacatttacagtgcatcttgctcatggcttgtaaatatatgttaactttaaagaacttgccaggagtggtggctcacgcctgtaatgccagcactttgggaggccgaggtgggcagatcacctgaggtcaggagtttgagagcagcctggccaacatggtgaaaccccatcttgactaaaaatacaaaaattaggcacgcatggtggtgggcacctgtaatcccagctactcgggaggctgagacaggacaatcacttgataccgggatgcagaggctgcagtgagccgagatcgtgccactccactccagcctgggtgacagagcaagcctccatatcaaaaaataaataaatcatgaacttggtaaggtttatgtagaaatagaggtgcttttattatgtaaatgtttgctgtattaacttaggaacataatttgcaatttttcctaaaggctgacatttaccaggtgtgaggtttcataaacactagtatcagaaaaacatttccagttgtgaaaatgattataagaacagaagtattggccaggtgcggtggctcacacctgtaatcccagcactttgggaggccgaggtgggtggatcatgaggtcaggagttcgagaccggcctggccaacatactgaaaccccgtctctactaaaaatacaaaaattagtcaggcatggtggtgggtgcctgtaatcccagctactcaggaggctgaggcaggagaatcacttgaacctgggaggcggaggttgcagtgagccaagatcatgccattgcaccccagcctgggcaatagagtgagactccgtctcaaaaaaaaaaaagaaagaaagaaaagaaaagaagtatagtcacaaggtgagcatgttattttaaacttcaatgacttaaaaaatataagtattgattttaattgcacgatagcataatattgaaaataagagagaaactgactttattctagtctgtgagaacaggttctcagtggggagataagactaagattctcatagtttattgaaataatgatcaattcaattatcaaatgcaggatagcattttgtattcagtttaataatccatcagcttttcaaataacatgttttaattgttttaatattatagattattttcactcttaaagtatcattttccaaataaagaagtatcatgatataagccattgggtagtggtcttgccactgactaattgagaatctcagtggtctgaggattttaatttccaactgtctatggcaatgattcttcactaggaatggacatgataaatacctgtagagcttttacaaaacatatgcacctagtttccttgatcccctgcctccccccacccccctaaagatttatttatttatttatttatttatttatttatttatttagagactgagtctcgctctgtcgcccaggctgcagtgcagtggtgcgatctcagctcactgcaagctccgcctcccgggttcacgccagtctcctgcctcagcctcccgagtagctgggactacaggcgcccgccaccacgcccagctaattttttgtatttttagtacagacggggtttcaccatgttagccaggatggtctcgattctcctgacctcgtgatccgtccacctcggcctcccaaagtgctgggatcacaggcatgagccaccgtgcccagcctaaagtttaatttattacatctggaagggaagctgagcaaggtctgcaaattttgaaaattcagagaaatacacatcaaatctacagtgagatatcacctcactctaattagaatggctactataaaaaaaaaaaacaaaagataacaaatgttggtgaggatatggagaataaacccttccatactgctggtggcaatgtaaattcatacggtcattaggaaaaacagtatggaagttcctccaaaaataaaaaatagaactatgatatgttccaagaatcctactactggatagctatccaaaagaaattgaatcagtaatttgaagagatatctgcacccccatgtttattgcagcgctatccacaatagcctggatatggaatcaacttaaatgttcatcagtggatgattgggtaatgaaaatatgttgtatatacacaatgaaatactattccatcatgaaaagaatgaaattctgtcatttgcagcaacataaatgaacattggggacattgtgttaagtgaaataagccaggcacagaacaacaaacaccgcatgatctcactcacacgtgaaatctaaaaggttgttctcatggaagtagggagtagaatagtgtttaccagaggatggagagggtaggaagatggggaggggtggcgagagattggtcaattgggtacaaagctatagttagattgaaggaataagttctggtggtctgttgcatagtagaatgactagcattaaaaagaatgtatatttcaaaatagctcgaagagaggtttttgagtgttctcataaaaaagaaatgatatttaaagtgatagatatgctaattaccctgatttgattattacacaatttacacatatatggaaacatcatgttgtgtcccataagtatgtctaatcatgtgtgaaccactataggaaaaaaaacctctgacctggtgggtttgatgttttcttagtcattatcatgatctctctatattctagagctctttgctctccatgtgagggagctaacagacctttctgggtgatctcatcagaaaggctgttagtgccaagaaaggaagactttataactcaggcacagagagtcccagtgaggctctgaagatcttttcaagtggaagcttgtatgacaggacactacactggggaatgagggtgggagtgaggtggagaaagaaggcacttctcagagcatagtaaaaatttagcaacaatttgagtcacttaccttactaaaaagttatctttatatctatgttagttttctgtggctggtgtaataaattacttgatggcttaaaacaacagaaatttattctcacagttctggtggccagaagtctgaaattaagggctgaaacccctcaggaggttctaggagagaatctttgcctcttccaaggtctatggctgtctacattatttgtcttgcggccgcaccagtccaacctctgcctgtgatcaacattgcctcctcatcttctctgtttttctttcccttccatctgtctcagctcttcctctgccttttctttaaggtcgcttgtcattgaatttagagcccacttggataattgaaattgatctctttatttcaagaagcttaacttaattatatctgccaagaccctttttccaaataaggtaaaaaattttacagtttctggagttgtaaaacatggttatatcttttgtgggggtgaggcgggcacgattgaacccactatagtatctgtcacatgctctgctacattcacaaaaactgatacttagtaaaagttcatgagattataaacagtgaagtatcaacaagacccctcattcaataattatcagggttgcttctctctctctctctctctctctctctgtgtgtgtctgtgtgtgtgtgtttgtgtgttctgtgttcatgtgtgttgtgctttgtggtcttttttttttttcacttgaagagtattcccatttagcccttgaagttaccaaatggggaagacattaccaaaaactatccattaacataagagttttgtggagcacaataagtaaagcaaagggaaacatccctctaaccctttcccagcaagaaaaaacaagataatcctggtagttccgagaaagcaaagaaagttagctctaactctttgtagtgaattttacagtattcagttgttctcgtacatttgtcaagagttgattcacctgcaatagaaaaggatgtctgtttacaagtggatcaatgattatatctactaatggaaaatggtagattgttcccaaagtcttcacaaataaaatctcggagataatatatctttctccgttagtagacacatcgtagtatctaaccataatgattacaggcataccttttttaaactatgggggcagtcacagtgctcagcattgcaggttttaaccttcatcagcagagtcagatattaaaaagcttatttcacgttgtatgcctgtatcaaaacatctcaggtagcctataaatataacacctactgtgtgttcacaaaaataaaaaataaaagttctcaatgtattaataagaaatcatgcatttatcaagcacttgttcaatgtttgtttgaaagtggtaggtaaataccaaaatgaatgcactgtatgagtttagggatgaagagcttatttcaaaagctcggtcaagcaaggcctaatggtgaaaatgttatgtgaactctaccttaattaaggtgtaggatttaagcagacattgatgaagtattaatagaaagacattgctgaaagaccagcattaggagaggcagagatgacagaacatatgttggcttttggagtgggcaactgttgtagccaactgaagaaattcagccaactgaactgatgaaaaatagtgctggaaaaaatagtgtagacacattacgaatttagatacactttcaatggaatatatcacaatggaatgtgtgtatgtatatacatatatattctgttgaaagtttcaatttcttatacaattaggaaagaaagagagcccaattaataaggtagtctcataatacattgtagaatgaataagaggaagtaggagccagaggtcagagagccaactgggaaactaattgtctaggcaaaaagtaatagagtaggatttgcaaaaggtcagagttgagggaaattgactttcagagaagtataaatcttattgttgtgtagactaatgctaagtaaagttgacagataggagtcaaagaaagtagattttaattatggttgagtgggaggaaggtgatatcaataataagaaaaagaatgttgtaaagaggagcaacatttgtgggaaatatgttgagtcaaactgtggttacacgacgatagtacattctgacaagtctctcccacaactggaaatatgtacagagctttagtgaggtattcgggctggacttgtatttgagagattctcttaaagaagtaacaaaggaagtcagatatttattgatgggaaggataacttactttctcatttgatctcagtattattggaataattaagcatactaattcctgaatttcttattttcctcttgaggacaggaaatgtgttttatttacctctgagtaatcagctgatagattgtcttcaaaaagttcctcttgaattactagagtttaggttgccgtgtttctgagattatcttactttttcaagtttaatggaatttaaaaaaaaatttactatatttactgttgtatcctgaaaacaaaagtatttctatgagttttactgtaatcctattatcatctcactgcttaatctttcaggtttccaaatacttttaaaatttactttaattgtttttaaatgtaatgagatgttattttaaaaactgttgattatttctacaaatgtgtcatgtccattaaaagtcactcattcataagtatatattatcaagttaatgtactagcgagacatcataaattatgcttcatctttctgctgttaattcacattattctccttctatccagggaaagaaggtactatatatacatgttattaaaatatttagaatctttgaataatttaaacaacattttaaataacagaatatggaagaaaatagaaaaaaagttaattgattcaatattttttttcaacaatttcttttaaatatatagacaaacccatacttggcatttatttggaactgtgtctgtttgcatttaaatttttgtgacctgcttaccaattttaggttttgtattgttttcttcttcctttatttatctttccatgctatattgattcctgagtgtttgagggacttccattttccagctcatttaagtgcatttcatcctgctgtgttggtcatcagcaagacacgaaaatggtactgaaatggccacataatgcaatgtgatttgaaacgaaggggaattgcacttgtctgttgggcaaggaatatttatcctgggttgctcgatgtatttagaaagtcaagagttatcaggtatttatttgtaagagtacagagaatcttgaatgctagtgattccaagacatttagatttcaggaaccagttgaattatttaaacaaacaaacaaaaaataagtaacgggaccataataaaggtgccaaatgatgttattaaatgataaagaattaagatctgctattaatgtaatatggaatttctaaaaggagcagtttaaaatccaaaacttggaaggtttctcagaggaagtgctgatcatttgaattcaatacattcaattttatatttgtcttaaaagctcactatagagccgagattgcgccactgcagtccgcagtccggcctgggcgacagagcgagactccgtctcaaaaaaaaaaaaaaaaaaaaaactcactatactgttttctgctgctaccaaattttgcatctaagagcatctgagacatagcatgattgttaatgatcgtgtcctgcctctaagaaacactacaatcataatacgttttgttttctctaccctaaaataaaatacttgagagtgaaaaccaatgcaaatgtgcaatatattttccccatatttgggaatggaatgtcctcactgatatgtgtgtgttttgtatttcatttacaatgaaggtgacacaaagaatttattctcattacagttgtatgtgtatacactgtagaatcatgttgtgaaagccatcttatataaaatataagtttcccctctctttttgcccacagccttaccccactacccagaggtaaacacctgcaactatagctgatgtttggtatttagttccatgcctcaaaatcacatgctgtactaagaacgcatttttctattttttaaaattgatttattgatttaatatgttgacttctcagtactgtagattaagatatagttctctatcaaattcttacccttcctacacaaatatgcatttcctgccttctcattctcccatgtagtaattttggctcccgtgctatctgccagttgtttgcaattatgaaaactctagcaaaagctgagccacttatagtaaatttccatctctttctctctttgatttgctttttgggacctttcctacactttgtcttcctgtcttcttactgaataatttttctaatacgtatttgtaattattaagagttttcatttttctgcatatctctttttctatagcagcctattcttgtcacatggagtcaagagcatctcttctcattctgaaaacattgaagttagttattttgtctgattttgttttgtggggttatttttctctctacataatctttatttttcccaagttcctattgtctgtttggttgcatgtttgagtctccctcatgttcaaggcttcctttgattttttgatggtccttggttgtctactcattaagtagaggtcactaaaaaaagtgcttggtaattcttagcagaatgttgattgtggatcttctggtttggttttctgctgagttgagaaatttctgctgttggtatctttaggtcttttgttttgcactggtcagattcacagagaatagtcctccaatatccagcctgtctttctgcatttgagagatgagcgggaaaaggtttcacatttggcataaaagtgcgtttcagctgcatgtttatgggtctggtgtcctgcagtgcagagactctctttcaacctctcaagagaataaacatattgtccctgtgatgacaaagaagggaaatcaatagctaccttattcataaacagacatttgacagaccctcttatttcctcccaattcttactctaccttccataggcagctggtgtcatcattcactgagcccttctggaggttctgcattggcaatcaagttgattcttagcttcaaccgctgttggattaggattcagctttttcaggcttctaagtgtgttactacttattcattaactttccagcttctaaaattctgctgccgtggtgtccttccttgttttctttgtcattatgggtttgtgcttaatttaaaatcccttcatttatatttccatgtgattttagaagggaaaaaaactctacttctgtgttgaattcactaccattacctgatagcctgcatgtgactttaggaaattggttcctgacattttatcagacaacagcataaaaactaaactgtcaacaagtcttcatagaggatttatgagcttgagcaataattgcaatactctctataagctaaactgacataactctaaatgaaagtgagcagtgtcatgtttgctattgttgatgtgctgtggacaacgtgaatgacagtcagttttaattagcccacggataattgcagtcatgtacctaagtcccattaatggtcactttttaacacctataacatggaagtagtgaaatgattcatttctttttttttttttgaatatggtagagaaggtcaactatgcttttgaggtaggaattattgataggatacttctagttggcttagcattttcatatctttttagcttaactatccattgtgagactaagcttattactgtcatgtaagattcggttaagtagcactattcatatctacaatctaccatgtggagtgatttgtcatcatttaaggaaaacccgtacatcagatataataagcagctattcttctggttaaccttttaatacatattattgggcagcaaaatcaaaacagaatctgttgtgtcatctctttggtacccaggcattttctacacaattgtaacaagactgctctggaaatagctataaatggatcctgctgagatctgctttttctcaattatcttatcctgtcaaacaagggatttttctcctcttcactttctcctccatttataaggatgtaatttcagcttgcaaattcgattttatcctttattgttagagcaagagatttcccagttttgatccagtctccacacttatggagggcccagtgtgaatgcagtatgcatatagatatcaatcagggatagcaggtcattccagccagaaaaactgatgtttttgcgtatatgtatatatgaatgataatatagggtgatggtgcctcagtctacttgtgctgctataataaaataccatagactgggtggcttatgaaccttgaaattttatttcccacagtcctggatgctaggaagtccaagatcaaggcactggtggattcagtgtctgttgagagcctgctttctggctcataaacagtgccttcttgctgtgttcttataaggtagaaggaatgagggatctctctcagggctttattttttataagggaattaattgcattcatcagagttctagccccgtgacctaatcaccttcccaaggctccacctcctaatgccattagctttgggttaagattttgacgtaataattttgggggaacaaacagtcagaccataacagatggatatggaaagagatctttagggacaccgtagttgggatggttatatctacttagaggggctggacaaggctccttcagggagacagtgttgactttgagattcaaaggatgaatataacttctccaggtggagaaatgtacaatgaccaaaaacaatatctgcaaaactcatgagcagggaaaaatcttaagtggttacaatgaagaaatgccttgaaatagaattaatgaaatttcacctttaggtctaactatgacagtatctaacatttactgaggactactcatgtgctaaacacaatgctaagataattatttcatttaaaacaccaactagattataaatcacattttacaaataaggagcttgaggtacagagaggtttcccaaggtcactaattattggagaaaatgagacttgaacccaagaagtatgatggtaagactcatagtattcagtgatatgctaacaacaactgacacaaatagttctttctgtcagctatagttgtactttggtctccagttatataatttgaagatacttgcagtcatagttcaggctgctatagcaaggtaccataggctaggtagcttaaacaacaaacatctatttctcatggttctgggggctagatgtctgagatcaagatgtcagcatgatctgtttcttggagagggccctcgtcctggttatgttctcatttagactttccttggtgcttgcaaggtggcgagagagagagagagagagagagagagagaaacagagagaatcttttatctgctcctctttttaaaaggagaataactctattatgaaagattcatccttacgtcataattacctgccaaaggccccaactccaaatgccaccacactgaggattagcgttacaacatatgaattctgctggtacacaaacattcactcctcagcaatggggtaccgagagcagcatcacatgtgggactgtggttgatgatggtgataaagatactgaaacttatgctattcttattgctaaatcatgaccacactttacattttaatggaaaacttcagaatagatggcaatgtatattttcataataaaaataaaatctcttctggtaaatttaagtacgtattggtcagttgagtagtttatgagatgtctttccctatagatcatagaattttagtgaggccttagaacagggtttctcatcctcggcactactgacattttgtgcttaatgattctttgttgggaggggttatatactataggatatttatcagcatccctggcctctacccactagatgccagtaccagtcccccagttgagccaaccaaatatttctccagacattgccaaatatcccctgtagggcaaaagtcatcccaaaacccaggttgggaaaccacagatttagagaagtctagtataatcccctcaactttacccaaaaagagaattgacgtgctgtaagcaaggtcatacagctaaactgtggcagaattttgattagatctcaggtctcctgagcccaaaatcatatttcacatataacaaactgtggtgtcttccacttaaagcagtgccttcagaacatatgatttaaaaagtacacatatatcatccataacagctcggcagacaggtagaataaatgcaatttgatcagtggaaatgcatggtgcgaaaagttatgatttgtcccaggttgcctacctagcatggaagacatcctgaacacaagacttcagatgacagctctgatgctctttccaatatcgttgcttaccgcagttggtcaacatgagcttggtttgagaaaggagcaacagaaaagtttttggggaacatttctaaatcattgctttcatttccagcactctgaccctatatcttttgtaggcaaaataataacaatcgcctttttttttttaaattggtagagagaaggaagtcataatattcacatagatattagctatttactaacttgtgcctcggcataatttttcttatacttgaatgattagagaataactgtcctcaaaaacataaaatggaaagttacattactttatgttatggatgcctcatctataaagacgtgactaccagtgattcctaaagacttatagagagttataagtgaagtcatattccaaagcctctgctgtttgggatttttttataggtcactgtcatgtagtgatatgaaataaaaatatttaactatccgcctctttccattcatcactgcactgccgcaagtgagggctttatggagataaacgatctggctttgaacacacacctggcaagtcacaatggtaaaatgtcgaccctttctgagaagtgaagtgtaagcagttctgagcagacccaccagctacgatgctgcacatttggttgtttctcttttaaaaataaactcagtctgaaagtttaaattatgtatagtttgtatagtggcttacatacaactgtaagaatgatcaaaggaaaaaaggacaaggtttgtatatctgcatattaatgttttaattttaaaaacaggtagccctaaattaacataagatgtttccacaatgtttttaactgactgaattctgtgggcaaaatgtatgtgtgtgtctgtgtgtgtgtgtttgtgtttgtgtgcttgtggtgtgtactacctgaaacgaaagttggtccaataaaatgaagttaatatctttaaaaatttggaataaattcagaaatgttctatatatactccagacatttaagtaaagtggtatttaaagtcctccttacagttatcaagtctggaactggtggagcagtatgcatctctgaccattacatctaatgaatcaccaagttctattgacaatacatccaaaatatattccaaatctgctcactgctctccttcacagccgacatgagcgcattagccactgtcagcatctcattaggagtaccgaagttgcttcttaattgttctttcacatctacacttgctcccttctgattaatttggcccaaagcaaccagaatgacctttctaaagcgtaatatggaccatggcaccatgctttttaaaatccttcccatgtctttccattgtacttggaataaaatttcaaattctaaacacgaaacataaggtccagtgtgacttgccctctcctcccctcatctttactttcaccaccttctctcatcccatcttttctaagctccaagaacacccctccatgcatcaaacttttcccaactaaagctttcacacatggtctttactatttctggaatgttctttttttttttttttttgagatgaagtcttgctctgttgcccaggctggagtgcagtggtgcggtctcggctcactgcaacctccacctccagggtttaagcgattctcctgcctcagcctcccgagtagctgggattttcccataccttcatatggcaattttttattcagtatgcagttctaagcttaaatatcaaatcctcaatgagtctttccatgatttccccaaagtatcctggttattcgctgtcttagcattctgtttcttttcactgtaaccacagtcatatatgtaactctggaataactttgtgcatggttttgtgcatggtatatacccagtggctagttcagtgctgaggacaaaaggagggaaggagtgaaggaaggaagaacagaaggatagaaggatagaaggaagggagggagggagggaggaaggaaggaaggaaagacagaaggaaggaagttgccagttcttcttcccaaaggcaaccaggattgcaattgcatgccaaaatttaattgttctaatgatttctgaactggttttgcagtgtttgtttgtttcgctttgttattctaaaccttggctttcgtcaacattagaaggaaggaattaagaaaggaagaatagaagttagaagtgggaagttcctgcatttaggattctaattctaaacttatttcttttatttttattagttctccatacagagagtagccctgtatacaacaatcattcctaacttgataactgaacataggccaatagttttcagtcttccatataaagttaaggcaaatattacgtgtacataacagaacctattaaaatagtcaaatctattatgtagcataagattatgtatctgtttatttgatttgactttttaaaaattaattcatcttttttaacaggtaatgctcttgcatggaacataattcaaaaattatgaaaggatttacaatgaaaagtctatgtgccaaccccagctactcagtttttctccacaaaagcaaccaggatttacaattgcatgccaaattttaattttgttttaatgatttctgaactggtttagtagtttgtttgtttttgtttattttgctttgttattttaatcattggcttttgtcaacattggaatagttgccttaatggtaactactattacataactcatgtgagtggaacacgtgtggttataagaattgtccagcatgctggattctattacacagttatttcatttccaaatatttgtctttcttgtaaaacagtcattatcaaatgactttgcttttacagccaaatgaggagacagttcttggatttaaagaactttgttacaatgattactcaagtacttagcagaaaatttttcaagcttttattccaaagactctcttttagaaaccccagccagaaattccaaattttcccagtgcataagtcacatcatggcaaattaggtcttcactttctcttttctgtaaaaagttactaactccctaatcaagactttgttctgacgttttgattggtctggccttttcaagtagattaaatgttattgattttaaaaatagttttcaacagattctttgtgagtggctacttctagactggcctaaagagaaaggatgacttcactcaaaagttcataaaaggagaatactgacagtcagcctttttgttcataagttgatttttaaaaatagaaatatggtaggacaaattgttgaattatttctttttactggaggctgtgggtatagtgatgaatcttcaagttggaagaatcaagaaacaagcattctgttgtccatacttggtatctctttttgtgatcttgtgttattcagttgacccattggtgcctctgttttctcttctttaaaacaagaggcatgaaccagattatctcttagaaactcccaggtttaaaatcctattgaatgaaaaaaaaagaaagaatgaactaaagccaaaaatttttaataagtttgaggcaaaagactggtttgcttttcccttatttgatatgaaatgcacatcatacaattaatattttgatctcactagagtctaatagaaattacagtatcacatcttgtcaaacacagaatcttggcttcacagtaattcagaggtcaattatttatacaaatggagttcaagttatagatttaattttcagaccaaaagtttctcacattaaaacccacttgcttcagttcattttgcagatacgaaatatgttttcttggtattatgaatctcttgttttaccctctgtttcattatgtaatcaatggatgtgaaaaatgaaggtgtcatgaaatgtcagaatctttaaaaaaatcttcaaaattatttaactgctatttaattgaagaagtttttcataggtattgtattaaattatatttatttatatctcatcagagtaacagtattacagctctgccggaagcttatattgaaagagaaatcacataaattctcatgtagcatatttgtaaagaaagaatatgttgacaactttctttttggtgacacgtcaggagttgtgagggattgaactgcctgcaattattgtttaactacatgaaattaccatttaaaaactgtccactaaaaaaataccaaataaatttgtagactcatagcaggagacattatactttattttttaaaatagctgaacttttggtaagacggaaaattccatgatttgccataaatgtataatttatctatagagaataattgtatttggatatagtaataaactctttatggagtgtgctgaatctacaaactttcaggaactttgattacaaggaccatcagagaaaggagaactgaaattttacgttacaaaattgctctacccaaattttcaatcaattgttagaataagttcaatgttgggtcatttttgtattttatgcttcaaagaaaatgaccattcagtgattcatctgggggcagaatatcagagtggttaagaagatggggtctggagccagaccacttggtttcaaaatgtggcagtgtgttttaagaaaattactttaataccttgatgttcaatgcatccatcttgaaaatgttggtagccttcatatttaacttatgggattgttgagaagataaaataggcgaatatgaataaagatggaagacctacaacagtgtcaacatctcaagaaatgttagttgttgctgttgttgtttttattagtattattcaagaggatgtgaaaattgaagttttgtctgatgtgccaataccgtatatgataattgtcatatattcaagagagtatgagactgaatagctgggaggaagcttcaaagtggataactcaaaagaatcttcatgtctttgaagacttcacccactttgagaatataaacgaatctagaatggagaggcagagggggctggccaaatttgttgagaaagagctgctgcagtgtatcccatatccttcaggtggggtgaggcagaccttttacacctgacctccaaagggtggagaagtcagtgggaccactcagagaggttaatgagcagtgtactgatgcctcatttatacctgtgagagttaaagcatgtatgaacaaggggaagagagagaaagagtgagaataaagggccacaaaatgatatccctgagggctagaggaaggcaagaggagtaaaagaaagcatgagtgtttctcacagagtaaatgtgagccacagggaaaaaaagaccatctggagacattttaagaccttcctggccaggcgcggtggctcatgcctgtaatcccagcactttgggaggccgaggtaggcggatcacctgtggtcaggagttcgagaccagcctggccagcatggcgaaaccccagtgctactaaaaatacaaaacctagctgggcgtggtggtgtacacctgtaatcccagctactctggaggctgaggcaagagaatcacttgaacccggggacggaggttgcagtgagccgagattgcgccactgcactccagcctcggcaacagggcgagactctgtcaaaaaaaaaaaaaaaaaccttcctaggaatagactctccaggtaatgtgggtccttagagatgctagttctaaggagacagtgaccatccaaatgggaggctcacacaatcacaggagttgggtgcaagctggggaccaatgacaaacccacagaagtacccagcagtgaaagatttatttgtagacatttgccgttcaccaaccaaataagaatagttttgccattatgtctctttctttactcctccctgcctctgtgttcctaagtgtggatatgacagggcggggaagctggtggtctaggtgacccattataaggtgtatcaaggacaaagggagatctctgagctttgactgacaattgaaatgttcatttgcgtgatcttagactggacactacagtgctacttataccttaaagtctggctggctatagagcatggaatcatgggaatttctgagttttcttcaagtgacatgggcagtttatccccattgactaaaactaatccttaaaaggaaagaagcccaaagttcccataagtttgaaatgcttatgctgttctgctggtttgttacaacaaaagaaaaagcaatcataaactgcatatacagagcacatgaataaatgggaaggatcctggcctaatacagcattactaaactaaatgctcatatgattcagtgcctaggctaccacatgaattaaaaatgaccttatgtaatgaattaatttccaaaataaatagaacaaagagaaaatcatcttagcatcttcttaccttaaatgagtatcggagaggtcaataataagacatgacattgtttccaaattattaaaatgatttgaaaatatatttcataaattgtaattataagtaataataatgtgcaaactctctactggattttatatatacgcactgtgttcaacattttaactattattttctgtcctgtttttgaaagttagatccaaaaatgcagtattgattcagatagaacataccgaaaaatatttattggttgatgatagcactggttcttgcacatggaatatatattttattttattaattattttcatttgtttatttatttattttttgagacagagtctcactctgtctcccaggccagagtgcggtggcgtgatctccgctcactgcaagctccgcctcccgggttcacaccattctcctgccttagcctcccaagtagctgggactacaggcgcccgccaccacgccctgctaattttttgtattttttagtagagacggggtttcaccttgtttgccaggatggtctcgatctcctgacctcatgatctgcctgccttggcctcccaaagtgctgggattacaggcgtgagccaccgcgcccagaatatatattttaatactaagttttgatttatttttgcttgattttaaatgaggcagaaatatggaattcatatacttgcttgtagataaaacatgttccactttaaaaccatgaaacgaagtttactttctttggggatattttaagtgttgaacctagaactctaaatcttgagggtcataaatatcagtcaaaaatattttcattataaataattatcttcagaaatactcttaatatcagactttttaaaaactaacaatgctagttttatggtgtcaaattttgtatttttaattttttttaagggacagggtcttgctcaggttagagtgcagtggcataatcatagcttactgcgacttcaaactcctaggctcaagcgatcctcccacctcagccttccaagtagctattactacaggcacgcactataatacctggctaatttttattttatttttttttggtggagagggagtcttgctatattgcccaggctggtctcaatttcctgtcctcaaggaatcctcctgcctcggcctcccaatgtgctggaattacagatgtgacccacagtgcctagcctgtctttttaatgtcaattatagatatcttaaaagaagtttcctattacattttaataaaatgcattatttattaattagtgcttgagggatacaatattgatattgtctgttggaaggccgactaacatgttaaaagatagtaatagaaaacctatggcagggtgcggtggctcacgcctgtaatcccagcactttgggaggctgagtcaggcagatctcttgaggtcaggagtttgagaccagcctagccaacgtgacaaaaccctgtctttactaaaaatacaagaattagctgggcatggtggcgcgtgactgtaatcccagatactcaggagactgaggcaggagaattgcttgaacccgggagacagaggttgcagtgagccgagatggcgccactgcactccagcctgggtgacagagtgagactccatctcaaaaggaaaagaaaaaaaagaaatagaaaacctattttagaactacagaaatttcacccaggttgaactaaatctagcttacttttccttaatgtactataagagaaattttgttcaaaaaataataggttctcttttattatatattacattgtcttatcttctttgatccaacttttcatataacttaattgcagttaaaccttattgcggttccatgaccatagaattctacctttcaatttttttaatttttttatttttataaatttaggggatagaagtacagttttattacatggatatattgcatagtggtaaagtctgggcttctggtatagccttcagccaaatagtgagcattgtaccctatatagcctccacatattaaattcatcgttcaatattaataaatttactatgaacttgttaatcacttttagaagaaccaatatttaaaaacccaactgtaaagaatgatagaactgtaaagtaataataatgagcaactgtgctttatacactatttcgtgtctattacttctttttttgtttgtttgttttgagacagagtcttgctgtgtcgcccaggctggagtacagtggcacaatcttggctcactgaaacctctgcctcctgggtttgagtgattctcgttcctcagcctcccaagtagccgggattacaggcgcccaccaccacacccaactaatttttgtatttttagtagagatggggcttcaccatgttggccaggctggccttaaactcctgagcgcaagtgttcagcctgccttggcctcccaaagtgttgggattacaggcatgagccaccatgcctattgtctattacttcatttgaccaactttggccctcctcctagccccatatggcaggcattttcataatcccattttacaaatgagcagactaacattcacagtcattacgatactttcccaaagccatgtagctagtggacggtggagcatacactgagactctgttctgcggaaacctgtccataacatcccttccttgctagcaatatatttatagtgagaaaacatggacttgagcttcagatttagtacttgatacctatgtggaattagagccacgtttttaacattaggtcctccccttgtaatatggagatgaaataagaatttctttgggttcttgttaacgaataaacaagttaatgtattttttaaagcactttgtattagtccattttcatgctgctgacaaagacgtaccctaaactggacaatttacaaaagcaaaagatttaaaggacttaaagttccacatggctggtgaggcctcacaatcatggcagaaggcaaggaggagcaagtcacatcttacgtggatggcagcaggcaaggagagagctggtgcagagaaactcccgtttttaaaaccatcggatcttgtgagacccattcagtatcacgagaacagcatgggaaagacccgcccacatgattcagtcatctcccaccgggtccctcccacaacatgtgggaattatgggagctacaagatgagatttggctggggacattgaaccaaatcatatcattctgcccctggcccctcctaaatctcatatattcacattttaaaagcaatcatgccttcctaacagtcccccaaagtcttaactcattccaactttaactcagaagtccacagtccaatgtctcatctgagacaaggcaagtctcttccacctatgagcctgtaaaatcaaaagcaagttagttacttcctggatacagtgggggtacaggcattgggtaaattcagccattccaaatgggggaaattgaccaaaacaaaggggctacaggcctcatgcaagtctgaaatacagcacggcagtcaaatcttaaagccccaaaatgatctcctttgactccatatctcacatccaggtcatgctgatgcaaaagatgggccaaatacttagagccaactgattgtttgacaaacccaacaaaaatatcaagtggggaaaggacaccctatttaacaaatggtgctgggataattggaagccacatgtagaagaatgaaactggatcctcatctctcactttatacaaaaatcaactcaagatggatcaaagacttaagacctgaaaccataaagattctagaagataacaccagaaaaacccttctagacattggcttaggaaaagacttcatgaccatgaacccaaaagcaaatgtaaaaaaaacaaagataaacagatggacttacataaatgaaaaagcttctgcacagcaaaagaaaaaatcagcagagttaacagacaacccgcagagtgggagaaaatcttcacaatctatatatgcaacaaaggactgatatccagaatctgcaaagaactcaaacaaatcagcgagaaaaaaataatcccatcaaaaagtgggctaaggacatgagtagacaattctcaaaggaagatacacaaatggccaacaagcatatggaaaaatgctcaacatcactagttctcagggaaatgcaaattaaaaccacaatgcagtaccatctcactcctgcaggaatgttcataaacaaaaaaataaaaaaaaaatagttgttggcattgatatggtgaaagggaacacttttatgctattggtgggaatgtaaactagtacaaccgctatggaaaacagtgtagagatttcttaaagaaccaaaagtagatcttttgatccagcattctcactactaggtatgtacccagaggaaaataagtaattatatgaaaaaaagatacctgcacatgcatgtttatagcagcacaatttgcagttgcaaaaatatggaaccagcccaaatgcccatcaatcaacaagtggataaagaaaatgtggtatatgtatgctatagaatactactcagctctaaaaaggaatgaaacagtggcatttgtagcaacctggatggaattggaaactattattctaagtgaagtaactcaggaatggaaaaccatacatcctatgttctcattcgtatgtgggaactaagctatgaggacgcaaaggcataagaatgatacattggactttggggactcggagaaagggtgggggttggtgaggaataaaatactacacactgggtacaggatacattgcttcagtgatgggtccaccaaagtgatgggtgactcagaagtcacctctataggatttatgtaaccaaacactacctgttccccagaaacctattgaaataataaaataaaataaaataaaataaaataaatatataacaggaaaaaaaattgctttttttcccagttacaaatatactcacatatattttaaattttctaaattcttcttttcactctgagcttttctatgtaagatttatttttgtgtctagtgtagaaatatactttttattgattttaagtgacaaataataattgtgtatatttttgaactataatgggatgttttgatctatgtatacattgtacaaagagtcactcaagctaataaacatatccatcttttcatcaatttaccatactattgtggcaagaacattaaaaatctattccgtctgccagtttccagtttgaaatacacactacattattaactgtggtcaccgtagagtgcaataaataactaaaacttttcctccaatttaacagaaattttattacctcctgcccccctctgcagcctctggcaaccacctttctactctgtttctataaaatcaactgttttagattctgtgtgtgaggtcgtatagtatttgtctttctgtgaatggcttacttcacttagcataatgtcttccagttcaatctatatagttgcaaatggtagattttttaaaggccgtataatattccattgtgtatatataccacattatctttatccattcatctgttgatggacacttagtttggttccatatgttggctactgtgagtaatgctgaaataaacatgggagtgcagatagctcttcaacatgccaatttcaattccttgggaaatatacccagaagtgggattgttagattatatggtaattatatttttagttttttgataaacctctatactatttccaaaattactgcactagtttacattcctgccaacggtgtacaagggttgtcttttatccacacacttgccaacacttgttatcattcctcttttgataatactcattctaacaggtgtgaggtgttattccattgtggtttcaatttgcattttactagtgattagagatgttgagcatttatttcatgtatctgttggccatttgtatctcttcttttgataaatatttgttcagatcctttgtccatattttaattgggttatttgttttcctgctgttgagttgtttgagttccttatatatttgggatattagcctgttattagatgtatggtttgatgcaatcctatctgtcttgtttttgctttcgttacctgtgcttttgtagtcctatccaagaaatcattgcccagactgatgttgtggtgtttttcccctatgttttctgcaagtagctttagagtttcaggtcttacatttaagccttttgttcattttgagttgagttatgtatatggtgtgacatatacggtgttcagtttcattcttctacatgtggatatccagtttttccaacactattttttttggagaaatcgccatttccccattgtgttttcttagcacctttttgaaaatcaattgttcataaatatatgggtttgtttctgggctttctatcctgttccattggtcgatgtgtctctttttttgttttgttttgttttgttttgtcgggaccatactgttttgattacaatagctctgtaagatattttgaaatcagggagtgtgatgcctccagtgttggtctttttgctcatgtttgcttttgctttttggagtctttgctggttccatatgaattttaggattgctttttctatttctgtgaaaaataacattggaatttcgataagtacaccaaggaatctgtagatcactttgggtagtatggacattttaacaatattaaatcttccaatctatgaacatgtgatatctttccatttatttgtgtattcttcaatttctttcattcatgttttacagttttcagtgtacagatctttcacctctttggtgaatttacttctaagtattttactgtttttattgctattaaatgaaattattaatttctttttcagatagctcattgttactgcatagcaatgcaacagatttttgtatgttgactttataacccacaactttactgaatttaagtatctcgattctaatagattttggtggaatatttctttaaggttttccatatataagatcatgtcatcagcaaacagactatttcacttcttctgttctcatattgatgccttttatttatctctcttggctaattgccccaggtaggattttcagcatcatgttacatacaagtagcaagagttggcatccttgtcttgttcttgatctttgagaataagctttcaattttttatcattaggataatgttagccgtgggtgtgtcatatatggcctttattgtgttgagattcatttcttctatatctactttgttgagtttttttttttaaccatgaaaggatgttgaattttctcaaatgttttttctacatctattgagatgattatatgatttttttgttgttcgttttgttaatatgatatatcacatttattgatttacatgatttttaatttacatatgttgaaccatcctttcatccctgggaaaattcccacttgatcatggtgaagtagtaatacgtctttgtattttatatatatacacacatacatatatgtgtgtgtgtatatatatatatataatatatatataatgttttgttctagaaacttttattgaatagtttatcttttcttcccttatttttgtgacatttttaacacttaagtttccatgtgtggatctgatcttagattactaaatttattttattggtctatttgttcctgtatgtataccttactatatttactaacaaacagttttataaaagaaatttatggaaatcttgttatctgctagataacctcttgtttgttatcttaaatttatgttctattcttgactttgctattaagtgtgaatcttcggatctgtttatcaaaatctgtgaaaattcctactgaaatttattttttaaaaattgattccaatttatagataagtttagagaatcatcacctttatctttataattctgagtctttttatccatgagcatggtgtgtgtgtgtgtgtgtgtgtgtatacacacacacacacacacacagatatatattttcccattatttaggcctctttacatcttttaatattttttaggtttaaacttctcattcagttaatcaggtcctttttttttcttttctttttttttttgagatggagtttcattcttgttgcccaggctggagtgcaatggcgtgatctcagctcaccataacttctgcctcccgggttcaagtgattctcctgtcccagcctcctgagtagctgggattaccgccatgcgccaccagtcccggctaattttgtatttttagtagagacagggtttctctatgttggtcaggctggtcttgaactcccgacctcaagtgatctgcctgcctgggccttccaaagtgctgggattacaggtgtgagccaccgcgcctagccaggtcctcatttcttcatgtgtgaattgaaaataattattttttctctgtatatttacagatataaatttgaagataaaattaaatgatgcttatgaaccaattacataaataataaggttttgtgtttattattttttaaacagaggtatgggtgtattttatgcttaatagtacatcatgattatctagattctatttaattattctctttccccccagtgtaaaagttaggatcttataattatttaaggtaattgttattcttcaacattaagaaaatcattgttgtgtttaatgatgtctggaatgctcagtaaaccatgattttttattaatcttatgcagtctttgattaatgagaaatataaacgatcatttagtcaattatttattatatcacctactaggttgctaagcactgaatcagttttaagatagttgtcttcattcagggaacaaaataaaagatggtaagaagttttgagggcccagtactgatcaatgttcttttaagtttagcagtctacagactttactaaatgtggaagttttaaacattattttattattgctgtttttttggagaaaaaaatgattccaaattttcttcttttttttttttgtggttgtaagtgacgtgaaactataggatttatttttccattggcttcttttaattaaacattttaataacatgtattatccaaaacttgctataccaactatgtaatcacctcttccttctatttttatgaatatactatctgacgactaaggtgatatcagaaaattttcactcaaatgaataaaaaaaagaatgacaatgaattgaatgtatatgcttcagtagataatttataaagaaaatttaatactctaggaatgatgctatacaagctggcgtgtcaaataataaataattttaaaataggacaaggaccttcatacactgaggaatgatataaaaatacaaaaatattttaattgtttaaaataagaacttaaatctaaaggagatacttatgatgtctaaatatgaaattctatactcaggttgaaaaattatattctataaaggcagactgaagtatattaatattgttagcagttagttgatggtgaccgtatgtaagttactgtgttgagttaaatattttatgactatgtagcccatatgaatggaagacatttgagtaaaaagagtatatttcttgtggagtctacattggtgcattgtggtaaaatataagaactactttttaagaggggcattgattaatcaaactgcattctgacataagtaactgggttgataaaaacaatctgaaaactctcacatgaaaatggattgaagggctagaagatattacactgaaaagataaatctggtgcaatggacaaatcagtttgaatacttgagtagttgttatatatgggaccaaattaagttttatttactccagaagaaccactaaactgttaaagggcaggtttcatttcaaacaaatttttttagccaattaaattatctaaatttggtaaagtctcatttgtaattagtagaggagcttcctaatttgagtagaagactgaactaggtaactgtcagccattatttaacaaatatttatgaagtacatacaatatacaaggtgttaaaaaattataaagaaagatcactgatccttaatggtatgtgattatagattttaatctataaaggaaatgtttcttgtagctatttgatacatataaagtttagagtaacttcgtaataattaatacattgcatatatcaaatagtgatcagtgtatactaattatacagttctccaccaagtagggtaggtacagacatgagaagacaagacttgattaaattttaaaaatggattcagtaattggattaatttgtttagagcaaaggattttcttaggtggaaaatgagaaaaatgatctaatgaagttgtgcttcaagagaaacaaagtgaaagagagctggagtcccagtgtgacccctagaccagaagcatcacctgggaatttgttaaaaatgcaaattcctgggtcccactccagacctactgaatcaaaaactcagtgttggcggggtggagtagcaaggtgtggtttaacaagcccttcaggtgactgtgattcatactaaatttgaacagcagtgtagactgctgttgttgtgaagaggagtttacatatgatttgtttagatataatttggaaggcaattcatggtcactgcacatcagtggaaataaaggatgcagatgctatggcttcaagtagtaatatattgactaacttatgtaatgcataactctagagaacattttaaatagcacagtgttgaaacatttgaaacaaatttattgatatagttttttttaagttaagttttacatctaacatttaaaatgatagaactaggtatagctggaaacaatgcctgtttattttcttacacagagaatgaattctttcttcccttaaaacagtgttgggtaatgttccagaaaagtaattacaggccagttagtaaatatacgctgagatagtagaatgccagatagcaacagctatatgtctgccactactggttaatcagctacagaacagactgattttttgacttaatatggcatagggactccattaaggacagaatctgcatcttaattactgaacatatcccccccactgttttcatctgtatttacgtatgttttctttttttgttgtctaatagaagacaatcagggttgtgcacgatttacaaattgcttcttcacctcctgtcttcctcttctattcaataggcttgtcaagctataagagattatgaaatttggggtagttagaaatcacagccaattcaatctcatttccacacaaaccaaagagtaataaattactttattgtagcagcttattgctttgaacctaaattacagaaaaatagcttggaaattccgtaacaaagatgaaatagtctatttgtgtaggcatacttcttacagtttgtgttaactctcagctctagcacattttatatgatatttggatatattggtttggaaggagacagtcatgatctgatggtctttctgattttgtttctctctaaccttaattgctgaacctattaaaaaccccattttaggtttagctgccttagattctaggattattcatgtgctaggtcaggaaaatacagaagctctatgtctggaaatggaagagttgccattgactcaaccttgctgcttatcctcttcttaccttgtatttctgttctgataattcaattcttgccttgtcactgatgatcaggactttccctcatactcaacaattgctctagagctctgctttgattctcagccttctcctctgttcatttcaaaaacagggaattattttcataatcttcaatctttctgtctccccagacacactgaccacatgtctatccaaacaggtatcagatcatcctctttccaggtaatctgatttgattttcctcatatacctcggggcatcctgctttgggatgtgaaggatttgtgtaaacatcttttgttgactgtttgttagaaaatttcttcattgccagctattggtaccctgctcagatgttcttaaccttcaagcacgcctatttttccagctgctaggagttttgggttataactcacagctaccaccatcacaacccctttctctggagtattatcttaggccagtggtcctaaaacattagctttcatctgaatcacctagggggcttattaaaacaaaagactggactcagagtttctgatttagtaagtctagggtggggcaagagaagttgtattcctaacaacttccaaagtgatgctaatgctgttgctctagataacacatttcaagggccattcctctaatctaaataggagcttattattccctgaaggctctttgtcctgtctctcctcagggtagaccacagtgagtgactgattgccacaagcttatacaagttggacctcttacctcaaagtgtaactatctacattgtttcatttgtgtttgaaagctgcctagtgggatcagaattaaagggtcaccatcagtaatgatattctggctaagcattcttttctaccctatcctgcttcttccactctccttctcctgaaagtactctcccaataaattacttaaataaaatctccatctcagaccatacttctaggagacgtgatatgagacttatacctgtggatctatggtttctggtctctttaattcaatctatctattcaataaacttgcattgaatgtctttgaatgtcccagaaagcatatggtatatggaagataattaagatccagtttctttaccaagcaacccaccatttggttcaagggtagataagcaaatgtacaattatagcagcatgattgatactatgctacctcagtgctgataatttgaggtcctgactgctttcatctgagctttggagagtgtcacatgcttgattctctgggacagagtctctgagatggagatttgtggatagaaggtttatggggaatattcttagagataccagtgaggaagtgagggaaacataattgtgcaaatggagaggctgggtgagagctcaggtgaaactgggaggggctctggagatggaatgtcccttcaaatttgtccagaattaaggaaagagatcgatcactagatgcaggctgcccagtaagaggagcataacattggaagaaataactctctttggctgagagatgcttgaagaggatacatacaatacacacaataaaagttggtccctggagagccttgcttgtgatcatctcagtaatatatactggcttcccaccagaaaaccatttatcctattcctcccaacaggaattttaattgagtttgctcttaagcactaaatttctcagatatcccaaatgctaaatgcaagccaaacctgagatttcctgaaaatatatcctgtagacagatgtgagagtgtttcaaaccttattgaaattactctgaggagcaatgcagcaggtaacaaatctgacacacagcaatctttagaataaacatatgcaggcccagagttcagaggctaaagtcaatttaatgagaaagctgtcactattcttttttacatgaattaaacgtattccaagttgcccaagtcacggcctaacagtaaagagtctggctgcagagctgagcatttgttttatgttgttctcagggtcacttaaaaatgaatgtgagttacctggattgaacagaattctatttagtgtattctaatatgtggtgataaaacttgggaacctcagtaaagggaactgatttgaatgtaaaattgtttattttgaagtacatgtatgccaaacactgaaattttctattgatattgaatatctatcaatattcaatattttccattaattctgttgattctatttgctattgaatattgatataacaccatttagtttgtaaagagaaatataaaatcttaatgaataaagggaaaactattgataagtcttcatagagttaattatacactcttaagacattagactcaagtaacttcatacctactgagaataaatgctggaaaaatttacaagttttattttccatatttagtgccagagagccagattacacacacacacacacacacacacacacacacacgaacaagaataaataggttcacatgtttccttgcagtaaagtctgtcctgatgggatggactctgacaatattatgaatgagtatgaaataatagcaaacttggcctctagaaacaatcttccctctgaaatgcgtgttttaaattacctcatggcaaggccagtgacattcaaggattgggaatgaggttagaaaaatggaaatgattctccacttctgggaaggtcttttgcctgattaacgttatgtaaacattttgctgaagaaagaataattctgcactttagccaccaaatcattatagaaaaacaatccagttttatgcctcctgtgctccagtccaagggtcagcaaactatggcccttgagccaaatcctgcttaccacttatttttgtaaatacgtttctattggaacacagctctgctaatttgtttacatattgtctatggctatttttgagctgccatggcatggttgagaagtgcaaccaaaaccatatggcccacaaaacctaaaatatttactatctagccatttacagaaaaattttgctgatccttgctctattgtgttttagttctgtgtatcccaggtttactgataagaattacctggagtgcctttcaaccaacagcttcttgatctcctcctttggagattctgattcggtgaatctgaatgagacccagaaatttctacctttagcaagtactggaactttgggaaataccaagctagttatttgactctccaatattctagcataccattttttatgttcaaaaagtccacattcttttcttcaaattcttcctcatctccccacataaatgcaaggtatggacgaatgtattgtacaggattgtcacggataaggtcggctagaagcagtttgtgataatgattagggtgtatgttgtttgttgagggagtactctcaggagtaaggaagttatagaagcagtataggaaagggcgataaagctacagaatgtgctctcattacacatacaccatggaatactatgcagctataaaaaaggatgggttcatgtccttcgcagggacatggatgaagctggaaaccatcattctcagcaaactatcacaagatcagaaacccaaacaccacatgttctcactcataagtgggagttaaacagtgagaacacatggtcacagggaggggaacatcacacaccggggcctgtttggggggtgggggactaggggagggataacattaggagaaatacctaatgtaggtgacgggttgatgggtgcagctaaccaccagggtacatgtatacctatgtaacaaaactgcatgttccgcacatgtaacccagaagctaaagtattaaaaaaaaaaaaaaaaaaagaatgtgctctcagctggagacatgcttcagtctgatcccatggggacctctgcagcataaattgaaccacagagttgatcctgccttcaggcaagagggctggccttttgagcactctcttcccattgccatcagttagttatttggatgcagggagtccttgaacaggggacagacattagcagcaatcattgaggcacaagtacacctgtggtaaaggcagaggaggggagaagtatagcatctggtgcagaagttatacccccaaatgaatgaaatttagacttggaatgtgccctgaagaaagacctatctacaagagtctttaaaagataattttgaaatatgttttcaagttagtaacccttcggaagtcacaaatatatttgctagaactgatacctatcatctttgaaaagtaagaggaaaatatgtatcagagagaagtgacttttccggttaataatcattgcttgttgatacgtgcttttgactaggtatttagtaagatcttttggttatgtttacctccattaggatgatatgagttccttatgaatttaaatgcatgtgaacatttcagagtcccacctggaatgcgactactgtcagacaatgtattctctctagcccctaacatttcatgatagattcactacagttgtagaagaatccttcaataaaagttatgttatgggaatgtaaaacaaagtttaaccttccataattatgatttactttccaaggaataatcatacctaccactacttgcttatcctcccaacctgcaaggtaggcatcaattacccaatccttacccaaagtcacatgtctagccaatggtggtgtcgaatattctgatgaaagagttctattggccccgctaaagagttgtggggttttttaaatctttaactcaagttgtttcagtgaacctagaactaagactttttcaaccactcccaaattattgatgcttgggttttgcaacaaatgccctctaagctctcaggataagttgggggaggaaaatgaaaacataatagggtaagggttgttctctaactattcccagaccagttctcaccttcaaactgctctctctctctgaaagatgagcaaaaaaaaaaaaaaaaaaaaaaaaatgtgacctcacaaaaggttgtgtgacctcaaaacctgccaagagtcctcagtgcagcccactctgaagacagtggaacaactcaggaaagaaggtagagtattttatagaccctagagtcttatctcatcccattctgctttctgtcttcttgaggcacagttggcttaaccttttcttgaagtgaaaactatgtgaataagaatattaacccccaaacaacttaaaagcacagtcaaccgcttcatcactggtcattagagaaatgcaaatcaaaaccatgagataccatctcacgccagttagaatggcaatcattaaaaagtcaggaaacaacagatgctggagaggatgtggagaaataggaatgcttttacactgttggtgggagtgtaaattagttcaaccattgtggaagacagtgtggcgattcctcaaggatctagaaccagaaataccatttgacccagcaatcccattactgggtatatacccaaaggattataaattattctactataaagacacatgcacatgtatgtttactgcagcactattcacaatagcaaagacttggaaccaacccaaatgtccatcaatgatagactggattaagaaaatgtggcacatatacaccatgaaatactatgcagccataaaaaaggatgagttcatgtcctttgcaggaacatggatgaagctggaaaccatcattctcagcaaactaacacaggaacagaaacccaaacaccgcatgttctcactcataagtgggagttgaacaatgagaacacatggacacagggaggggaacatcacacactggggcctgttatggggtgggggtctaggggaggcatagcactaggagaaatacctaatgtagataacgggttgatgggtgcagcaaactaccatggcacatgtatacctatgtaacaaacctgcacgttctgcacatgtatcctagagcttaaagaagtataataaaaaataaattaaaaaaacaaacaaacagaaaaacagctgacaaaacagaattgcccagcgtaactgtatttttaagttagcagcaaaaatagaattttgattttatgtcatgtatattgggaaaaaggagcaaatgatatgatgtcagttaaaagaaaactagcatagttcaagattttcccatgattctcctatgaacttgaaattccaaaccaaacccagctgagtccaaagccagtagtgctcttatcaactttccatggcaatgtcttacaattctctttaggctagggccaggggaagaatccatggaattgaccacttggcaggacattaccaaggtaggggtggctatagagatttcagccgaaccaccctaggggatgaagcaagaacacaatgaccggggcagctccaggctcacctcctccatgaagcttttccttctctctctaggtagattaggtgactgccttcttggggaaacattaacatgggttagataatatgagctattcctatatggcaacaagctaggtgaggaaaatgaagatacgatgcatctatcccatctctccagcacccaggacagagccactatatcctggcatgctgtagcacagagtagagagccctgcagcatttaggcacattgaacatacttgttgatgatattctgagccctctttcctttaaatcattgttgagtattttctgggtcaactcacaatataaaacccctgtcataaacattcaaaaaacttgataagctaccagaaatgttcaattaaggaacaaaaagaaactgaagagcaacaatggacacctcccctcctgaactccaccagagaacttcagtccatttaaaagatgaagccagttttaatctataatttatgtcaaatttcactcttaagtcacaaggttaatatttttagtagaaaatgttgattataacagaaactcaggtatctcatatgcacatactcacggtatgattaaagataatcaggtacaattttactatgagattggacaatgtttgaagaatatcaatactgttttagtgaaaagcagatcaaagtatgaaattaaaaatatctttagaatagtaatacttaaaagaattcagtaattggaatgcttatccatgttttttaatcactctgttttaaatctgactttcagttgtttcaaaatgacaggttatgttgattaggtaaattatattagcatttatttgtatttaatttctacatttcctgttaccatctttttgcccacttttctattggtatgcaccttcttttttattgtatttatttaaggtatgcaacatggtgttttgatatacatgtacatagtgaaatgatcactatagtcaaccaaattaacatttaccttcccacatagttaccttttttgtggtaaaaagggcatgctcattcttatctttttgattcatataaatgtcttatatgtcacttatattagcactgcaatacaaatggttgttttaaattgatcttctgccttaaaactttacttgaaaaattaattaaaatacttttttcagataaattctgtctttgaatgtctgtttcagaaaggtcatatttatccaagaggagacaaatagccacctacattttctcccagtgctcttaaaattaactgcaatatatctgaatcttttgtggcaagattatctttttccttctgtttttctcaaatgagtaacacatttttaacccaattttgagtgataaatcttttttgcattgttttgagatgctatttatagtatgtaacaaattcttacgtatgcttgatatgcttctagactttctcctattttgacatctctgttcttttttcaacaccacatcaggaccattcttttcgtgattattacctcgatttacattgtgatatctgctgcttcaggcctattcaaactttcttgacgatccttgcacatttaattcctctagactattttggcatgagtctaataatgtcattgggatctttattgagattacattaaaatattttgattaatttaggaacagctggcagttttacaatattaattttccattcagaacatatgctttctctatttttcgaggcttttaaaacatttctcactgtaaattgttatagttttcttaatgcagatcttgcacatttcttataaagtttattcttatgcattttataattttgttactgttgtaagtaagttttttggatcatatttctaatttttattcctgggcatataagaaagctatagctttatgtatacagtgtctattttcagactttttatcagaccggatagaatgaggatcttaccaatttcagtgtgggtataaatagaatattagcacacttgtacattccctatgattttttaaaacagtatttcctttgataatgagttattcctgagaactttacatataactctgcatgtttgttttgttttgttttgttttttgagaaagggtcttgctctatggcccaggctggtgtgcagtggtgcgatctcggctcactgcaacctgtgcctcccgggctcaagtgattctcgtgcctcagcctcccaagtagctgggattacaggcactcgccaccacgcctggcttatttttgtatttttagtagagacggggtttcgccatgttggccaggctggtctcgaactcctggcctcaggtgatctggccaccttggcctcccaaagtgcagggattacaggtgtgagccactgtgcccggcgtctgcatgtctttttgtgaatgatttactttacttcccatctgtggctgatgggacaaaagaaaaattaagagcaatgtgattaatgctaagattgaccaacagtttttagaaaattaaactgcttccacatgagataattcatgttttctagatactttatcttccaacaagtggtaagtaatgaagtagataaacttcgttgtcactatgtttatatttcaagttttctgaatgaggcaggcggtgtaatgtgtatatattattattattgtttttatttttgagacacagtctcgctgtgttgcccaggctggagtacagtggtgtgatctgagctcactgcaacctccagctcctgggttcaaatgattcccctgcctcagtctcccaagtagctgggattacagatgtgcaccaccatgcccagctaagttttgtatttttagtagagatggggtttcaccatgttggccaggctggtctcgaactcctaacctcaggtgatctgcctgcctggggctcccaacgtgctgggattacaggcgtgagccaccatgcctggccaatatgtatatactattaattaatatgaagatattgttatgcttggatgacacccttcctgttgctgaggcaggagttacaaataaaacatagctcttcggtctgctcccagatcctcctcactgtactcttgctcacattttgtccctgacagatgcctaagggccactgaccactccctcaggaaatctctgtagctatacaagcagcaggcatagaaagaaatgaattgtaagctattcttctagcactctaattagacttttcagtctaattgcaggagatgaaattgaggcagatcaaattctcaggatgactagatttgagaatcattacaaagtaatacattgacaattacaaagctagcatgctcctgagagtagaactgaaccttcctcagcctcagagtatcagatgtgaataagaatatctcatcaacttgtttcacatgcttgtccacttgttttaaaggagaaaatgcaaataaatatgctgcaaggcagtctaggtaataattatttacactctagagacagacctggcttcaaatcttgacatgtaccacttattaacagcacgttgaaaaacacatttctttaatacctagagcctccacttctagccagaaaagttaagataattatagaacctactgaatatggttgttttgatgataaatgaaattatgtatgtatgaggtctatcctgacgccttatatatagtaagcatgacataatattatgtactgctactattgtatttgctaaatctccaattgttttaaagtataaaagagtattattattttattaaggacacagagtggtattctgagaggagtgggaatcctcaagagcttttttcctggaaattaattttgaaaagaagcttgatgaaaatcttgcatttagagtgaggaagacagtcaactctgaattacataattatatatatgtactggagacacagttcgttcctatgatataagaagggctgaaaaaaaaagttactcctttatttaatcttaaactgatctggtcttcttcatgagtcctcatccataaggaaattatatatatattccttatccaacagaggaaaaataaattctcattctggcttaatctgatcatttagggcacaatctctcataaaaaagacagcttagtctctctttcaccctccttctactgttacttgttgcaaataagatgatgttcctccattatatgaggtaaaggggatgcttcctaagccctcatggttgcaaggaaaaataagtgcccttgggtatcatgtcccttgttttctgagataatatcccttgttctctagtcactgataagcttgtcagctggtagaacacacgatcggcctcctaactagatcagtgcccaatatcattctctggttcagttagattcttcttaaattggaatgtctccagactcccaagtctctgctgtttcccattcagccctctggcccatggtccatctctggcatcctccactggggcaactagttttgccactgcaggtccaccacaaaccccttagcagtatctagctagaactcaacattcctaaagatgtgtgtgtgtatgagtgtgtatatccatctatatccatatctgtgtctatatactagactgtcaaaaaatttatatggtaacttttgttctacgacagctagggtacattgtgaaagtttcaaagcagagattatgtctcatttatttttagctttccagcacctcacctgatctctgatataagcaatcaatctgtattctcttcatgatgagaaatattctccattctcactgatagcagatttgtgaccactaaacacacacgcagtactggtgtgaacgcacaaactattgaaacaacaagcacgcaacaagcaaggaaattgtcactgctctataatttggtgatgagatatctggttactttcagacaaaagaaaatgtctcataataatagggttttgtatgattcttctctttcttccagaaataaaaaatttagaaacaaaacattgagggacattttaggttaattatgcattttagaagagttccccagatatcatttttgtctaatttatttttcaaattggcatataaaattatatgtatttatcttgtacaacataatgatttaaagcatatatacattttagaatggttaaatccagctaattaacaaatgcattatacctcacatagttatcattttgtggtgataacccttaacaccctggataacttttgattcagtttctgaacttgccatgtaaaattagtatttgtactcaatcagtttcttcagtttggagtatccttatagtgatcctgggcccaaactaaaagtgcatagggaaagtagcatagtctctttccatttgcctctagtcatttttatgtactgatgaacatgtaaatgctgctgtacaaagtacaagacagggatgaagaccctgttctcaaatatttccaggatagggagaggctttaattatattttttaaagattttctaaacagaagaaagaaaaatccccattgagaggggaggcagtggctcatgcctgtactcccagcactttgggagactgaggcaggaggatatcttgagtccaggagtttaggagttcaagaccaccttgggcaacagagtgagatctgatctctatagaaaataaaaataaaaaaagagaagggagtgcatggggaaaaagaaaacaataacaacaacaagaaattcagaagtggtttgatgtgttgaggttaaactgaaacaatgccttcattgcaatgagtgcctttgacgtctgtcaaaggtggtacagtcagtgacaatgactgcattctttctggctttgggttcacagtgctttgcagtgctgtgctattcagaactaaataactgttgtcactgctctataatttggcgatgatatctggttactttcagacaaaagaaaatgtctcataacaatggggttttgtatgattctgctctttcttccagaaatacaaaaaaaagacacatttaagaatttatctctgttcacattgaggaagaaaataagctttaaaaagttttactcctccctccctatagcaatgcttgcctgactttccatcgggggaaatgttactttcagcatattctgtgtgtgaaatagacagtgccagatgcttcaaatggtcataattgtgaaggatatgaaaaaagaggcatcttcctactgcgctttattaaatgtggagggaaaaaaaccctttgggtaaattagcacttggaggatttagcaaaagtgaattaactatgacagggtcccctaacacatctatttgatgatcttgcaagtcttattcccggttacctgggatactactttgctttgggatgccatggggtcattaaaatgtgagacaggttctctggaagagaaaaatcagatgaatcttgacttacagacagtatgtcttcctaaatagtatttcttttgactgaccatacctttcccttgatgctatatttctccctcatgcgctcatctgaacaaagaactgactgcgaatttcagctgccaaaaccaaaggacagttggaaaggctttttacaagcaattggcaagtgtgctctcaaaaactgaatatataggtgctgtttttctcttataaattagtattgaaatctagcctctattatgccatgggaatataaaaaggagaaatgaaggcagaagtatgtggtgactacattaaaaaaatgagtccactattcttattcttcttcttgttatttatttatttatttactttgagatggagtctcgctctgttgcccaggctggagtgcagtggcgcgatctcggctcactgcaagctccgcctcccgggttcacgccattctcctacctcagcctcccgagtagctgggactacaggcgcctgccaccacgcccagctaatttttgtatttttagtagagatggggtttcaccgtgttaaccaggatggtcttgatctcctgacctcatgatccacctgccttggccacccaaagtgctgggattacagacgtgagccaccgcacccagccgagtccactattctttcttttctttacacataattccaaaatcaaaaatagctccgagataccagatgtctttgtggtaactcattcaacccaacttgaatgtatttggtgcctgaaacttatctaacctaccgtgagattatctttatctctctcaatgtgactgttcatatgcttcactgcaaaaatattagtgtgtttgatgacaggggtgttgtagaccccactgggggtgctatagaatctgtgtagtgttacttctataaatctgacaaattctggattttagaacagaaaatattttgttacaagtgaggcactgtgctgctttacagactttatctcactgaagcctcacaacctcccccagacgtggacattgctctgatctctagtttatagatgaaaaatttaaggattcaaaggtgaaataagttgctcagagtcactcttctattatagttacgcactattgcataataaacatcccggaaatatagtgacttgaaacaacatgttattgttaacacacacttctgtggattgactcagctcagctgagtggttctgatatgtggctgctgtcagataggagctggggttggaatcatctgtaggattattggctcacatgcctatacctcagctggaataccttgaggctggtcaagcatgtctctctgcatgtggcctctctgcatggctatattattcctcccaacatggctgcctcagcatagtcagaagcagctcctagactagaacaagtgttccaggaagtggaacctgtcagtctattaaatcctgggctcagaaactggcatggtgtcatgtctacgtttttcgatgggtagaaatagtcagagacatcatatagtcagttatatcccctctgatatctcacaggggatataactccaagtattcatgtaggaatggaggctgctcagcttgtaagtgaacatctgggacttaaatttacatctacctagtgccaacgtccattgacaatgaagtaaaacctacctgtcacccatttttccctctgcatgccaccccgacctggtggcttaatattccattttttttcagtcactttcctataatcttctacctccaccagactgttctgtaaaaaggctattctgatgatgccaaaacgtagacctgtgctttatgtatttgaaggaatgggcagggagtattcttctttcccctctcctctacttacatgacttcagtgatcctgatttcaccctcatttttaaaattttcatcttgataagaaatacctaggaaataacaaacaaggagattcaggtaagaattgatgtgaggaagagaactggggagagcattctggaacattccaactacagtgagcagctttactcctttctccaccttcccattacctccaaactctaacacattcctcctactaaaatgtagtatatttaatgtttccttttttttaaacatttgccccagctcctaacacagtgactgtattaattcccatttctgtctcagaaatgcacgtgtgaaactccataggctggcagatatgctccccagacatgtcacctatgacctgtctctagatctgccctctatccaaacggaaagtggaaaaaaatagcttggtcatgcttgttagctgataaggttttagctttggctatattgagaccttgagctgtttttgcttttgttacttaagctgtgggatctggtcaacttggagacaaatagagaaggccttgagaattgaggttctatactgatttgtgggggaataatcacaatgctgttcagaaggagagttgttgcacttgctgtctttttaggaagaatcaaagcttcactgggatttggctagctggcagtcataattttgaaccctatccccattgggccaaacctatcacatgtgtcaaaatgacatggttctttcaggggacttttgggagtgagatccacagcaggcaactctgctaataaaatccagctcaacagtaacattgcattatttagccttcctcagagacatctggcatttgtcttccatttcctttctgttacaactttaccccctggatgctggagatacaagtaacccttcttgctgtgtcttctcttattctcccaataactaagcaacttatttctatttcttaaataaatctcatggttttctgacttctccaaggtcctcttgtcaagtcaaatgaaaactactgatggccccttccaaaaaaaataagtatcattacctagaatgttcctgaattctggttcattagcacaaggtgaagacatgatgtgtcactttttagggccttatcctcttgtttcagtgatgatgctgtagtagacaagaacattttctaaaagagaattatagtcttcagggccaagaaagtagttaggccagcagtcatgaacactatgctacaaacaccagataagaacttgttgccttgccagtggtagaattgttacaaatctatgtgggagggcctttgggatcttctcatctaattgcctcatttttctattaggagattggtacccaggtaggtaaatccatcttcccacagatatgagatgacacagtaaggctataacccagccctcctgatttctcctagctcagtgactgttctgcaataatgtatttagatcagaattcctttctttgtccatcagcatatcctgagtgttttactctatccccaaattacatacccctgtgatttatacttatgtcacatcaaagctatttttaattttctaggtctcttttaaattttggtacgttggtcaagagacctttccttgatctttctcacttgctaccaacgttttcattcctaccctctgtctttattgaactgttaagcccatgttgtcaggaaaattggcacacctttttggccaacgaattaaaggcaaagggataaagtgggttctgctgatcatcatatagctttccatctagtctcaccaggcctggctgatggaggagatttccacctcagcaaagactgtaactacagcaactagtgagttgtattgtccactttatgctagctggtgaggagatccagccaatgtggaagggtttgtaagtacatacatgtagtcccctgcagaatctatgccagaatcccatagtttgggcatgcgtcaaagacatctgatgtggaggccccctcctcacctgctcagggtctgagagactgtgactctgatctaggtgtctatctggcagtcttaatgagggatcctccaggaagcaaaaatagtgcaaagtaaaagggttgatacccctgcctttgacctttattttcaatctaataaacttacctttctcaggaaaagaggtgagagctggtattttggttttggtaactagggtctggggacaaggagctggtcacgtgctctgacagaaaaactaggatttcaacccccagctgggagctggaggggagttctgtcttcctcacttactaagcatgcttgaaaaacattaagctgaatatcagagcttgattgtcctgcagatgccacccattaagacagcaagggctgaggaaggagcctgagcaagtatagaaaagaacttacctaagagatcttaaagcagaacctggaaacactggaagcaggacataaattccttttgcacagcaaagcgatcttgtgttcctggtcagtagaggctcctttactttccttcagctaatgaaccacaaaaagaagatatatatagtattgacttctgaggccagggaattttgttttctttatttttctaaatttgagtagcatatgcttcaaaacatcagatatttactatcctcaaaatgactggaaaacttagaaggataaggcacaaggaatggcctaaataggcttaaataacaaatcccactaatggagtgatggtatataatggaaagacagtgagacattagtcttctttggaaataacgtgtaagaggattttgttaattctcattacttttccttcacttggcactgtaccccacccccgcacttctaactgttacgatagctagaactaggcaaaatgggacaaagtaattcatctgatcatatctttactcattttcagtccttatctcaaaatttgtgagtgatataaaagtcacgatccattagtggctccatacccttcataatgtgatctccattttcctcgcaatcatcaactcatggcacctccctttgatctatcctttctatgccctaactacgaaattagctaaaaaatggtgtagactttcaacacacagcatgtgctctttccttccacataatgaacatccttgctcttacctggtaactcattacttgtcctatacattccacttgacttgtttctccttctgcaaggattttgtcagtgatgttatcatatttttctgatgcatcttctttatgaatactttttggagaatgtctctgttgctggtctcaggcccagggcagttttacttctctcttaggattggttcgtatttatcttatcaacgcttagtagtgacatctaccagcttttcccttttgcaatggttgccagaactctcagaggcaaatttgtcgcacatttgtaatcaagagtatgaattttcccaaatacatttctggctatatttttacaagctgaactgttctttttctcccctttactttaaaatgtgatatcttatattttatggaacctctttctggagcaaggtggccaaggaaggaaggaagagaaagggagggaggcagaggaagaggatgagaggggagggaaagggaagggagcaatgagaagggaaaggaagagaagaaaatccaaattcaaagcctactttcttcatgagtctgtcacctgaaaaaattaatcactttccctctgagctcccccagtacttggaagaagcctctgttatggctgttatagcacttacatctctgcatgtcaattctttgtcttcttggacttttttccctcctatctgactgcaaattctttaaaacaaggacgacttcttcctttttttagtattcccagcttctggctcagttcctagttcaagtaactgctcaatatatgtttattgagtgaacagtagctgaaaagtagctccaggggtttaaaccaatcacacaagttgatttacttaattggagttctgttcaagatttagcctcattctctgaatcagacttgtgaccttcagaactttatgtgtgactagtcacagtcatatttctcattgtacatgtctccaactgactttcagcaaataacctgcagctttatttaatacaaatcagatcatattaaatataattaaaaatctctccatgaaataggataagatcccattggggcatcacaaaacacaattataccttcatggcatatgctcttttttagcaaatctacttgtgagtattaaagtctgacaatcctttctcaaagttagtatcatcttttaaataataccatataccaaataagaattaagaagtcactgtattatttctatcctggattatttctctaagcagaatcatcaacattgatacataacagggatttatttgagttcaatggcaaatcagttacatcagtataacagttaattatattcattctctttaatagatgatgaaattctacaatatgaacttaattaaaagtatcccagtgagcacaggtatgctcaaagtttctttctgcgcaagttgaaacagatgcgaccactggaagatttgctcacttaggtcttccaggtcattgctagggcaattacctaaaatgtcatttgaagcattaaactaaaaatataatcatctgaagaaattattattgattccgattttctctctgttatttggagaagtaataggcacaggaaaaaagaagacagtattgtgagtaggaaaatagattatcatacagtgtttttcaagttgcaagaaaagaagcatttaataatttcttcagacaggaacaaatcatcatttaaataaagggacaaacaaacatgatttaaccttcaacacagatatgtgttacatacacatgcattcacacacataaacacaggcacttgtgggttagagctctctctggttaaattataatgtcaccgtagtcactaatcatgaccagacaccaggacaggacgcggtacagagcaatccacactccagctccccaacttgccagcaggctgctttgcagtgtttcaggaaagaagaagaaaatgagttgacatctgcaagagataatgtctggaaattcacttctacatctagtaaataactgccattctttccaaagatgcagaatttcgttgataagctatctcatcagtgacttaaccatttggaaacatctcccttcaacttactgttccgtgttctcaaaataatagtttcagcaagatcaggggaagctacccctctcctttttttcccccttcccttgctttcagcaccatcaaaatctggagagctgaatagagattacaatttgtgaaggggaaacctaaggttgtatgagagatatgaaccccaccccccaattcccaggggaaagcacctgtcttgaactttgcacaaggatctgccactgagtttcatccttattttctcttcttgctctgtattcctcatagttgaatcatttgtagtgaatattttttctaaggcatctgtatttgttttctattgccattatagtaacttaccacaaacttcacaacttaaaatattccaatttattattttataattctgaaggtcaaaagtctggaatcgaactccctaagctaaaatcaaggtattggcagggctgcatccctttctggaggctccaggggagaattggtttctttgccttttccagcttctagaggctgcctacattccttggctcatggtctcttcctccatcttcaaagctggcaatgtctacttgtgtgtttctcatgctgcatctctctgacactgactctcctgtctgtttttcttacatggacctctacaactatattgagcccacctagataattcaggataatctctttattttagggtcagctgatagcaatctcaattccatctgctatcttaattaccccttgccatctaatttaacatattcagattctggggatgtggatatctttgggggaccattattctacctaccataacatctttctggaagcctcagcttctactcaaacaagctgaccccaagctaggggccacatctcttctttgtactcatgcatttttttcagttgaagttttttcaattggaataagttccagactcattctgtccggtgtgagagtaggtagcagcatttcaagaggctaagatgcttctgtcatcccaagctttgcagagaaagggttgatggggcacagtatgtttgagattttttttttcctagcctaagaaccaaattggagatcttatttatagatattccaccaatatgtctttattttcttcacatatttttggctagtaagtgttggaatcatcatcatttacatatttcccccaatggaaaatcagttactggaaacagagacaacaaacagatggccattaggccagctgtgttgtgaataaaaacagagtagaactaagttacaaagacatggaagacagaatagacttggttctggccgttagccaggttaaattggtatgtatgtggcaactgtgctgcaaaaccaatgaaaccattatgatcagctagaccacaaagagaaagaaaacctatgagaacactgaagttgtccacaaagaagcagattctaatatgaagattgtgcatcctaaaggttatgcaagataacccattggggtgtgaaacaaactgtaagcatttttatacccatatctctatttaaaataagaacttcaactttaccaatatttaaaatacaagccaggcttgttgtcacatgtctgtaatgccagctactcaggaagctgaggcaggaggatgtcttgagcccaggatttcaagaccagcctgggcaacatagcaagaaccctgtctcaaaaaaatacagtttgacactgccacactcattggctttgtacttcagccattcacatatcacacatgtgtattaaagaatttgggctgggcgcagtggctcacacctgtaatcccggaactctgggaggccgaagcgggcagatcacctgaggtcaggagtttcagaccagcctggccaacatggtgaaaccccatgtctactaagaatacaaaaattagccgggcgttgtggtgcatgcctgtagtcccagctacttgggaggctgagggaggagaatggcttgaacccgggaggcagaggttacagtgagccgagatcgtgccagtgcactccagcctgggcaacagagactccgtctcaagaaaaaaagaacttgtttgtgactggggtatctttggttcatatgcagtcaccttaatgtggctaattgcaatactcatgaaattgctaagtagactgattattatattatctagttttaactaaattgacccttacaaaatggacaagtgcttaaaaaatatgcacgtatcttaaagattctataagaaactgcataagaagataaaactaagatgggcccgggtaagcatgaagcaaaaggaagaaacagtattcccccaaccaccagtgtaatctcttcagtcacagaaaaatgcccagtgtgatcaaatcggacacattcaattttgagcacaaaaatatttttgtattttaaatgcatacagtaaaaataaaaatcatgttatattaatacttgtttcatcttccgctctgtttaaatttttatttagtgcatattttaagatgtttgtaatagattagtacaatagtccatgcttgtactttatattctgagggtgtatacacatattttgagggtaggtattcaaatttcttttatggataagggtacacaatcaagatggtttgtagaccattgctctagaggatagagcttttggagggaggcaacaaattccaaaggaaaggtttggcatggaaaaacacttaaaagctcactgagagaagggtgtatcagggaactctagtgtaggtcataggacttgctacactaagttgcaaatttgtccaaatctgacattgccaggaagctaagtcttgcactaatctttgtgtagtacttttatcctataatagggtccatgacatattagataaagaaaagaaaataaaccataagggtctcagtgagatcttcaaaattttacacttctactttgtttttaatgcttagtaaaagaactgctgaaaaagtcattaaaaaatgagtattttgtctttaaccaagagccgggaagtatctcagaaacatatttcaacattaaaatatcaaataatcaatttttataagaagtgcatttaattagcaacttggctatagctagcacacagtgagttaatctaataatcagtgactctctggacagagtcatcttaaattcagctattcttttatcgatttaagaaatgtaataatatgcattttatagcaaatggctagaaaatttcagctacagaatacttcattctatgaagcctgattattttatggcttagaagatgttcataacttctgttccaacatgatacagaagcatccttcagaatgttatctttaagatcacagaagttaagagatttaaatttcaaagtgaatattatccattttctgttcttttttagcctacttctaggcaagccctctgatgccctcatcgtttgtttaaagtttctctttcttccaggctactttgcgaatcaattccagatcacagaggagagaaaaccttattccttttttccaccccaagctcaccttcctagacaagatttttatctacattaaatacattcgctaacccaggatagtgacctacccatagcagtggcttctgtggagctcagcagaacatagagaagtcccacaatgcttgattaaagccatcaggaaagcctgaggtaattctaaaagatcccactctgtggtacaaaatggccctagaagccaatcttctgactacttgtcattttatttcatttcatttcattttttcttttcttttcttttttttttttttttttgattcagggtctcactctgtcaggctggagtgtatggtgtgatctcggctcactgcagcctcgatttcctgggcacaagcaatcttcccacctcagcctactgagtagctgggctacaggcgagtgccaccagctaattttttgtattttttgtagaaatggggtttcactgtgttgcccaggctggtctcgaactcctgggcttaagtgatctgcctgcttcggcctcccgaggtgctgagattacaagtgtgagccaccacctggccttgtcattttgttaccgttaacactttcctctaggtctggttcccaatgcgcagaatccggggaatttgaacagggctctcttggagagttgtttcattctatgtgctgggataaaaacaaattatttttcctgctaggaatgcactaaagatccctccactgtatcttccaggaggttcatattagtatttgctttagggataatgttttggattgcaccacagagcaaagtttttggtcagacaatctaatgggactaataacagccgacctgaacattgacaattcttgcacattatcccattccatcctcacagatcagagaaacccaattaggtaacatttccccacttcatagaccagggaaggaaatttctgagaggttaattgatgtgctgaaaggcacataaagtgcccggctcagtcccacgtctggctctagattcctttttagttcttctgtattatgctgtctcttctaaatggattattaggttggtaatgttattcttagtcattctgcccaaataatgaataacagattatacatttaagatgttaaaatgtatcataattttattataactgaaaatgttcagaatttttttaaataataattttggggaaaagaaaacttccttatacattgtttcctcagtatttttttcattaggtattttttccatttggctgtggcaatccttgagattgattctcactgtcagggtcataactctctctctttcacccagcggtaaccatggaaacatatgtataacacgtcctgcttcttttaatatgattattcatgagttgccataaaaatataaagtgtatttgtttgcatatttaattgttaaaataacacaagtatttgcttttaaaatacctactcatagctctgtggtcatgtatacataaagtaccaaccattcttaaatcctaggattaagaagtgacatgttgcaaatttagagtaccttgctcttcaccagttgtatagcaaaagagttttagtcagtttagaagtaccatgggtccaccgcgtggtggctcgcacgtgtaatcccagcactttgggaggctgaggcaggtggattgcctgaggtcaggagtttgagagcagcctggtcaacacagtgaaaccctatctctactaaaaatacaaaaaattagctgggcatggtggtaggcgcctgtaatcccagctactagggaggctgaggcaggagaatcgcttgaacctgggaggtggaggttgcagcaagccgagatcgcgccattacactccaggttgcagtgagccaagattgcaccattgcactccagcctaggcaacaagagtgaaactccatctcaaaacaacaaaaaaacaaaaaaacagaaaaaaaaaaaaaaaaaaagaagcagcagcagcagcagcagtaccattggtcgaattagggttcctgtcccatttttctgcatacatttaaagtctaatgtgatatagtaagtactttctcctttgaagatcagctataatctcagaacttaatatttcacttgtatagaagttactcttaaatcagattctatgacccagacagccatccagaattttagttcgtcatctctagcttcctaataaaaatatccaagtggatgtcccactaccccttccaattcaatttgcctaaaaccaaacttgttatctttccttcagggttcaagtcctttcagaaatttcttaattcaatctccaatcccatcattctcttagttactcaggcttaaacttttgttatcctacggcattttctttctctcttctttcacgtcctatatcctataaattattcttagcttctactagcctttctatttccactgccacacttgttacattgtgctgagactaccctacagtgctttaacaagtcttctcccccagctctcatctctttgtatctgccttccagtctactccaaggtcgaactgtctaactcaacattttgcatatgaccctcaccccctcacgacaaccatttcttctaaattaaattgatgtataacaccattcaaaagttatttctttcagcttcaaaacaatcactccagtatatacattacttgccaacatgatgtgaggtgaaccacatttcttgcccacacgctgttctcatttctgttctagttcctcacttatgacttgtaaattgaaagcacctagatttctgttgttattctggatgagtaatggcaggacaaccctaaatcccaagtatttctgtggctcttttaaggaaaagaaatatacaaaaatagtctaaaggaagaaaaatataaatattctaaacattagtcttatatctgtgttacattgccattatatcagttttgcttgaaataagactgtggagattagatattagttttaatttatgacatttggcaattgtaaacaatttgtgttactttattcttttagaatctgtgtagttttccaaaattaaaattaaaattccatttctagccatagaggagtcttcttagttctatttgagtcaacaatcatttttaaagttttaatttgaaaattaaggacagatccaactaggattgtgagtccagcagacatactgtgtgagcacacagctgtggcatatctgtggaacggataagggtggcatattttggcacttgtggaacttattcccatcattttaaacaatgcttggtaggtttatatcaacagatttattttcccttcagctattacgagagtaaagcagagacctaaggtctggcatatgaatcttacaaatgagggatttttaactaggagcgactctgaaagcttcttacattcttgggacagtctgcagtcatagattgaatgagaaaagcctcatattttggctgggtgcggtggctcacacctgtaatcccagcactttgggaggtcgaggtgggcggatcatctcaggtcaggagttctagaccatcctggccaacgtggcgaaatctcgtctctactaaaaatacaaaaattagccgggcatggtggtatgtgcctgtaagtaatcccagctacttgggaggctgaggcaggagaatcgcctgaacctgggagatgaaggttgcagtaggctgagatcactccactgcactccagcctgggcaatagagcgagactccgtcaaaaaaaaaaaagaaaaaaaaaaaaaaaaaaaagaaaagccccatgtcttttcattgaccatatacgatctcttaaccagcacagcattgatgcatttcagccatctcacaaaacttcccttttatcattctgaaatgattttatctttcccaagagactgatagacaaagcagctttgtatactcacgtcctggttattgtgcattattaggaaacagataggaaagctaccctcatacagaggctatgtaaatattatttggggaagaggaaaaacacatatgggtgctaagaagataagacagtgcctctgaccgttctatttgatgtttcttaaacctgcattgttatgaaaactcaggtaaatgaatttgtaatgactactgaaaatgaaacaggagtatacttgaataagtattgacatttttttttcaggtcatttactttaagactcacaaagaacatattagctaatagaattcatggccaaaccatgatgtaaatggagctaaggtcagaattagattccttagggagctgaagaaaaaacacggctatgaccctaaaaccaatctgctgactgttttctgctgactcttttctgatgcaaagtaaatggtgggaaaaaaaaaactgatactaaaaacaaacaaataaacaaaaaaacctctaactatccaaccacctgtgcaatacaatagctttctataaaataaaacagaatggaaaaaaaatctcaaaatcatgagttgaaccaatgaaacatacgggttggttcagcattgcaaccagatgtcatcttaataaaaaccaacactattagctctttgatgattaataatagtaaataccattatcacactcaaatatgactctttaggctgggttactaatatatacaatcaacctgcatttttcccgtctttccggatttgacaggaagagtggctgtggcatggaggaagattaaaagtctaagagaacctcggatttagattctagttgcggccctgccctttcttagttgtgtgaccttgagaaaatcagctaacctctctgaatcctatcccttcacttgaaagtgtgttaaaatggcacttatacatgataattgtataaatacgtttatatatggcatatataagtaatacatatgtaatatgacagtattgaagttaatataaactaatatgatataatgtgtttatatactatttacaaattatatattaatataatgtatttatattaacataaatacatgtatattagtttaaattatatatgaaaatcttataattaaaatttttacatataattattaatatatcataaatttctatattatatataataaatttatatataaatcatatctatacacacaatgctttgtcatgtggggtcataaaagagtactgcaatcattattatgtcttcggttaactttacaatgaaaagcttcttaatcaatattaaactacgggcaaatataatgctgctgccttctaatgtaatttactttaggaaaagcaattgatgagataaaaggtctttctcttttttcatttttatttttttgagacagagcctcgctctgttgccaggctggagtgcagtggcacgatctcagctcactgcaacctccagttctctagttcaagcgattctcctcctcagcctcccgagtagctgggattacaggcacacaccaccatgcccagctaacttttgtatttttagtacagacggggtttcaccatgttggccagaatggtctcaatctcctgacctcgtgatctgtctgccttggcctcccaaagtgctaggattacaggcgtgagccaccgcacccggccaaggtctttctctttttaactttgtttgcaatacctagcttgccttcatgctgttatattaggttagcattaattttccattattggagcagattgcctacaagcacacacatacaaatagtacactgaggaggaaggagccagtgctgaagttctttttctgaaacgtaatagagcttttctcattactgcaaatacatgaatgaatgaacaacattgcaagcacagacgttgcatacattctctcatcaagcagcgccatcactgccttagtactttttgttgttgttcagcattattgatttttccaacaatcgagtttgtttgcaataaactgaactggagcataaccttcactaattagaaaaaatgtatgggtattagcttaaggaagcaataacacttcttgtacgttttctatcgaaactcagggtgatgctttgtaggagtgctattgtttcttttcccccttgtgacaatgttgttaagtatgatgcaaaaaagtccaaagaccttttaaataatttgcatccattctagaaggaagaagaactacaaaggccaggtgtgaatggatatgaaaatagcaacttagaatagaaatatctgccattactctctctgcatacctctaagcctttgtccctatttacaattgtttttatattctggtccactttgaaagtgaacaccttaaggatctttgttttaactataaaatttagaaaatattccttgattcatatttatatttgctgggtaattatcatttataaaatcatagttgaactaagaagctagaaaaaactacatgtgtgattaactgtttagtttttcaccatttctggtcaggctgtttgaattggccaatgcagatttcttcatcccagcaaagcttaatcatagaagtaatttcaattatataataaataaaagctgctttgcctcagcatattcagtgattaaaaatgagtcgttttttaaaattttcaaatctgacagtatttcttgaaagaaataatttgtgatggaaataaactgaaaatgaggaatacaatggtcattgaggtgcaaaccaatgcaacagaataaagttaacatgaaatttgaaattattgcccagaaatcaaagtaactataaaaatatagctgttattagggaaatctctagtaggaaaagaaagccagaaattatcacattagcattaccatgggatgtcattctagttcttaaatagaactaaagacgagagcatcgtgactctaccattcatatgaaggagactaaatagacaatgatcttgaatccatttccttttaaaaatcttaacagcatagggtaagtatttggtgatggattcttggctgcagaaaattcctcatgataaacagggtgctatcattaaataacacacatgctaaatgctgggaatacattaattcctccaagtccaattccctgtaagtcatcttattctctaaaaatcattgtcataaagggaattctgtgtgtgacatctgagagtaagcatgtttagaagtgtctcaagagtacctgacagtaataaaatcaggaaggtaagacaagaattatccagtctttgcagggtcaaaaatgacccttctctttattccttaagttttttgtgtttttttttttttttttttttttttttttggtgagatacagtttagctcttcttgcccaggctggagtgcaatggtgcggtcttggctcactgcaacctccacctcctgggttcaagcaattcttcggtcccagcctctcaagtagctgggattataggcgtccgccaacatgcccggctcatttttgtatttttagtagagatggggtttcaccatgttagccaggctggtctcaaactcctgaccgcaggtgatccacccacctcggcctcccaaagtactaggattacgggcatgagccaacatgcccagccctattctttaatttttaagtagctttggccttcactagcattactacagtcctatatgtaaaagtatactgctgatgaggaaaatatacctcatttaaaatgtgtgctttaaagtcgagtctctgctatctaccataccaatgtaggttttggtcactatcaagttattttcgttctcagcaagtaaaactgccatgttcttcatgatttttttctatgcatacacagtcattgctaagataaacattatttttagacatcaaaattcctagcttattattttacatcatattagtgcaattgtcaagagacaattttatatttcttaattcactttttctctttgtaatctgagttccccaaataagagaaatattaataagggtggcatattttggcacttgtggaattaactagcaatatgtaaattcctaaatagcatactgttaaaatgcttctattcttcaaactctaataatttgctaagaaattatgataataaattttaagaatttttggctaagtgcagaaaaatctgttgaattattaatacattagcaaaatgtatcatttagggaaataattttattgtaaggaaagaacttagaaatttgataataagcataatttaatgaataattttctgaatgagtcatttctttgcaataaaaagaatttttctctctacatatgtgtggagcaagtttctgtaaaggaatccaaaacttgtaaggaagggaagccaaagaattaccaaaaaatattcctgggtgttttgaggtttcataagatatttgataacatattgaatgactctctttgtgaaacatttagtagcagacagtgcaggaaaaagctcattcttttttttttttcttcgcgacaaattcttactctgtcacccagactggagtgcagtggcgcgatctcagctcactgcaacctctgactcctgggttcaagtgattctcatgcctcagcctcccaagtagcagggattacaggcatgtgccaccatgcctggctaatttttgtatttttagtagagacagggttttgccctgttggccaggctggtcttgaactactggcctcaagtgatccacccgtcttggccttccaaagtgctggaattacaggcgtgatccgctgcacccagctgaaagctcattctttactaatcatgaaaccctatattaaaaaaaacaaaacaataaactattaggctggtcttttccagtgatatagccaaagcaccatgccagcaagtgaaacataataggccctcaataaataattgttgaaatagccatatgatcagacttcacacacaaaggctgaactgagttgaggtaattcaggatagaacccactggataatcaagcacataatattggctttaattatgtagctgtttcagaattgagaggtgatgaagggactcaaacagcttgatgctctggctactgggctgtttggatggctatgtgctctttgctcttactccattgtgaatttctgaagccaggacagccttaattagatgtgagtctgatatgataaatatgttgctatggtgaatatgaatgtttcatacaacaatatttcatgccaattaacagtaaattccaaatactttgccaataaaattgaaaataccattattccattggcctgtccatgatggcataaataatgcatatttgtttatttatcaagagggctcttattgaacaccctgagctttctaacagttatctcccttgtgcagtgtgccagctcattaggaagactaaagtcacagtggagtcatcctgaaatgacttcaacacaaattccatgtaaaaagatttttggagagccatctgtcccggggtctaggttatcttttggaaattggaactaaatggatgaaaagtatagaaatgctttggtcttccaaatactttcttaatcacctctaattgtaaaaagaggaaaaagtggctttaagaaaaaatagcaaattaaattaattcataagctattttgtatgatacaggagacagacatttataaaagtaattgtgcttagttatcttattgcaagccttcatctccacatttgacttcactggcaaatgcggcaacttacaaaacaaatcaggccatttcaacgctagtactacagagcttgtttttctcccccaatcttaaagagacttcatggatattttaatgttagattttacaatttaacatattaagatatgattactaaagactaattcttgtctctgctacctccatgatttcattactgtcatgtgccgttgggacgcttataaagccagaaacaactgtagcagaatgtgtagattacatgccattagtttcactgttcataatgccgagcatattccagagtatgtgctgaatgcctccaaccttcatgaagatatcctttttccttttttccataaaaagacatcattgatggcaactagtataatggacagatcattcaaaaagcacatttgatcatcaaacattttccaggtaccaaaaactttctggaaacacacaatagaatttaaacctagtaagaaggctggatgtgaacatattgaactctaagccaataaaatgtacaataatagaggtatgcaattagtatatggagacacagttgatgatgccattaatttttctttgggaggtaataattataacatctaatcttaactgagtaattactgtgggtcacattctgctttaagtgctttaaatgtactaacagagtgagagggaatggatattatttccatgtttttagactctaagatataatgcatcttatccaaagccatggggctagttggcagtggagctaacattttaactcgggaaatatgggtccaaaacctaggtttttggcccccaggccatactgcctttctgttttagagtcatctaagaaaagtctggagacaaattgatatttttgttaaaatctaaaatatgaagatgacttcatcatttaaagaaagagtaggaagagaatttaaacaaaggacatatagtgagcaaaattaggaagaaatatgggtccaaaacctaggtttttggcccccaggccatactgcctttctgttttagagtcatctaaaaaaaagtcatctaagaaaagtctggagacagattgatatttttgttaaaatctaaaatatgaagatgacttcatcatttaaagaaagaatagaaagagaatttaaacaaaggacatatagtgagcaaaatgaggaagaaatgaaagggagaataaattgatgggaagttgcccaaagtttgagttgctaaattggagggcatgcaggaagcagcatgggaatgaaattgtaaagggagatggagcccagactaggagtcaccttgtaggccatgaaataggatttgggcctgttctgtgggatcccttaggggatattgttatactcactcttaacattatactgactccctagccaggtcaaagtacaatttaagctgccaatgaaatatattggctttaaatttttgtcaccatttttaaagtgtagtgtggaactgaaacattatataaacattgtatagacaaaagaaaccatctattctaaatattcttaagctgtttgaataatgattggtctaaatgtattcctttcacataaattatataaactccctttgaaatgatgtatgagttaaataagcaatttttatgttaaaaagttcagtaattttaaaaatgaaaatgctcttactgaagcctccaaatcatgcatactatatacaatcttttatgttgtaaatgtccatgataaaagaaaacaaacaaaacaagacatcagcaccaccaccaataaaatttcaatcagaagggatcacttggtttgaaactttatgcagctctcagatagccagactttctttgtcaaaaacattcaatacaatgtttaggaagtgtcgtgtttaacagaaaacatcatgtgctaatattaatttggaaaattctatgtggtggctgacaccctacagtgttccagtctcttggaagctattcgggaatagtgagtgttccttctaactgttttatgtgggggtatgtggaatcttctaatctccaaagccactaggcttctatcctgactcttatttcctgatatatggaccctcttcttaactctggagtgttggactttctcttttctgcccttcactggtggcttggtttagttttctggtaactgcatttcttcctgagcacatccagaatcttctcagaggaggcaatcattccattctttccttgtgacacctcaattctccatctccttacccaaagagcctcctttatgtgtcactttccctttgaaattatcttttctttcttagaaaacttttcgtttctattttaagaaaagctgggtaacgtaagaacatgaaacattaagaggcagatggtaaattgattagacataagatgcttcgtatttgtatcctctgtcctgttttccactttttcttcagaaagtagtccgtgactttgtattcatagctgtttttcactttacatatcaagaaccaatgtttgggaaacaaataattgtgagtaagtggttatattgagttgcatatcagaagatatttaattttataggttaaatttataatatgaattgctatggtataattttgagaaaaaaaatcatttttagtcattacaaatatttattaatggccacactaggaaacaaagattatgagcctcatataggatacattttttgaacttgcaaaggaatacaccatatttcattaggtcagtaggtctttccctccttaggtattgatacgcctacaagtgtaatgacgtggcatttataatttggtaaaaataattaaagttcatttttgtgaacaacttagtttttaaccaattagaatctacttagatacattctataattacatcaccctaagatatttacaatctgatcaatgctatttttcatgaggaagagtgatagaattagagccacagtctagctgatgtaattatagccatggaacgaaacatatgtgcctgccatttatctcaggtatctcattgaaaaaaaggatgagaaaagctgatccagagtaggtcactaagcatcatccataaattgagaattggttctcaaacaataactttgaatcagcagaaatccagtgtttgctaaaagctatacatgaagagttaaagtagttgatcccctcaactctagtctctgcttatttttatattaaaagtcaaatgcttgctttgttctgaaattaatatacatatacacacatatatacatatatatatacacatatgaaatataacatgaatatgtggattatatcagagcaagtcatcatctaaaactagattctagctaatatttcagcaaatatgggctaaaaacctatgtggccacaaaatattgatacagctgtgaataaattaggtataattccttctaaaattttcagtctacagtggagacagccattaaataaattatcatgtactaaccaaaataaataactgcttatcattactgaatttctgatgttcttgcaaaaacaatttgaaaaactatatgtataaatttactactgaatatggtagtcatcctttaaaagacaatttaatggcttcttggccttttggctaagatcaagtatagtatctgttcttatccatttaaaagacaatctaccataatacctgaggaagaacatatattttataataacataaatataatacgtgttctcaaataaaaattaagccttctaacaagtgattttacttttaggcacgtaacttcaaaaatatggaaaaatggacgctgggtgtggtggcccaaacctataatcccagtgttttgggaggccgaggtgggaagatcacttgaggccaggagtttgagaccagcctgggtaacatagtgagaccccatctctaccaaattattttttaattagctgggtgtggtggttcacacctgtagtcctatctacctgggaggctaaggcaggtggatcacttgaacccaggaatttcaggttgtagtgagctgtgatcacacagctgtgctccagcctggacaacagagtgagaccttgtctctcaaaaaaacatgaaaaaatgtaactacctatatctatatatcatatatatgtgtgtgtatatatatacacacacatatatatatgataatatgtaactacctatatctatctattttatatatatatatgtatatatatgtgtgtatgtatatatatatatatatatatatacacacatatatatattaggtcccacagatgtacaaatttttaatgtacttttattgtaaataaacactgctggatttatatatcaaaaatattgctgattaagacttgatggcccgggcgcaggggctcacacctgtaatcccagcactttgggaggccgaggcaggtgggtcacaaggtcaggagatcgagaacatcctggccaacatggtgaaaccctgtctctactaaaaatacaaaaattagtcaggcgttgcggcatgcgcctgtagtcccagctactcaggaggctgaggcaggagaatcgcttgaacccaggaggcggaggttgcagtgagccgagattgcgccactgcactccagcctgggcgacaaatcgagactttgtctcaaaaaaaaaaaaaaaaaaagacttgatagacattagaaagttaactgagggaagtcatcaaatccacttccttaaataggtaagattctccttcgatggtgctaattcctttgagaatacttgaatgaaaggagatgagcgttcatgtattatttgaatactgaatcaatgctttcctgagtaaccttggtgatatggtccttccacatctgagagtttattttgcatccccagatattctaccttcattgcaatttttcctccaattggtttagaaatggtacagaggaaagttagtaaaagtaatcactctaaaagtgagtcatttattcttttatcctatgtaagtaaaagaactgaaaatcaagcagttagctttaccctgtggtctcaaacatatgagttaaaagacataataaaaactatcaatgtgtccaatatatttgtccttagcatcattaatctattccttgtaaggttggagtttataaaatgagactccataaagagagagatacctagtctaaatcaaagtgtgtgcgttatgacatagtagaatatattgataagttaactgaaatcaggtaattgcgggtagattggcttaacatgtccaaaacattctgtgtaagttaaatgactggtaagtaaaatggtgggactcatgaaagttaatttaattatatcagtcaaaaatacataaaataatttcaatactgttacaacctcactctagtaggtgtttctcagaggcacttgcttcattgtttatttgtcatcattcctaataaacatatatttgagttcatgtcatctaaaaataaatggcctaccctacagagacatggaaaactgatgtaggcatacactcacccaacatttaatgacctgaatccatctcaatgacttccttttctattcaaataaccagtttggaatttgatttactaaaattaacttttgtggtattgtttcaacaaaggacagccttttgtgtgacaacctataatatttagctactaaaagacctaccatatttctctcccactgagaattatttgttatctaatatcacttatagacttcatgtaaatcaaataattatttctggctctgcatggtgtaaggatgattaaaaacttgtcaagctatcagaagaataaggccacttcccagcatggaatgacattatttattctaggtccaatgattggtaccagaactgacccttaataataatatttatgacatgggggtgggaggggagaaaccatttagaatgattagtcttatcacaatcctaaggcattagaattttcaaaagtgctgaaataattgtgcaactttaaggaaatgtataagaaggtagctaaattatcactgaagttagtgaacactatgcagtgctaatcatgtatggcttctcaaaagcatttaacactcttgacaactgtcctcttgagatgctgtacctacttccctctctgttcttcaactttttctctattcatttgctgtctctttggctgtttctctgtattttgttcctccattacatatttgaatcctgtgatttgtcatgcattatctttgcttttcattttatgtgctgttctggaaaattctactccttcaagtgcgtttactgcttttcatatattctttaggcaagatctttttcttgaccttcaggcccatatcagcacaccaggagaaatctcccactgataactcagattcatcctggataaattgatctcattatctgtcattcaaaactggcttttcataatatatggctccaaaattcttatagtcatgtagcaaaattcctgggagttattctccctcacagtcccatccattaaaatctgataagtgaactgaaatgctactcaaaactctattctgggtcttctttccccactaccctgactcatgttcccattacctgtccattatcaccattccaaaagactctctgcctgaattcttgcacatctataatccagcttcccaagtgtgtttttttaatacacagaaacgattagccgcaacagcctttaacaatacaagactgcctgaagtccaaacatactaacttgacataagtatcctttgtggtcatatgttgagcctcctttccagcctcctttagcttggtcacctttgtgctctaagtttcagctatactatgctaccaaggcatagcaggatgtttcacacctatatgcatgagcatgatgtgtatgtgcatggacacatatgttttacacaattctcactgcttataaaacacactgcatcagctgtctattgttacgtaacaaattagcacacatttaatggcttaaaacaatacacatttattatttcacaatttctgtaggttagaaacctgggcatggccatgctgggtcctttgcttcacagtgtctcatagatggcaataaaggtgtcagtcaggactacagtctcatctgagggctcaaccggggaaggatctgcttctatattcactcagtggttgttggcagaatttagtttctcaaggccttaattcctaactaggtgttggccagaggcctttttcagttccttactacaagggcttctctataggcagctgcctcataagtatggcagctgcttcaccaaagccaacagtgaagagagtcttttagcaagatgaagttcacaatcttacataacctaatcactacagtgatattccatcatctttgacattttctattttgtaggcaactaggtttagcccactctgaacaagttggaattacacaaagatgcaactattaggaggctgggattatgaggagccatttcagaatcgaccacacccaccaaccccaccttcctttacccccatcaacctgacaacacctgctcaaattattgaagactcatgtgacttaccaagacctcagtttttcaatatttcccaacaaacccaccatgaagttggttactcctttcttcatactcccagtacacctccaatattatttttcaattattgtttacatagttttctctcccgtcaatactttgagaacaaaaaatgtagtgtgttattttctactctctggtaagatcagtccaaagaaagtgctcattaaatgttgaataataattgtttaaagtaaataaaaccacagatattaaatacataaaattatctggaaacaggtaattaccccagggataattgacagctaacgatgtgcttaacatctgaatgtatcatttactttagttagagtacacatggtaatcttttgtgagtgacatcacaaagtgacagattcggatgtctctattatttttaaattctttcaaatgagaaacaactataaaatgaaatgcgatgtggataatatagtatagtggttaagatcactggctttagcatcagtcaatgggatcaaatcccacttctaccacttattaactgtatggttttggacaagttactttaacctctctgttcctttctttactggtctgtgaaatggggtctgaaattgcacctacctcatagggctgttataaagattaaatacaattatttatggaaagcagttaataaagacctagtgtgtatttgactctcagtaaatgtcaatcattattatctcctagtatactgaaatagaaagatgtccataatatgaaacttggagagatgtatgtaagttgttaattatctttaatatatacatagatatatacagttaattcatctatatgtttgtatatgggaaaattgggaagtatacacagatttttaataatgattatttccaggaattagggaagaggtgagggtggataactttatttttttattttgcagattattgtattatttgaattattctaaataagcatatatcacctttctcttttttttgagacggagtttcactcttgtctcccatactggggtgcagtggtactatcttggctcactggaacctctgcctcccaggttcaagcgattctcctgtctcagcctcccgagtagctgggattacaggcgcccaccaccatgccagacttatttttgtagttttaatagagacggggtttcaccatgttggccaggctggtctcgaactcccgacctcaggtgatccacccatctcggcctcccaaagtgccgggattacaggcatgagccaccatgcccggtcgcatatatcacttttataatctgttatggattggatatattcgtccaaaaagatatgttgaaatcctaaccccagaatgttactttctttggaaataaggacattagagacataattagttaaggtgaggttatgctggtgtagggtgggccctaattcagtatgattagtgtccttataagaagagacatctagacacataggagagaacaccactgggtaatgaagccagtgattgagtgctgcagctgcaagccaaggaatgccaaggattgctgacagagcaccagaagctaagaagaggcaaggaaggattcccctacatgtttcaaagggatcgtggttccgccaacaccttgatttggactcctaacctccagaactatgagccaatacatgtctgttgttttaagccacttagtttgtggttctttgctactgcaggcccagaaaactaacagatagccaaaataaattaattaatatttttaagtatatacaaaaaagaagagaaaagacaggcagttgcatagctcataaaattataatctcttgaagttgaagcttcaggttcattttgactcttacctctccggccatgccaatagaattattagtttttgacatcccagccaaatatttgacaagcagttcataaactaatgggaagtgctaagaaatataatatggagctatttctttctattctgttcctccatgaaatttcttctatccaatttccaatcatgcaaatcgtatcaagaaggcaagtgatccaagggttaagcaacatttgattggctgctgtgactgcatgtatctaaagagaaatagaaagcaatttgactacggtatgtgactcaagtgatatgtgttttagataagtaattagaaacaaaacaaaaagtcaattagtttctagcctgtccttcaactgtttaaaatattatagcaataaaactaatggagagttttttcctaactacatcaaagttattaaaatgtagagtcaattagaaaaaaaatataagaatgtacattcataattgttgaatactaacaactcatatcaaatggacaaactgtttgacaccaatatatgtgggaaaggtcagggcttctaaagaaatgtttctttaatgatgaaactttccaattttaattttttttaattagcatcttatagacggaggaagaagagggtcaaaaacaaagaactttttcttgtcttaatatgtatagccatggaagatggcagaagggagtgaaaaaattcaatcaatcatttttataaataaaacaaatggagaaagcagtggaaccagtaaccccaataatggatcctatattattatttattttatttgcctatctctttcacagatatctagctattcatcaagtagacattccctccaaggcacaaagaaacactgaagttttaatctaccattgtttaattctttcttctggcagaaatacttgtgttcataagaaactttccaaattaattaaacttgtttaaggttgatactggccagagactttcctgtcttccaatttaagagattttgatgaacatatgagaattacattacaaaatatggcaagacggggaaagaaaatagaagaggtgaaagaaaggagagggaatgaaaggaggaagaaagaagaaagaaaactgaaaatggaaatacaggccagacgcagtggctcacgcctgtaatcccagcactttgggaagctgaggcaggtggatcacctgcggtcaggaatttgagaccagcctgaccaacatggtgaaacccccgtctctactaaaaaattacaaaaattatgcgagtatggtggtatgtgcccataatccgagctacttgggaggctgaggcaggagaattgcttgagccctggaggcggaggttgcagtgagccgagatcacgccattgcactccagcctgtgcaacaagagcaaaactcttctcaaaaaaaaaaaaataataataataatacaaattttctctcattcatttcacaaatgtcaagtattggccattattcctaatgtaaaaaacaaaacaaaacaaaaaaacaaaacaaacaaacaaaaaatacccaccgtgtttcacattgttctgaagtagttactgttggttattattgagagtgcaaaccacccatgcttcctcttgggctaatgcagaggttaaacagcctgagaattacctgcaccatggaaatgtattctggggttaataagaacaaagtgtccatctttgagttattttaacaactaaaccctagagaccagagataaactaaaggagaataaagaaatataattacattggacagtaatgtcatgaagagttaattaattaggattcaatgagtcataacttattttgaagatgtggcattttagaaaaccacctagcttcattcatattaccctcagacattaaaggtgtaattgttgtcattagcattttaattggtcctgtaatttaatggttatacacgtggttgttgtaaggtcttttaagctgttgggattttaatatttgacatgtagcttgaaaaaataattatgacatttcccagatctgaggttggcctttgcagttaatgacaacactgcgttttcaaaatggttattattgatagtacaaatactcaaatggcctacagagctaccttcatctgtaccatagttcttttttttggagatcactgggattatctaatcagaccaacactgccaccatatttaagcagtatgtaatgtatggtagatatattgcaaaatgccaaaagaaaagcacttgtagtagtttctacttggaaaacagtattgttactaaaagttatggcagaaataatattttattaactgtaggccttgattgtcttgattgcaaatgctaggtactatattatgcacacagcttgaaatgtatgtggcacaatgaataaaagcttactttcctaaaatataaaatgattgaggaatttgatgatcacatttaaatattttcaaaaagggttattttctacccagcagtagaataattgatagataattacaaaagaggctatgccaaaattattgctaggccctttatattgagacaatggtctttatatagtgtttgatgagaaatctatcatttcccttggggtaatggccagttatttaccaccgtaacaacttaaatgactctgtttctagacttctagttaggggcacttcttaaatcttgaaaatggggcaaagcataaatttctaagatttacttggttgtcttcacccttagtacatggggtgagtttcagcttacaaacctggcctctcctctgaaactagcaaggaagaaccaagtgtcacaatatagcaggagctcttaatccgtctgcacaatcattgcgagatggggagtggataggcttcccagtcagtgcctctgatttgattggtccagatctggggtgtggacaatttcttataaagctctcaaggtgattctaatatgcatccagggctgagaaccacttcattagtgattattagatcggttctcaaaatacagcctaacattgatggactctgtcgatggcaatatcctggttgtgatatcgtagtatggttttgcaagaggttaccaccagaaacaattgggtaaagggtacgtggaatagactctgtctgtattatctcctagaactgcatgcaattctacagttatttcaaaataaaaaagtttaacttatttgttaatagtctgccagtgaactccattaaacttacttgtgactcttaaaagatgcagacttttgggccccatcacaggtctagcaaatcggaatacctgtgggtatgtcctggaatctacatttttaaacaagctcaccaggtgattttgctgaaacactgatttagctacttacatgtttaggttttgagtaatactgggcacctggacagtcctaggtaagtgagaattaggcaaactggcacactaagttccctgccctattcagtattctgctattcctgctacacttgtcttaaaaaaataggatttcatataccaaggtgttatgatgatactaaggcacactaatgcataaaaataatatataatgaattattcagtcattcaacaatttttttattgagtacctattatgtgccaggtacagttctaagcattgcttttaagaatgagtataagaataacatttgtaagcctatcacctcaggcattctgatagtacgtggatttcttatttaagcttcacaaccaccctgatgtaggttcttttattctcccctctttgcacaagaaaacactgaaacaagctgttttatgtacattgctaaggatctagaagtaaaaactttgaatctgaaatcagatttcgactgtttctttatggtaaaatatacataacataaagtttacctttttaactatttgaagtgtacagttcagtgacattaaataccttcacacactgtgcaaccatcaccaccatcaatctctaaaacttctccatctttccaaacagaaatccagtacctattatacaatatcaggggctgtttttattatacagtatatgacacccccccaccaaagaaacctttaattgtagaactttatacaaaaggtaaagaaaacaatttgggagaaaagcctctcgccagcatttcttcaatcacacaacatattatagaaaagctgctgtgtgtaagatcagccttgatctggctgtatttttattgaatctaaaaaaaagtaattatcagaactattgttataacttaacccatttgtgctgcaattgcttctcatttgtgaaatagacactaataaggcatactaatggaatctttagtgtgagtatttattaaatcactaatgtatgtgaaacacttagaacattgcctggcatttcctcagtccacccacccaatcccacccacacacagtcaaaagttagttcttatttccccgattgtcaattttgtatatatcacttgatgcacatcattttcccacatctttgtcactgattgttagttttatctagttcagtagcaagcacaatatctaacaacctgaatttatttttattgtaatcatttcaaagaaattagagtcaaatgtcctcaactgtatgtctccagtaatttcacttagaaagtttttcaggcactgaattcgttcttgagaatagagtagcattcccctgtctgtaatatttgagcagaaaggacattgcttccatgaagccttgtttctgttcttcttctgtttgttagaaaatactctgttgatggcaaattcgtgagcaatctaaatatataattaattagaagaacaaattgaaattgaccaaatctctcagagctttgaacaaaaggactcttcaaatggtcaaaacaattacttagaatttaagcgttcattgaaatgcgagacagtgtgcggtagagatacaaaagagaaaccaggctcccatgatattgtaaatgctaaccctgctccttaagcaaacaaaagtctctttctattgtcagtagctgtcttctaggacaaatagtttggtattttataaaagggagaaaaacttatcaaaaacattccatgaaatgtacctcttttgaaaaattactccttgaatttgagttaaagaattctttagaagccaaactgctgagatgatttatctgcacaaaagaaaactactgttcaagaagcatatttgaagaatatgtcattgcaaatcaaagattcttttaaaaataagtctcaaaaggaagagagggagagagggagaaagagaaagagagagaaatatataattaaagtcataggtaatttaagtttggaaatgaacattcattcactactttgttatattgtcatatggtggtaaacaaaacaaagcaataattttgtctgattttcttcgctaagaaatggaaccatttatgaagcttagcaactgatgcgaattttgctttgatggtaattatgtaacagagtggcaggggtttcacttccagataaagatggacaatgaaggtcaatttctatcctgtcgttttgaatattcagtgccagcacaatttaattgggatcaggtaattgctcagaaggctacactgagcccactatcatccctcagtgtcgctcctgcacacctacttatcctgatgttgtttgtcaaaaactgtcacaaggaatgtgtctcactgagaaaaataacctgtttgtcattgctcagagcttcaagaccatactctaaagtgataagaaaaagttttttgttttttttttttttgagcaaaactgtcttgtctctgaactgattaaattggtccatcatggtaatataagggaacattttaatgaaataaattatttatgggagttcagtgatatttgctctcctagctcttgtgcgatagtatcaagtgtacctcttactctcttttggcattgaaggatattatattagtcttgaatatcttttgcaaaatattataaattatgcaagtaataaatgtaaacattgttttaagaactagagtattgtgaataaattgctaaaaatttatcttgtgatttttctcattggcattagagagaagcagaaatttagaaactaattcgtatataatgtgtgtttgtataataaaaggaaactatgtgctcaggaacagtctgatgtcctcagaatgaaaatactcatagtaacagtaacatacatatatgtaatgtgatttataaggattgcaacattaaatgtttgtttgaattggcactagtaaattttaattaccacctatgacttctgacttctgtctattgatacgaggactaaaaggatagttaatgttattattagtattaataaaagtaatgtaagtttagtataagatttctaatctgttcaccatagacaatgaaccaaagaggaactactttgtgctacatttttatctgtctcagggcataggttcaagacaagacaatttctagttttgtaaaatgaaagcagtgatacagaagacacctatttcattccctcagattaatagtatataatactatatattatatactttacacaaatgttagaataaaaatgaagaaatatttaaaatgataggctcactactatatttaatagcattaatcctcaaaggcagtatttaatacattaatttcttaatatgcgtgcattgtgaatacatgagaaaaaggaaaaaaattctttaaatgagttcctgcaattaatatcatcaaatgatgtaaattacagttttaaaacaaaaaagcccttaaagcgtgctatgaataaagtaggaaacaaattaaattttaatctttattattattaaaataatctttgcattgttctttttctacttgaagtttcagtggttttcattgatagtcataaactggagagaaacttgtgcccacctatgatactccagaggcacaagacgccaaggcttactgtcttccagcattgcttccattttatgtctggaggagataagatatgggtgtagctgtgaaggagaattggatatgcagacgattgctttatctttatctctgaatgatggacacccaagcagttttaagggagggcctttactggctctcatttgccttgtttttattaggagacagcctctctgggttgcaataggttgcaagttataaaattcaaatgactctggatgagatgctacctttcttaacttaatttgaattgttcatatcaggagtcctttttaaggatcagtcaataggggaacaataagacagtctatgaatcttcagcatgggttacagctggaggacataaaaaaggaggttggaagcactggacacactttaaaaaaatcttgtctgggttgaaaaatgcattttctttgtctaagtcacatgttgtattccatatttagctgtagtgttgaaataataggaaaaacactgtgtcttggcaggtaggcccctgctctgagctggacccaatggtcagagcacatttttgtttaacattcagagggctgtcaagatgaggaagtccattttatgggttttctaccatgaatttgctcttcctggccaactccgctcatgcctgtgaaaagaactcaccagcgtactggagaatgagatactaaactaggacaagagccgctgctgaaaagctcatggctgatatcaactggaaactaattcaaatgactcttacaataaaccagttctccactcactcaaagtgacagtgaagtgaaggaaatcatcctttgtgtttcctttgtttcatgcaatagtttgtgtggttaattcattatagtctttgttctcaagcgaaataaaacagtcaggtgaaagaagagttttcttccttgactttaaagtggatttccttttataacaggtaaaactcagctttcaattgtttttagttctgaagttaatagcagtagttctaggctttttttttttttttttttaaatcaatggcttgttaattgtcatcccagttatttacatgtgactatagagactgcattctcccagctgccaggccgccagggctttgccactggtataatttataacacgactaattaaaatgaatttgcttgcaataaggttctgtgtgctatttgtgggagaggagttattaaaattttcagtacagtaatagtaaacttgaatgcaaagtaataataatcatacatttttaattacatgtttaatacccatttggctaatgtagaactattctgaaaattacttgggatcagcacaatgtctttttgtgcttagtagtatccaaagacatccttctgaatgggcttagcaatatgcactgtcatcaagatacagctgtttgatgacagacacacagtgtgttcctatgatactttgcacaagatcagctatgacaaatacaagttcattttgcttattgcaggcaaataatgtcctttgcaggaacttggatggagccagaggccattattctaagtgaaatacctcaggagtggaaaaccaaataccatatgttctcacttacaagtgggaactaagctatgggtacacaaacgcatatagagtaatggactctggcgactcatactacatattgagtacaatgtacactacttgggtgatgggtgcactaaaatctcagaatttgccactgtgtcattcatccatgtgaaaccagaaaccacctgtacctcaaaagctgtcgaactaaaaaaatataaatttttaaaaatgattcccggctgggcgcggtggctcacgactgtaatcccagcactttgggaggccgaggtggacggatcatggggtcaagagattgagaccatcctggccaacatggtgaaaccccgtctctactaaaatacaaaaattagccgggcatggtggcacacacctgtaatcccagctactcgggaggctgaggcaggagaattgcttgaacccaggaggcggaggttgcagtgagccaatatcatgcctttgcactccagcctgggagacagagtgagactccgtctcaaaaaaaaaaaaaaaatatatatatatatatatatagatagatagatagatagatagatatttttatatatatatccaaatatatatatatttatatatccaaatatatatatatttatatgtccaaatatatatatatttatatatccaaatatatatatatatttatatatatatgagatttccattttccaccaactttcttttgaaaaatttcaagcaagactagtacaaagaacatccatatgtcctccacccaaatttatcaatttcttacatttgctcacttgctcactctccctccatcccctttctcattatatatattatatattaatatataatatataaatataaagtatatattaatatataatatataatatatgatataaacaaattacataatatataattataatgtataaattatataatgtattataattatataaatataaattatataatgtgttatatataatttttatatatctggctgaatcacttgaaagttatttgcaagatgtcatgatactttacttctaaatgcttcatcatatatcttctaagggcaaaatattctcttacatagtcacaacataattatcccatccaggaaatttatggtactgttatctaatacacagtccgtattcacattctttacagttgttcctcactctccactttgctccaggatttaatcaagagccatacaatacattccgatgacatgtccatttgatctttaatctaaaaaagagttttcagcctttgttgatatttatattctttatgttcttcaaggattgctcccagttgtaaatagtttctgatgtttgtttgtttgcttgttttctaagtcaactcctgaagaagcatgtatttatacacaactaatcttgaatgaagaatggtcgttgttaaggacttgatattagcaaactgtattcccaagctctttgctattttacccataatactgcaagacattttctccgactcatttggaaggtgtttccatttgtatctggcaagctattctcttagttcttaataataccgtcattgaagatcttctagtatgtagaaaagtataaagtgctattagtattccaaaggaaagtataatctaaatggtgaaaggaaatagaaacatgggcaaaatcaatacagctgaataaagtttaaagatgcagaatatgttacaaggcaggttagcattaattgctaaccaagtgatatagaacataagtctatattatctgtaatttacatagctattgattttcataaggataaggcaataccacttgtctaaaatggaaaagaattatgttgatgttagaaataatcatttacataagcgtacatgtgatttcaaggacaataagctaatgatggctcataaatatgcatatttttcattgatcaaaactgcgcagtaaacttctggtatctgatcttgtaaattgttacacaacattaaggtaattaagaagagaattaaggcaaataagactgcctttaaaacatacctttgcatggttcttcatcttgaattcgataatcacaaatgtgacaaatctctgtgctaagtttattcagtttaacagttgtaaattaaaaaaaaaatcctccattatgtttatcaagtcttccaagcttttattcaccatttttaaattatgtatttatttgtacaccatttaaaaaaattatatttttctacttcatgaccccagccaaatagcatacaatgtttaactccttacaaatcatacttatttctttatagtatattgacaagttttgtgatagatcttcttttagaattcaataacctaagaattaaaaactattttagagttagtgattctaacttcatgaatcttctgattaataagcttcctcaaatgcattttaagcagaaagaaaattgctgaatataaactaaaactgctcagagaaatgctttttattatgcactttcaaatgaaagtgaatgcacaatgagcccagtcctctctttagtgttcagtacacagctcagggctgtgtattaacccagtgccctctcctttctagctatgcaattagtattgattgactgatagatagcacacttgatgttggtggtcactgaggtacgtacacctctgtacaatgcccgccaggccattgtgtgtgcctggtacgttactgaggaataacaaaacaactggtgagtttttaatcaactgtacatggaatacaaaatgtggtctgtcttcctgtgtctagctacttttacttcgcggttttattttcccagtgatgtgtacactttagatttttttcccagacataagagaaaatgtatattgtattctacttgctgttttaagctttctcttaaaaagtctatacattatatttgtgttatttaacaggcccccatacatagcacttggtatgtttaaaacacctcatttgatgctttataaatatgagttaatttgaaggaaatcatgagcaaaatctcatgcacatttcttttgtgtatgaaatttagtggaggatgtttttgtctacatatcagcttgcaggacttctgctcaggccgcatcatcttttataatacacatgaggtccaatatggcctccttccaatctatctgctgggacaggaaaaggaagctctaaatatctcagcagtaactcccccattccctcattgccccagcccctagaaaccactaatctgttttctgtctataactttgcccattccatatatttcatagaaatgcagtcataccatatgtgaccttttgtgcctgacttctttcacattgatgttttcaagattcagccacattgtaggaattattttatttctttttattactgtataatattccattatattccacattttatttatccatttaccaattgataaacatgtggggttgtttctgctttggtgctattatgaataatgctgctatgaaaattcatgtacatgtttttgtatggatatgttttcaatgttcttggttatatacctacaagtggaattgatgagtcatatttttgagggactgccaaacagttttttttttttttttttttttttttttttttttgtgatggagtctcactctgttgcccaggctggagtgtagtggtgcaatctcgactcactgcaacttctgcctcccgggttccagcgattctcctgcctcagcctcccgagtagctggaattataggcgcccgccaccatgcctggctaattttttttttttttttttttttttgagatggagccttgctctgtcatccaggctggagtgcagtggcgtgatctcggctcactgcaacctgcacctcccgggttcaaccaattctccttcctcagcctcctgagtaactgggattagaggcacgggccaccatgcccagctaatttttgtatttttagtagagtcggcgtttcaccatgttgatcaggctggtctcgaactcctgacctcgtgatccgcctgtcttggcctcccaaagtgctgggattacaggcgtgagacaccatgcctggccgccaaacagtttttcaaagtggctggacattttaccttcccaataaatatgctttcatatttgaactgactgataaaatttcaacatacaaagcatataggaatttttacttcaagttacatctgaaatggttggctatatttaaaagtagatattctgtttttaacaataaaacataatatcttgcttttctatatgactgacattattatgctagatgacaactacataattattggcaaagcacaatttgtagaattacaggaataaaactgatggaagcatgtagcatttcattcttccaaagcccagaatggaaccaaatagcagattagttgcaatattgaggttgaaactcaagttcggtgcatgtctatttcctcctcctttcttccattcccatatcaaaataaaagaaaacaaacaaaatgctttttttttaataacttgtttttcagtgtaaggaaaaaatggtacagtgtgaaagctaaagtacatactagctgagaaaacctgacatgagactcattttttaaagtataaacctgtatagtagataacatttcttgaatgctcgctatgtgccagacacaatcataagctctttcaaggattaacaacacaaggctatgaggttggtattattgttctccatattgtacagatgaggaaataaaggcacatagaggcttagtgtcagagctaataaatgacagaggtggagttcaaacctaggcaggttagctccagaatctgtgttttagctgccattctgtgctgctaaagagcgtctgttaccaccattatcctactagcaactttaaatgcattcatgtaatcattggaaacttcacatgctatagtaatttttatgcagaatttcagtaaaatatctctaacatacaacttccagattcaaatttgcagatctaccattgttatctaaagggtgttttgattgatttgtatcttattttgtgggacagcaggattcagtgagaatttccacagggtggaatcagtattgagtgccctatggaagtgttaactccattccaatatccatagttcaagcaaattgttgtttcctgtgaatgttcttcaggctgttactatatgtgcctgtcatgtcattccatgaaaaaataatgctggccttgtagtttctacaaactttactactatgagtgtcacctctgagtttgaaatatttgaagcaggagactctataagttttcagagataaaattgtgtccagaaaaatatgtccccctttgattgacgtgggtgagcatgactgtgtatcatagattatagtattccgttcactcagtttcctttcaacaatgtctcatatatttcaaaggaaaatgttgccatgtcactttagatttaaaaggttgcagtgaatgatgttttcttaaataaaagggaggaaaaagtaattgtcatgttttgtagatttaagccctgtcattgccaaaatatctgcacgtgaaatcagtagatagaatttttggtagggcttctctgttgtctgaattcccattactggaaggaaagtatgagaaaaataaaatgaatgtctcatttttcacatgttcttcagtagtttggggtcactgtttggaaaatcttaagaaactgtgatggcttgaataagtagtagagagtcaatcactttaacctgtgctatttatctattttcttctaccatcaattcccactatatctttaagagaaaaatgcagcacagaatttctgacatagaccatgttgaagtaccatttttccccatccttgaaatctcaactcttccttaaaaagtgtcaagaaccaggtatggtggctgtgttagtttgttctcacactgctaataaagacatacccaagactgggtaatttataatggaaagagctttaattgactcacagttccacgtgcctggggaggcctcacaatcgtggctgaaggcaaggaggagcaagaggacgtcttacatggcagcaggcaagagagagtatgtgcaggggaactcccctttataaaaccatcagatctcatgagacttactcactatcacaagaacagcatgggagagacccgcctccatgattcagttgcctcccaccaggtccctcccacaacacaggggaattatgggagctacgattcgagatttgggtggagacacacccaaaccgtattagtggcgcacacctgtactcgggagactgaggcaggaggatccattgagtccaggagctcgaggctgtagtgagccctgattgcaccactgcactctagcctgggtgacattgtgagaccctgtttcttaaaaaaaaaaaaaaaagtcaaatagattcattctcaattttattatgtaagtattaggatgagatatttatagtatgatagaatctgaccaaagagtatctgttcagccataaagggagtatgtaataatattgtacgttagtgataatatcaccatcaaaaattatttctcagttttcctttgagtgtacatctgtaaatgtgtatgtttgtgtgcgtggcaagatttgcagatgccaaagtcctataagtgtccttcttcccatctttttatttgaacttctgagggtctgcggtgaaaggcaataaaagcccttaacttcattactgtactttatactaaattcaaacaatattgctttatttattttaattcacgtttagatttgcattatattttgtacaagacaatgggtagaacctaatttccagttttcactggagcagagggtggaaaggaatcagcagtaaaagtgagtcctgattagtttcccctcctcttgctttagcctttgataagtaagcgccttctactttcatttccaacagcgtttaccatagaaataatacagtgctcttctccatttgctgtggagccctgtggttcattgttattatttcctcaggaatccctttaaaggtatcctgcaataatgctataatctcagagtagctttaccccttgccacctatataatgatcatttctagttaaaaaaaaatcatgtggaagagagttgataatattacaaggagaagacaattttcctgctcaaaatgtgagaatttgaaataatagatgtggagagaaatttaagtaaatatacaattaactcttaacctacaacttcactgaaattctgaggaaatattccaaggctgcataaagtgaatgaagagtttcctaccaaatatttctccctcagtacctaagtaattgtttcttttctgaatcagttgcatacacagaagtagaggtggcactaaagataaagatgcttcgaccttgttctcaccactttttttcctgttggtttccagcagtgtcatgggctttcattacttattcaagaactggctgtgctgaacttccattgctactctgcctgtacccacatatttctgtagcttggaaatttgtctttgagtttatatagtgaggatcttttatctgtcactgtgcggtagctttagcataactgcatttagatttagagattaaggcttataacttaattatgaatccaactacatacgaaagagtttaatttaaatttaatattttgattcagcacagctcaactcatgtgttcttgttaaattgtctctcattgaatttttccttgtcattaccttggacatcagtgcttttccagaattgcaggctgtagcaaaataacaacgcagacttgacttctgtctgagctaatcttcagaaagggcacaggctaatggtgacgtagacatctttacagtttgtctgtaaatgtgttgggtgggtgtgtatgtgtgtgtgtgtgtgttcatgtgcatacacagacatatacacatgaatgtgtcttgctatgctaaggcctgaacaaataaaaataatgtcaaataaatatatttacaaagcctaatctgaaatgataaagtagatgaaatttgagaaggaacatttgtggtctcccaattttatgcctcatgcacatgtaactctatatacatatatagagggaacactattcacacaacacatacaaatatacatgtaacacttataacagtgtagttatgtaagtgtttagatatgagaaactactatttataggaatccttcagcagtatctttcttgcctcctcttcctgctcttcctcctacttctcttcctccttcctctccgccacccccctccccacccccgcataaaaagggaatggtttagtcaggtaaataactaaaaattgttatttttttaaataggctttataaaggtgattttatcccagaaagaagtgtacttacacggctatgggggactgatctatgcatataaagcttttcattatcagtgggaaatttccatttgtaattatgtccatcacaacatcagcagcaagagcatatataatgtttcaaaggttagttaaggagtgtttgtgcattttgtatataattagacaaagaagtaattaatatagacttggataacttgcttgcataaacaacattaaagcaacaataatgaacactttaaaatatacacgaatatcatgttaacgtatcaattgccctacttctacctttccctagttcaaatcctaatttaaataatatttcagtgaatataatttttatacgtaaaatttcttcaatatacaaagaattgtttgttataaatttcagtgtcagaaactttaaactagaaatgcattcccatcgaaatagcgtagttaaaccttctctaccaagtactagtgagatgtttgtgtcgagaagacacagaggctgtgttggggtctgtctgcaaactaacattacacagggtagcttcatttggatgtatttttaaattagatccccactgatggtttcctttgaaataaaatgtttctcttattttaaaatgcttgaaaatcaacattataattgatggttaaatttccagtttaagcatacttttccttgttgtactacacatgaagtactgtgctttggcaatgaaaataatagaaaatgtgccataaaagtaattgaaacctaaacagaattgctgagtgggatttttgtttcatgtcttgagcatgttgcttaaggaaagcagatctaattagggaaagacaggaggcagatacaaagactttggtgggaattgtgagcagagaattggggcattttcaagggctatgagcttgagagagtcgttatatccgatttcactttccatttcctagttgttacttttgctacacctacacttattaatcatcattggggttgtttgggagcttacaagtgagttgaagagctgggtaaagaatagaaatttcctctgagttattagaggagcaaagaaggaaaaaaacaaaagatgggagatgggagaatggtgtgcttttgtgtgttaatgtgcctggggttgaagtagttacttgtgagaagcaaaaggggacaatagatcatatgctattgctcatccttttgtggaagaaacccatcaggtatccattcactcactatttactgaacagaacacattgtaagagcacagtgtattaggcgaagggaggtcactggtgaacaagagcttcctggagctttcagtctactggtatcacaagcatagaccaaagaagcacatatcataagtgctaaaagaggtagagcacagaatgagacctcatgataagggcacttattataatagtcctagatctgagggaacacttctctgagaaaataatgtttgagctgacacctgaatgctgaatgggagttaatttatgtgccgagagatgggaatagttcctgacagaggaattagcaaatattaagctgaggagtttgtgttgtattttataaatataaattaggacctactcttccttttgtctttccttattagtgtgataaaatcatcctcctagttacaaagccaaggactctgacagtaatttttgaccctactttctctgccaccttgcacccccgttacctttactctaataacatccttttgctcaataatttttttctctttctatctctaaatctcttctcctacactcaaccctcaatttaattcaggtctgagccacgtattgctgaactcacagctttctcacttccgctagaattgactttcagaagcatttgatcatgacattttcagtgtaaacctattcagtgacacagccctgcctgtagaataagacgcgtcagctttacatgttctcttgatatgatctggacccctcatctcctaccactttccctgtattcttgccacatgcacctccttgttctcttgaatatagcaggcacttagggccctgagtctctaaacatgccagcgtgccctcccttccctaatcatcagtcacaatttgtatcctctagcctgttgctttccagttatcatactcagaattaattttgcctccttccttgtaatcgtattacttttacctgcctctcccccttttcagcatttactttataactctgtcctatattgtagtgtcataaatcattgctctaactagagtttaagttcagtgaggtccaagaatttgtcttatttatttttatattttatgcttttatcattttccacagttggaaataaaaatttatagtcagacttttagcagcttcctggaactgaggcaatgcaggctggggcagagaagaaagttaaaggatacttggagaaacctgaagaaagtaatttagactattttatggtttatagtctctttttgatcagctgtgggtgccctcacaatattggttgttgagaatgatttgacagaagttatcaaaataaggagattcaaacttagtctatatgagaccaaatactcacattttaaacaatagacatttttagtaatgacatttaagctcctagatagctggatacagagccaatgttattgcatataattcaccaattcaacaaatatcagttgatgactcaccgggatcaggtacagttaaaacttgctctccactttggtcatacttgctttaattcattgctaattgagtcttaaggctcaagcagtgggtcttataaattcactggtctttattgttgaatccttctctaattttggcagtaatcacgcatgtcaatcttgcaatgaggagctatcggattttcaacctttacattcaagctcttgttttttcctgaactggctctttgtacaaataaaaacacactggcaaaataataaatgagaatccttttggacttttcagccaacaataaaatattttttataaaaatggaagtgcacaaaatggcagccatctgttgtttaaaaacaacagaactgtatttaagtcaattattgtgtaaggtctgtgccttgaaagcaagggcaaaatggtttatgttcatctcaatgggagaagattttgtgtgcttctttgtcattgtctatgttgatgtgagactggataactattactaactgaaaatagttaatcatatttaatcatggatgaggttgattgaaaaaatgtcatttttatttatgaactcacatggacatgtctaattggacaattctgattttctctctttattttgagtagctttaaatccagacatactagcctagcaaatccataaagaatctgtcatcatggaaattgctaacagagcctgaactttttcctctttccccccactcaaagtttgaaacataggcagattaatagagataacaattagaataatggtaagaagtttttttttcaaatgaagtacatcctaatgagagttaggtttttgctaaaaagtgtttttcttgatattcaataaaattgatataaataaattgtattgttaattttaatctttttttacttggtaaaaatgctttctatgtcagtcatctatattatgccaattcttgcttcattttcaatgtttattagagggattttataaattaatcttgttttcatttatactattgtataaatagttttcatttatactattgtataaataatagtattcatttatacgatatatattgtataaatagttttcttttatactattgcattttatgagtgaaatatacaatatatattctttggaagacatatcaatatcactattgcaacagatatttttccagaggttaacaagctatggctcacttacacatttcgcttaatctacattgtagtttgaaaacacacagatgtgaacatattaccaatattttgccaatataagagtccacatttctgtcttcttttataaagtatatgaggcaaacacaacatatccagactaggatgtagactgtaatttcaaaatatctaaaataggggagtgccgggggaaaatacgtcattttgaaaagatggctgtgttctctgtgtttatagttgaaactataaacctatttctacctggatgaggggtttataagggcaacattactaattttgagtctccacctctacaatgttagctccatgagcgcaggtattgggtacagctgaatcctccaatctaccgcagtccctgcctggcacataagtgatcaacaaatattttgttaaatgaataaatgaacaccctgtctctttttctttcacctaatcctggtatgtctttgctccaatcctctgccacccagggctactattttattagttgatgccagaaaactctccaatgagaatgtcccatgttcttcactgtcataccttttttagactctttgctatcatgccttaactaccaacagcaaagaagccaaaaattcagacactgagatgtggttcagccagaaatatttacaaatgtagaagtgagaatactaagccaaataacatttctcataataaaatgtagactgtaggataatattaaaacttcaaattgtacaggagagataatttgggggaaagagtgtagcactaagccagtgcttctcaaacttaaaggttcacatgaatcacttgggggtctttttaaaatgcaaatttgtatttggtagatctagaatggatcctgagaatttgcatttataagctctcagatgatgctgatgctgctgatatatggaccacactttgagtacctcgatattaagcaactgtaaactatttgtttgaaaacagccatgatttgaagctatacatgataaaatcgatgggcatttatcaacctgctgaaaaaacttagatgtctacaaatgtccaaatgggagagatacttggagtaagaactttgtagtggtagaatggcagggacctgagatatctgttgcttcaatttacaaactgggattctggaccccaaagatactcaatgacttacataagaacccacagctatgttgatgctgcacccaattggaaccaacgtttatttattcccagacccatgctctttaaaagagatcatgcacatggacataaagaaggaaacaataaacatcaggacctatttgagaggggagggagggaggagaatgaggatcaataaactgcctataggctactatacatattacctaggtgatgaaataacctgtacacccaactcccgtgacacgcaatttaaccatataacaaacctgcccatgtacgccctgaacctaaaataaaagttggagtgaaaaaataataaaaaaataaaacagatcatgctgcctcttggctattgaagttatagtagaattccttcaataaaacacttaggaagttgttgtactataaaatatacttaatttcacttaatattgagtgcttcactaaagtcagtcaaaatgaaaggaagtaatgcattcgcttctcatgagttgcatttcttgtgggtaacatatattaattttattataatttatcttcattagctattgaaaataatgctaaagacatttagaatgccttttagcgggcattactgaatattagatgatgaacagctttgttggaatagtttgtttagttcctaggagaaagtttgatttgacgactaagtaaaaaatttaggggaaaaaagcaacaaaaaagtacccaaaatcaatatcactacgtttgctgacgaagggtgtatttttagctacactgattttttaatttaaaaaaaatctacacggatccccctcaactccaatgtcaagtaagctcaactgacattatcgaaaccatcttcctttttattatcaaaaccatcttcctttttactgtgcatgtgtgtatgtaagtgcaagtgttacaaattcttaaaagaagataaaagaatgatttttcctcattatggtgtaaaacaaaattaaaaattgaaattatctaatctgcataaattagacactttatattacattggcagttttatcatatttgaaacattttgttggtctcaagatttaattagattatgtcaccaaatcagagaccacaaatatccatgggagcttaatagaactttttggattttcatgggatgaaaacagtattttcatgaggcgcagaattcatcatcagcttctcacctccattctaccctcagccttctatttccctgacccacattagtgttatgagagcaacaaatggacgtttcttccaacacaggttgtaagaaagtgctgctatcatgtgaggagtataaagggaaaatcaggcagcataatagctgagctaattaggctcagaccattaaagatcttataacggttatattattgttgttgttaatatcacctgagtattgcctcacagattacagaatgcctcctcatacattattttatatcacagattataaaaggctagcattataaataataatcatattaaagagtgttattttaatattacatgagacattgattttcagtgatgccatgtgtttccatagtgactatgataattaattgctataaaatcacaaacagtatttccttttgagagttgacaacagatgctggcattttaacaaagagtatattaaataatccacagcatgcccagaaaattgaaatgattaccatgaattaaaaaaacccacaaaactcataacaatgcttggtgatacctagaatattctggttatctgtaagttttcaagaaggccaagcaggcctctgtcactgttctttacctgccaatcacaccgataacttctatgagacatttctgtctttgagctaatcatcctctttttaacagcatacgcattccaacaggcatggaaactataatgtattaagccattttatctgcaattctcacttgttgtgatttagtttaatctgttttctttggttccaagtataagccaaaatcaggacacagagaaggggcatcttgttaataaggaaagaggatgaaatggcagaaaagtagtgactccccaggtgcaaataggggaatatcaagatgtgtcaagaaatgaataggcagcccaaaagccagatttgtatggaaccttttctgcctttgtgcctgaataataaccataattcctaaataaatcatatgactacagttgaacagtggtaacttttgtgtgtagaatgctgaacttctaaattatttttatactcttcgtcaaatgcactttaaaattaaatagttgttataatatagtatgccagcaaatcccagattgtcttgcagagtgactcagaactcttgaaaggtcactactttcgaacttcaacatccttaaaatcacttgaaaactgactgctgctggtgtatgtgacttgaaaatatattttgttgagaatatacaatgtttcttgttctgtgtcaattggctacccacattcaaacatttggagacctcccataagcatccatttttcttttaaaaaactgaagatctagcagtattgggtccacgttctgttccagctaagtatcactacctcctttggaagggatttttcctttccagtctcccaggtcttggtaaacctctatcttccttgaatacaatagatctggcacctattggcattcagtgtagaagaaatggcattcctataatttgatcaatgcactgattgattggttgttttagaaagagctgaatgaaacatttcagtttcgttgttgatccatatctatctgtctgtctgtctgtctgtctgtctatctatctatctatctatctatctatctatctatctatctatgtacctacctacctacctacctatataggtaggggaggagagagagagaggcggaacataaatcatggtgtaagttacacttttaaaaaatggaccaatttaccattgtacaattgtaaagactgcgttgaagcaattttaaggataattcagaacatatttttctaagtaaagttctatgtcttatgagagtagaaagcaatgaagaaatatacatacattttgcgtaacctagtggcccttaatgtataaatattgcatgtttaagtgaagagtcatccatcaagaatctaatctataccagaagtatacacttcctcttttatactttgtactaaagatataaatatgacgtgttccctagttctctatccattacagagtctggtggataaaaattaaaaatataatcttaattaaaatggaaggggatgaaggctataagacagtcaggtacacacatactatatggaaaaactgggcagaagtaattctgtctcatatagtctgggaaggtcccatagaagtggtcatttagctgattcttggaaaaataagtagtaatttatctagcaaaggatataggaaaaagcattataatgagaggaaatggcataagcaaagaccttgacatgtgaaagttgattttatatctataaagatctctgactgaggaatattgttggaaatgggggatagtgaaggcagatatatgtggaagataaaatgggttgatcgtgacattttttttttttttttttttttttttttttttttgagacggagtctcactctgtcgcccaggctggagtgcagtggcgggatctcggctcactgcaagctccgcctcccgggttcacgccattctcctgcctcagcctcccaagtagctgggactacaggcgcctgccactacgcccggctaattttttgtatttttagtagagatggggtttcaccgttttagccgggatggtctcgatctcctgacctcgtgatccgcccgcctcggcctcccaaagtgctgggattacaggcgtgagccaccgcgcccggccgatcgtgacattttaaagagctttcttttccttttcaaagagcttgggcattttattatagacaataggaagtagaaagtggttttacgggaggctatgaaatgatccaaaaggcaactctggctgtagagcagagtcctgattagaggagggaacaaatgaagtcagggagtttattaggaggctttaggaattggccagcgggagaggctgtgagtaagaacgaaagtgattggcaatgggaaggaatcagaagataaataactgaaagatattactgatgaagaaactttccggattggatgtgggcactcagaggatgagatgagttggaggtcggtagtctgggaaaaagtgaagaaatcatgccaaaatcaaaatcataatgtctagaaagggaagtattttccgcagcatggataacagtccctgggtaatgtataaattctctgtcataaaatactatctcccacaaatgttaattaagtatttgaaccaaaagttatttggcattaattgtgatcactgctattattgttattgttgatattatgagaagtagtatttagaaaatgtgagcaatctcatgctgtatatgcacactaggaataatgctaaaatagaaaccaaactaaacaaaaataagtaagaacaaaactccgatttaattcaagaaacatgcagattcatttttgcttggattttctttgttattctaaagaatcatgaaccaatttttttttaagtcctaactattgctatcctggagaacacttcaactacatagagtaaccatttacagaatacagttgaagtctacagctgctctggaggataaatgcctatttcttttaaacgttggctgaggccctctcgaattatatacctcacatgtgctgtatttacatcagaccaccccaaacatgctttccaaattaggttaaaatctgtgtcaccattttcatgtaacatagaaacttaattttatttatagagattttattcattttatcacatagttactatttgccttcctggtttatgattccagtttctttggaattccacttttatgtgactaagtaccctatgtgtttaactctactagatatcccatcactaaaatacaaccataccttgggattattcagttctttggtaccccactatacctcccattaggtgagtttctaatgcaagatactgaccatagtatgatgcattctgaaattgccttggctattcatacacaggtatatgtcttatatttgaaatgtaatagcattttgtatgttataagcatgctaatttgggggcctatttattgtaggagtagcaaaaaataagattgtacttttgaagactatatgtggatacatagtatcatgaatggctgctctattttgtcaaattcagaattaaaataagatttaaataaaaatagaggccttttcagtttatggattttcttattatcttaaaaaaaaaaaacatgatagtgaggtttccagctgagaggaatggttggaaaaacattttgttccagttagttaattcttccctacatgtgctctattcatcgtatccattttaaaagcaaatgaaccatctctatctcctcttgcatttgtggcaaactcttgctgtgccaatttcagattacatgcatcttaggaagaataagatgttctaatcttgattataattttaagttaaaagaataaaattagttcaatactaagacattgatacgttgcagtagtcagactgtcattacctcttttgacaaaatagaaaaacatgtctatacacaggataataagttcctgcattaaaatgcataatactataaatgctactagatttcaacgcaatcaagaaatcagtttatggaagctgaaatttgttaataaatatgctgctacttgagagtttaaccattttgcaaataattatagcaaacttccaacgaaattattttcattatgaatggagatactttccaaatgaggatataagaatagataataaacacatgaaaagatgctcagcaccattcttcatcagggaaatgtaaattaaaaccacaatgaaaaactattatacacatgttagaaaggctaaaatctgaaagactggtcataccaagtgttgtaaggatatggagcaagtagaacacataagcattgctgttggaaatgaaaaatagcataatcacattagaaaatgcttgatagttttttaataaagtttgatagtttttaaaaatataggtcatggacaaatagatgtatgctttacagatgctttatacatctatttacccataacccatagccaacattgtaatcccagatgtgtatcccagagaaataaaaatgtatgtcaacacaaaagacttgttagtgaatattcatggcagctatattcataatattccccaactcgaaatgaataaaacgtgcatcaataggtgaatggatagtggtccaaccatacaacggaacacaatttagcaataaaaagcaacaaactacagatatacataagactatggatgaatttcaaaccattctcttgaacaaaaaggccagacatagaagtacatacacattaatatgaagaccaagctctggtgacagaaaacagaccagtcatcgtctgctcatgggggaatcttctgagataaggggaatattttataccttgtagcttagaagaaatgttatagagccccaaacctgaacatggagaagtttaattttgaattatgagacaatctaagcattcaggcttcagagattttttttaaaaaggcgggcgggggggtggggggaggccacagtgtgggaacattggaaagttaggactagaagtctcttgtgaaaatagaaacaggaatgaatggaaaagcattcattcataccgtcaacaaccgaatagttgttagagtacaaatgatgagccagactgttccaggcattgagggtacagatgaagtacctggcctcatcgaacgtacacttacttagttgctgagacatacagtacacaatgtcaagtaaacatgatgaacacagatcagtaatataaaggaaataagagcacccagacaggaaggatggcacagatccatttttagagaaaccctggggaagggtgtaccaggtagaagaaagagtgaatgcaaaagacagagggtgacagagggtgacagagagctcactctgcttcagatttgtatgataagtgtggaaagcctacagaggcctgtttctgttggagcttgaaggctaccatatggtgtttgcattttaaccaaaataaaatggaaagctattgtggagtttcaagttcgagagttgcattatttatctgtgccttaaaaagatctcttttgtttaatgtgtggattgagggagggagagaggaagaagaagtagcaaataagctcgtaaagtctaataaaaagaaagcagggaggcaagttagggagttattgcaatgtgctggatagcaaatcagggtatcttgactcatcgaggtggcagtagggataaagggaagtggacagtttcaaaatacattttggaggtagacgtggaaggacttactaacaaataagatgtggaggaatgagtgaaacagacaaatcgaggagatccatgggtcttgcctgagattcttgccatttacaaagatggcaaggtctgggtgtataaggcagggatcgggtgaagagagactgtttacaaaggtgcagaaagtgtataaggagaacagcagtgatagtgatgtactcccaggcaagtaccaatgaggggtcattactatccttagaaaataagtagcaaggaaaatgaaccattagggtacttgtacggagaagccttctcctaggagatgaggtcttcagtagaggaacgcagcaagcccacagaaacctgggagaggagcctttgttcttatagctggggaacattctcattgaccaaacccaaccagaacctggagagacagggtgaatgaggggtggtgggaaatggaggatgagggggctggagtacttagagcaaatgagagtaaaactataagggcaaagcaagagacctggcacaatgcccatattctgaattctgtataatttaaaagttcagtaaacttttcctaacaatctaaattacagccaacaacatacaaattttgcaacaacatagaaacttttgttgccaagaagactaatttggaaggctttgctagttctatattagtaatgtgttattttttgaatacctagtagaggaagccagtcccctgaaaagtgtccttgtaagtagtcattatttagttaagaaataacccaccaggaaaaaaggaaagagaaattatgagatgcacaaaacctgaagacaactttagtgttatagaagatcttgagagtactagacagatggaagtggagaatgcatccgtttctttaccattaagaccttgcctaggtgtttttgacattttgagctgagataagagagtcgggttttattccatatgcttaaagtctttactaggtttgtcagtataacttaatgtttttagttaccacatgtcattctgttactacattttgctagaattgcctaacataaacagtatccttatgtttcataatacaagctattcaagggtcatattggctaatacaaactgtttagaaagtttgttttgccagaagtcactattgtcaaagcactgattttaatttttggtgatacccccatttaaaacagatatttaatgcttgcccagtatttgttgctcaatgatactttattgtctgttgctatgcactgattgattactgacagacagtaagtgcattggaagaaaccatgatttaaattgtgtgtgtgtgtgtgtatgtatgtgaatgtataaattattcagtgaagcaatagaatctgcatttattcagaaacaaagaacattcattgattccacaaagatttattgagtgactactatgtaccaggcactcttttagggacgtgtgctacgtcagtgaacaaaagagacctagattctcgtgcttgtagatataatattctagtaaggaaacacagacaacaaataatacatataataaaaataaatcatagtatgttagaaggtgatatatgctaagaaaaaaatacaacatgcacaaaatgaagcaatattcatcaaggtcatgaagcaacattatctgcactctaatctgatctccttgaattcataatggaagctgttgccgttttcatatacatcaattcttttttccctttcattttgtgataattgtacatatgtatggggtacagagtgatattttgatacacatataaaatgtgtaatgaccaagtcagtgtcatccatcaccttgagtatttatcacttctttgtgttatgaacattcaaaatattctcttctagctttttgaaaatatacattcaattatttgtaatcatattcattctacagtgctatagaacagtagaactttttcttactatatagctataaatttgtatttgttaatcaacctctacctatccatacgtcaatacttaaatggtcaaaccaaaatctttatcagaaatcactggtactttcatggttggtatgttaaagtttggatcactaaataaatttagagtaataggctgatcctaaaatttcattgataaacttgtcataattaactgtatttatgacaaagaaagcaaaacagaataatttagataattttataataaactagttcaggatatgtttatcctagctatatattggtgcatcatttgtcttactacatttgcatatgcttaaggcactgaatctggaacacaaaggaaataaatgcgcattgttcgttttttaagaaattctattcacatgggttttaatccacagagatgcctccttttagtcttgaatgcaaaaagaaattatcttttgagtgcgtgtgttagctttgaaaaaatacattcacatgagatttaattcaccttaaagtttcttttctattaaatctcatgaggaattgctgaaggaaagtttcatgatgccaagtcactaagcaaagttctccaatatgacagttgttagaaatgtgaacctagtgcagttgtccccttaagctatgggcaaaattcccagttttgaaccctgaactcattcagccaaaaaatctatattatgctagtgtctattacatgtgacttccttttgaccagctttttctatgtttagactctcacttttattccaaagtacactggaaaatagaaaaaaatcggataattctgttctgggtgatcagtaactttggaaaaattcaatttgtttgttttttttctggcaagagtttgaagtaaaacaagtttcttttcaacacattgaaacaacctattttctccagagcaatagagtttgcatctgatatcagataagtgattcttgtaatttgtctaggctttcaacaaactggtgaaaaaaaaatctcctttcatttactttccatctttcttcatgagtttcttttttttttttttttttatctcaaagtgttcttagagattgggggttgactatctagctcataataagaatctaacagaaaacataccattaagcatttgagcttctcagatcaaaatcaatatttaagaccaaaataatattatgcaagcttttctgatcataaaaagaaagatcgttagtcactttggacagaatgatgatatctttagtcattgaattaaaattcataagtgtaatcctcctgatgaatttttctctgtctggtatttttctatcaggtttataactcatgaggctaaagcaaattagtgtcaacgttttatcatgaccatttactcggtgcctttctgtttctttacgaaaataaagttgctttttaatgttttggtaaatttatataatttctttggaaacatcaccactaggatttaccatgaattacagcaatatacttagtgctgcttagaaaatatttcatccctttccctgttttttgtgtaggtttatgtccttttaatttctgtttaattccccttatttaaagcctaagtctcaaatattcatgattcttattgcgaactataaaatatgtgcttaatgccattatccttttaaaatcatcttgaatctttatagtttaatcacacatcttgcctgtaactaaatttaaaactctctggtaaaacaaaatgcctaaacatcttgtataatgatatgcctttttagcaatggttacacttctggctttataaaactatattacttagctttttaagttacatatgtccattatatgtatctaataaaattaaaccggattttagatattgaacatttttaaagccaacaaccttggtgctatccttggtttttcctctcctactgcctctgatatctaatccatcaattcctattagttttatctcaaaattgaccctgtctctgtccataagtcttctgtcagcctctttattgcaagcttccccactggtctctcattcattctccacacagcagcgaaagccactactttacagtaaatggtgtgaatcattcttctgcttaaaactgctcaatgacttcctggaatcaagtccaaactccttatcatggccgcctaaggccagtatatataactggaccttgcttctttctctgatctcatgtcctgccacttccctttcgggtcgcgtaccaagctcattttcatcttggaaccttgactcttggtcatctctctctactccaaagctctttctctgcatcatggtttctgccttctcatctctaaggtctcggatgccacctccctaaagaaaccatcttgcccgatgtagccccaagtcaatctctcttaaatctctctattctatttattttataccagggagcgccatctgaattacttgtttatttatttgtttgcttctccacctcccccaaccccattacaagtttcaaaagagctcctatctgactcagtgcaatatccaacatcctaagttggatcctggtgtataattcatgctgtttacagatttactgaatgatagtatattaatatgtcaagattcatggcaggtatcaaaaaattaatttattgaagcattcagtctcaaacattttcttttttttctttttatctttttttttttttcagatagagttttgctcttgttgcccaggctggagtgcaatggcgtgatctcggctcactgcaacctctagctcagagttcaagtgattctcctgcctcagcctcccgaggagctgggattacaggcatgaaccaccatgcctggctaattttttgtatttttagtagatatggggtttcaccatgttggtcaggctggtctcgacctcctgacttcaggtgatccacccgccttggcctcccaaagtgctgggattacaggagtgagccaccatgcccagccttcttttttttttttttttttcttttgaggtgagtctcgctctgtctcccaggctggagtgcagtgttgtgatctgagctcactgcaacctctgcctcccaggttcaagcagttcttctgcctcagcctcccaagtaggtgggactacaggcacgcaccaatacgctcagctaatttttgtatttttttgtagagatggggtttcaccatgttggccaggcttgtcttgaactcctggctcaagtgatttgccctcctcggcctcccaaagtgctgagattacaggtgtgagccaccgtgcccagccatgtctcaaacattttcatcttgtgaagctatttaagtttcctgaaaatcacctcactcttcttgtactcctcttccttaaaaccaacccaatggtctcaggcttttctgctcattcaagtcacatttcctcccagtaaacttaattttggtaaaatattcaacagttcaggagagatacataaatcatgcttgaactgccttgcaaatagcaaaggaactgactggccatgtgctatgatttcaagggttttgggaagcatctacctccaactactggtcctcactgagtcttgaaatcccacatttagagttttaatttcttttttttaaattaaacaacagaaatttattttctcacaattatggtggttggaagttcaagatcacagtgttggcagggttggcttcttctgactgctgtcctcattagaattttatttaagttttgactcatgttaagatagaaatactctcggaatgattaatgctttaaacttgtccagccacttagatgtaaggtctgaggatcttaaaaggtattttgggaaggaaaaaagagcaaacgtcagaataccaggaatctaaaatacaggcagaagagccacctggagggtggggaccattcggaaatcctgatctgcttgtaaggccggtgttagtctaacctatagcattctggttcttttctggctcggctcctactgtaaatttaaacatcccatttaatcattatgcaaaaaaaaattaagagatttagctgggtgatctctaaacaattctagatcagtgattctatactccataattttattcacaatcaaccctttctactactcacagatgctagaaaatattagaaagcagatgtaattaaatgttcacaccacaaaaatgagaactatgtgaggtaaggcatttgttaactagttagattgacccttgcacaatgtatatatacttcaaaacatcatgttataaacaattaaaacataattttaaaaagccagtatgatttctacaaatacaataacatgggaccaaacagcaacagacctcgagttcaccacatattttatatatttataatttcacatatactcacagtgtttcattccacatctattcccaaacttgaatgcatgtgcatgcacaaacaacatatacatcacctccttcactgagaaattacagcaccattatttattcaaaggcactaactctgacaagagtgaaacagaaggtacttctctattatatagtgtctattttctgattttctttgttatatttcattgtatttattaatattaggttaagcaagaatgtacaaagccatagcaggttgggaaggttatcaagagaccacctattctttttcttcaattcaatctcttttcagattaatcattcttggctattctgttttttaagtaatttactttttcttttcacttactcacctaattaatctattaacagagtgtcaacaattgctgtttcactaaaccagtaaaagacaactgctttggtgataatgttttattttcaagcaggtcatgattatacttatcacattattacacttactacatttattacttatcatatttattgcaataatcattatcacaaaaatgatccattgattctaactctcaggaggcactcaataaatatttagtcaatgagtgaataaatgcaatattggaattaaaacatactctcaacatttcaaccaaatgctttattacaaagcatgggggaaggaagcatagggttggactttgtgcactgaaacagttatatattttccgtagcactaaatctttttctcattaaaatgcatataatgtgcagctattgctccaggaggacctgctgtatcctgttaaaattaccgtcaccaatctgtggattagctaacagtaggggaggatatggctgatgtttgtctgtgtgtgtgtattttgatgattgaagaaaagaagtaatggggattaacattctgcttttacaagtataattgtaagtttaacacagggacaactttatttttagtgtaatacatctgtgaattatgaattatgatatgttcaggtcatgcttttttgcattcattttttacttttatggagttggagtaaactaacccaatctatgaatgaaattcaaaactgtacttgaaaatgaaggaaaacggcattatttttcaaatattgagtataaattatcacaacttcgttaaaaaaaaagatactttagaagtatacttaacttagtctattacttctccaaatagatgttttaaatgttttaagcatctgctgtaaaaattaacctaggccaatttggatattcagcaattatcacgttattagagcaaagtttggtagaattctacaattagagacaggtggatgattcatggcaaccttttctccataatcttgctaccaggtggtatgctaaaattaaagcaagcctgagattaaatagaccaaattctgtcaaatgtaccaacatttagtcgcaaatagggcacaaaagcagttattgaacttaagccttcaagttctcagtctcaatctgtaggaacttccacaaatacccttccaagagaggttcattatgaggaagatcagccagccttctgagttacatcagggacagaatcttccattaaatcgaatagagggtagaccaaagggagtttagacctagacctagtgtacttacctgatggtattagacttctagccttgatgagtcttatgcctcattcatgataaggctcataaaatctatatagcaactgaacattttgaacaccactcatttcatcaacaagtaatgatttcaagcatgccttttgtgaattaatgaaacctctctgtagattttgataatgatacttgaaattcttgggtggcatttttagagtacagattctggattagggaacataaaattctaaccaccttaggagtaggaatcaaagttaatatacagatacgtaacttacagtgaagtattttaaagtaaattagcacatctgttgcacaatagctttccggataggtttgaactataatgttacatccacattacggagatattaattgaaataagtaatacttcatagatatcctatacatgttatatatctatatctaaatcatctatatctatctattacatatttatcacctatttacctatctctatacacatatcattgtaggagtagaaatcacagaaaatgagatcatttgaaccaatggcctggtttgtgtcatttaaataatcttaaatttcaaccatataaactctcagatactcaaataatgcaaattctgcaggtatctggagtaatcgcttccaacattttttgtttttgagacagggtctcactctgtcacccaggctggagtgtagtggcacaatctcggctcactgtagactcaacctcctgggctcaagtgatcctcccacctcagcctcctgagtaactgagactacaggcacgtgcctccacacccagctaatttttgtatttttagtaaagacgggtttgtgctgtgttgcccaggctggtctcgaactcctggactcaagcgatccacctgcctcagcctcccagagtgctgggattttaggcatgagccgctggggctggcttctttcaacttttaactctgttgactgcatataactttttcatatttaagaaatgtgttggttgttgaagaagaccaagtctgaactcaaactgggttcttagaaagctttgaaaggaaaacagggacaaattaagtgtctgcctctgcccaaaggggaagtccctaaaagagaaaagtttaaagacatcaagaatagttctgatgcttgcctaaaagttaagtctagaagtagagtaataagtaaagtttcttggaaccttttcaatccagctagagagatacattatgaccactgataatggtgtgctttctacctctcagtttaccctttgtaaataactcaaatggtttgctttgaactggcatatttatttattttccctctgggaaaccacctctactcatattcccgaataaactgttttcctataatcagctatgtatgaaggctttagatatcaacagaactttccataatatctcttttaaggtgaaaggttcagaataaatctacctaagattaaatgctccttaggtggaaccactgagcctcatgctacctacatgcctatgacaaacaaatttttatttcatatgcatactctgctgaacaatgacttatatatccaaatacctactagaaatctactcctgaaaatccagcagacaattcaaccacaacattcaaagcaaaaataatggtttcttgcccagcccattcttccccatctcaattaatgtttgcaacacacccactgtgactcaagccagatacctaagagtcattctctatttctctccagcccttatacccaacagccaatctatcatcatttcttgtgagttctacctctgcagctattcttccagtgcaagcctccatcacctctcacctagaatgttgtatttgttatattttaggcctcctttctttctactctagctctgtttctttggtcaacacagcaaatgaatgataattaaaagaaaatgaaaggatcatatcacttccttatttaaaactctcttttagcttctgtctaaacatggaaggatcaaaatccctactaatgccctgcaaatcctgcatctccaatctcagtttctcacatcccatcaatttcctgttcactctggccacacagtctttcctcttgtttcaaatggaaaattgacatagcccaggcttaggagctttgcactcactgttgcctctgcctggaaaactctggcctctgagagtcacctgtgtggttccttgatatccaggtctcagctcaacttttacactactgtgagaacatccttaccaccttttcttaagtagctcagcaatgcccccaggcaggcactctctgcatccttaccaaccttctattttccaggggattttttactaagtaaaagtttcttgtttatttagttgtttggttactgtccttctactctaattataatgtaaattccctaaagtcaaagattttgcttctcttccgttgtactctacttgccttggcacatggcaggagcccaatgtgtttcataaggaaattaagattcctacctggtaaggttattctttcaagaaaaggagaatccaagtgacctttttccaaagtggttgaggtccttggtatcttgctgacttggcagaactgttctgagagcctcagaaattgaaccacgttatttaaattcaactctgaatgtaaagagtcaccaaggggccactaggatgaatcccagcatctctcatttcctcaggccccctcatccttctgtttgttaaatcaatgctggaggaagatgggtggcatcacattcaatgacaaggatgccctgtgataatttgcatcatctccaaagaggattaaaaggggctgggtgcggtggctcacacctgtaatcccagcactttgggaggccaaggtgggcagatcacttgaggtcaggagttcgagactagcctggccaacatggtgaaaccctgtctctaccaaaaacccaaaaattagccagtcgcggtggcacacacctgtaatcccagcttcttgggaggctgaggcaggagaatcacttgaacctgggaagcggaggttgtggggagctgaaatcgtgccactgcactccagcctgggcaacacagcgagactccatctcaaaaacaaaacaaaacaaaacaaaaaccaaagaggactgaaagggatttattaaatctcagcgccccaagccagtggttctcaaagtgtggtccctgggccaggagcatcaacacaactaaagaactttgttagagacacagattatcggggggctcagccctgacttggagtatcagaaactttaaacctgtttgaacaagctcttgctaaaatatgagaactaccatgctaagacaacagtgccaaccttgattgcaccttatgattacctgccaagcttttaaaatttatcaggcctgagcccctctgctacaagttcttagtcggtctgccgtgagtgagatctctgtattatttaatttctactaagtgatgctgatggagctccaaagtttagagtcattgccccagtgtgggagcagggtaacttcaggtttatccaggtactttgtagattttcatcctgaaaagaaatataatttggaattcaaacatggcttgcctctcggttttatagtaggagagaagggaaatgacttggcctaaaacacagcatatggttctaaatgctagtgttgtatagcctcatccaaagcatcaactcatagagaagtacattaaagcagtgtaatgttcaaaaccaagttccatagtaagcatctgctataatagaatgacttattccagaagggaagtttcatttcaggagagcttatcatgacatcaaatatgttttgagttaatgaaaatgcaggaagcaccaagttaatagggcaattttaaaccataaagcctaatttaactgcgctaagaatgacaatataatgctctgcacaaaaggaagtttcacaacctgattgatcaaatggagaattactaggatgctggatcgcatcttccttgaagaagctaagttgactaggagaggcagacttccttagaatgcagttatgtacttcttaattaaacaaagaatgattaaaaagagattttgctttataaggccacagaacagcttgtttgataaaattgttataagcctccagactttcatttctactttaatattgattccattttcagaaatagttaagtagaagttattcaggttcttctttatatatttgcttttttagttgttgttagacgtaagataaatttgaaatgtcaggaaggagaatgtttattttcacaataaaaagcttactctgtgtaatattgaaactatccattctgatataagataatgttttattttggctgcttaatttcaaattgaattatttaatagaacaattaaaagtcaatacaaatgaaacagctacttgtttttctcagtttatggatgttttataaagtgtaaaagcagctgtttcgttatacttttcttgaattgaatagccataagagctttcttaaaatcatatttgatccatagctctttcttttatagcttcttctatataatttacttctaagtaacatttcctttacatataaaaattgattattactgtcttgtgttaagaacttttcctgggtctccttaattcatcagaatgccaatattacgattagcaaaaccaattaggccatttatcgcagagaatattggaaatgtgctatatgcaaagcattgttttacaagtagttcaacattctaattttgaaattagactaagagcataatacatttagaaaatgtggatagttaagtttaaatttaaaataataaaaagtcaagaatattacaattttacttcctcagtcacactaggcacatttcctagactcaataggtgcacgtggctagtggctaccatagtggacagtgaagatacagaacatgactatcatcacagaaagttttgttgggcaggcagtgctgtataggctagttagtgaggaaatacatttttaaaaagcattgttccctggggcattacaggataaatttaagaattctgtttcataaggaaatattatgccacacatggagtctttcttaaaataactgaccctctagaagaggaggcctaagtgtacaacctgttcatttcctatcggagttggttgcctggaaatgttgtacatctcagtttcatagcaaggtcataaatgttttgtaggccgtatcctctgttctatctactatccccacagcacaaagaaataattatgtgcatagagtggacacccaatgaatctttactaaaagcaccaaagtaatatgaggcaaggagatactacacagatttcaacctttgaacttgaacagtagtttgtaactcctggcccagtctagtactagattgtagggtcctgatgaacaactgtaggccaggatctccctctgtttcaggtgccttgtggtaaaatcacatgaccactgaaccctcaaccactccctgaactagatgctaccaacaccaacacagaacccctttccccataattccttccttatccctggtccaggaccagccaacctgaacatagactgacaagcttctcatgattcaattatctaacttaagttaccatatgacttccttcaacaaaagttacccattttaaaatctctgtttctttctgtattataggagactcatatcccaaatacacacacacacacacacacatgcagacacacacacaaacacacacatttatatatatgcagaaaagcaatgataaaatctctcctgccaaattagcaatatagttttgtttcaaaatatttatgcataaatttcataaggtattctgacttttaatttgaaatttaattcaataaagattacattagtcagaaaaaactcatctttggccaggcgcagtggctcacgcctgtaatcccagcactttgggagaccgaggtgggcggatcacctgacgtcaggagttcgagaccagcctgaccaacatggagaaaccccgtctctactaaaaatacaaaaaaaaaaaaaaaaaaaattagccaggcgtggtggtgcatgcctgtaatcccagctactcgggaggctgaggcaggagaattgcttgaacctgggaggcggaggttgtggtgagccaagatggcaccgttgcactccagcctgggcaacaagagcgaaactccgtctcaaaaaaaaaaaaaaaaaaaaaaaaaaaaaaaaaactctccgtctcaaaaaaaaaaaaaaaaaaaaaaaaaaaaaaaaaaactcatcttttaatgttagtttataatttaaagacacaaaaacagcttcgtttctagattcaagcaaggcatgtatttccaaaatatctcttcatgattgccccaaatactggatctcctttcctgttggactgtatgtatctaaaatgtacagagattattgaaaaataagttaggatagggactattaacacaattttgttctgaaaatcttcccttaatacatcacatgggtttttgaggcagatgtttggagggcatgatttttagggcagaaccagcacaagttgcaagcaatgcctggacacctgttgagcccttctgtgccatctgcttaaagggaagtacacataaccttaaaatcgttgctgcttttggaggtcattttatcaggattgagactacatcccccacaacccacaggacttaaaaagagagagatttatctcagaagggcattgtctctaagtgtgatcttcatttttatgagctgagcttgaagtccctgacatttagaaatgatagtgtgttgatgtgaggttctttcgaataatccttctaagttttatcagctttgcaaaatgttactaagtgctagcatttagtttgtgaaatgttttaactattgagaaggtgatgttggtcagtccttaactaagatcgatcaaagtaagttcagtaggtgactgttttacaagtggcatggtggtggtgttcctcaaaggttttggagagatacaaaaggactctctagttgtggttttaagttatatactcagttttatatcctgttaaagtttttataccatattttaaaattgctgtttggaattacaggaaatgtttaattcacaaatcatttatagttacaggaaatataattctattattgatataatgaattgaatggtttttaatacatcgtagttttaaacacttaaatattcacgagtaatatttgggaactttaagaatagcatccaaaaggtctacgtgttcatgtgtatgtctgtgtttgatttggtgggggccattggccaaagtttgatcccactcatttgaacagcttgctcagtatgtgcatcattggggaaaaaaatcggcatggagcgttcggtagctagcctctagtagaattatcagaggaaaactgtgatggtgaaactgagaatttgaaaagccagattgatgttttccaagcttgatttttagatgagaaagtaaaagagtattttgatttaacatttgaaattataatattagtagcaataaaatataccagtgcttctcaaattatctgaggtggcagaccaggtttttaaaaatttcattttgctttaattttcaatctctcaaggaccaatactttggtaaaataccataaatatcaataactagaaacaacgatgttaccaaaaaaaagacatacaaaaatacaagccagggcttttaatattttttttcatttaacagatattatcaaattgctgtgaaatttactaaatgttcactctcagtttctatacttttattgtagaacaacaaaaggaatttgttaactggctgtgctctgtaggctttttaagtagaattgctctatgtcactgtgcattaaattttgtgtttggatgtatcctaagcaagctatgaggtctctgaggaaaaaattatatatatatatatatatatatatatatatatatgtgtgtgtgtatatatatatatatatatgtgtgtatatatatgtatacatatatgtatacatatatgtgtatatacgtgtacatatgtatacatatatgtatatatgtatacatatatatgtgtatatatgtgtacatatatacatatatgtgtacatatgtatgcatatatgtatacatgtgtacatatatacatacatgtgtacatatatatgtatgcatatatacatatgtgtacatatacatgtatgcatatatacatatatgtgtacatatatatgtatgcatgtatacatatatgtgtatatgtatacatgtatacatatatgtatatatgtgtatacatgtatgcatatatgtatatatgtgtatacatgcatacacatatgcatacatatatgtatatatgtatacatatacacacatgtatatatgtatacatatacacacatgtatatatgtatacatatacacacatgtatatatgtatacatatacacacatgtatatatgtatacatatacacacatgtatatatgtatacatgtatacacatatgtatatatgtatacatgtatacacatatgtatatatgtatacatgtatacacatatgtatatatgtgtatatgtgtatatgtgtatatatgtatacatctatgtatatatgtgtgtatatatgtatatatgtatacatatatgtatacatctatgtatacatatgtgtatatatgtatatatgtatatatgtatacatatatgtatatgtgtgtatatatgtatatatgtatacatatatgtatccatatatgtgtgtgtatatatacacgtgtgtatatatgtatatatgtgtatatatatacacgcgtgtatatatatacacacacacaatttatgtgcatgaattgtgtgtttttattttgattataacttttaaaaagtcatacaagtgtattctgcatcacttgactgaccaaaatgtacacttgcataacataagtgctcaagtttgtgtttatgtttacaatgaagtcaacaacaagtagcattactttaaatgtcagggtctgataaataaagaccagaggaagctaaagaaagaacatgatactttgaacaatcctctctattaaatgggaaaattgggctttagatctgagtgttttaatttctactttaatatgcttgattatagttttaagatgaatgcataccagaaatgaattgatttatataaatctttcattttaaagcagattttatcattttacaatgtgtgagaaaagaataaaatcagacccttgattgacactgttctttcaatcagtttatgaaacattttcctctgtgtctaccacttttatttgcataattaaaaattttaatgctaaatcagaaaccaaaaatggaatgtgcataaaatccccttggactatgagtttggagagttggcattttttctggcgtgatctgctataggcttactgttacttagggcccggagaggtgggtcagggaaaacattaaatgtattcagggtatgatccatattctatttttaagttttatgctgtttattttgagggaagagatactgatatagtttggctgtgtccccacccaaatcccaccttgaattgtaataatcctcacctgtcaagggtggggccaggtggagataactgaatcatgggggcagtttcctccattctgtttttgtggtagtgagtaagtctcttgaaatctgatgattttataaatgggagttcccctgcacaagttctcttgcttgctgccctgtaagacatacccttgctctttttctgccttccaccatgattgtgaggcctcctcagccatgtggaagtgtgagtccattaaacctctttcctttataaattacccagtcttgtgtatgtctttattagcagcatgagaacagactaatacagatacaaacatgtaaagtgcagaataaggtcctatatgtcaatgggccaacttgtgtgttttgtaattaaatatactagtttagagaaaaggaagctcaagctcaacatgaactggattcatcagtggtggtctcaccgaggaacatgaccaaacttcagtataaattgtgtttacatctcttcttaaaaaaataattaaatacatgttattattgtttgaaaagttatttaatactgagcatctacacattaatcatgatgaaaaaataatattaaacttttgtatgtcctgctagcttaggaagaatgacactgacaattatttcccttaaccattgtggtaagccaagtattagttcatagcaaatatttcatttgtagatttcagtttttttcactatttctacttttcatacaatatcattcttcaaatgataaaatagtacttagtgaaggatttgggagcatgttaaagttatttagcattaattgcagcattacactgggacacatgtacttctatttctgtaacatatcactcatcatttcactcagataaaggaaatattaaacattttatcagatggggaattcctggggtcacactgtagcagatgagttgggattggtataccttctccaagcttcctattagttacacacgcacacacacacacacatgcacgcacacacacacacactccagtttggaatctgtctagccaagaccacagtgcaagatgttaaaagcactccacttgctttgggcatatgccaggcctgaatgagtctcttaccattgggaaaacgatctatatttaaatttttctagatactatctattaaaattattctatattaccaaagaatggaaatattttccggaaagttcagagtagcaacatattccttaagcatgtttccacttcaaaagataaaaagtttagaagacatctccatgtcctcaaaaagaagtaagaaaacattataattattgattaaaagctgggagccctagaaagaaaccttggagatgaatgacaaggatacaaaaggatttgtcaaaatgagaaaagaagacaaggaaactcaagtacagctagcgatataaaagctgcattgaagtctattatagtcttatatgacagaaaaaggtgaagaaaattgtatataagtaaggaagaaatgtttatagatgaaaaattatatatatataaaatctatagattatatataatatatacaggaagagagagagagagggatggaggcagggagggagggagagaaatagagaatgagaatgtgatgaagggcagagaatagggatcagaaatacagctgattcagttgaaggaaccagaaaatgggagggggcaatatatttgaataaaataattacaaatatgtaataaggataaaaacataagtctttttctgttgctcttgctctatgtacatgtgagcacacgggcacacgtgcgtgcacgcgtgcacacacacacacttagaaagttgaaggctttgtagttaagtagggaatttgtagtatgtagggaatttcaaccttgattcagagtgacaggcaaagatttcaaatggaggtatatgtgtattcttcaatgggaggataaattgaaaacataagtaaggcataaaatgtatctaaaaaattttaaccttactaaattccaatgaaatccaattatgattttcttcctaaacttgacaaagttattcctaagtgcatctgaaaaatatagcaaagaatatgattataattttaaagtaatataggaggacttgccataccagataatattgtcatgggtcaatcatagtctttaaaacaatatagtactaacttcaggtgagcagacaagccaagggacataacagatggccctgaaattgactttatcatataaaaagactagtatttaattttttaaagtatcattaaccagtagggaaataaccatctaaagaatatatatctattagccatttacatatataaccaattaaatatataggtttgactatgtgtctccactcaaatttcatgaggagtcgtaatctccagtgttggaggtggggactggtgggaggtgattggatcgtgggggtggagttctcacaagatctggttgtttacaagtgtgtggcacctcctcctgcacttactcttcctcctgctctgaccatgtaagatgtgcctgcttcccctttgccttctgccatgatagaaagtttcctgaggcctccccagaagcagtcatgcatactgtatagccttcaggaccgtgagccaattaaacctctttactttataaattacccagtctccggtatttatagcagtgcaagaatggcctaatacaatatgtaactatttaaatatatacaaaatcattcaaatatgtatagaaccatttaaatacatatattaaattatatatatataatttttcaatttcacgtaatctagagagtttatattaaaattgaaacatgacaaatgagaaagctattggttaataaatctctagataaagcagaacttttcaagaatttttatttaaaaatgaaagggaaacactgggcatggtggctcacgcctgtaatcccagcactttgggaggctgagacgggcaaatcacctgaggtcaggagattgaaaccagcctggtgaacatggtaaaaccccgtctctcctaaaaaagtaaaaattagccgggcatggtggcatgcacctgtaatcccagctacttggaaagctgaggcagaagagcctcttgaacccgggaggtggaggttgcaatgagccaagattgcgccactgcactccagcctgggcgacagagcaagactctgtctctcaagacaaaaaaaaaaaaaaaaaaaaaaaaaaaatgaaagggaggatccttacaaaaggaaagatgattttgatgcattaaatagaaaacatttttaacaacagcaaaataaataagataaaaagattattggctaattaggtaaaataccttcaacaggtgtgatgcaatttgatttctgatacatgaattcttcaagtcagtttttataaagtagcaaagcgcatgattatgcaattaaataaataataagaacacataaaatagcaaagaaacatatgaaaacatactgaacatcatgagtaattggtaatcaaagaaatgctaaagtaataagatacaatctttcacctgataattttgtcaaaaatattaggtaaaatagtcaccctcatacactgctagtcagaataaactgtttttgcaggacagtttggtaatagctatagggaatcttaggtttaataatttgtaatcttgatctaacaactcaaattctgggagtacatccttaagaaaataattagacttttacaaagatttatataacaagaggtttatcactttgatatttatagtagcaaaaaaattaatttaccaaaatcataaacagtaaagtagttatctatgaccattcaatgaaaaactggcaacccttaaaaatatgcttaatggtaattttttttaagtaagtgaactaatcctgttttttggatttggattgtcttttaaataaggtcttacatataatcttaatctaacacatctaaccacattgtattaaagtaaatgtttccaataataccaatgttttaaaatttatagagttgcaataaggttcagtatgtttgttattaatttccatcaccgctccatgtgtgcttggaaaggttttgtattctgaaattgttgggtacataagatcaagtttcttcattgtgtttctcaaatcttatgtatggtacttattaattttaattttttgcctgttttatctatcagtttgtaagaagagtgttgaaaagctacaactaaggtggtttatttgtatatttctcttcatattctgtcaaatattaatttatacattttaacatatatattatgttcttaagtgaatgattacattttcttggaatatatcttcagtacacctttctggtaaagtgaaactcttacaattatgtggtgactctctatctccaatactactcagtctttaaagtctatttcatgttttattaatatggttaaaccagctttgtttgtattttctatatataaatatttttatatgccagcctgtatagttttaattgaggtgtgcctcttataaatccatttaactggatttgatatttgctttgttcctgtatgacagtctttgcttttcaactggaacttttagttaatttttaattgtaatgactagtgtctgtaatcatgcctaccatattctgctcctgcttttttttttttctttttttttggggggtggggggatacagtttctctcttgtcacccaggctggagtgcaatgttgaaatctcagctcactgcaacctctgcctcccgggttcaagcgattctccagccttgcctcctgagtaactgggattacaggcgctcgccaccatgccaagctaattttttgcatttttttttttttttagtggagacggggtttcaccatgttagccaggatggtctcgatctcctgacctcatgatccgccctcagcctcccaaagtgctgggattacaggcgtgagccaccgtgcccggccgagtttgaacgtttttatacttgatctctattcttttcatgatcctgcagaaaatttgcacatatgcttaacttacgaaatctacttttagctatatctttactcgccttcagaacaatgtaagtacgtaggagactttattcctgtttctctgtattttagtcatctttttttttctaattcacaaacgggacgttatcatcatttctttatgcagtcaatatttgtttaatgtaagccccatgaaggcaagaagtttttattgtggtggttgttcaatgttatactccaaacacataaaacagatcctacacatagttattatgcctagataattattaaataggttgattaaatatacccaagtcgttaacttttttttttttttttgctcatcataccttcctgcatccctctgtgttagttttccttctgcctaaaaagtaattgtttataatttccttcagtaagggtgtgttggtaccaaatactctctgtttatttgttgcctgaaatgttcatattttgctttcattcttgaataatactttgatggttatttagttctaaatttttttaagcagagtgtagtattattccacagatctttacattcattgctgcctgtaagaatttggttgttagttttattgttatgctcttgaaggtactctgtcttttctctcttattttaaaagttttctctttgtgtttaattacatatgatttcactatacatacatagcagcacatttccttttatgtattatttatttatttatttttattttattttatttcattttgagacagtgtctccctctgtcacccaggctggagtgcagtggggagatctcagctcactgcaccctccacctcccaggttcaagcaattctctgcctcagcctcccgagtagctgggattacaggtgtccaccaccacgcctggttaattttttgtatttttagtagagacggggtttcaccatgttggccaggctggtctcgaactcctgacctcgtgatccatcacctcggcctcccaaagtgctgggattacaggggtgagccaccgtacccagcccacatttccttttatttatcctttttcagattcattagtgttcatgaatctggaaatgtctttcactagttctggaaaattcttgcctattattgtttccaatattatgtcagcctcattctctttctcctcttctcatggaattccacttagaaataagatatattttcttattctatcctccatatctccaaccctagtctatattttccttctctttgatttgttcctgcattgtggaccatatctttagatcactgattgtttcttaggtgtttctaatcagctgttaaaatagccatttgttcttatattcaataattatatttttctttctaagacttatagagttttttatttccaagtctgcttaacaattttacatagtcttttgtttcttagtcacataataaaccccttcttttacttcttaaaaataaaaggtacttttaaaacatgcttactttataattaatttcgaatgatttaaatatcccaagactttgttagaatctgctgtctatattctctacttgttcccactcctgcttgtttgcttccttccttccctcctttctcctttctctctttctttgtagtatgctgcacagttaggaaatacagtctaacgtatagtgacaaaagaggggggtcagtgattctcctgttatatgaggtatggggtaagaggaacagagagaagtagaaagaagggtggatatattagcagagttctctagagggacagaactaataggatagatgtaaatatataaaggggagtttattaagtaatattaactcacacaatcacagggtcccacagtaggctatctgcaagctgaggaacaaggaagccagtagaacttggagttcaatgttcgagggcaggaagcatccagcacaggagaaggatgtgggctgggagactaagtcagtctagccttttcacgttttttttttttttctgcctgctttatatttgctggcagctgattagattgtgcccaccggtattaagagtgggtctgccttccctagcccactgactcaaatgttaatctcctttgacaacaccctcacagacacactcaggatcaatatcgcatccttcagtccaatcaagttgacactcagtattaaccatcacaatgggattaccaaagagcacaagaaaacttttggaggtgatgtgcatgtttctgatcttgattatgatgatggtttaacagctgtatacctatttgaaaacttaccaaattatacactttatgcagttaattgtatgttaattatacctcaataaacttgtttttcaaacattggacacatagataaccaaaatctttataattgttagtcttctacatggaaaattcatttataatttcactttcattttttcacttttctgcatgttggtaaaagcacaccctttaacacaggaatttcatttttcagaatctattctcaccaagtcaccagatgaacaatagatcatctacacagttataaatgacaatattgataagaaaaatgtgataagaagaaacgcttagaagcaacttaaatgttgtacagtaaaagtttgatagacagattgtgaaatatatatgctagaatataaaacagtcaacattatctggagaggactttatgatttaaaatgtttcagtcaacaaaatagcacaaaacttttagttgtttacactgtggtaataatttcataaagattcgaagagaatgaaataaggtaagccaaatgattaatgactgttactttggaaaagtagagttgtggataatttttatttccttttttatgcttttcttcatactccaaattctctaccatgaatatgcattacttttctcatcacatttttttgaaaatgactaaaaggaactctcccaaataattttccttttatctttcaacgaaatggcttttaaaagaatcctctcatagaggatttgaagcacgtcaagaaaattgttcagaacggctgagagtcttatggtgaatgtgacaaggttatagtccaagttttgacatgttcatcattaacgttctgctggtccctagcctgtctcagtggatggagatgaattcattagagatgagtaaataaaaaagtgattttctctctaaattaatataacgacacacttttatgatgaattttctaaatcatttcaggttataccttcctctctgtgagttcaattatctttgtcataaaaagcttcttttccatagacaagctttacccatttttcatagcctaatttaactgtaaagctgttaacatcctaatttaagctgatgataaatagtcttttaaccgatttgaaatttttgaaattaggtggtataatattcatagatataaccttaccaattgtgaggtgaaaaaaaattcaaagcataaatatggctttaaccttgaaacctgacaggcgtttgaataggaaagagatgagccatttcctgtatttaaatttctctagactccccgtgccctgtgtgccaccattttgattaatccttcttaaaacttatcttctattaaatgtgtgaaaaacatatgtttctcattgttaacatctcaatgttttactcaagaattggataatctgaggaagtttcattaataaaggaaaatatatatccgggaaatattatgtatgtatgtatgtatttcacacctttctctttgtaggttatcaaaatagtgtgaaaaattagaattaggcttagaacaacactatcttttactctaaagctctctagaaaaggtccctaaaattaatcaaaaatgggcactatgtcttctgttttaaataaataccttaataccttacaatacctcttttacaatgatgtcatcttcttactagccaaatgccaagattctgatgtaagagagtaaataacttgtgaaacaaagtaagagaatctaaaaaaaaatcagtttgcttggggctttatttgtatcattattttctagcattttaccaattcatttgtgtttcaatcatccatgatgcattttcttaatgctggctgctttcattttttattttttaatttttaaaataatttcaacttttattttagatttgggggtacatgtgcagatgtgttacatgggaatactgcatgatgctgaggtttggggtatgattgaacccatcacccaggtagtgagcatagtacccaatacgtagtttttcagactttaccccccttcccccgccctgcatctggtaatctgcagtgtctgttgctctcatatttatatctatatgtactcaatttttagctcccaattataagtgagatcatgcagtatttggttttctgttcctgtattaattttcttaggataatggcctccagctacatgcatgttgcttcaaagaatgattttgttcttatttatggctgtgtagtattccatggtgtgtatgcaccacattttctttatccaatccacccattgatgggaagctaggttgattccatgtctttaccattgttaatagtcctgtgatgaacatacaagtgcaggagtctttttggtagaatgatttattttcctttgggcatatacccagtaatgagatttctgggttgaatggtagttctgtcttaagttatttgacaaatcaccaaactgctttccacattacctgacctaatttactttcccacaaacagtatataagcattcccttgtctctgtagccttaccttttgttttttgactttttaataaagccaatctgactggtgtgaagtggtacctccttgtggttttgatttgcatttctctgatgactagtgttgtgatgcattttttcctgtttcttggctgcacatacgtcttcttttgagagtgtctgttcttatcttttgcccgtttttaatggggtaatatgttttgtgtctattcaattgtttaagttccttatagattctggatattaggcctttgtcagatgcatagtttgcagatattttttcccattctgtaggttgtctgagtactctgttgatagtttcttatgctgtgcaggagcttagtttgattagatcccacttgtcaatttttggttttgttgcaattgctttagaggacttagccaaaaattctttgccaaggccaacgttgaaaagggttatttcctaggttttcttctgggactctaatggtttgagaacttacatttaaatatttaatcctttttcagttaatttttctatatggtgaaaagtagggatccagtttcattcttctgtgtatggatggccagttattccaacaccatttattgaatagggaggcctttcctcattgtttaattttgtcgactttgttgaagatcagatggttgtagggtgtgtggctttatttctgggttatccattctgttccattggtctatgtgtctgttctcgtaccagtactgtgccatttttgttattgtagccttatagtttaaagttgggtaatgtgatacctccagctttgttctttttgcttagaaccgctttggctatttgggctcatttttggttctgtataaattttagaatagtttttttttcctaatcctgtgaaaaatgatgttgatagtttggcaggaataacgctgaatctataaattgctttgggcagtacaaccattttaacagtattgattcttccaatccatgatcatgaaatgtttttccatgtgtttgtgtgatttatgatgtatttcagcagtgttttgtagttgtccttgtagagatctttcatccccttggttaggtgtattcctacatattttatttttgtatgactattgtaaatgggattgcattcttgatatggctctcagcttgaatgctattggtatatagaagtgctattaatttttatatattgattttgtatcctgaaactttaatgaaatcatttatcagttctaaaaggtttttgatagagtctctagggttttctgggtatagaattgtattattggtgaagagagataatgtgacttcttgtttttctatttggatgcctcttatttctttctcttgcctgattgttctggctgagaattcagtattatgttgaataagggtggtgagagtgggcattcttgtcttgttcctgttcttaggatatatgcttccagcttttgcctgttaagtatggtgttggctgtgggtttgtcatagatggctcttatttttagttatgttccctagatgcctagtttgttgaggctttttataattttataaaatccctttgtataagggatgttgggtttcagcaaaagccttttctgtgtctattgaaatgatcatatagtttttgtttttaattttgtttatgtggcaaattgcattgattgatttgtgtatgttgaaccaagcttgcattccagaaataaagcctactaaatacctatatcaagaggttatacaaatctcaaattaatgatctaacatcacacctagagggactagaaaaacaaaaacagtctaaccccaaaggtagcagaagaaaagaaataattaaaatcatagcagaagtgaacaagatagggaatcaaaaattcatacaaaagatcaacaaaatgaaagatgattgtctgaacggataaacaagataaatagactactagttagatcaacaaagaaaaacagagagaagatccaagtaagcccaatcagatattacaaaggtgacattataacaaatcccacagaaatacaaaagatcctcagagactattatgaacacctctatgcacagaaactagaaaatctagaggaaatgcataaattcctggaaacacacaatctcccaagattgaaccaggaagaaatgaaaaccctaaacagagtaatattgagttctgaattgaagcagtaataaaaaacctaccaatgaaaaaaagccctgggccaaatggatttgcagccaaattctaccagaagtacaaagaagagctgctaccatttctactgaaactattccaaaaaaaaaaattgaggagtagggactctccctaactcattctatgaaaccagcataattctgacaccagaatctggtgaagacacaacaaaaaaagaagactataggccaatatctctgatgaacatagatgcaaaaatccaagaaaatacaagcaaactgaatccagcagcacatcaaaaagttaattctccatgaccactctttaaaaatgatatttaatgtgcctcattttccttcctccccccccactgaaatttgcttctatttcatcattcctgttgcatctaacactgagcaagtatcttaggaaacaatacaattttgtaaaagatgttctgcagtagcctctatgtaaatatcgtttatccctctgtcttattaccaagataatggatgtgctttttagctctctctgttatatatatcctctactttatgtgtgtgtatatatatatatatatatctcctctgctctctctcctttagctctaggtttcaatattcattcccaatatagcaggcaaacttttactttgagaaacttaaaactctaatcagacatttcaattcctacatgccatctcaagcctaatttgggaactgtgggagcataataacgcattgtctatttcttcctttctacttttgtacaatagcttttgacttggagggagtttacttctacttgctgcacaattatcccaacatccagctcaatttcaaaggtccatttagctgctttggtggtacactttgacagcctattggccttgtagattttaatgcattttgcattatttatctcagttttccaagtatagtttttctgttgaatttctactcgttaaccaattttctggaaatgtttcccaattgatctgcattgcacctgtagcttattttttttttggttttggcaaaactcagctgaaaggtgtatgaagtacaatgtgatttcttagcacattgatggtactaagttggctctaaatgtgctgatgcatatagtacacttctgcaatgatgtctctctgggaaaccccatttaacttgagttacaataagcaaagataacagcaaagctctcagtactctttgagacaaaggtctcatacaattcattaaaattaagatgattctggctgcaagttatagaaacccagattccgattgattaaaataagaagggatgaatggtctcacttgacaggaagttcagatatgggatgggcttcaaggaatgctcatttagcaatgtcatcaagggtccaggtgtttttctcttcctctgctctgtaattcttagtatcattctatgtgtggtagaaagatggcttacagcagtcccaggcatcatatctatatccaggagacaaaggtaacctattttttcttatgaatatctcatatgagcaaggagatgtccctgtagtccaagatgacttcttattacgctttataggtcaaagtagtgtcacacgctggttctagagtaaaccatgagcaatattcctcttaaaatgatcaggccctccataaaagtgggatgagttctgtttttactgggacatatggatatctggacttgggaggatatctgatcaaaattggagttctaatagtacaataaaagtaaagaaatgaatgttggttgggaaacaatgtccaggttgtgtcatcatcattgaacagtggaaaaaaatgcagagggcagtgagagcccctgtggcccactggctgtgaccagcatgggtttctaaagcactggtgaaggataaaagaagaggacaataagaatgcctatattttggcccgaggcgaaaataatgaatagaattccttagtgggcagatactgtagtttggcccactcaacacccctttcatccctcttctatagagattggaaaggaaagtttttgatttcacagcctctcttgcagcttggcttaatcaaaagcagaatgctggccaatgagatttaggaaaaatttatcaggctgcatttgctgaataaatgtcaaatttgtatttggaagcacgatatctttcttgaaataaggaagataagaagtcacttattaaggacgttggagtaggaagtaagctgtgctctcagtggcatcactgagatgccatttgagtcttggactatatactctcaaaggtctggtcatgtgagaagacgtaaactatagcagtagctgaaagcaatgctatcaaatatagagtgctcaagttagttacataagtttactcatataatattccaattaacttagccttttaattgtttcccaaaggccaaatcagaaaaacttctcaaacagtatatatcacaaatatcttaactagtgcgaacccagaatccacctaatcacactcccagtgccttagcagagacaaccgtggctaattcttcaaggcgtcatttatatggataaatgttacatccacaactcatatctgaaccaaggcaggtttcataaatcagaagtctagtttgagcccccacgtcagccttattataacattcaacgtaacaaaggacggtgtgttataccttatgtaaactgacctttaaattggcctgaaaatattcacatgcatgaatggggctgtattacagcaatgacattgaaaattatattaaagacactttatttagcagcaaatttaatataacatttgaactgctaaaagtcaagtaggaagtagagagtactttcttcatttatttgatgaaaaaaaagcacagactgctttaaaaatataacttttgactacatacaaccagatgaaaaaagacgttaactagagggaaatttgtttcatacccataaatagaaactaacttaaaatgtaccatggtgggggggaaattagttgagaattacaaaatcctcaactgctttaataccacagcttcattccatttgcctctcaactattcctgctggggcttctgctatagtttattaacaagtatcagtgtttccattaccttagaaaaacaaaaccaacaatcatttttcaaaagacattcaaattgtcagtatgtaattattgctaatattaagaattcagtatgttaccacatacaacgcacataccaactatctactcattgagataaacttatatttccgaaatgaaaaaaaagccattataattaagactcaagaaaacttttccagtataaatatactcttaattaaagttgagataaagatatatctgtgagatagtttaccaaaatatttatgttaaacatcaggctctactatatttaagagtgggtttccatcaaaatacctcataattatctagttgcctgcatgtacaacagaaatacaagaactgaactggatgagtacaaaagggctttcaaatgtgtccactaatacagttaaaagaatataagctgctacatgtataaatacaatattatataagtatattatataaacattattttcattttatcttctaacagctttataatctaagtgttatataagtattttatatttatatgatatatacttataaatatatatcaacacttatataaatttatatatacttatataaatatagtataagctactacatgtataatatactgcatgtataaatataatataaaccatatacatggtatacagtttattctcctaagtaacaccaaccattaactttgtagtatatcatatgaaagagatgatatggttaggattcaataatatacagaggtatttgtcactaatagatgtagtcaaaaatcaaagacaataatgctaacattttttatattactgtttttagcagtggaatattttctttaagccacaggttacaaggcagtccaatgtagaacaaagataaaaacagctgcgggttgaagcagagctgactattcagccatggggagcttctcagaaacattagaatcctttatagggtctcaaagagacttgggacctaagtgttttctcctatgtcctaataattatacctattttagcccccctctggggacattttaagtgaccaagaattgttaagaggaaaatgggaaggattctgagctccaaactacatttcatgctggccctcccatcctcctaggacatctgattatttgtataaaggagatgtattagaagtccttggaattttctaattagaagttccagctctgattacttggagtttgagtaatttttcaagtaagtattagagtcaaggcttggacccagatatgactataaaactcatacttttaactaatttttatgtagttttccactgatacactagtggcattctcagccaactaattaagttttctctgctgaatgttttgaattctttgtcttgggtaatctctccctttaaaatgtaaggttgaacctgtagagctccatattgtcacttaattatgacaacatagatgagaaaagtacaaagctttgatgtgtctttggtggagattatatgacatattgaagttttgtgagatggctcagaaagttcagtaatagctgacgttgaaaagaatcaactcttatttatgcaggtgaataataatgtgactaatctggtattgcccattagtaattgatcatttctctctgacttgggaactatcgcctgtaatcccagcattttgggaggccgaggcaggcggatcacgaggtcaggagattgagactaccctggctaacatggtgaaaccccgtctctactaaaaaatacaaaaaattagccgggtgtggtggtgggcacctgtagtcccagctactcgggaggctgaggcaggagaatggcgtgaccccaggaggtggagcttgcagtgagccaagatcacaccactgccctccagcctgggtgacagagcgagactctgtctcaaaaataaaaaataaaataaaaataaaataaaacaacaacaacaaaaaggaaacagattttgaagttacatccttactgaaaactttgttttattttcttcaggtcacttacaagaaaccacttactcataatgaatttcaattatggcatgacctatgtcattatcctgggatttaagggtctagatttaggctgtttttattcacatggctagaactgtatctatttagaaaattaatttaactttaatgtatcaagactattttatatagcattgatgattttctacttcaaaagggaaagctttaagatccaaagacattgatttccaaactgggacaggcataatcctgaaccttaatcattttattcttagtgcttcagctttctattgaattttagtgaaagataacatggctctggacaaactttcgtctcttggagagagcaagttgacacagatctgaagtattttgtacatttgttgaatatgccacccagtcttccacaatgtgggagtgcaacatttaagtatcaaaatgaagcgaagttatcttggtgaccttctgacttctagcttataaaccattcatatggaagccagaaaatacagtcaaagatttaattttccaattgatcttgtatttagcatcatttagaataacaatctggatacttaatctagttttttttttaaatttcaatcagtttgtttgaaatcatgtaaacaaacaaagcctatattgtgaagaaaatacatttaattattaccgcctctaaataaatctagtttaaaacacatgtggtgaatatttgcagaaaagtgcatttaacaagtatgtggcattgtaatattaaagaactaatggaactaacggtgaagatttactaggcataaattatagaagcagataatgaggttattaaaataatatgtatctgtaatttttatataaaagactttaaacatttttttgaacttcttttttgtgtgtttacagatatacactttttttttttgcatgttttggtctacataggcagcatttagatatgctgaaggtagtctagtaaagtcttctgcctgagtaggatattttattaatttaaattacagtataatgttttaaataagaatgtatgtttttgtaagtgagatgggccactcactcatggaatcgacatatatttgttcagtaccaacaggatgctgacatggtgccagacagtgagaaggcaaggattgggttttattcaacgtggcagcctctatagtgtttaaaacattgctttaaaagctgttggtattctgtaaatacttgttgaaataatgaaaaaagaaaggtcctcgactttggagaattaaatatgcaggtaataacaatgtgatactacagtagaaggatggttcctatatttatatagctcagaagaacttatagtggaaggaatggaaagtttccacagaggagaaagatgaggaatttgatatgataataggaaatggtgtggccaaaggcacagcttcagaaaagaataaagtagccatatgtgaagaataaagtgtaaatcaatttaattggacatagtctccaatgtaaaggaaataaacttgggaagattgtgcatgttcttgaatgtggactagggaagtttgatctttgtttgggaggcactggaggcttttgggcatatgcatgataagattaaaggtccttcctgaagattaatctagccgcagtgtgtaagatgggttgtcacaatgggagataaaaatggggaaatccactatgagatgaatttaattggtcacatggaaggtaataaataatagcctgagcagccagatagtgttcctgtatttgagactgacctcgtttttccaagatgcttcaaactgtgagatatttccagaagtctcaagtgtgaaataatcagtgttactctaaaataacattatgcaaagctacctcacttttctggaaatcaggcatccaaaagtgttaaaacactggaacacagatacaaatctgaacttcttgttgagaagactagactattcactttgcggaaactgaaagcatgtatatcttgtttttgtttcattgccagcaccagtgccttgaagagtgaaaactgaagttaggcaattcatgtataagactttctataaaataattagtttctaaagggtcaattcttagaagtacattttagctttctgaaagacatatttccagggtagaactaattcttaaataatgatgaatattgaggtgtcataatttcatatttatggaaacattgtctctccttgtgtataacttaacatgtaatttgagatttaaaaatgaaggaatttgatttcatttgctgttatttaagctccctatgtctgtttaaattttgctctgaagaacagctgctctaaagtacagccaatatttcttcctttgggatagctagttccactgaaaattttgatatcgtcaaaatgtgctgtatgtgtgtctatgtgtagccaatctccctttctcacatccccggatacccatgtccttatgcctgccactggttctcaaactttaaagtacataaatatcaccagaaacaattatttaaactatatgttcctagccctacagtccctggagattcagattccataggcatggggaagcctgagactgttttgataagctccactaggcaattctaatgcatgacttccagagatcataccttaagtggctgtaacttaagctctctctgccttacttgcatcagatgtcatgttcctgactttaagtagcagttattatttaatttaattaatgaataaagtcaaacaatgtggatgtctagaaaatctcctctactgaaagagcctgaaatagggtgtgttgccttactagagtctgatcggtagtagcgtcatcccacattgagagctgcagtttcatgctctcaatcctgagatgttttacagcagggtaaatgatctaatttatagtatgtgctgagatatttctaaagaaagcttgtgtccgagggtagaatgttttatgtgtttaattacacttgagttccaatccaattcgaagccatgtctacaaaggctggcgtttagtcagctaaacatttgaaagcttctttgttcctaagggggaaagcacaagactaatttttctaacaagtaattgcaggtgcaagttatgtttgcaatcttaaaaaaggaagtgtctcagtgaaggggaaattaaatgagagggttaaacgcatgacctagaaaggatgtttgaatcacttgtgtttttccatcttgtacaaaaatccatctttcctatgagatagggctaatttaccagttgtgttccttttaatatgaggaagttgggggctggagggagaaaaaggtaggaagaaattagccaaacacaatcaccagaacatgttttttttttttttaagccaggagggagaaggtgaagatctacacaataaaggagtaaataaaaacacttgtaggggaaaaaaaataatggagtgttttctcatccactaaaacagtaaaattccatctttaggtttttctttgttcagttctctttggaaggaactttctcagctgaaattttatttgctgtttttgtgtcatttttgtcatcagaaaatatttccaagttaagcaatcttacaaagaagtatctcaggactatcaacattagtgagccgggtaccctgaagtgaggtactctttcctcacttcatagtgtggccaccatagccattcttgcctttcttcagtttgctgtctatcggtgtccatcagaaataccttgttggcaaaaatgtcttccctgcccatcttatttggtctattaatgatttcataaacttcaatatgaatctttatgagacctcctactccaaactggaagctctaatcccttttgcctctcctcctttggcaaccagttcctctctttgatgtccctagtttcctttctctagatttcttccagttccatcatgctttccagatatatctccaccaaaaccacctccaaaaagctaaattcttattggctgccgcagctcaacagcggatgctctggtgaaataagcataacaacaatagttgctttgtatgtagcagggatcagcacagttttcctgtaaagaactggataataagtagtttaggctttgtggaccatgtggttttgatcacaactattcaatggtaccagacaatacttaagcaaatatatgtgtaacttattcaaataaaacttttctttgtagaccttagaatcatttcatataattttcacatgccataaactattatccttcttaagattttaaaaatcattttaaaatctaaaaataatttttgtctcacaagctgtacagaaacaaaacaggccagatttggactgctgaatgtagttcgccgactcgggttgagagttttttgttttcacggtgtccctacctatcatctcatctaattctcccccacagtcttgtgagaaagttaataccgctgccattttataaatgtggaagttgagacttggaaaatgtgactgtcttgcccaaagaaagagaactaataacctgtgtttctggaacctaatcctacattgtcatgcgtccaatcctgtgttcttacctccataacacacttcatgctagtgttatatctatgcctgactgacacagttcaaatctccaaaccaaccaaattccattgaggtggccatttctataaaagctgtcctttggaaaaaaaatttatccaaaacatcaggactcaagagtgtaacagaaggagggcttgttaaaccatcagctgctggacataaccccaagaatttctaattcagtggttttggggtgggggccaaaaatttgcttttcattttttaaagttagataaaattcacacaccataaagtttactatttaaagtgttcaattatttatagagttgtgcaagcatcatccattattatctaattccagaacatttgtatcgccacacaaggaaaccctgtacctatttgtggtcacttcctattctcccctccccacctccagcccctggcaaccactgattgactttttatgtctatagatttgactaccctgaacacttcatagaaaaggtatcgtacatgtggttttttgtgtctagcttccttcacttagcataaggttttcaagattattctcattttagtatgcatcagtacctcattcctttttatggatgactaatgttccattgtatggatatactacattttgtttattcattcattaattgatgaatatttgtgttatttcagtggtttggtttttgtgaataatgtctccatgaacatgttttcaattcctttggctatctacctaggagtgaagttgctgagtcatacggtatctctatgttcaactttttgaggaactgccaaactgttttccaaaaccagctgcattatcttacattcccatcaacactgtatgagttccaatttttccacattctcgtcaacacttgttattgtctgtctttttgactactgtcattctagtgggtatggaatagcaactcactgtggttttgattcgcatgtccttaatgactactgatgttgaacgtagttttgcgggttggttgagaatctgtatttgtaacaagctcccaggagatgctgatgctacttgttcctggaccacactttgagaaccactgatctaaaaattaccacttactcctagcaaatagaatatgctgtgtataattgtttttgtaatcatagtcattatggagctgtactttagacattgaatataaaggaagaacttattccacaagatttatcgagaacctgaaaagtgcaaggcactgttataggcatcaggaaataaattttttaacaacagatacaaagtgagagtttacattcaggtgcgtgaagatagacaatagatgataagtgagcacctaacctttcaagtggtgatacatgctatgaacaaaaatgagagagggtgtggctctagagaggggacagtggggaaaggtaaggtgaccagagaaggcctctctgatgaggtgttgtttgatcagggatttggaggcagtgagaaagcaagacctgcagatttaatgcacaagaaggtaaaagcacagtctttgggaccaggccaagctcaatacttagggctggccctccactcgtcctttgacctaaaacaaattacttaaccactctgtgtctcagattcctaatctattcaatgggaataatagtatttccctcataggattgttatgaagattaaatgaggtagtatatgtaaagcatttagagagatgtgtggcacatagtgttacataagacgcggatatatatgaggctaagaaagctaaaactttagtccctctcacttacatgggcctcttctgtggccttctattaaatattgtatacaaagtaccatattcttttctagaaagagagcctccaagttgtctaagctgtaggccctacatagcctagacctgtacctgatattaactgctatttattcatctctgggataaatgattccagacaaagggagcaggagtgtaaaggcccaaaggctgggagaacatcaggaagacattgtaactggacaaaagtcagggaggcacaaagggagaggataaggtgagaccaaaagggacagtacttgggggatgggaatcgtaggcatagagcaggtcttggtaaaatactttgtaattgtgaattagattaggagacactggagagttctgagaagagagtcatgaactgctttgcattttaataggatcattttggctgacctttagagactagatgattaagaaggcaaaattagaaggtggaaaactcatggagaagcagtaatctacagatgagataatggtaccaaggactaaggtagagatggtacgatattgatagtttatgtatatattttgataatggaacagacagaacttgttgatgaatcatatgtgggattgagagaactgttaaggatgattgaaagatttggtgtctgaggaactgacaagtgaggatcaggactggatgtacatgtgcagtggaaattaagagtttgatgttgaacatgttagttttgagatgcctattttatctgtaagattctattttatttctatgatatatagccctgatggacattttttggaatctctacagttagactattttatagttatatgcccatcataaaattctatgcagaatgtaccatatggacttttggtgctataacacagatgacttttatggaaaatcagacaaggtaggtcagagaatttctttatggccagctccaagacaggaaggtggggagagattagagtcctgccggggggaaaaaaagaggaggtgaaaagagggtacgagaaggtcagaaggagagattttttctgaagtctgcttctgaggcctgcagcaccccaacattataaccaaagatggtcttttatctttattgctctgaagcacttccaaagctgcttcaggaaccaagggcaaatggccaaatattttaacaaaaggtatgcttattgttttaaacacttaggaaatgacaagagttatgagccaggaaccatggacaaaaacctacacacacacacacacacacacacacacacacacacacacacacacacacacacacaatgttattacaccctccatggaactatgatggttctgtcctttttatgttacatgacatggaaggtttccatttaaactgtattatctaactagtagataatgctagcaatattagtaaaattattgtgttctctgactgtaaggacttgaggacatgtttcctcatcttcataaactactgcctgcccctatgcttgactatggtaggtgctaaagatgttacatgaatgaaagttacaataatctgtacaagaatgaggtctttcttttgggtattttatttttgtttagaagggatcttatactcattaggcactgactatccataacagcttaatactggacagtgtagtcaaaacacatgactacaagttccaagtccaccaatttttggctttattaatttgacaagtcactaattatctgagcattacttataaaatggaattagtggtattttttctattttacagtgttatacttaggattggataagataatatacagaaaaacatgatctacaaagtaccaaaaattatattaatattttgatctaatctagaaaaattttgattgatagtgtctactgcttaatctgagaataacataccttgctatagtttccaaacacttttcatagaggatgtaaaatggattttcaaaaattacatttcctcaatataaattacaatggtttgatcacttaacatcaactctcattaaaatatgattctctttgtaggctgaattagctctcttttgagattcatatgtagaaaataaccaagtataaaaaggcttgctgcaaatgtcctctgatatttgattttgagtttgacatttcaattcaattattctgaatttaaggtgtcttaaatcattgaatacattttgcggataatatgtccctgtacccttgcatatttttcataacctcttatacattagccaaaattagaaaaagaaataatcctcttccctgccttaagctaaactagaatagttggcacatttaaacaacaaatgatgagaaaaaaatgacattgataaaagtttcactgagtcatcatgaatctcattgggtgagcaattctattgagggagcatatatgaattttcatatactttaacactttaattgtgctaatattttaagtaatatttgttctttaaatatattttcttatttttctgtcatttaccaagtatagattcatcatttaccaattctgactcttttttttttttttttgagacaagagtttcattcttgttgcccaggctggagtgcaatggggcaatctcagctcactgcaacctccgcctcctgggttcaagcgattctcctgcctcagcctcccaagtagctgggattacaggcacccgccaccacgcctggctgatttttttgtatttgttagtacagacggggtttcaccatgttggccagccttgtctcgaactcctggcctcaagtgatccacccatctcggcctcccaaagtgctgggattataggtgtgagccaccgtgcccggcctctcagactctttaaaaaagatagctgaatgggactgaaccaaccagtgcagatccccaagggcaaaatttgggagtaccttgtgtccatgtctctagttatatggggatagagagacaaaattgtgtttaaaggagtttcaggcctcaaggctagaaaaattggcttatccaaataggttctcaaagcaacatgaaatgagatttaggagatgcgttttggaaatggccctaagagctaggaaagaatggagtaaagtataatggttccaaatttgaatttaaaaggaaaattagagacaatgtctctagagactagggactctgtcttgttcacagctgtattctctgtgaatagtgcttagaacataaatatttcttggctggcaaaacaccgtttaccaattgtgtttattacatgcttctgctaaggtattgtgtgagcaaaccagacacaatgaaagggctcaggaaagaaagaacaagatcctggtatcaaaaacaggtatataaagtgtggctcttaccctccagtaaaaggcaattaagtccccccatggaactcagtttcaacaaatcactactcatattgtgtgggagagaaggatctcagaggatgcttataaagtgacctgaagatgagacaggaatggaatcccaggcagaagcaaagcaaaagtatgtgcaaagtcttggagctgtataaaaggatggtttgtttggaaaatctctcgcagtttaatatgaggatcatgagaaatgacactggggaaatagacatgaatcagactataagggttttcgttgttgtgctaagaaatttgggcttggttaagactaagcttcaaatagttaattctaggatattgacatgaaactatagcccagatatgttaatcatgttacaggaaagtttagcttgttagcaaaagtataatactgacctaaaagagcatacttaagtcctgaaagtggagagccttgtctaaggaggagagaaacaaatatatatagtcagaagcagtgataaaacagaaacttttcccctaccaccccaacagtatttagttaaaatatattttatatcagcctctagggccattatgtcccaatatgcatcccctctagttttattatataagtttattaataacctcttatgtatttatgattgtagttaatatacaaagagaactaaatttatggtagttcagttttaggtattgcttatatgattttttccataatgctgtcaacccgtgggacacctgatgacattctttttcaagaaccaacatcacaactaagtttgtatgtgaccttaaagtagcagaaggagctggtcatgagatgaaaagaaatgctattctacttctattagattattctcaaggactgataaatactttggattctaggtatccttggtgcaaatgatttaatgaacatgtgccatgaagaaaaataagattatagagaatgaaattaaatccgtgctctacctgacttaaaagtgtgcatattatttctctcttccaaaatatctagcatccttatataaagaaagaagtccctacataatcattcctttcccaaccatcacattcaaattatcaaatataaactctgttttcagtttggagaaagaagatatagttgctggcaaaatttgggggtgtgagtcgggaattagaggcagaaaaggcaagggatgtaacagaaaagctttatgaatatatctttctgtgccaaaggaaatggaacacatcttgcatgaaacaaaatgtgacttgttaggcagcctaagatcttatcaaaggagtggaaaatatcacccactgctgactggctagtaaaagggaattgtgctcaaatgggtcaagactcacttctcaatgtccacaagctttttttcctccttatttcctctgtaaatgctgtttttttgtttttgtttttttttttttttggcatgcaaagggacacacacacactgaacacactgacacacacaatgttatgcagagagtttcctcccagatctattcatggtttaaagccccccacctccctttacctgtaataaatatctgttggctttgatgttcactgtcagggataaaacaaattcacaaatatttggtacacgctgctcctgtatgtgacattgaacaaaatgttgatcattaataaatggtgggggaaaaactcaaagactaataaatgtcattgtttctgatgaagtagaacacaagaaggtaaatacccacaactacccccctgctaaggtacaaatatcagtaaaaaatgtgtatatttgaagtatttggtctattacaattcttcagatataaaacaagcactataagcattatggtggtgttgattttaaaattccaacttcacaaattcttccagaagtaccttatgaataaaataatgtaatattcagatgacacatatatacacatatgcacacatgcacatgcatgtatgtagtaggtatcaatagatgatagatgggtagatagatattcttctctctaccttgctgcattcaagtggctgtcatataatataaatcgtatttagtatgtatttttttttaacttggggggttctggatattttgacccacattcatatttttaaccacggtgttgaaaattctctaagtgatcttactgttccacaccttattacattaatcccctataaggcactttcccaaggagtccctgaacacttctgggagaattataggcagcccatgctactctgagcacatttaaaacatagaaacttatttacatgggcctaaatctacctctagaacacctgggtttattctacctagggctcacttcagaaatggtatgtttttcaaaaatgacaaatcatgaagtctccagtatgatttatatttcaaatccatctcttgagaaaattctggttaatagtgactgactagagtgttaggaacaattccaaggtgttttcaatctcatcaggaaaaagagctgctgtgatccattagtgatgcctgctatgggcagggtgtaggactagccaagttttgagtctatttcttctttcccataaaactcccttaaacatgtgcaaataggatccatgtttcatctaaggaatgtattctacccaaatctgaactcttttcagctacctcacaacacatgggctggcattctctgtagcctttggcatgatgtagcttgtcctatgaatatccttgtagccatcgcctccaccataaagcacagagctaatctaatctatgtttgcagtaattccatagaaaaatctttatttcaggatcacaagtgaagcttgaatacttcttaaaagttcctctgagctcatatgtatgtgcaattaagtgtactgaaagcaaaacgttatcttgtcatttgactgctaagagagcttgccataaacatcaaaaacagcttaacaatgcattcttattttttattctgcttttaaagggcattgctaaaagtcaactccatggtctggttctaccttgaagattttgtatctttctatgtctctgtggacatagttaaggatataccgatgactctagtagtgagtgcaacagcacagttgacacacacacaaaaactgcttacatttttaaaatggaaatccagtcatagaaatatcacagcacaacctctcaacgctaccccttgccaagaggctgtgaaagaaaaaggattttttttttttttttttttttggaattttgggtgatgctcttttaagagctagtgggacaaagtggaatatgttaccacttttggttctacttgagaccaaattccatgtgccctcatataatgtacttccaggatagccctgcttcaataaatagaacatcaaatattatactttgaattacaaatacatcaatgtaaaatgatttcaattttgaatatcctccattcatgctacatgactggttaagcaaaactgtgctgacatcatgacagacaattccactcacattttagttttgaatttctggtatatttatgattctagcttttcattttatatgctgggttatcttgtatcaacaatgtatataaaactgttcatgtttcctattatgacagctgcaccaagtccatgtctcagagctgtatatcaaagtggcaaacataataacacaacacagatctgttttgacactaatatggatttcatgcttatttcacatccccttggccaaacattcaaaaacattgtagttcccagtaaataacattccagaaacaaaatccagatgctgtgtctattatttcaagcacacattatcagatacaagaatgcacaatgcttttctacaatttacttttcattttgtatcctgtttttagtgctaaagcacttcattccccaaattctaaatattactgaaggtgaaataagagcctttagagggttctcttactttaaaaaaaaactgacatagaaaattacatgtatttatcatgtacaacatgatgttttgaagtatatatacaatgtagcatggttaaatcttgttgaaccattcttacatccctgggatgaatcccacttgatcatggtgagtgatcttttaattgtgctgttgaatttggtttgctagtattttgttgttgacgatttttgcacctatgtttcttgaagataattgcgtgtagttttcttttaatgtgtgttttgtctggttttgatatcaggataatggtggcatcatagaatgaacttggaagtgttccatcctcttacattttttggtatagcttgagacaaattagtattaattattctctaaatgtttggtagaattcaacagtgaacccatcaagtcctgggcttttctctgacgggagacattttactactgattcaatttcctttcttattattggtcagtttaggttttctctttcttcataattcaatcttggttatctgggaatttatccagttcttctaggctatccaacgctttggtgtataattatttataatagtctcttataatacgttgtatttctgtggtatcaattgtaatgtctccttttatctttgattttatttgagtcttctttttttttttttttttttttagttagttagtctaggtaaagggttgttgattttgcttctcttatcaaaatagccagtcttcatttcatggatcttttgtattgtattctagtctttatttatttctgctctgatctttatcattcccttccttaattttgggttgagttttttctttcttttcttctggttccttgaggtccattgttaggttgttgttctttttcaatgtcagcatttattgctaaaaacttttataactgcttttgctgtagcccatagattttggtatgttgtgttttcatttttctttttttttttttttttttctgagacggagtctcactttgtcgccaggctggagtgcagtggcatgatcttggctcaccacaacctccatctcccgggttcaagccattctcctgccccagcctcccgagtagctgggattacaggtgtgcgccaccacacccagctaatttttgtatttttagtagagactaggtttcaccatgttggccagtatggtctcgatctcctgaccttgtcatccgcccgccttggcctcccaaagtgctgggattacaggcatgagccaccgtgcctggcccgtgtttccattttaatttgtctcaagacatttttaaatttttcttttaatgtcttcattgatccatttgttatttgggagcatatggtttgatttccatgtatttttcaggtttccaaagttcctcctgttatggatttctagttttctactattgtggtcataaacgatacttcattctaatacttttaaagcaaaaatataatgattttgtcagcacattgatagatttttttttctagctttctatgtgctgggcacctatttctgcactattgtttaagttttgcaatgaccctattaggtagattatattattactccccgtcaccagtgagaaaaattgaagctcatagaggttaaataatgtggccaagattcaaaatttgtaagagtatagtcagaatttgaacccaggaagtcaggttttagtgcctattgttatcaacatatcatgctgccctgtacataaaaattataatgaaggtgggccaggtgcggtggctcatgcctgtaatcccagcactttgggaggccgaggcaggcagatcacgaggtcaggagatggagaccatcctggctaacacggtgaaaccccatctctactaaaaatacaaaaacaaaattagccaggcgtggtggcgggcacctgtagtcccagctactcaggaggctgaggtggaagaatcgcgtgaacccgggatggggagcttgcattgagccgagttcgcgccactgcactccagcctcagcgatagagactgcatctcaaaaaaaaaaaaaaatatatatatatatatatatatatatatacacacacacacacacacacatatatagacggagagaaggtgaagagttgagtaaattactaaagtttcttaagcccctagtatgtatcaggaattatgacaggcaattaacatcaataatcttacttagtcttcacaacagctttatttgttagaaaccaacattaccccattttgtaaatacaactcataaggttaagcaaacaagcaataaaattaggaaagtaagaagacattagttacacccctggtaagggaaaaagctggatataaactcctatctacttgcatctgaactagactagactttctgtatttatatcatctctattctaaaacagaacctaaccttaataaagtggttgactaaattgacttacctattttctcacttccatgatatttatgtattgaaagtacaagaagctaaaggtctttggatgaaacagaacatagcactgtgtttacaacagctttaagccacattcaaaacactttagcgtcatctcgtgttatttatttatttatattatttttgcaaattgagtggcattgttagcactttgaaaggcagaaaatatagctgcatattatatcataagaatagacaattataaaaagagtgtaagatgaagtacctttacatgagctgtaattgcagctggtaattaaactgaagtgtttcattttctcagtcagctcatcagtgacaccagaaaataaacaatttgaaagtgaaatccttaggggccaacaatagtaattaattgcattttccagggaagaagcgttcctaaagtctgtttggggtgacctcttgagtaatatacacagtgatttacactgtgagcagaagtgtggggttcagaaccaaatctgatttaacttgaatattcatgaagtctccagtatgattcatacttccatttccattgtcaagtttattgtctcctaggttaacaatgaaagcaaatttatattctgaataattcacataacacaatgagatgatcagcatggaaaaactttaccaggccagtaacacataaagtgaggctgctattaatcccttccaacttggaatctcctcaagtatcaagagcattgttttagagatacttgggagctgaaaagaaaatatttatgtgtgtaaatttggatccatatctcataagcctattggattaaaatcataacattcaggcagtctagtttgccactgttcattttcacagagaagagctttgtttgagatttgtgcacatctttttagctattctgatcacagggaacaaactgccatgacttatactctaatttctcttcttgtttttacttatgatatgaacatggcccttggactcagataggcataggtatagaatccagccccacttcttactaacaccttgtgttagttagctcataccagataacaaagaaccttaaaacttgctttaaaacactaaccctttatttagattatcattctacaggaagacaatttggggtgggctcagccaggtggttcttctggtttaggccaggctcatttggtctcagctggggctcaattatacacctgcaggtgactgccagattgggtaggtaggctgatctatggaggcttcagctggcatggcttgcctctgcttcctgtatcttccattttccagcattgcagcctgagcttttccaaatgatggtgtggcagtgatcagtaagagaaggtaaatccaaatatgcaagtctctgctattgttccattggcaaaatggccaagcccagagacagactgaagggtactgtcaagaaataatagtgatactaaaacccatgaaaaaatcgggggccattattacaacaatcaactacatatatgtataagaaactatgagccagtttcttaatccctcaggcccagttgctgctcatctcatagagttgttgtggagattaaaattaactcatatatgtaaaccaatgggtcaatcacctggcacattggagacacataataaatgttggccctcttttctctgacagatatttatgcactcccatttattggttatacaaagcaaatattctaatatgagaacaacctgttaatgatatgtcatcccactgacctctatagttattcagttatccggctagtgaggttagtgtctccttccttaacaatttcatattaatctgctgaagctatgcattaacctggaggatcaacttctgcacagaagtatattcctaaaattacgtattatgcatgtatgtttgcataatatacttccataaaagctgaaacttggctgggcacagtggctcacacctgtaattctagcactttgggaggctcacgcctgtaattccagcactttgggagaggatcacttgaggccaggggttcaagaccaacctggccaacacagggagaatttgtctctacaaaaatattttttttaaaaattagccaaacatggcggtgctgcctgtagttccacctactcagggggctgaggcaggaggatcacttgagcccagaagttcaaggttgcagtgagttgtgatcacgccgcaccactgcactctaacctgggtggcagagtgagcctctgtctcagaaacaaaacaaacaaatgaaaacaaaacaaaaactaaacttttattgagccattgatttagctatttttaaaacttccttacaatgtacaatcagaggcaaatctgtgttaataaagcctatatgttgcactggggggtcgcaggctagaagaggtcataacggtttaaaatttccaaagtgtcgattatggccattgaagaggctgagtcatcttaaagtcggcttgacattacaatcaaataatcagaaaagcccgtaaattgaattctactttggcctgattgtcttaaaagctggctctgatattaacggacggatgttcacatctttaatttggatcagggccactgacacaatagagtagatgagcctccataattttcaagtgaacacatgcttttccccattgatctgtggataatagatcattctattggctcccctgcagcatttaaatacagtctgcctaattcaaaattggtcagtaaatgtaatactaaactgccttgacctgaagacgatagaaatgaaaacccattttaaaaaatcccaggaaatcactgtacttgtcatatctactgcatgaaataaaaaatatatttcaccaaaatacacttctacctctattattttatagattattaaaacagtgcagaacatacaaggattaatataatgtgcaaagagatcttatatatatggccagggtctttcatgactgacagaacctctctgatgtttgctgactttttagccaaaaagaaagagaacatttggttaacacaggctcagagatagatagaattataataatacctgacagccctttgatacttggtagttttatggtgcagggaagggaaagattttgaagacttcattgggatcaaatgttaataaggaacaaggtgaaacatgcctgtaaaaataatattgattatatcacaatattctctatcattccaatgaataatccaataaccaatgaattcctaatagcaacattaatagggtgattaccgttttgtgaacatttattaaagaagaagaattttaaaataaagctatccatgaatttgctgttatgtcttaaaatactacataaacaccacaaggtgtctgaggtgtgccctatattaattttatgtttgtttggtaactccagtcatggtctctatagccaaagtcattcttcaaatatacagttatttgaactactcaattgaagggaaaatctggggtgacagataacaatgctttacagagtacatgtatatttaatcatagaagctcaagtatataggaaaataaaatgttagttacaaaatgtttatttgataattacacatcatgacaaagaatattataggaagtaaattcaaaatttaaatatattcatacagccaagatatgatccatatttattatgttgtcatgttttgctttataatctatcgtctgtttatgtgctagtttgtttaagtaaaaatattatcttcattttaaaaaagctgagcatgtaaaaaggccaaaattcggggttttggctatacttgaatagactgcatttgattttctttttgcaagctatacccttgatgacagttaaactgaacgagcattcattgagcaactatttagtttatagtcactatactagaatatagtgatacaaagatgataaaccatgatccctgtcctcagaaaagatggacgtatacatagcaactgtaatacggtatgtaagaactatacaagcagtatgaattgggttactcagaacaatcgagtgagggattcttctggcgcaggaggaatggaagtggcttcacatagaaggagctgagaatgcagaatgatgtaacagggctttccaaggttacccccaggttcagtgattcactaagaggactaacaggactcagcagatagcatactatggctataatttattacagcaaaaggatacggaacaagatcaacaaagggagaaggtatgtgtgagatgactaccagaggaaaccaggcccacgcttttaagagtcctttcccaggggagtcacacagaatgcacttaatgccttcagcaggaagttgtgacaacatgtgtgaaatgttttctagtaaggaaattcattacagactcagtgcccagagattttactgggggttgttcatgtaaacgccctaaaccatactgtctgcacaaacagtttaggcatagtaaacccatttgttatcagaaaatgctgggaacctttctgatatctaagttttcagaagcataaatattatggcaatgtactcaaaagaactgggcctccattttaggattccagctgaatgctaaccttgcaagcagtcctttctaaggacagcagcctcaggcctgttagattaactcttttctgcacaggtgaatagatctgtccagatatagttggtggagaaatgaattcaggctgtggaaatttcaagaaagggctcggatgtgtggaaaaccgttcaaaacatttcattcagtgagatgtttaatcttaagtgtttctgggactatttggagtgtcaagttcacactcctgaggcctgacatgatttcaggttccctgaacaggccccatcttgtaaagaggattaaaatggcaattgtgttaattcgaaacatttggcctctgttgtgtacttcattcatgtgaagatgtgattctaatttagaatatccagatatttgttttagttcagtgttttgttgtcacagtatataaagtttctgaccataacacctttgaagttgtatagttcaaaggtccctgttacagtgcaacggagacttcagtttcctggaggagagtatgtactttcaaagacgacatttcagagcatagtacattcatacaagtgatcgacacaaaatgtcatttttgtcactagtacttgtggcattaactataagctgtggagttgtgcttttgttttccccccagccagattgacatgcttcagtgcctttcagatcctacacttgtacaacccaaaacagaactatccctgtatttcactaggagaaaaatgaaaactgttaagcttataaatatttcactacagattgctgtatattcgctgctcactgttgaattcagctgctatgaaatgctaataactctctactgagggcttgagaacaacctctatttcgataaatattatggcgtgtactgaattatgagttccgtacattcactgatagacaagatggaatgttagccttattaatgcaactggtgcaatgtactcaaaagaactgggcctccattttagagatttagctggtaaggtacatgaccactgtaacatgcatgggccttagtagtataaaatagatatgaaatattgtacaaataatatctctgctgtggtttggaaatctattggaaaatatatacatttgtcttatcttctgatttgttaattactcttaggacattatgagtgaattttagaactaaaaagtcagtataaaaacagatggttacattttgtgattattagcttcctgtgactgctataagaaattgccacagacttagaggcttaaaacaacacaatttttttatcttatagttgtggaagtcagtccaaaatcagttttacagggctaaaatcaaggcgtaggcagggcttggtcttttctggggactctagaaggtaatttgtttccttgtctttttcagcttctagaggctgcctgtattccttgacacatgactgtttactccatcttcaaagccagcagcatagcaattcaattctctctctttctcacttctctctctctcttcaattctctctctctctctctctctgtgtgtctctctctctcatctctacttccatcatcacatctccttccctgactcggaccattctgcctgcctccatcttataaagatccttatgactggacccacccagatattccaggcttgtctctccatttcaagatccttaatcacatctgcaaagtctcttttgttttgtcaggtaacatagttacaggttccagagattgagattaggacgtggacatgttttggggatcattattttgtctcctacaaccccaataactctattttgtgttataaatactgtgaattattcagcaccaatacatggtattcaatcagattttgaccatgtctgtctatccatccattcagtaaatatgtattgagaacctaatatatgtcaggcaatgttctagatgctgaggtgcagtaattaacaaaggagacaaagtctttgttctcatggaggttgcattctagaagggaacacatataaattaatattggatatgtcctgaatatttggtctataacaaaaaataaggcaggattagatggcatactgtgttagtatatgtatgatgaggggtgccattttatcactaagtatggtcaatgatgtcctctctgaagaagcaatgtgatatgttgaatagtggcccccaaaatataggtccaagtcttaacccccggtacctgtaaatgtgatcttatatggaaatacagtcgaccttcagtatccacaggttttgaatccatggatttagccaactgtggatcaaaaatattctaagaaaaaacaaaacaataaaaacatacaaataaaaacaatgcaatataacaactatttacatagtatttacattgtaataggtattataaataatctagagatgatttaaagtatacaggagaatgtgcataggttatgtgcaaactacataattttatatcggggacttgagcatccttggattttgatatccacagcgagtccaaaaccaatccttcttggatacaaggaacaactgtattgtaagatctttgcagatgtaattcagttaagaatcttgagatgagattattctggatttgggtggagctaaattgaattataagtgtccttataagagacagaacaggagaagccacagagacacacaaagaggaaagccatgtggtgcatttacatgccaacaaatgccaaggattgtgggcaaccaccagaagctaggagagagacatggaaagggttctttctctgagcctccagaagtaacgaatcctatagacagcttgatttcagagttctggcctccagaactgtgacagaatacatttctgttgttttaagccacctagtatgtgtaatttgttgcagcagcgcaaggatactaatacaggcaatgtttgagcaaatacctatttgaaataagaaaacaagccatacagatactgaaaggaaaagcagtataggcagaagacacaataagtgggagactctctgtggtattcaaataacaacaatgggagacagtgtgactagaacccagaaagccagggggaagagtgtttgaagatgattccagaactatagtgctaaccaggtcgggtagggagggttttgtgggccatggtaaggactttgaatttaattctgtttattatatataagctagaataattatgatttactgaaatgtagtgtttctgggcatgacagttttaactgccagaagcaaataatcgtgacacaactgaatattaacacaaaacatgaaggttgaattctggtgagctccattgtgttcccagtaacttaactatcacatttttaataatgttggtcctggcctgaataacaaaatatattggttcctccacccccaacacgcaactactgtattaggccattatcacattgctataaagaaatacctgagagtgggtagtgaaaagacgtttaattggcccacagttctgcaggctgtataggaagcatggtggcatctactcggcttctggggaggcctcaggaaacttacaatcatgcagaaaggcaaaaggtgagcaggcgcgtaacttggcagaaacagcagcaagagagcaaggggggaggtgccacacttttaaacaaccagatcttttgagaactcacttagtatcatgaggacagcaccaagggcatggtgctataccgttcatgagaaacccacccccatgaaccaatcacctcccaccagtccccacttccagcactggggattacatttcacgtgagatttgggcagggacgcacatccaaactaatcaactacttatttctttttgtgtctgcatatataaaatctgttaggtttggctttccgtgcaacactgtttcatgtgttattagtatcgctgttacactctgatactcccacaagataaccctacccatcaatgagaattgaggccagtactgcagaatgaggatcctacacaaaatacagaaaccttacttgttcaccaaaggtgtgaaccagtagtaaaatgaatggatttgtttcccgtccccttgctggtccctgctaactctgactcttaaaagccataacattttagccaaagaggacggaagaaatagactcaaaagttgcttattaaaacttgcaatatgtgtgccaataattgctagaactgtgttagaaataaggacattgtaatgagataggatgttatttttctaacatgatgtctctatgttaagagataaaggtcaagtcctaggaaatgaagggctactttttaatggcgttgaaaccacgtaatgggtaggattgtctctagaagatcagtaatgcactgatacataatcaatggaagtttcttaggagatactttatttcttttagcattggttcctctccctactatgtcaaatataaatatttcacattgtatagccattaatcaaagtaaaactaaccacagtctatatatatatatatacatatatatgtatatatgtatatatatgtatatacacacacacacacacacacgtatatatgtatatgtactctgtatgcatatatacacagtgaattttagcttatgtccctatgggcagggaagagaacaaaagatgcatataataattcatctctgctcattttcccatgctccttcattttgtgtatcatctcacatgcaaattaaaatgttctaaatgacaaaagaaaatctcagttgtgggaaattaagcataaaatgtggactgaatcttgattttgaaatcctaagggttactaaaaatagaacatttcacacccctttcaagggagcacctgctaaattcatttgagtcaaatgtagaaatctctgtaattcgagtagataaggataatctagaaataagaccacgagcagaggaatggtcaatgttttttgtagccaacagctttgaaatatgcttatagaaaacattgcttaaatcaggactattttaattcagaaggaatctacccatggcctactaaattatcatcagagaggtggtcaccacacattggtttagtgaccaagcttgacatcagaaggcctgaattctgcttctgcttttattattagtgagataactgatctcatgcaggtcatttaatttcactgtaattcaagttctttatatttacactgagttgtgtaaaaattttaaaaaacaaaatacagcatcattttaagctgcataaaaggtagaaaatatatcatttttaaatatcaccaatgttatcaaaatcatatatccagacaagggatctaagtaatttatctatatagatggcatagatagactacatacactacttatgttcctcattttgaatgtgaacagattagccatagcagtaaattccatcgctgaagaaagttaaatacctttaagaaaaatacaagcctgtccttccagttgtaattttctttcttaatgtgctttatctttgatttgacataatgaaggtttttatcctgtgcccagaaatacaaaaacatgagatctaaatatcttttttggttacttccccgtgctttttcattttgttttggtttaatatacaaattaaaatgttttagaaaatattgccaaatttgtacattttgaagttttattctggaaatatgatccattctgcttattcttttaaaatactacatattttcattaaaaaatgatctgatgtaataaaaaaaagtttttgcttgagaattgtatcagtagatacaattctcaaatagaagagttcaactctttacagatgatcagaagtatatttcctttaaaaaagtgaaacttaaaaatcacacatttttagatgatgacagtttcttttgtaggagagtgtgtacctttacaagatacaaagagaaagaacatttgttatcacaatcataaatgcaaattgtggactcagcctagaaacttaaaagatctgtgtagaatgatttttctccccttttatttccagtttaattgttttctgtcatagacttttattgaaacaaatacatgctactgattcttccctaatcttacgtggctaaagctaatctttcttactatttgcttagtagaaaaaaagcaaacagcaccacatattttttttcttttccaaaatatagcaaaaaaaaaaaaacatcctattatttcattccaaaagcagtagtccttttcagacttgtgcagagcagcttatcccacagggatttcaaatagtaactcattggatgcaggtgataaggactttctatgaaaggccaaagcaactaaatagttatggtttttgtttgtatttaatattattttgttgtggatgcgttagtcatattttttcaaagggaagcaatcaagtgtgatagaaattatgatggaatgcagactggactactgtcaagagagctgagctctggtctggactctgtcactgacttagtatgtgcctctagtttccatgtttttattttattttgagacagagtctcactctgtcacccaggttggagtgcagtggtgcgatctcggctcactgcaacctatgccttccgggtttcaagcaattttcctgccttagccccccgaatagctgggactacaggtgtgcaccaccatacctggcaaatttttgtgttttcagtagagatggggtttcaccacgttggccaggctagtctcgaactcctacccttaagtgatccacccacctcagactcccaaagtgcgggggttacaggcatgagccaccacaccctgtctccatgtttttaaaataagaacagcaagatttgctcttaccaacctcatgggaataacagcaagaaaaaaaaatgggtaagctaccaaaaaaatcttttatttttaagaagaaatgtagttttctatttttggtatattatcaaattctcccttatgttctgacttacattaaaccattacatgtaaacatgtaaataaatattgatagtctgtcttgaagcctgactctgatacctgaaacctgaaatacagtcctaattctatagactgtatagtctgaaatgtattataaggaagagactcttttaggtgctgggatacctggtgaccaagataacccagttcccctacaagtttgtattctatgaaatagacaggccctatacaatgaaacaagcaaatattttctcaggtattgattagtgctgtaaagaaaagtaaagccagctaactgaatagaaagtgtcagaggaggggggacactttcatgaagattggtaagagaagacctgtctgagatggtgacataagacctgaaacctgaatactgagaacaactgagctatcgaaagctttagagacaaacattccaggcagagggaacaacaggacataaggctcttgaagcctgaagaagcgtgacaagatggaggaacttgaggcttactggcctggacagaaatgaagggggaagagagctttggatcaggtcgaagaggctgccaggggctagatcagacaagatcttgcaaaccgtgaaaaggagtttttattttattctcaataaaaagagaagtcattggaaaaataagcagattgttaaaatgacctcaacatgacagaattgagttggggagggtgtcctcagagtattacccagagaacttggccccaaatcttttacagatttctcttcctctcctcaaactttcccactcttgagtggctaaaatcttaatctctttctctgtctctctcaacaagagtgaacccgatgcactgcttttccttttaacatcttctttggcatttaagggcacctgagtgtagtcccttgggaaagtagattttcttcttcttcaaataaggtcatcacattcttcaaagaagaaaattctggtgagtgaaattcttcctttctgcccaccatctacctacttacttaaaccttagcagtcatctgtcaaggggatcagtgtttatttgtgcatccagtagcactttcttgtcatagccccatgaccctgctccttcagattttctcaaggacctctggagatgtttccaggttaggcatagccatgtgtttcaaaatgcagtccaccagttccaggacccaggacagaaagaactgcctgtgccaaatcttgttgaggcttaattgggaccttaaggacccttcaggacctctaaggcctttccaaagagcaagaacatgtgattcccggatgaaaagcctcatggttcacggctgccacaattgaggtggtgcagaccaccctctcccctgctggagcccgtaaggctcggtgtgggtggcgactgtggaaagcagggcaggaatacattgccttccagaaggaattcaccttattgctgctcgtggggacagtgttagctggtatgctttggcttcaggcagctgtgcctcagttcacccttcagccagtttttatttttcagtcttgagcagcttcacagacagtaacaatgcagcctatattcttccactaaacgcagtctaagattattcaataatatttggctattagttgttcccacaataacttcatctcgaacttcgagccttccaaattcagtgttttgtttcatcctggatagaccttgatgagagttcttcctattctttatgtaaataataccaagaactttctccctttcctttgaggaggtaaagttaggaatttgacatctgaatcccagtatctgtccagattgccatgttcacctttaagtcagtaagaaaatatgccttcaaaactgcattttgattcgtttctaatggaaaaggtggggcagtggcataaacaaaaatcttgaagaccctcatatatacagtctcagtacttctaactttaaaatcatcttgacccatatttctgtatctctctggttgtatttttaaaaccaccaaggctcctgtctgatttatcatgcccctttatctcttaaatcctggagttatgtcagccatgatgaaaatatacaataagctcagctttttatccaagttgtggctggatacctttgggacacaattctgaaaaagtagtcccaaatatcgcccgattatatagtacttcccctcaaaaggctggtaatgcacccatgcaaacaagaacaaattgaataactcaatttccagaaggccactgaaataatgtagagccctgaaggagaatttctataggggatttcaactggtttatcatactgaaattattttcaagaatccttctagacatttattggtttctcaaaattgtcctgtttaaggcagtaaccaaaacatcttgccttttctgtcatgcctacccctttgagttcacttccttcgtttctgtgcagtgatgctctgtcttggcttatctgtacataggtcactctcagacatgcatagacctgggggagctgtaggtccttttctgttctgatggcttttcttgtgggttctatctccttttcccttccccactaccatgcccataattctatcaaagaaaaagaaaaataatagtaaaaacaagaagctgttctttgttgtggctcattggtaagcaaaagattccatttactttaacaaatatatatagattgcctactgaatattatggactgcagcaatcagaatagcaagttattcttaaaacatagtgatgctcttaaagtgttttagctttgaattgagctgtctgctttgattcaaagtcacacagagactgctcttggaaattttcccataggcccaggggccactcctcggatttacagcaatgaaaacgtaaatgaatctgctcacttaagggagaccaagctgtgcagaagtggtgaatgttaagccaacttgccagaaactgatttataaaccagaatgctgattcattaaatgaaatgggagatgaatctggtaagataaccggcatcaatcatttgaacagggtactccctcttaatgaataagctcattgaagaaactaaattgcagatcagaaggatttttggtacagggaattagaagagaaaaaaaaagtgttaaggggcattcccttaaactcagtttactcaatttgttcctccccattttggaagtctttcagtctacgaatctggcagcagacactggaatgatgtcactcttgggcagttcttgcctttcatctaactttgatctcttcttcattcataccaccaaactttttttgggacaacaaagccctaacattgttacacaaatttaggtcagagtttattttgtattcatgacagttagtctcctgtacctttaggagataaactacagaatccagtaaagagatttgggaagtaccttaaactcatcagcaactatctatataaaccatttttttatagtcagttttttcaacagatgaataaccatgtctgtttcagcttaatgcttattagcttcaattttcaagaggtgactattttcctcattcaatttagcagctacttactgagctcctcaagagcaagaaaagtctccagaggaaacaaaaatgagcaaggcaatcctttatgaagtttacagtcagatttgagcaataacaacaataataatgagcacaaataattatggcacagaattaagaaatcatgtaagagagtctgttccagaaaatgaggcaatcacacagctgactgtgagaatcctgtggcttttgacttggaccttctagggcacatggggttttaccaagagagataagaaactgtttcatgcagttgaagagaccttggtgagacacagcatttagagagaaaagccccagacacattcagagaaaataatgggatggaccctatttgaagactgcaaggagtacatgtaaaaactgatctgccaattctattatggctttaaaaaaaaaaaaaaaaaacacggccaggtgcagtggctcacacctataatcccaacacttgggaggctgaggtgggaggtcccttgagcctaggaattcatgaccagcctgtgcaacaaagtggaacccagtctcgaaaaaaagaaaaaaagaaaaaaaaattagccaggcatcatagatcacttgagctcaagaggaggaggctttagtaagccgtgattgcacaaacgcactccagcctgggcaaaagaacaagaccctgtctcataaaaaaacaaaatctaagacacaacaaaacaaaaaacaaaagccctgtctctccttagaaccacaacagatcaagttatctgatgctttttttttctttttttacttttatgggtaacacttgtatttgaaaaagaaaagaatggcaattaaaagttaattattaaggcaataagcataacatttattaaatcgatttagaagcaacttgattataaatcttttttcagtagaattcagtcatcaatcgctgttccatatataaccatctattcctgatggtgtaaaagaaaacatgcaaaattaatataagttctttaatttctgaattttggcaatccctttacgctttgggtgactgattatctgtcattttctattatatgatttcactcagaggagctattttttgtggtgttataattagaggaaaaccaataatcgataagaagatagtttgaactgagcaacaagattgttttgattcaatgtttttaactgattaaaagtgactaacgtattttgttttcatccgtgacatgtaaacaatagaagggaatctcgctgtatctaacttttttccccaaacccctctctcattctccttccaaattttcgaggtacgaaggatgactttctgacttcacataaattgcccctgaaacatttctgtagttagtgacagctgtcttctacttacttccaggagaaagactttattcacacaccgttaaggctctttttactggcttgagcagcttacaaaagagagaaaaatgtaacgttatcaaagactttcttgtggctttcactttatgctgtcttccaataatatatactggtacctaaacactgagcagcatggagaaggagtggcctgacctgggtgaatttaacttacggagacagggctttctaagatgacacaggaaaggtattgatgagataaaagccactgaaggaataaatcattcatatgatattttatttttattaatttctggttcagctaaaagtagagaaatatcagatgaatgctattccacctagtcgtcagaattgacaagccacccaaggtcaggattgggggctggtctggttctggaatcagatggctacatttgaatcccaacttccccttttcactaactgtgactttttgggcaagtgacttaattttatacccttaagttaattttttctcttattcaatggaaatattaataatactttcctggtttagagtaatgattgaattatatggtatatataagacatcagtacaaagcgaggcacagagtaaatcaagcaataaatggcaactattataaaaaatggggccaggcacaacggttcacccatataatcacattttgtgggggccaaggcgggaggatcacttaaggtcaggagttcaaaaccagcctgaccaaatagcacacacacacacacacacacacaaaattaacgggaggtattatttctctataacacctatttaattgttctgggcaggcatttgtatacctctttatgttctatctgtcttcgtaaattatagaacacccatggctgtcactgaaagacaacttaagcagacccttcaccatgcccagtgaagaaacagaaagagaggaatttgggggattagtatccaagccattgaatcattaagacagaattgattgataaaaggatttgtgtttattaccccagatagtgaatttctctcagtagaaagagtgtcttttcatatcagtgtaggaggaaattcattacccattaatttcttaatgagacaaatggtaggcatctactggaattcatctatggaaacatgtttgtgtatgtgcataaacacaagtacagaaactcacatgtacgctcatatgcgcatgcgtgcacacagaacgggagagaaatttgttgactaattcttttatctttaaatatatgccatttttactgagatcacactcactgagtgggaatttgagagttattttagggttatttttggtgtatataattatctcaaggctctagataaagatcctggagttttaagcccatctaccaacattctggtttgaataagttatttgaaccagcatattagagagaagataaagtcttaagatgtgaggttataagattcctttttttcacgagggcagctaatgctggaactgcacgagtggcagaggtagggtaggagttgacttttaaaagcaataataccccttagccccaattttgggttttttttttcaacatgtttcaatatccatatgttaaaatgttgaatatttctacatctaccatattcacctatgcctgcttgtgaatttgttgtggagggttaaagcaagcaggacaatgtctgtctcatgttaactgctcagaaagtggtagctactcttactgtctcagacagtacctgagtctctcagttatccaccatcagtgttattttcttattaccattagctctcaaatggtaattttcaatcttttctacatcaaaaaccccttggggaatttgatgaaagctatgtatcctctattaaagaaaagtgcgtatacctacatgcatataccatgcaccatttccatacatagtttaggagattcacctattccatgaattgagagttttggtacaccagtctaagagctccagcacgagttgagaaactgctctttcatcttttaaggatacattccaagtgacttatatttgattttagaaaatactggtgaacatactccaaactacttccttgaatcttttctcttgggtcttgaggtaaagcctggaatccttgatgctctggaaactcttcagacagactaagattacttaaatccgtcagtacctcctgggagctggtacaagatgcaattcagaatttaaaattattcagaatgtactaagatgagacagtttatatatgcatcatgtattacatagcatccaagagagttcagtggcagcatcacataacgaaacagattaatatttcttcatcaaaacatgtgaatattcatattaagtgtaataaggactgtagatagcctcacagtagtttcttttgctaccaaatgagtaacattaccataaaaacaactttcagttatcagagcttttagaaattcagaattgcaaataaggatttgtggatctgtagctgaattcatgtatccagggaatcactataaaactcacatccctttatatttctcgactatacctaaagggttataaattgtatactacaatcagccttagatatcttgtagtttgccaagatggatagtttataaatttatgaattacacacagactacatgcatataaagtaatatatatgcataagtgtatattgcattacatgtattagtctgtataattcttcttttagcagtattcagcaatgcatccaagtagctctacttaaactagtatatattgcttgcctagcccaataaggacatataaatcattaagaaaagatttgaaaattatagctggaaattagaaaactgtctgcaatggcatagtttcatagaaacagaaaatggattgagtaccatacttgaatctggagcccctctcagcttcacttgaaataattttgcctgaaaattgcataacacgagttcactgataagaaaagcaattaattttaataaaataagtacgtctaaatttaaactatcttttagatttcaaatagcacaagagaaaaacttccacagaagtttaaaacgtactgagaacattaaaggaactgccaaataataataaaacataataataaaacccctaaatttaaactatcttttagatttcaaatagtgcaagaggaaaaaacttccacagaagtttaaaacctactgaaaacattcaaggaactgccaaataataataaaacaaagtaaaccaaatttctatgtctatgtccatatttctaactatcatattgtcttcaagtcactgctaaaataaagtgctatcaatgtaaaaatgctgaagactgcttctcccttcctttcaaagaaaatctgacatttagatatgaagaatgacaccttcttatgcctccttcatctcccatctatctagaataaattgaataccttgcaagggaggcaaaactttatcttcacccttttagggtcttcagctggcctgagaactaaattgatataagacagattgagaggggaaaagcatacaaatttaatatgaattttatttgacacaggagcccttgtaagaaaatgaagaaccaaacaagtggtaaaacctaaatggttttacactagattggacaaagggaggcaattctggaaaagtgactgactaagttgtatgaagaggcaaagagtatgggagacaaagagttattttcacaaggtctgtttgtacagaatctctaggctttgactctccatctctggtgatgagaatgtttattttcttctggtataggaaagacatctttcacttgggagtttcatcgcttgctttcaggaagaaaagggggagatcagaatgttcttcttgtacttgctgttttccaagtgcctttagctcaacataatccttatgccaaagtggcatagttgagggtagcaaattgtgccacccttcaacctcctggtgttccaaattttgctttgtgccttgaaggaatctaacagaagtaccagaaacacccttctatgagaagaatttacagtctatttagaaaagatgacactagggtggtatggatcaatacagcacacaacacacaatacaccgtaaagtgttttgcacatcataaaaactcaatacatatccgttgcttgattatagaacgttcactttcacagtacctctgaccttttatttttcaatttagtctctctgcagttcctaggaccacatatactctggggagtgcaaaagagacttttacattaaaatatatggaagtgccactctgtaagcctgaaaaagcccaatgccagccattttttatggttcattgtggcataagaattgttctagaatatgttaccctaggtcagttactcttttattcatcttctaacctcaatcttggactttttgtattagagcaacagccacctcctacccgcaccatgaatttgttcctaaaatctgtgtatctcaagatcttcccagtgataattgtttaccctggagcttggatattacctggctggacatctggctaataggccttgtgtcagttttcttttccctccagacttgcacatccctgagagagagtgttttgtttttttttaaattttgttccctaggctctttatttgcctcattttagtcctagtcctgcatggcatcacacttgatcatcaaccctgagctgtctgaattcagccatccaaattccactgaaatgttctcactcctaagtgggtatttttcaccctaatcatattacctcctctgcagcattgggcactgtgagtcactctatccttaccaaagctctttcctctgttagcaatcatgaagcagctgccttgcttctctgtacatctgtacttctctaatcccacaattaccacttaccttttgaatctacccaaggcctggtcccctctcttcttttcattttaaattttctctgggcaatctcattctggaatggcttcaactgctaactacatgatgatagctttgtaaaccccatctctagttgaaacttctattctcaactgccatctcaacctggaggtatcacaaaggtcataggctcaactatttatcctcttcaggttttttcttttacagttggtaacaccatccagtcacctaaattaagactttggaatttacctctgatggctctccatagccaatctaccaccaagtattttctttcttttttccctaaagccttcttaaaactgtgtttttcctccccataccttctgcacttgtaatggagatcaccaaaagttacccaaagccctcctcagataacacctctgaatgtgatttttcccttttcacctgagaccagcataagaaccatctagaaactgatgctgtgatagcatgaattattttcatacacctttgtatgtaaataatttccacataaaaatttctatattacttttttatgaaatgtgttaaaaattactgaaataaaatacttctactttgaaccaatttatgaacaatatttctagaagagttatagatattctatacaaaatgagttcaattgtcgttggtttttaccataagacattattgataaaatcctaatgttggaatctaataaatacttacacagaaagggtccttaaaaagacattaaagtgccattgaatgtcttctagaagttacatttaaagataaaatacattgatatgcttttaacttatttgggcattgaataaaagacctttcttataaatgagcataagacgattagtacaagagtggtgaggactgaaaaacaattcaagataggaaatcctgaaattgatgttactttataaactctatttctaacaaagaaaattgaaaaactttgagtttttgaaatgtataattattctaatacattgagaactgtttatcaattatgaccaaggatacttcacaaaggctagtaagcatgtcattctatgtcaaatcaccctcccgataggtattgcttaagaacctgctaggaagagtgatgtgaaaaataatacaaggaacaatgcattgtttttattccaaattagcttataatttagtgtgtcaataaaccatataaataactataatactctagtagcatatgatgcggcttgtaaaagccagtcacagagttaactgatgtgactttttaagttagaattaaatttttttttattatacttgaagttctgggatacatgtgcagaacgtgcaggtttattacataggtatacacgtgctgtggtggtttgctgcacccatcaacctgtcatctaccttaggtatttctcctaatgctatccctcccctatccctccaccccctgacaggcccgtgtgtgatgttccccctctctgtgtccatgtgttctcattgttcagcttccacttacgagtgagaccatgaggtgtttgattttctgttcctgtgttagtttgctgagaatgatggtttccagcttcatccatgtccctgcaaaggacatgaactcatcggtttctatggctgcatagtattccctggtgtatatgtgccacattttctttatccagtctatcattgatgggcatttgggttggctccaagtctttgctattgtgaacagtgccacaataaacatgcatgtgcatgtgtcttgcacaaaatcactctgtcaccttagcacctctttctttttgtttgcctttggaaaattctgttgaaaaccctttctaaattcctgcccacaaaatattataaaaggaggagggagataaagaataggagtaagaggaggagaaagtaatgaactgtggttaaagattaaagctttttcagaaaagcacttatcaaaagtttctaaagagctcaggagttaatgctgtactttttaggcaataatggatgggaattgcttttggaaagcactcttttttcttgaagagtgcaaaaaatgtattcctttgagtgaatgaaaatcaatgttatggtcaaatatagaggaattgaggagaaaacaaggacaagaaatgctctaaagagaagactttgttgcctcttttcttcttcatcttaggaataggatatcaatatttgaatcatccatgggagcttttcaaaacccctattcctgagctctacccccagagaaatgcaatccaaatctctaaggataaaactcaggtgtcagtattttaataaacttcccaggcaattgtgatatgtagtcacagttgagaaccactgctacaacagatctaaaaggcagaagccaagtaatgctttaatgaagaatttgagaggaggaatatacatcaccctcagctactgtcacctaactagctgatcctggtaagactggtagaaatatagcatccaaaataagcaagggataaaagactacaaattgggttcagtgtatactgcttaggtgacgggtgcatcaaaatctcacaactcaccgctaaagaacttcctcatgtaaccaaaataccacctgttcccccaaaaacctatggaaataaaaaataaaataaaaataatgaaataataaactgcatttctcagaggtgcaaaatacccaaaccctaaatttaaaaaaaaaattagtgagaaaaaataaaatttccctagctgttaaatccgtgatgtgatatttcttcttttaatctgaatctaaaatgttcagtcttggtccaataataaacacactcactgaaacacacagtaaagaatctaagcagggtgagggccatggctcatgcctgtaatcccagcacattgggaggccaagatgggaggattgcttgagcccagaagttcgagaccagcttgagcaatgtagcaagaacctgtctctacaaaaaattaaaaaataaaaaaaaattaaccttgtgtggtagagcatgaagttgaggctgcagtgagccatgatcacaccaactgcagtccagcctgggcgacagagcaagaccctgtctcaaaaaaaaaaaaaaaataagaataatctcagcatttgagaagatgataatatggaaagtcaggtgtgaggtcagcatgtgggtgaataatttcaaaagctcttatttcttaatatcagtaaatatattcccctcttacagaattcatgcatggtattttggggtgtgtaaaggtacctctcacttattctcattctgaaagtctttcacttccttggtggatgaaaaggaaagctgcagttggttataaaaacgtgacggatgatttaggtggctgtattcagctgtaagcaataaatgctgagctcggcagaaagtactataggcaaaaacgtgtgatttactagctatccaaagcacatgagatttataatgcatgagaccctcaggcccatcacttctcttcagtaatgggaaacaatattgtgggaaaaaatgacacatttaatttcaactttgtgttgtaaaacaaaaacgcagcctaattttcattttattattattttttttcttttcgtaaagcatctttgcatcttattggaaatacaaatggcttcttaagaagtaggaacaatagagcatgttcaaaacaatatctatcggtagacatttattactggctgcatgtttgtacgtgtttggtgggatgaaaatgagaaacccggagtgctgtgacagactcattgtgttctgatagactctcccgaaaactgattctagaagcttagtgttctttaaggcagatgtttagccaggtgattgccgtggttacctatggataccggataccgaaaagagtcttggcatacttaaaaaaaaaaaaaaaaaaaaggctagagaaaaaaatagtagagacattttttacccactgaactgagggtgaaaaatgtagtcacaaaagaccatgaactcaaatcccaactctgttaatgatatataatgtgaatgccataaactttctgtatctcattatatcatcctgtgaaatactgacctattttgcaattgcaatgtgagagataaatcaaacctcttctaaggtactttgaaaatagattctgcatttcagaataaatattaaacaataataatgatgatggaatagctgacacaatgcaaattttaaatagagcagagtaactttctaattatgagctacattttattctttgtgagtgtaattagaaagcgaccatgttcctttaattagaaagttaattagactgtgacctcttttcctgtcttactgtcttggactacaggccaggagtaaattgcaaatcccctgacctacatgactatagccccccaaaatcagactgtttaaatagaaataacattataaggaataacattgggacttgcaagtcagatggggacttcataggctatagaagggttctctcatgagagaaaagtttatgtggataaataaaaaagggttctctcatgggagaaaagtttatgtggataaataaaaaagatacttttccagatcaagcctatagagtaagttccctaaattgtattcaggatgttggttcctttgtccagtgactctattactttagtatgcatgcaagagaattacctgaaggacttgtttctgggctccacacatacaacttttttttttttctttttttgagacagagtctcactctgtcgctcaggctagagtgcagtggcacaatctcagctcactgtaacctccgcctagcgtattcaagcgattcccctgcctcagcctcccaagtagctgggattacaggcgtgtgccaccatacccagctaatttttgtatttttagtagagacagggtttcaccatgttggtcaggatggtttcaaactcctgacctcgtgatctgcctgcctcggcctcccaaagtgctgggattacaggcgtgagccaccgtgcccagctgcacatacagcttctaattcagtaaatgtgggactcgagaatttacatttctaacaagtttccagatgatcttggtgacattggttgagagaccacactttgagaactactgacttagaatattaatagtgttaggccgaagtattgttttgtgatcaaataagtttggaactttcaatgttgaacaaagttaagcaagtttgttttttgtgtgatacctcaaaacctttgaatgttaatatgctttggaaatctccaagaaggatagactgcattgctcctgaagggggtggcccttacaaatgttttggctctctttatctcggagctacaaacagaggttttgctatttcacatagtgttcttagaatgggttgttagaatgctttgttttttagcattaacagaagaatgtcagaaatgagtttccattggtgtaatttgtggtttccccatgtgtgtactggccaaaatattgtagagacattccctactcttgtatgaagagggtatacaaatctagtaaggtttcaccctttaatgtgagaaatggtactgtacatttgattaccatttttggaagtttcttgattgcctggctcctgatagcctaattagctgaattatttctctgatcttatcatgtttacctcatatgaaattttcatgtaaaatgacatttggaccactttaaagaaatgtgtgacttcatagagtcgactgttttgagctagcttgttcgtaaatgtctaaagaaaaatttgctgtgaaatttgctcacattacaatctagaagcaaaattcctagagcgagaggttaaccctctgccacttctaaccagtggcaattatagatacttatcagaaaagagcataataagttgtgcaagatgagattgcctgaagtcagattaaaacactgcccctgctccccactccaatacttgtttgagtccttgttttcaaaggatttcatgcatccagtgttattcaaaaacacttgcgaaaatgctgtgtgattatttttaacttctcagaacaaaaaagaccgatgtcacaggaaaccaagcagcattagtaaactggtctgtgacatctctattgcactctgtgaaaattccatgaaaagcaaaatgggaatacaagaatcacagagaaacaaacaagtggagaagaggcaatgacttcatgtttatgttcttggtagcaatttcctagggaaataataacttcagagaaatagtcaatttgccttacctggtgtgatatacgttgtatattgtctaaaaaataagtgctctagaataggcaaaaacactttgcctaaaaagttgtgtacgtgaatgatactggaaaattcaatgatagcctttttgtctgttctcattttgtgtagttgagagcaagatgctcacaagtacatattaatattgagtgaaattaagaagtctcatccccagaataatgttgctcacaaaatagatgctcaataaatgcctgtggttgcattgggctcatttctgttcatgtgctgtttttttcttttcttttcttttttttttttttttttttgacagagtcttcctctgtcaaataggctggagtgcagtagtgcgatctccactcactgcaacctgcacctcccacattcaagcaattctcctgcctcagcctcttgagtggctgggattacaggtgcacgccaccacgcctggctaattttttttttttttttttgtatttttagtaaagaaggggtctcaccatgttggtcagactggtctcgaactcctgacctcaagtgatccacccgcctcggcctcccaaagtgctgggattacaggcgtgagccactgtgcccggccacatatgctgttttaatttcaacttattacatggcttagaatatatttttaaaaagatattttgatgacacaatgaccctgatctataggaatgccatttttagccagaattaatatagagcactctgctttgggattagctttgggttcagtttttggccatatcatttaccagctcagtcatgggaaggataccttggaacatttaataattttttggagtttcagcttgattctcccaaaatgtgactgattaaatcttacctaatacgtcattcattcattcaacaaacatttaatgaatgtccagatgtgacaggtgctgctccaggactgggggccaggagtaaattaatgcattagctgctctcatggagcccacatctggttgcacaagacaggaaagaccaccagaaagtacgtagtagaatatcttgggataatgagcaccatgatgagaaataaatcagagtaagggaacagggagaattataaagacgctcttttattaagaatcaggcacagcctttctgataaatggaggtttgcaaagacgaagtggtcttctgtgcacgggacaaaatgagataaagcatacacaaatagattgtgaaatatttgacgtggtgttaggtatgaagcaaaaaaaaatctatttcattgtgattaccattaccatattatcactgatgttgatgtattttcagaaacacctatctcgtgtgcatatttggtagacaaacctgaggaaagaattcctaactaataaaaagcctcataaatcaaatgccacttaacaaagggaccagtcttgttaacattgctgcaacagaactcgagctctcaccactgctttagtgagatcattaatatgatcattgcaatagtttgtgctcctaggattattgatagagaaaatgtgtatgataataactattaaaaatgatatcacccatcaccatcaattactgattcctctgtatgcatcatacaatgtgcatagtgctttatattttctattgctgttagttctcccaacaatcctataaggtagatattcttaagatgttgtcaaataacttgttcaggatcacccgggcaactttgtaatcagacctgggatggaagcctggagcagagtgaaaacaatgcccatggcctattgaccacattcataataaaatatatattggtaaaaaaaaaataaaattacaagactcttaaacttttatatgtttcagttaacattatgaaatagacaactaaacttttgccctgatttggaacccagacttctgtgtgctctttgttttttaatgaaaaatgtgttttaaatacttctgtggtctgaaagtatcccctagaattcctattttgaaaatccctagtgtgatggtattaagaaacggggccttttggaggtgattaagtcataaagatagaaccttcatgaatgggattatcaaccttaaaaaagagatcgaagagagtggcctaggcccttttttgccattccaccacttgaggacacagcattcaaggcaccatcttggcagagaccagtcccttaccagatactgaacctgctgataccttgatcttgcacttcccagccttcagaactttgagaaataaattctcgtttataaatttcccagcccctatagcaacacagactaagacaaataccaaataaacataaaataaactcttggagaacacatttgcacacccaaaacttcctgaagatagcaattcctagaattcgaagcactgagagagtaaacaatttactttaacttttgaaaccatgcagcctcccctcaattccatgttttatccctcatctgtcgatagtgcatggtgctgtaggtcatgatcaaacttccaaatagaatcattcatacaattctaagtcatcattaaggccaattcagaacgtggagattttataatttagttgctgtttgagaaactgaatacctaagacagcttatttgattattgaactttatttagtggaatgacctctggtggcacaaataatagaaactgctttcaaattatcattcagggtagcttgtagttggccatgaatagagagacaattaagtagcaaatttattacaaagcaaattccccagtgacctactgtttttcttttctagtgaggttcctcaacgcataatcctattacttttggcttgaatgagctagtcactgtcttccaagctgaactatgatgttacatggaagtttaattttcatcttatttaatttgaccttaagtgagctggatcatgaaaaggcaacataatctccaattctcgacgttaagcgtcttttaactactctacccagtaatcattcccaagagacattgtgaaattgtttaaaaattggtcacaaatgctaatgctaattttatgcccccagatattttggcatctctttcttcttattgtgccttttacactgtgaggcacccagcaggacattcctatggatggatggacttaaaataataaattccaaccaccattctctctggctaggccccctgctctaatgcttaacacaatgcgtggcacatggttagcactcatttggtgttagttgtctgaatcacgaactcaacgaattaatgaatatacaaatcagctaacaaacagacagcagaatgttgaccttctactttctctcatttgtttgaagtgcaattcaagaccggagaaccaagtggacaaaatactgcatatagatacagcagcaaatgcttaatgacttaaatatcctggaaatatttttatatcttactctgacttttcacaaacattaaaccaaaggaatgcttaactggcaattttaggttctcactgggcaaactcatgggataggcagtgtggagaggggcttgcatatgttttttgcatcatttcaataccccacatctgagagtgtacaatttgggttagatttccactcaaccggttggaatttcaggttttggactacgtcctctctatttcctctttatactttcatatttggaaagcatgatatgagtactgtcttagggagaggatagacaggaaagggaagctactgaaagccttcttttgaaataataatttcttaatctatgcactaacacacaagagtttatatctcctggaattttaaagtaataattgtagtgtgacaaaacaatgttaagtcataagatacatttcaacgttttaaaacacacacagaatacatcagtgcccattatgtgataactgagagattaatttgcaaccaataatatccttggtattttagcgttgtggattgtcaaaggcttgcttattgcaggttaagacattaaagggcccacattcccacttcttattaaagggagactttacgaaaggtaggcactgtctctacacttctgggaagaaagcctggtgatacgtaatgctccccctagcagaaaaatagtggtcaccagaagcatctctccataagataaggtgagacaaatagtgctgggccaaaccttgtgaactatgggcttcaacaaaagctaagagtctcatcatataactctcacctagactcagactatttcaagcaagaattaaggtaatgacatgaacttcttgccacagttatctctttattataaaatgtccttgactacaaggaggtgtaaataataactgccattccatggataatcagggtaagctctatacattgtctgccaattaccatgtactacttgaaaattgttaatttagttgaacttgaaaaaataaacaagtggccctctttggcatagtctagaagagactgcataggaaaaatgggaaattaaggtggaggatgatggatggggttctctgagtacagcagagggggcaagcagaagagttggagcatcatgaatggggtcacagtacattagtatggcttctttggcttgattgtggaaatgtgagagacaactattgtgagattcaaagacagtggtaacatatataagaagtgactgacaagatgacagccactcaggaaaactgcctcagaaggcagccagaaaggatcaattctggaaaatgactggcggaagctattaggcatattgaatgggtctgacttagtggttgatttgacaatgagagcaaaagatagatgttataaaacatcattcagagtcaatgaatctggctattgccaaagacagagaaatgaaagaataaaagggaaggtatggggaagaaaataagaaaaaaattaaatgattatctttagtttctgcattagttcttctgctttggaatctccctagctgcctgcagccaggggcaaagatagtttcacctagagggtcctgattgaggctgaggatacctaggctcaatcacagcagtggcacttcccattcagaggaaggcttaacattaattatgagacatgagatccaggtgctgaactgacaaatctattctctctcccaaggcttcccaaatcacagctccgataggcagttatcctagcttgtattagtcataattccctgtagccagagcttccacttttccttgcgttctgattttgatgctatcttatagattaccctcctaattacaactcactgcttacctggttctccaggaatcatagcatagttttttgagtactctgtctcacttgcctggtcaggacacactacctcactttctattctaaccatttctcaatgccgaggactcatatctcagactcaagacagttatattgttttatttttaaagtcactaagatatacccatatcttggtattccataagcaagaaggaagtgagatgagaaagtggttgcaaccacagtgttaaaaatatggactggaaacttgtctatttgcagatggtattagatttctattgctgctgtaataaattaccacaagtttagtggcctaaaacaacacaaagttctcgtcttacggttcagtaggttagaagtctgacatgggtcttactagaacaaactcaaggtgaggctgaactcaacagggctgaattcctttctgaagctctaggaagagtccatttccttgccttttctaaattttagaggctgcccacattcctcagtgtgtggccccctttttccatcttcaaaaccggcaacgtctaatctctctggcccttttttccatgctgtatctctgatcacagcgggacagattttctgctttaaaggaccaatgtgattagattggacccaccaggaaagtctcccatctcaaagtctataatgttaatcatgcctgcaaagtctcttttctcatggaaggtaacatatgtacaatttctgaggttcagatgtagacatccttgggggaccattattctgccttccacaaagatattttctaaaccattgagaacagatgagagtctcatatccactaacaagagccattttgatatgcaacacagcaacccaattgacaaggaagtcctcagagatagtgtagactgtgatactcttcatctttaattctataggttttacctgcgtagtgtctgacctgaaagtgacaaagtttcccacaccttgctagatattcccacacattcctatttagcccatctagacattagaagggaagctttcctatttatgattcctatttaattggagtgaatggatttctgtcatttcctgttgttccttccatagccttatgattgtgtggtaatttgaaatctagacctttttcttttcttttttttgagatggagtcttgctctgtcacccaggctggagtgcagtggcgctatctctgctcactgcaacctccgcctcccaggttcaagcgattctcctgcctcagcctcccaagtagctgggattagaggtgcccaccaccacgccgggctaattttcatatttttagtagagatgtggtttcgccatgttggccaggctgacttgaactcctgaccttgtgatccgcccgcctcagcctcccaaagtgctgtgattacaaatgtgagccactgtgcccggcccaatctagacctttttctaagttagttataaaattttacatttttccctccttgcaaatttgttcccatttgaagaaccatctgcaagaagaagaatacataccattcaccaaaccttctatccgttgggtctatcagagaattagtattggtggtgtcttctagtcctcttgcagattaacaggttatccacttgacctgattatccatgacatcaatttggtgtatcctaaacttcatcagagcagaatattcctcagaaggaatatcatgtcaggtagcttttcagcactaagcctataaatatcctgcctgtgtaggcacatgggagtcaatcctgagaaagcagctcattgaggcaaaaaggggagatttttagctgaatcagacaattactcaataagtctgctttgtggatgtttgtgtctcccccaaaattcatatgttgaaagctaattcctaatgcaataatattaagaggtgagacctttaggaggtgattaggctctaccctcatgactgggattgatgcatgtataaaagaggcccaagggagtttccaacaagtgctgggctatctgctgttagctagcacttaagatgtcttacctgtaaagtgtctttcactataattagtctttctgactaattgtcagattcagctaacaatctcttctttttgcctcaatgagctgctttctcccatttgcctacacagaacataattgtttcatacactagaattagatcagagtagattcaggctcttcattacaaaatgctcatctctgctggatgttaatatcaaaatcagaattctagttctatcacatattgactgatataagaataagtttagtttaaaataaaaggtgagagaaagaatggaaaagtaataatatggaacatgagcagcgtctcgacttgtttctgcttcctctctttttcttactaattaaaacagataacaacaaagccctttggtcacagcccacacaatcacaagtggttccctttgttgatgtgatgtcactggaggggaaatgagcagttgacaggctgtgcaaccaagaaggcaaaatgagctcaaccatttgaataaaacatagcaggtctcccactccatgtcattgactgacataacccaccagacagtaccctttaaataggctgtctctcttttatgtagcaaataaaaaaaaaaatgtaacatgtaaatatcaggtgattcttcttcagcatctgtggttgccagaaggaatttactgccttttcattgtgtggttcaacttggtcttcaggtggtgtgccccaaaatccacaattagtgggatccagtggtgctgtggatgtttgtgccccccccccaattatatgttgaaagctaatccctaatgcaataatattaaaaagtgagacctttaggagttgattaggctctgccctcatgaatgggattgatgcctgcgtaaaagaggcccaagggagtttgttagaccccccacttccgccctgtgatgacacagcaaaaagtgtaatccgtgaagcagagagctcacgccagacattgaatctgctgtcacattaatcttggacttcctagcctccagaactatgagatataaatttttgttctttataagccaccgactttgtggtattttttgttataacaacttaaatggaccaacacaagtgatgatgtttctagagtctgtgtatgtgcatgtgcctaagtattttgccaatttagcgttaatgagtacagcaatgccaacaatggatccattctttgcctctcctattaccgcaggtctccttttcacagatcagtatagataagggtagtagagataaatattacgaggttatctgttagtgcctgttcaatcaactcttgattttacagtagtcttcctgtgtaccatgacccagacatcttataaaagcaaaacacaaattgcagttttaaaatgctattgctctgcaccattattttcctcttcccactaatttgcttgcgattcaatgtgttttctagcatctctcatgtcttgggttcttggccctcatatttccctttggattgcttcattttggtggattttgggaattcccccttggctaataaaaccttggttattcctttctgttctgctgcctagatgactattccccattccaaactttaaccctgtggaaccccacccccacacaggccatctatagacctttgttcttcctaacattttcaacagggcaatgaagtgtttcataaatatttggggttttatggaaaaaaaatgctctaaggcagcttaaagctattcttcaaaataagaaaagtattctatattttaaacatgtatatagtcatcttctttactggggaattaatggagtactctaagctattgcccctcccactctcttctcttcagctacccaaagtgatgatgtggaacttccagattttctcctgcaagttcatgctttatttattccattatgaggtccacatcaaattatattaccattcctgggattctggagttcagatctttggaaaatcacagtgtcaacagaaattataagataaaggcacttatatatgaggaatgatcccttgccctgcatttacagattcagatcaaaaaccaatgcccacatattttatctctagcttttactaaacagtagagtccgtgacttcattcacagtaggtgattgatacatttcgacaaaagtattttgcaaagacgcttcctgcagcatcaacagtaaaagagatactgaggtaggtgctatatgtatcttctggatacaaatttccaccaaaaaaaatttcatcttagcacatatctttgacttatggtgttcaattttaaatataactggcagttttgataaaatgcattcctttccattgtttctgttacaaagaatgcaattttaaggttttctgtttttgtaaattggagcggtggatacaacagttaccacccccacacatacacttctctaacacatacatatatacacacagttttaacattcccaattctttaaaaaattatctttgatcaaattattgtttatatgatgtaaatgccttggacactactgcctgtcagtgatgcgagtcagttcttctattccttttattggctcctcagagatttctggaagtccatctataatagaatcattatttcataatgataacatattttaaaaactcatggtttcagaaacatgagcaaattgccttgtaaaagcctacattgagggagttgtgcagactttaaaacacctcagcttctcactgcacattggatatggttgagtattgcaaatacagccatatttatccatgctatctagcattagacagtccttatcatcaagtgatctgagggcctccttcatcagcttcccttggaatgcttgctatcaaagtactttcctgagcccgctacagatttaacaaaccagagtctctgtgcacccagagaagggagtttgctccagtgattttcgtgcacactaaggttggagaaccattgtccctcagagccattagaaattcagcttgcatcagtctagagttctacaagaggcaatcacaacaacatgctatctacgaaaatcctatatttccatccctgactcagaatctataaatttcagtttaatttccactaaatgtattatcccgggaaaaagggcaggaagtaattatggaaaaaccattgaaacgtaagcatggtgagcagatagtatgaatatgagtataatctgacacttttaatatctcagagaacagaggaacaatagggaaagcaggtactgaccagccccagttcacgtttgtttctgccctcttgggctgtgcaactgtgtgacttgggcaagttacatgaccttgatagtcaaaatgtgaatgacagtatgtgtatattagtgatgttgtgagaattaaatgactgatataatgtgtccaccaagatagtagacagatagtaggcccccgtgtattagttacctttcttgttttctaccactactacccaagagggaagcttctaaactctgaaggagatctgttgatagagtctaatgtgtcatccagctttgtctctgggtcatatagagatacagtttgtatgccaaaaaaaatgtagtcctctatacagttcagaaaattaccaccaatatgctttatcaaacagcagctacagtgtagtatatgccaacctcagagtgggtctcctcttaaaggttcccaagtatccagtcatgtaaatgaagactgcatctaaggagttagctgtacagagaagagtctctgagaaagcgaaatagggttatagtctcctctagtccttactttcgctttaaggaaggagaaaatagcaaagagtgaagaggcctggaaaattgcagtaaaacagagcaaataggataagagactaataaaataagtggagcacagagaaactaaattgaatgacaacacatgagaaatgtactcaagttttgactcctgatttgtgaaccagaatctgccaataacaactaccaaatagatcagcccaaatatctattagtaacccccaagaacagtgcgatgtagtagagtgacccagcaataaacaaggccccatctctgccttctagtgttttacagactaggaggaagcctccacaaatttggcacagttaatgggtagctaatcagaaaaaattaagcttatatcaatgtacttaagctgtgaagaaaaagcctcatacttcttgttaaaaataaatatagtttgattgctcaaagagatcccagtccacagattaccacagtaaataattgcacgcccatctcttttgcaaagcacaaagcaacctgctccacgcgcctcagatgcctttctgaatcaccacagagggagacttttaatcatttcaacaaccagagcaccagctttgttctcaaacaatgctggaaggtttctcacacctctactatccatagtattataatttttcatttttcataggcaggggttttgttttatttggttggtgttgtcatatcccagaaacgaaacaggcctgcaaaatcaatgccacacgtacaactatgtatatattctcccctgtaaatctccattagcttgattgggactccatagtggctggaggtattgcctgcatctgcctttcattcttagtttgggcaaaatgagtggtgaatgactcttatacctgccttttaaaattggggatctcagatgagccctggctctaccactaattgcatggaactacttggtaagcagcatcactgaggcatcagcatcccatcatatttatttctagggaagatgacaaattatggccaaattagcatcgatatgaacaagtttgtagaagggtcaaaatataaatacaatatacaaataactacagcagtaatgtttttaatcactacattttcaaaaatattctaccgaaaagggtgattaacaaattattattatgttaacctagaaaaagaacataatcagtatataatcactaagaagacattaggcacatttaaataagtaggtgtttgcatgttaatacacacgtactcttagctcaggaacatgatccattaaccgatagaacgagtaagatgttagctaattggtgagttcttgcagtgagaaatgtctaatgtgagtccctggtacctgtgattttcaaaattatttaaacaggaatcaaaactgttttaataatttttgaaagcattcccatgctttagaattttggtttaaggcttagaccaaaatcatcatggaaaaaatgtgtgtctagtgctgaatcactttgacttgtattagaatgtcagctccaagaagacagacatttttgtcaatttttaatcatcaatgtacccacagtgtttacaagagtatctggtacactgtagggttattagcaaatattcacaaaataaacaaataaataatacttacctgtttcattacagtttctctgccagaattgtaatcattggtcaagtttgatagtggacatgggcctctttcttgggaagtaataacaataggaagatatggtactgaatgctagcttatgggaggtgtgggttaagaggtctcagggatgccctgtcttataaagagctctgcacaaacttaagcttaaactaactggaaaattaggacagccatctctgtcatttctctagcgtcttctaccctctattgctttccagatgcaactcaggggactctccttcccattttcctggccctttgctttctttattgggaactagttaccttcaattctccccctttgggtttatatgcattttagattattatggttattcttcttgtaacctcatttgcgtggtagatgcaaaacagaatttgagacattgccatgaacaaaaatggagccaattatttgtatttacatacttttctgaagtctattcatcagattttctgattcttagtgaggacttacttaggattattcagatgtggtcaagacaaaagcaatgaaataatcatctgaggttttgtattatctacagatataattctttatatttgctaaataacaaaaggaaatatttttctcttgttctctctgaatgaagggcaattgtgctgtttttctgtcactgtctataattttacttctaagaaatggcatgaaggtatatcagttacataagagggcttttatttgtcctttttggtattttttagtgtttggtttaatgattaaaatatattgtatctcttagatagttaactatacacttaccatatgacccagcaaccttacttctgggcatttaccaaagagaaatgaaaatctatgctcacacaaaaacctgcacatgaatgtttatagcagccttattcatgattgccaaataacttaaaaaagcagcctacatagagttcattgggtgaatggataaaaaccaactgcgatacagacatacaatggaatagtacacagcagtaaacaccaaagcagactcttgatatgcacacaacatggatagatctcaaagacattaggatgagtgaaacgatctggtctgaaaaggttacacactgtataattccatttatatgacattcaggaaaagataaaactatagtaatagagaacagaacagtggttgcctgggattaggagtagggagagaatgccacttcaaaggaataataggattaagactttgggggtgatgaaactgttctgtaacctgattggggtgttggggtggtagttttatatatgtgtgtgtgtgtgtgtgtgtgtgtgtgtgtgtgtgtgtatatatatatatataatatttgtgtacatgtgtatctgcatgtatttgaacatatatacaactgtataccaagagaaaaaaaggtaatttcccagtatgaaaattttaaaagtaaaatttaaaatatatcaaaaatatcatattgttccttataaatctataagcatagagaaaaagctggaagggtactcaagaaacgttatcatctgtgtggagggacttcaaaataagaatctatttcttttgtctttggaaaaaaaagctatttccgttttaaaaatatcgtgaagtcttttgtttagaattggtaaaggtgcttttctaaaaacgctcattttcttgtagcttttggttaataaaaatactcaaattattactgattatttttatacagtattttttctggcagtattaacagtatttgtatatggtgagtgttatattacttctgccaagcttgaaaacagagatgacaagttccgtaagtgtaaaaaaataaatgaaattaatagtttcgtgcctaagagcctctctttgcatatgagattagtacactgttctcatgcttattttgtattataattcacttcttcagaaagctcactttattccattcagttgcaaagcttggatggttggtatgcctataataaatttagaaaattaagttattactgcagtgaagttttcaaaactccatccactcacaggtatttcagttataattttgataatggagaagatggaaagatagatactatcaatattttttcctttgctacatttattcccttatgccttaaaaacgagggcatgatatgatattccatatgctaacgtgtgtatatgtaaaagaaagagaaaaaggaacttgctctatactttaatttcagaatatggctacctttgcttatgttagaatgtcagcaacagaaaattaaatagcccatataattaatgcttgtcttttattccagagtaagtttctttctgtgttttgcacatagtgtaacacaagtttgttgctgttgcttttttcattgagaaatctttaaaatgatcatgaagtgtgcaagtcaaagtaaaaacaataaaacgaggtattcaagtagatactgagaggtaaatgaattatgttcgttttatggcaacatccaaatattttgtgtttccattttatgtcaaaagttaagctttagctggaataaaaaatttcctctcttggtaaaatcagttgacttagcagttttatgcaagaactgaagtattcaatcaacatttttttttccatcaaacttcccttttgacaggaaattctgtgtctgattctttttttctttaaactgcattcaaaagaataataaaagagcaccacatgtcctctttgctgaaggagtttttaaagagataccacaataattattttcttgcttggaagctacctttattaagaggccaattttatactggaatctactattaaaattatgtgactaatgtttcattatgaatcatgatcacaaacagagtcattatgtatgggagacctgagaaatgttcgccaaccacattcaaaaatagatatttgtgtgtgttccagttacattttatttgaaagatcaccttcctttttttcttccaaatattccctttccccctcccttgtggtcctcctcacatctgagctccttttcttttcacagatggtgatactctttgaggtcaggtacctatgacctggagtgtttcttgaagcacttccaatattcggttctactttttcaatactcatgacagcacgcagtctaaggcaaaacagaagtgagggttgattgatcataaatatagctgacaccaccaagctgtcagggagcaggacactgaattgatcaaattttaaaagtggaggatgtgtggagccaaaaggaggtcgccttattttggagtcatcagctgagggctaagaaaagaaaattctggaattctgctctgtcaggatatgggatgggcttttagaagaaaataaggaaactgatttcattgcaacatgacttttggcagttgttttaccttaccttttgctaaaatgtcatccccgcacccccctcatgaccctttactattctccttctctttatttttaattttgtaaattttaatttttgtggtgacatagtaggtatatatatttgaggggtacatgagatgttttgatacaggcatgcaatgtgaaataagcacatcatggagaatggggtatccatcccctcaaacatttatcctgtgagttacaaacaaacaactcgattacactcttaaaggtattttaagttattttttacctcagaaatctctggttcatattatcagagacttaataatatttattgatcagaatttaacatttgaataatttattcttttcttatatgtacagtagtgattgggtgggaagagggctgagttcaaatatttactctcccacaagctacttggcaacttaggtagttggaacctcatgatccaagctctgaaatctttggaaactacattgtaagagacaattggttctatagagggaaacccttgcaaaagttacatgtgctctactgatatatcaaatgtatgtgtgtatgtgtgtgtgtatagtagaactgatggtagattatttcaattatatagcattaatgacaggtggactcaatttattttctctaagcagctgaaaattctcaccaagaaacagccttcctgtattcaccacctttatttgaagttgagaaataaaatgttgccaagtatatccagggtcatcccatttttctaaacacaagttttctctgcactatgacactcacattactgctgctaacatgacgagcttcagatattatcaggaggcattttgtatagtagttaatagtataagttcgggtactagtcctggattcaaattttgggttggctactatccagcttataatcctggataaattatttaattgctctcagtttcaattcctcatcttccataaactggaataatactagtactgacatccagggttgtgaagagaataatctacatcaaatgtcaacagtcattttctgtaacagaccagacagcaaatattttaggttttacaggccatataatatagtgtctttcacaactactcaactgtgcctttatagtataaaggtggacctatacaatacataaacaagtgggcatggctgtgtttcaataaaactttatttacaaaaacaggcaggaagactgatttagcccactggccctagttggcaaacctctggtctatattaatgcttaacacagttctaaacattaattttaattaatgtaaattaaatgttattagttctgtggcatacatttcaacgtatgccattattcaagaatatgtcacaatcatacaggccatactgtatttctccagaaactaaaattactatatcctaaaggaaactaccatggtttgaagatttgtttgtgagaaattctgcagtagcatctggtgatctggtgagagggacataataatcagtaaatagtttgcagtaccttcttatcaactaaatagatgaacgatgctataaaaatgaaacaaaagtgacttaatgaaatcttcagtaacgtagggtcacacatttattcattcttcaaagtagttatcctttcactataatttccttcctagattttgctaaacatatacaactggtagaagcctaatgtgctgttcctgtaacattatattcctgttccttgacttcctgatataatgaagctgattatattccgtgtttgataatgttcatcctattaggattgggaaatccattgaccaccgagcacaaccttatgttcatgttcttatcattagcaccactccagctatggagctgtcagcattttcagcctaaatgctgctttcaggggcctgcaattcagtcataaaaattagctgcaggcagaaacttgatatatgaagtccagatccaagagagaattttattacatttttaacacagagagagaagtacattagaccattataaaaaaacatacaaattagtgtagtgaacttgctctgcatccttttctgttctgacgtaatttaagattgcattcatatctgcccccttcgttttccatgtatccatgaaggaatcttacggatttccagtgccaggtgactttacgacaagttcccttaaggttacatttaagattggaacagagcagcttgagtctctatttgtcaatgggaaaaagattttccagccttttatgaattcaaaattaattagaataaattttctgccataatgcagcaacacagggtatgacctgcatcaggcttcatgttttatgattgagttttaagaactggcttgtgtgcaaagacttttctttgacgtgagattgaattaaggaaacttaattaacattttctaattaaatactgcattgtgaactcaatcgcattgtactctgcaactatgatgagattgttctgtctttatttaaataaacaagatggctcacagggttgagagcttggttgataaccatccctttctttcctcagttgtcacctctgcttttcagaaatattattagccactcacctaactgcaggaatttggtagacacacatttctcaaaaatgctcaaggatactaaaaatgatacctgatctcatgattgacgagagtagtagtctacccatttaatacctaattccagttcattctattcattcgagacaaaccctatttttattccctttcaccttattttctccatggaatatgtgatgtataacatgtatcatgtaatacacaataggtagcgtataatatgtgatttccagtgaccaccatggtgttcaatttaatagttaatgtgccatcctcatcttacttgccccgagagctgcactggacaaagtacacaccatttctccatgatactcatcttcccatggctcccaggacaccacattctcttagtttccctcccaccattctggtcactccctctcactcttttttgctggttagtcctcttccccctagtctcctaatattgcagtgccccagggcttaatccttggtcatcttctctactctccctactctcattccactgatgagctcatcctatctatatgccagtgcctccttaatgtatatactctgccctgacatttctcaaatcttgcatacctaactgtctatccgtctctgctggaatagacactccaaactccatatgttcaaaatcgagttcctgatcttttcctgcggacctgcaccacccacagccttctctgtctcagggacggtaactccagttgtcagttgctgaggccagaatcttagaaataatccttgactttttattctctcactctttacatccaatctgtcaggaaattttcatgcctctcacttgaaatttatccagcatctaaccacttatcacttctccaactcttatcaacctggtataaggcacttaccacagtttgttgctccaaagctctctgttttacattgtcagcaacagtccttacaatgatctacaaggcccaatctgggtgaattcttcatccccccgtcttagcatgtctcctcctctctgactttcttatgccacaacagccccactggccttcttgctgttcttctgacatgccaagcacacttccttcttagacctttgtactcactgcctgcaatgaatgcctgcaataacacatcctcctggctaactccctcacctccaagttttttctcaaatgtcaccatttcagtgagtcctatttcgatttctatttaaaattgcaaacctattctactgccagcatttctgaggtctaccttttctcctttccccatatatcttatcacctttgaacagattatctaacttttgtctgtctgtctaccccttatcatttgcccaccacattaggatgcaagtcccatgggggcggaaagttttgctttgttctttcgtacatcccaagcactgagagtagtgcctggcacatagaagtaactcagtgaacatcagaactattaaaagcatatacaatcagacgggcatggtggctcatgcctgtaatcccagaactttaggaggctgaggcaggagaatctcttgaggccaggacttcaagaccagcatggacaacatagtgagaccctgtctctacaaaaaatgaaaaaataaaaaaatcagctgagtgtggtggcatgcacccgtagtccgagctactcgggaagctgaggcgggaggttcacttgagcccaggtgttcgaggatgcagggaactatgagttcaccactgcactccagcctaggtgacagagcaagaccctgtctcaaaaaaacgcatatgtaatcattgaagaaaattaaattataactatgaaaattcaagcagtcacaatatagtgcaaaactgaatggtttattaaagatgtttaatttgaaggagattttttacaagtaacatttgttttaaattattcttattaacattttaaaagattgattttgcatgatacaagaaggatggtggcttcctatattacagaagtaatattttagagaagtaatagttccagtcattgccacagagttctaaataaaatttgcacatggaaaattaagcatgtaaagcaattgcatcctcatgatttagctaagaaaatgtccaaaacagttaaggtcagtcgtagatttaactcagtgtttcaaaaccatttgattcattggtaccaaaagcaagcgttttacatttttctccaaatctttggatgttgttatttcttctttaagcaccataaatttttagctatgcatgcttactagaagtaagcaataagcaataacttattccttttcatctgtggcttatagaacctcttgctttgtgcatatgttttgcccctctatttcactccagaggttttgatcatatcaagtttcacttaataaagatgagtagagggcaaaaatcagtagtaactttggggaaaagtagaagttccccttaggcattgaattataatcaagtgaggaaaagctattattgatactcattcagaatttcatattagatcattgaaaatctttaggaataatgattgcggagtcaccgctaataacttaatgacaattgaatatgttaaaggctttgaaaaagataaaatagatgtagatgacaactcctgactcagatgactatagtaatttttcataattaccattcacagaatacaatttagatagaaataagagcaagagttaaatgcaatacggagtagctctaataggacctagacatcagggttaatttgaaaattatagttcctaaagtaattgtgttgcagaagcctatcatacaaaatataaaccatgaaataaaatttttatgaacttcttactaaagctgtttttatacccttgttttgatgatttacatttctaatttcacaactttagcccttagttgagccctaagcaaatttatgaaaacatatttcttattagagtacttgaaatcccctgtatgttactaatcccaaccaatgaataagaatttccattctgcaataaatatcattgctatcccataacctatgtttcacttgtacaagaaaatacttcttcagcacaaagaaggaatgattaattcttaaaatattaagaaaacagcctaataaagtctctcaaattccacttgtaaaagcagaaaaaatattagagtaaaatcgccacagattgtctcctcaaatcataggaacatgaaaattggaaactttcagcaaaatttatttttaacattgttcaactgttttgtatagaacatttaacgttaagaagcaattttgtggtttgaactatttgcatgataatttctggtgtggaagatgccttagagctgtgttgcttcaacttttcacatcagcacagtaacagtggggccaatttggtctctttatgtatatttcaacattaaagttatttttagacaaatctaccattggaagattattgttgcattggtggtggtgagtgagattcagctatgtcaaatctctccatttaaaaaaatgaggctgtcacatatttcaggacttctctgatgaggtgtcacagtattttgatttaacagactttgtataactatgtggatacaatagcaaaagtttattttcatttttttttttgtaaattgttttgagctaggtcagaatgatttctaagcatacacacgctaaaacaatgctaagacatagaaaacagcaaatttttcaggctattggtagatagtttaataagttcgtcctcttttgagaggtctagtcacctgtgtctagtgttggatggaaaggggcttggatccactggttagtcttccttattgtctcagagaaggagaaaagggctttatcgtgaagaaaaatgactgatggagctctatatacacaatagtataatttgaatttaataatcaactaatagtaccaaacaatttataacccccataaactcctaacacccgatcttcattttcactgtaataattctgtcgcaatacaaagtgttcatagttttttcttgtatttgtcaataagatggctcaattttggatgagaatttcaaccactgttgtttacagaagttaggattttttttttaccaccatgttgagctccttgaaaaaattaaaggtaaactttttgaggtgaggtagcctttgtgaataacattgcaactgaggaatttttttttttttttgagacagagtcttgctctgttgcccaggctggagtgcagtggcatgatctcggctcaccgcaacctctgcctcccgggttcaagcaattctcctgcctcagcttcctgagtagctaggattacaggtgcccgccaccacacttggctaatttttgtatttttagtagagatgtggtttcactttgttggttaggctggtctcaaactcctgacctcaggtgattctcccgcctcagcctcccaaagtgctggggttacagatgtaagccaccatgtctggccacaactgaagaatttgaggtcaaaatagtcctaatgaaggctatcattcttcagctctgcctttcatgaccctttcagtgtacatattcatctggttatattttcagtcaatttcttggctcacccaagaaaaaaatgcatatcttgttgaaaaattcctcgccaactattttccatcaaacagtttttcataggtcttcacagggagcgttattttaaatactgagactccaaggcaaatgaaacaaccaattcattatgctataataaaaccataagaaaaataacagaggtaatctgaatcgagtgactggttgttccacagtgtttttaaaagacgcttcttgttagtgttagtaaataaaggtgtctatgtttttcagcttagctacctctttttggctcaaatcagattctactatccagtttttaatcaaattttctcttatctataattaacccttcaaaactaaactttaaagttcaacttgtttcctttttatgactagctgaaaattttttaattgtaaaagaaaaatgcttataattttttctatatgcatatgattgattttaaaatgtcattgcaaaaacgatggcctcatggcatataggttcatgtttttttgtgtgccagacactaaaattgaggctcctttatattattaaattgaaactcatgtttgaaataaactaaatacagcctataaggtttagattcactgcagtttactgctgattggaatacttttggtatcgagtttaatatctgacacaaactttcatcatttgtgatattcccttctaatttatcttgcatatttccaccagtttgaaatttgcacttcaaacttcctatttttattcatgacccatttcaaaatatgatatattaattatcctttactgtaaatatatgtactcaaaggggtttggtaataccctctttgtaataagtatgaaaagaagtgtccaataatatggattgattaaataaatataatccatataatactctgtagctacgggaatgaaaaaaatagagttacttgtactgatagaattttgtgctttttagaagatatatgtgtatgtgcgtccatacatacatgtgtgtatactgtatatgtgcgtatttctatatattcatgtacatatgcatatgtttgtcatgtttgtctattattatacacacgtgttgtttatatatgtagtattagccaagaaacatacagaaaaaactgtttccatggttacctctgagctctggggagtgaaaccaaagcacagaatgtgggtaggagctctttactcttcatcatctatcctttttaactgtttcaattttttttttactatgaccatttgatttagtatgaaatttgttatatatatatacacatacatatgatatacattcatacatgttgtgtacatttatatcatatatatattacattatatatgtatctatatacaatgtagtagctatcttcaaagaagattttttataactaaagataagaatgttaaaagtgaaggaaaacctcaaggcccaaataactttgtttgtagtatttaaattctgctttttctttctattctctcactgtctattcccttcatcacttaaattcattcccactaaaaatgactcacggacatagtttggaactagttgccacatcacctcaaagttaagggcagcagcttctctatttacagctgggaaaacttgtaactaagagggaggccatagctttagttaaatcggcatccaaggaaacaaaataccagaaattaacaatggttgcaaaatggagtcctagcctaatccctctcctttctaattactccctaattgtttcttaaccatgtgccgccaggctgcagtggttggggtatggagagtgaagaactttttgaataaggcaattcttactctggaaggactaacgaagaacctgattgtaactaaaatgagggaacagttcctactatttccatcaaattcattctgcccaaggaaaaagatgatgatttgattttaattatgctaacagcatttcaatagcctccggagaaaatgcctgctttccaaaatgcagatcactaaattatactgtgcctcctagcaactcctactactgagaattcaaagcttatctcaactttactttgttttaaccatcctaagatttcagtccacagctttcccataggctctacctgccttttagtgtctagaacacactctcacggcatctgggtcttcaaacccacacagttcctgtgagctattcaagataggtcaggttccagctgaggtcaggcattgtgatcactcaagttaaccctcctctaaaccctacctctagtgtcctaaatttgctttttgtctcagcagataaaacccagaggttcccaaacctgctgtgcatctgagtcatgaggaaagtttgtgaaatagattcttggtttctcagctacactaatacacggcaaggcttgctatcctttcttccagttcactgcttctgggtcctgcatgctggagcaccaccagtgctgcctcacctctggcctcctcctgacaaaggggtctctacactctgcactctgtcatctgtaaccagccttcttaggcacaagctgccttctattttttaactcccagtttcgtttttatgaactattcaaatcaaataattaagaataacatcaatgatgccagcaccagtagaataaggcacacctttgctttaggtcagatttccttgttcctctgtttcctgatgaaggcctatgcttctggactttcccttgattcaagatgagtgttctgcttttccaaatggccatcagcagggactaatggtggtcactattagtcttcactgacaggctttttagtccaaacttggagacatggctattgagcccagagttctcctcacaggcactgaggcacaggattctatgagcctcctctaataggtttcattcacagggataatgacatggatggatatggttatattcatgtaggttttagcaagaaagatgctgtccactgagagctacctgaaagattatgatacacactcttggaaaagaataagaggagcagattaaaataaaaatctttgcttaacagtttgagttggatggcttgatgaattgcaacacctaggaaaagaaatcttcctaggttatcttacagttatgatttttttaagtataaaggagatgagaacaataccaatgtaattcatcttaaaagactttaacctgtactaaagatttgtgaaattcttcattaattatgattgactattaataccatctcaaagattttgctagacctagaaaggctttgttaaataattttccatgtaccccatactctcacagatttaaaacctaacactgggagatagtctatcaggcaaaattatgaacttatatattgatgtaggcatagttgctcataggttccaaaagttaatatatacatttccaaaagttaaatataacattgtggttttgattacatatcacgttttcctttcccgctcaaatgaagttttaacatgattgcctagatttggtttcaaatttacctgccttagaaactgtcactcaaatgtacaattactttttcaatgttaagaagaatatgttatgataagaggttcctaaagaaagcatttcatagttctctggcattgaattttttttatttgttaccttgtttacttgtgtgtgaacgagcataaagtgaaccctcagaggacaagaaaaaatatcaggtatttctttatggatttaatctctgaaaattttccatcatcactaatgatgtcccaggagtccttgaagctaaaataacaagatatacaatttacacatttttatttagatgcactcattgtttgcaaataactttgcaatctgataaagaggcaaaaagataaactataggtataataaacttgaataaatggatagaatttagaatgtatctgggggatatatcaagggtctgtttggcaacttgggaagatgattggagaaaaggacagaaatacttgaggaaatctttctgcatggactggatcaagtctaaattccaaaatactgtccagccatggaatggcaggttagatgacagcttagagcgaggattggaaatgggaaacaatgtgaggatggcaaaagagggtatgtctcaagatgagattcaccagagcagagcaaagcagtgaagagccttcacttcattggacagcacttgctctttctccctttacatagattaaccttgagtttagcaatgcttatggagactgctagagaatgaagggaaacaagacacaatctgttaagtaaagaagcctagaaacattgggtatgtggaaatataacatgatggtgctaacagtcattatggtgactctcatttgtagaagactagttctgtttcattaagagataggtttcagcttgtcacctagtagatcttatcttaatcatggctgtgtatgttgactcacataccatttttactagtatgcacatccaccgtttactgagctgttgctctgtgctaacttacagtgtgctaagagctttatatactgtattcatacagttaatccctataacgaacctaggagtgaaatttttcacacccagttttgcaaatgagaaaattaaaatatcagaataagtgacataactttcttaaggtcaaggagataataaaagataggcttctattttgacatagatttagctgtctcaggggcctaaattcgagccaccgcatttatgttttagaatagcgattgcaaattgttgactggagcaccaaaatcagcctggggacctgctttactgattctacatactatgttttcagacaatctgaatgtgcatttttatggaggggagtgttaactggagtcaccgtgcatcattgttttaaatcatcttgacgtttaagatttcagtttttcatttaaggttacaggttgaataatatttctccctactttatcaaaatatatatcatatatatgtataaaataaactagcacaacagttatttaaagacagttcaattgtttgtactgagatatacaaacagaaacatttgggagaaatattacaatattcgtaaagaagccagggacattggttttgcaatattgaggtgacaagtttccaaaaattaattctatactgatttcagatcctattttccatgaatagacacagccagagggattcccttctgtaatcctcatccgtatgcctctaccaaccaattaattgctcattactgcatcaacataagtgtgaatttgttgacagagagacatttaagaaagaggttgtaaatatgtcccaatggtcctacgtactctggaatgtgggggaaaccataatcacagttaattcaatgtcaaatttcttattcaaatatgtatttccagttacggtgataatttttcattcatgctcgattgtgatgatttttgcttttattttatgttattctccattacggaacttcattttgttttacacaaaatagttaatataatacttcgcagtaagggcattttgaaagaacagtggcttaaaaacaaaatttatctttgtgtttcctacgaggtggtaagccagttagtattcaacaagtgtttataaaattatttcattttcttaaaagcctataataaagatattaactggagaaagaacgttgaaaattcagatgagatgaccagtggttttaatacagaagagacagttttcatatttttagcacatagaaaaaattgtaaaatgtgtttgctaaattccatctgaacattatcgtaagaaaacctcacaaatattttaatttcttaagtaaaatagcttatttcatttatgccctttactactttattttcactagataaatcatcaacgttttacttactttttcaaaaatcccagtagaacaatcatgtttgttttgacaaactctagaaggtttttatttctattaatttaaatagacaaaaagaagacacttgaaagcagcacgaaatccccagcacctttttacgagattataacttgtgtataaaagtaattaacattttctagtatcatattttaaccagatcagagattcttaacccaggattcttggatctacaaattaattttaaatggccttaaaattgtacacacaaaaaatattttcatggggtggggaagggggacaagggctctaccattcatctgttcttttttttatttttgagacggagtcttgctctaccacccaggctggagtgcagtggcatgatctcagctcactgcaacctctgcctcccaggttcaagcaattctcctgtcagcctcctgagtagctaggactacaggcacccacaatgcccggctaatttttgtattttcagtagagacggggtttcaccatattggccaggctggtctcgaactcctgacctcaggtgatccacccacctcggcctcccaaagtgctgggattacaggagtgagccaccgcgcccggccccattcatctgttctttaagagcgtttgtaactaaaaaattttaagtcagatttggaggaagaaaattagaggttttggggaggataagtcttgttcactgaagagtccctttcacataatttaaataagagctattgtgtatgaagctgggcacagtggctcatgcctgtaatcccaacactttgggaggctgaggcgggtggatcactttaggtcaggagttcaagaccagcctggccaacatggtgaaacctcatctatactaaaaatacaaaaattagccggggtgtggtggcacatgcctgtaatcccagctacttgggaggctgaggcaggagaattgcttggaggtggaggttgcagtgagcaagatcgcaccactgcaccactgcactgcagcctgggctaccgagcgagactccgtctcaaagaaaaaaagctattgtatacgaattgggctgctattatttattctcagtatttaatagtgaagaaatgtcttttctaatcatgcttatttatccattcactttctgataagcatttattgagtgcttaatgaatgctagatattgtttaccaagataggaactcagaaggttgagcaatctggggagaaatatgactaatcaaattgctgacacattgagtgtgagatgcttgtgggatatccaaatggagatgtccatggagggcagaggtccaagccaaagacttagatttgaaggtcagtaaatatgggtggtaaagtcattaaagtgtttgatgtaggtaagcccattcttgcatgtatagtgtgagtagaggatgaatgagagaaacagccaacattccctaggtgcgtggagggagtaccttccagagaggctggaaagtggttgtaaaaaaagccagcagagaaagacttccaaaatgagggaagagtaagctataccaagaatgtagaaagatctagtaaaataaagacataaccattcaaactgggaatcaattttagtggaaggctatcagtggacgtcagactgcagttagtagatgggaaacgactttcagtgtgctgtatgtttaaggaaatgattgattgggagataaagtcagaaaggacctcattacttagcacctggtatgtgatattttataaataccaagttaatggctttaactgggaaataataaaatcattttcctcctaatcccagaagacaatccactgagagaatgggatacttaaccaggggagaagacagtgataactttggcataacgtgtatcattcagagttcaaccagagaagtagagcagtagggtattatatatgtatcctattaggtgtgtgcatgtgtggagtttgtgtgtatacacatacatatagatagatacacatatattttacagagaatcggtttacaccattatagatctggctaagcagtctccacaaagctgtctcttcatctaatatcagagcctgaagttcacaggcaggcagtcaggtgggaagatcacaagcaggcttgaattccactaggatagactgaaacctgtgttttttgttgttagttgttgttgcctctgaccacggcagtaagaatgagcacacatacctctggcccagaaatcagacactgaaggaagatccaggggggaagagagcaatcccaggtccaaatgatgctttatgtcaatgaggcaagtcagcataccagcagcagtatgcatgtgtgcacacacatatgcatgcacatacacacatactgcaaaatggcaactgccttcctaacatcctccaactagtgtgaaagaatttatcgtgtagcctaccctaactggacacatgcaagaaaatggaattctggtaaatgtagtttgacctagcaagttggcacattacagagccaatacaatgcgtactttcagagatggcaagccttagaggctactagagtaggggttctgggtaatcattgtgcttcatgaaggtcctgtcacttggtagataagtgaaggaagttatgtagaaatctgagggtgggaccatgaagatcagcttgtttatcctctcagttgttctaagggcattgctgccatccctgttaacaaggggattaggaaataactgattcaatttgcctctctactacttccaccattcttaataataaaaagaaatgaccagtttctatttatttttttttcaggcaatatttttataagatgaatgatcttgattattacagtgaaaataaaatgatctctcagaatgttctgaaaacagttgtacaagtggaagttacagtgttggcttaaagaagagaacataaatactattcacacttctttagctgtactaaaagagctatagaatgtagccttatttattgttatgtaaaccagtaaaacttatccagcaagtgacaggaccttcatcctgtaccaaatccctgtttttggagtaagatgccaatggaaatagtggagctagtttaaaatcaaacatcagttcaaccaaactgatttaacattttcatttgtgttggggaagctcacggtctttaaatatcgatgagaaaggtgtctcttctaatacttgcttatgtgctgttaatgctgtactcccaaagatgatcgctaatctataatctaatctatacaactacacttttcaaaggatgtttagagtcacagacctgaacctgacttagggaaaggtgtttctccaagagcttttctgtgactacagattgttggagaaaacaggtagtgaaggaagatggcgcatgatctgctgcgctaccatgaagtagaatatatggtgatattttaaggctatatgtttacttttgcctaaattataaaagcaatatttttatattataaaaatttaaatgttgggaaataaagactcatataaaaaagataacaaagaagtaactgagatatgtcacaagttctttaaagcttcatccgtggaatcttaagaggctctctcctacttcagatgagaaagtcaggaagcatatcgtttgactaaacagtgatataaaaaatactaattaagtgacatttcagaattgcagttttgaaatgatttgctgttctgctcacaagaatcgtagttatgtttactaactttattcattttgtcttaatatttgctatagctgccgtgggcatggccacggcaaatgtaagctatcagactgaccaggttgatcacatcaatgaggaatattttcattaatccaagatggtgtttgattcagaatgcgcatcgtatcagcaacacttgccatcgaccattaaatgtgaggaattccaacagttagttagcaccaaggagttaacgatatgaaacatcatccagaactgaacaaatggctttactccttcctgtatcttgggctgtgtggaagttgtcagggtttcctggaaaagagttagatatgcttatatagattaaatatactaaagggcattccccgtaacagtcaagtaagtgttgggtaaaaggcaagtttattcatgtaactacagatagaatacgaatagtgtgaatgattccgtaagtattttagggaaagtattcatctttatgcaatgaaatatataaagtggtcattttcctaaagacaagaagacagttattttaattgacttccacaacttcccacttagagagttgctagtattaaaaaataaataaaatatcactgccatgaagattaagagtgatagtcagaaaatggacttcagaaaatgatacactttctttaggtaggaaagcagtaaagctattctcaagtgataaccttttattagatgctggcaagtctgaaatgctccttgacaatctcttttattgaacgaatcttgaggactataaacctagatcagtgccttataatccttgcataaggctgttgtgattaaaaaccaagtgaaaaacttcccaatagctcacagaagagtaatcagtctgtcttagtatttattagggtgtgtgtgtgtgtgtgtgttttaatgggatactgcttaagtatacaggccaggagtaaaggtaacaccatgagggagggtaaaggcatggaaagtcagattgggaactccaaaaagaaagaaagaattttgagggttgtcagagcttctcaagagatcacacgtttagagacaattcaaatacttttaaacaataataacaaaaaaatctactgagcctttagtttcatgatcagaatgggggatcaaagtcagaataccaggattagtttcaagtgattttaaagacaccaatattagaatggactgagacaggagatacaggttgcaaagagaaataaataacaagtcttcctcaagaatgaaaagaactctgagagacgtagctttggtcatagactagaaatgagaataacagtgaataattttttttttttttttgagatggagtctcactctgtcgcccaggctggagtgcagtggcgcgatctcggctcactgcagcctccccctcctgggttcaaatgattctcccacctcagcctcccgagttgctgggattacaggcgcctgccaccacgcctggctaatttttgtatttttagtagagacagggtttctccatgttggccaggttggtctcgaactcctgacctcaagtgatccacccacctcaacctcccaaagcgctgggattacaggcgtgagccaccacacccggccaacagtgaattttttaaatactgaaaatatctatgaatgctaccaaattctgaaactcttcctgattaactcagcacagaaaattccctctcattttgagcttcagttgttcaaactgcttccatggcagttcaaactgctatgtctccctctatcaaatggggacaacaaagccaggcttcatggtatattttaggctcagaagctgtcagaagcattttactgagccagtatggagaagagacaagcagagcaaacttctgcctgaaaaacaagcagttaacactgagtacttctaatataatggcgactaacaaaaatccttctaggcagaaaaggagaaaacacaaaacagtgagttcactgttacatcttaaataataaacaacatgcattagccatcatgatttcctgcacttgccacgttataagcttataaagcttcctaaaaatatttcattagctttgaaaactaataaatctaatgattacaatttatatttttaaaaacataagaaaagcaggtttgtgcctaagaccttgagtgtcaagaaagtttagagaggataactcattaaagtgtacagcgaatcataaaattcaatttgaattgaaccttccattttggcccaacctatccatgtaaaaaccagcaaaacaaatcattctaagtcacaagctgctgtatgtgttttagaacagatactatttactatattacccctaaataaaccaaggtctaagtaaatggtttctagcttttctctagttaagctaagttctttcttaaaaggaaactcgttctaattcatatttttcttctcgaagagggagcttatatttttctgtttctgcactttgaacatgagtattgtgggaaagtattaggggattagcaggagataaacgtggtttttgtcttcaccactaagtggatcaaattagtgggtatatggccatgattttattctgccacactatgacctgtgagacaaggtggaaaaagtagattctagaggcactgatggatacaggctaagctgggtaacaaggataccccaaaatgtaatgtctttgatcaaattgaagtatattatttctctcgataaataaaccaatagctagcagccccagaccagtcaggtgattccattcaattaagtcattcagggactcaagtcccttatatgttgttgctccccatttttttcctcgtatttctggtggaagccagttcactgatacatctgctttccagtctgcaggaaagggaaaaataaactccagggcatgcagctttatcataaaggaaatgaccaggaaattgcacacatcacttcttcatacatctcgttgacccggtctcaggcacatggccacatgtagctgcaagagaagctaagaaatgtggtctacaactgggtagccacgtgcttacctaaaattctagggactatactactaaaaggaagaaaggactaatagacactgggacacatttagtggtctctgcctcaagaggtatcagccagggtttggagatgacgtattcagcacaaaaaagataaggcagtgtttggacagggttacatgtaagttgtgattctcttgaacagacccctagtggtcactgacatttgaataaactgctaggggtatttcactttcaccaccactaatattctttactttcctcctcctttcatttttctttccgtcttgctcctccttttcatattccaattttccccccatatttttcctttttgtttcaactgctcatgatactgaggtctaaagaatttactgagtaatgagcacagatgtatgctttctttatgcatttttaatggctgatttaaatatacttggaggctaaaaatgcaataatttgctttaaatgtgtaggactctggaaagatgagaaagcactgtaagagttaaataaatcaagaaaggatttggaatagtgactatgtaattaaaagagcagaaataaaggatgtgccttatcaagatgtaatcacaaatattggaggataaaaagacctctgtattaaaacctaaagatatctgcattacaaaaaatgttcactttgtggatgacttgaaaaactttcgaaatgagtacaattataagcagatctgatgtttttgtcagaaagcaaatcacgaggtacttcttccatccactcaactcaagggtaacaatggctgtactttctgcccttcatcatcaccaggagtttctgagtagccttttagagcaaatcaatttcctggcaggtgagtaatttctactgtatagtcatcattttcccgcatcatttatctaagacccatcttctcaacactcaggtgcaacatcacaccttcccaggggtgaggtcatcaagggcatctgggtgttaaatgtttgatgttaacaagagggacaccccctcttctggctggtgtccaccgattgttctagacaccatgaacttttgtttcatgcaggtagaaaacagccatcaagagctaaaatttgagcccttacaagaatctttttactacccagcacaatgtggtaataatattcccacttctcaggcccttttccttcaagtgaataagatttcctctctattctagaggagccatgctactgcctctcttcatttgattactgtgggaaatcccccagcagcttattccaagttcactgcgcagccctctgattcctgaaaggcataatttggcctaacttgatatatatactatatatcatcacttacagtaatgtttgtcccataatagtaatactactactaataataataataattgctaacagtgagtgagcactcaccatgggtactataaatttatattaacttaattaactccaagttatttgttgttacttaaattctcttataatctattgatcaaacaattgagttgctttgttcctaaaagctacaaaaatatatagtaatgtagtataaaatctattttcataaagaaatctgacactacagctgaattatggttagcaaatttaaaattcataccttgttttcctcttgtgattttgtctccttgaaatttgagcagatgttgttatatctttcagcaatcacatcctcaactatgagcttaatataacgtacccctttcattacttttcctttcttttagaattcttagataaatctctgatttccaaagaactatctgtgctttgatattggcaactattatctgctgtaggtcctagtacttatttaggtaaaagatcttaatgaagttccaacgaacttcatttgtctccgtgtgtgtgtgtgtgtgtgtgtgtgagagagagagagagagagagacaaagaaattcttctcttttttcatttctgaataaagctttctagaagagccattcagtgtaactaatgacaaaagataaatatgttttgtaaaccactttgcttttatcttaaatggggagtcttcggcaaaacatttatctttaccatgaccgtagagtaattttaatatacatgattaatggtgcaaatgaaattaaaatccccctactattcaacatcttagttaagaacaaaatgctcactgtttcctaattgcaaagagtaaaatgtctggatgttgatgctttttaattagaggagaattttctttttaattaaaaaaagagagcttttttatttttcagtaagttagagagtgtcctctagtggagagagactctgatctcatagttttagaaatggctatatgatacccagttagaactgtgctccacttagctgattggaatctactggttgaagggaaaaagtattgtttttcctctaagacccctcaaatcatggcctagttaaaaggctgcagtgtgacaagcattgttctcattttagataggaatgattttttatgatcaattttagcatgcttccttctgaacctgttgaggttgagctgactgtgcacctttctgccaaaaaggaggcagaagcatttagtgcaatttactgtggcttttacaggtatcaactggaggcagcaagaataccattgtcttcaggactgcagacctggctgactgatatatttgatgtgtgcagatccctaggccatagcttaaatttgtttcttttattatttgaaggaaaacaaagaaacaaaattgagagacaaattaaataaaggtctctcttctccttaacttgtcgaattctaatgctaatttcctgtatttctggttaaatgtgctaagcagtcttagctctatcacttgtgtatcagagatgagaggtggaggagttttttcgatatctaaatggaagagggtacggaagagctgtggtggttggctctctgaatcacatactagaattgccttatcagaaattgcttattacagcaaattagagactgaaagaaaagaacgatagttgctcttgataacaagctaaatagcttggacttaaataaagataaaaattttattgctgattctttttttaattttaattttttaagttctgggatacatgtgcagaatgtgcaggtttgttacataggtatacatgtgccatggtggtttgctgcacccatcaacccgtcatctaggttttaagccccgcatgcattaggtatttatcctaatgctctccctccctttgcccccaaccccgacaggccccagtgtgtgatgttcccctccctattccatgtgttctcatttttcagctcacacttatcagtgagaacatgcagtgtttggttttctgttcctgtgttagtttgctgaggatgatggcttccagcttcatccatgtccctgcaaaggacatgatctcattccttttttatggctgcatagtattccatggtgtatctgtgccacattttctttttccagtctatcattgatgggcatttgggttgcttccaagtctttgctattgtaaatagtgctgcaatacacatacgtgtgcatgcatctttatagtagaatgatttataatcctttgggtgtatacccagtaatgggattgctgggtcaagcggtatttctggttctagatccttgaggaatcgccacactgtcttccacaatggttgaactaatttacactcccaccaacagagtgaaagcattcctatttctccacagcctagccagcatctattgtttcctgactacttaataatcgccattctgaatggtgtgagatggtatctcattgtggttttgatttgcatttctctaatgatcagtgataatgagcttttttcatatgtttgttgactgcataaatgtcttcttttgagaagtgtctgttcatatcctttgcccactttttgatggggttttttttttcttgtaaatttgtttaagttccttgtagattctggatattagacctttgtcagatgggtagattgaactttctcccattctgtaggttgcctgttcactctaatactagtttcttttgttgtgcagaagctctttagtttaattagatcccatttgtcaattttggctttttttgcaattgctttggtgttttagtcatgaagtctttgcccatgcctatgtcctgaatggtattgcctaggttttcttttagggtttttatggttttaggtctaacatttaagtctttctttaatccgtcttgagttgatttttgtataaaggtgtaaggaaggggtccagattcagttttctgcatatggctagccagttttcctagcaccatttattgaacagggaatcctttccccattgcttgttgctgattcttatatttgaaaaaaagggggataaggagagtgttcataaaatccttcagtaatccaacaaatgtcagagccataatgaacaataaggcaaatatattcccttttatagataattttcagaaacatgtatagtcgtgactcccacacagatggaagaatgaatacatgttaaaaaattttttgctgatgtgatatgaggggaccaagcagatgttatgaccagttcaaaggaaatatcaaagcagcagatttacacagattaaagaaatgttgagatgaattgtaaatggagacaaaattgtttttttccccaggttataggggggataggagaggtgagtcaattaaatcactatcagacaggagagaatttgtacccctatcagtgtcctacattttacagagtcaaaatatagttcaaagacagtaaaaaagcctttgggaggccgaggcaggtggatcacgaggtcaggagatcgagaccatcctggctaacacggtgaaaccccatctctactaaaatacaaacaatcagccgggcgtcgtggcgggctcctgtagtcccagctactcgggaggctgagacaggagaatggcgtgaacccgggaggcggagcttgcagtgagcccagatcgcgccactgcactccagcctgggtgatagagcgagactctgtctcaaaaaaacaaacaaacaacaaaaaaaaaaacataaaaaagcaggaatccaataatctggaagggtgtgccatagaccaatgagtagttttccaatgaaagatatttctttctacataactttgtaaatatatatatatatatatatatatatatatatatatatatatatatatatatatatatatatttctgtagcctggttgggttgccagtgacccagttttatatcctactttcttgtctacaccagctacttctctacctacaactgccattattgtgaaccctctttctctttcctcttctccagcctccctgtccttgcttcctgcttacaggacctgccctaatatttttcaattttgttgcttttctgagccccagttccactttaaacaaattccaaggtaaaaacaaattgttctggacagttaactgtaatcacttgcatgaaaaaatcacctgagggtgcttgttaaaaattcaaatccctggaactctccagacttgacttgctgaatctaaatctggtggggggtggaggtaaattttttgacaataaatttggaactcactgacttaagtaaaataagaaaaaaatgtaacatctaagccatatgactctaagctaaatgacattgtagaatatatgggagtataaaataaaaactgatatgaaagttagtggaaatatgcaagaaaaagcaaagttaatggtagcattagtaattgctagtaataactttccctaaagttcctatcacaatctatctagcactaattattttcaagttgaatatctggaatgtcaatctattaattttttaatgtccattctagatgctatgctaagtgagttttaaaattatttttcctttttaattgaaagcatacccagacacacattaaataaacacaaaaaataaaaattcataatcattctgttttttctttgtatcactttccattctactgaattttactaattataaatttaaatcttttaatcttgcacttttttgttatttctagacttcaattttaagaaattatttttcctccacatatttataaaatatatactttctcctatatagtatatttatttcatagtaatatttaactctaataaatcccacatttatttttctatattatatgaaactaatttttgtttttagaaaataatgcaattctgataactcattgcctggagttaaatctggtaccatatctgagcactacaattgatttcaaagagttgtaccactgcctgcgggataaacatgatgttgtttttttataattgttttaaaatacattttgctctttgtttagaccaacaacgtaatgtccagatctatcatcattacacttctttaggatagttgttgacaatatctacctacttaaatttctaaataaatatagattttgttgagttctacatcttattggacttttattagcattagcattacatctaaaatgtaacttgggaatggatttgtttaattgtttattgctagtataaataggatctcttctattttctaattagtaactgtagaaatcatggatgataatgatttctaaatatcatagaccataactaactacagagtttcttcttaaggctggcaaaactatgataaaaatcagtgtctcttagagaataagattaaaaaaatttaaatcacattaactatagctaaactgtaagtacattaaatttattgctacaaatcatgtagtttaaaaaaaacccctcaaatttgccagatttacaaacttaccccactatggaaaactggctttcttctgaattgccttcatcaattatttattgctgcagggttgcaataggctgaggtagatgctcttatggagtatctaatatttcatattaggcagatagtgtttcatttttaaatttcaagccttgtgcctgtaatcacagctactcaggagaggggaagaccgcttgagcccaggagttcaagaccaggctgggtaacatagcaagaccccatttcaaaaatatatatatatatatatataagcaaacttttttaataattttagaatctatgctcttaagacccacattctctcttggttttattttgcatattctcttttgagtttcttaagggtatttttgtctggacctaaagttctatccaaatatattgaaaaaaatgggtagcccctcctttgagaattaccacatagactccatttgatctataggatagtgagtcttatttttacgtgattatattttgtttaaaataactcaaactatagagaattttatattttggaataccaatacaaaagaatgttatatcaaaaggacaaatttttaaattttgctagtaagtgattacaatatatgtcttagatttgaatatttaaaataactttttaaaaagtcaaaatatagggctttttaattggttaagtatgcaatcaggttatcttcaaacaatgtttttattgaaattggttcaatatatgaagcctttatttggcaattttcatctttatgcactttccaaatgttagctagttaatctgcttaacaatattccattaaacagttgtacacattttatgttcatacactcctataaactttaacaataataataataatgatgcttttatcagctttttaaaacatctcattgctttgttatatcctattgtattagtaaaacttctaaaacattatcatattaaaagaatgctggccaggtgcagtggctcatgcctgtaatcccagcactttgggaggccaaggtgggaggattacttaagcccagaagtttgagactagcctgggcaacatagggagaccctgtctctatttaaaaataaaataaaaaattagctaggcacaccaacctgggtgacaaagctagaccctgtctcaaaaaattagccaggcatggttacacatgcctatagttccagctacccaggaggatgaggtgagaggattgcttgagctcgggaggttgaagctgcagtgaaccgtgattgtttcactgcactccagcctgagcaacagagtgagaccctatctcaaaacaaacaaacaaacaaaaaactgaaaagaatgctagtaggcacatttctatataccaacaacatccaagctgagtgccaaatcaagaatgcaatcccattcacaatagccacaaaaaataaaataaaatgcctagaaatacagctagccaggagggtgaaatatctctacaataaaaattacaaaacactgctgaaagaaatcagtgatgacacaaacaaatggaaaaacattccacactcatagataaaaataatcaatattgttaaaatggccatactgcccaaaacagtttaaagtttcagtgctatgattaaaaagtcaaaacataacagatgctggcaaggttgtgaagaaaagggaacgcttatatactgctggtgggaatgtaaattagttcagccactgtggaaagcagtttgatttctcaaagaacttagagctaccattggacccagcatcccatttttgggtatatacccaaaggaatataaatttgtttttaccataaagacacatgcatgcgtacgttcattgcagcactattcacaatagcagacatggaatcaacctagatgcacatcaatggtagactagataaagaaaacatggtttatatacaccatggaatactatgcagccatcaaaaagaatgatatcatgtcctttgcagcaacatggatggagcgagagaccattattgtaaatgaagggaaagaaaaccaaataccacatgttctcacttataagtggaagctaaacattgagtacacaatacaggtatacttgagggtggagggtagagggtgagaggaggctgagaacggaaaaactacctaccagataccatgcttataacctgggtgatgaaataatctgtacaccaaacccctgtgacatataatttacctatataacaaacctgcacatgtacccctgaaagtaaaaatttaaaaaaaaaaataatgcttgtaggcatatttctattgaatttaaaggagatgatactgtgagtcccattgtatattcttgtttaacatatgtttacttttaaatatttggaatggaatattttcagtatttcttaataaagcaagcctacaataatttatttagttcctaaaacttgccaagtaaaaatatagtctgattttataatcatacattttataaatcattttataaattcattatagtgtttataacacaaaagtaggtaaataaaaagcattttagatatgatgttgacaattgcatgctacgatccaatgagaagcctttttatcttgatgttttcataattttgaacagtactggtgattagcaaaatagctatatttaataataaaattttggtttaatatgaatgttagggaccacaaagagatcctacttcactctcactaggatggctataatcaaagcgacagatgctaagaagtgttgacaagcctgtggagaaactggaaccctcatacattgctggcaggaatgtaaaatggcacagccactttgaaaaccaatttgttatttcttcaaatatttaaacataagattctcttatggcctagcaacatcactcctaggtatgtacccaagaaaaatgaaaacataatgtccacacaaaaacttagcagcagtattcacaatagccaaaaagtggaaacaacccaaatgttcatcagctgatgaatggataaacaaaatcaacatatgggatatattcacacaatgggatattactgatacatgctatataacatgaataaaccttgaaaacattaaactaagcaaaagaaaccagacataaaaggcaataatattgtatgactacatttataccagatgtccatagagacagaaagtagaagtagattcgtagttgctaggggctaaaatggggagtggctgccacttggtacagggttcctttttggggtgataaaagtgtcctaaaattgattgtggttctgattgtacaattctgtgcatatacagaaaaccatggaattgtacaaattcatgctatgtgaattgtatctcagtaaagctattaaaatatgcatactatgtatgtaaaaaataattttatagacagtagcatctggtaaatgtttaacacttggctctaaatgtagttctgccaagaatacagttcatatttttgtttacattagctaataaaacaatggaggtgcatatcagaactttactcactcatcagtgatgtaaatgagttctttgcggaatcatattttagtaggagaatattttcttgatgtttgtgctattcccaatatggcagctatagacacgacatacttttaatttaacctgcattattaacattttccctgtcacattttaagtacagtcagtcaacaaaacaataaatcatagcctgatttgtagcatttgccaatgtatggagtaaatactccccctatcgtctttttcaagctaccaacataatgtcattaaacatatagttgagaagagatgtgcagtagtacactattgtatagtatttccaccatacggatactatagctgtaaacaatctcaaaagatgagtgaatgaatggtaaaatgtagcaaaataatttggaagttttgagtatctattatttttgtttttaattttttttgtatttctataatttaattttcaatgactgtgcttaacagcctgctcacagaatttctgaaaatgtggtaactgacttttgcaagctggtgtggaataataccactgaaataatacctgaatgaggaggctctgtacttacttacaatgtgaagcctagtttacacgataaatttgggctgtggagacatgtagacatgtagcctttaattaatgaagctttaaaaaaagggaaacaaggtaaaatgaaagttcaaaggatattaagcaggttattcattaatttgagattatgtattgagttcttaatatattcaagatgctgtaatgggtcctggtaatacgaaggtaaataaagatataatttctgcctttggggaatgcatagtcaagttgctgggctagatatgtgagcaaagcagatactgaaaggactatattatgataaaacagaaatatgttccaaagtctatggagaaaggagaagagaaggaggaagaaaaattaaatgagtattttttgaaagcgcaggcctgcattttggaagaagtttcatttgaattggatttaatggatgaagcgtgtattaggtgaaaatgagaatttaaagcaaagaatataggcttaaataaaatcaagagactataaaatggaatatgaatgggtgactcccaaaattcagatgctaaaaacctgttgtgtaattggcatatcctagttcattggccaaaggtacaaacacagtcccatcatttattactttcataactactatttatcctttttaatccttatttgcccttatttggtggacatacatcacttattcctaagctccaccctgctccatgaatttctatcaagtcctggttcttattgagattcagaggaaaggataatagtccttcattcccactttcaaacacaaggtaatacagttgggttccaacgtcacagctctctgacacaggtgtgattaattactttttcccaataaatagtacctggtgaatccagcttttctccacaacactaaggcccctggttagagactcaggtgtgagcttgacctcacctggcctgctctcagaattgactccattggactcctagtgtctaggctgtgagcagagcaatgcataagaagtgaagtggtaactttgcttagccgcacaaatttgtacaattaagagaaaccactgaaaagcctcttcacagaacaaagcactgctcaaattgactttctgttctgcctatattgagaagcaactggcagttcccagatctctttctctgtgtgggtgacacagtgatacacacacacacatatatacacatatatgtatacatatataaacacacatatatatacatatatatagagagaaaaatatatatattttctgccttaacaggattcctacttaatgtctggtttaagaggttccctattatcacattgataaaaagcagagtgttctgtaattactgctaccacctatgctttatcactttaagaaattatgtggaaataatctgatctttgcagtgcttattccttatgtgatcccagagtattgtaacattctcaatccttgattctgtctgatccaatctcaggtttgaaaatacagtaagattgttctctttagaatagagatgtgattgcgtcagtctcctatttgaaatcttccctcaacttcccattgccctgaaatggaagtctcacattttccacatgccatacatagaacagcgctgctcctgctcttgcgtcatcagggtccattcgtctcctaatcttccctctacttgcccctcgtctacactttagcttcagccccttcaaaactattttattttccccaaagctcccaggctttttctcactcatgctctttcctctctgtccagagtgtttttctattcttctctccaccgtcttctattccttccttgaatttcactgtcttacccacagcaagcccatctcaagactggttagagttctcctaggtgtccccatagcactgtagatacactcagtactggagccccaggcagggtggggtagtcaaagaacaggtgagccaagatggctgagaaagcagattgcttcttacatgggtgcaggagccattttttaggtgtggcagcacaaggcctgcaggtaaaagaaaagaaatgaattataaaattatgaaaaataaaagtgaataaaaatgaatttcacagttgatgtcggaaagaaaggagggtgatgtgagacagtaattcaggttccaatgaggaggtcaatcggcctctctgctaaggaatgtcagattccttatttatgatttttaaggtcccatatttactaaaattgtaatggaaaattaggcaacacctggagatttctatttatgagttccaggcattaagtcccacctaaaaacttaaacttggtcttataaaagacagtataaattattaatatatacatttttaaaactgtaatacatcttgattccattggcatataatgttaatcatcatactaggtagtattttgagacttattattgaattcgtgactaccttggcactataacagatagtcctggtacaaaaaaaaacaaaaacaaaaacaaaaacagtgctcttataaaaatgtaaacacaaagaatatttgatttgaaactgttttgtaatgttggttgacacttgccgtagaaatctgcaattgatttccaatcaatggaattgacatttattcattttgtaatgtaaatattctctaaaggagagggaattttatactaaaatatttctgtacaaagattaataataaagaaacctccttggagcctcagtttgcctcttaaaagtttgtagatattttctggacttgccttatctggtcatcagtgatgactatcacataaaaaatccggctggacgtggtggctcacgcctgtaatcctagcactttgggaggccaaggcgggcagatcacgaggtcagtagttcaagaccggcctggccaacatggtgaaaccccgtctctactaaaaacacaaaaataaattagtcgggcgtggtggcacgtgcctgtaatcccagctactccagaggctgagcaggagaattgcttaaacccgggaggcagaggctgcagtgagccaagatcgcatccctgcatcttagcctgggcgacagaggaagactctgtctctgggtttaggggcgggggaggaatccaagtctgtgaggaatctcttggagaacatgcagacataagctaaaatagagaaggctatatcatgccatattagaaatattagaagagcaataattttcatgaattattcttaaacaacgaacataagagaatacgattttatcctataaaaatgttgtcattgtggaacttgtagaattaagttacagatactcatgccctagtttagaaagattacatgtaagtgcattctgcttttctctgtgtttatgctgtagaatctctcataagcaaaatttcaagaaatacgtactatcaactcatagcttagccctgaggcttccagtacttaagaaacctccttccttgctccttaggatcgcagagttctcagggccctctggtaatattctttttttttttttttttttgcatttaatttttatttttattatttttattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccaccacagtccccagagtgtgatattccccttcctgtgtccatgtgatctcattgttcaattcccacgtatgagtgagaatatgtggtgtttggttttttgttcttgcgatagtttactgagaatgatggtttccagtttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatagctgggtcaaatggtatttctagttctagatccctgaggaatcgccacactgacttccacaaaggaaacaacaggtgctggagaggatgtggagaaataggaacacttttacactgttggtgggactggtaatattcttaagtatctatggctaccacaaattgagagtttgcttacttcaaatgccagcaaaggtgttgctttttcattttcagcccctcacgtggtgcccatccctgagagttcctttgccccaatccagacttacaagaccccatcttatccctcaatttctggttccatttagcggtagcaagatcttaaaactagtatctactggaatatgtcagttctgtaatgctgactgaagcttgagtaaaccaggtgcttgtaaagtggcatgaaatatccagaaataaactttactttctacgggcattaaatttacttccaccttttagaaagagacttcaatttaccttattaaataactgaccaatctgtattcaccactaaaacattctaagtagcgtattgaaataagctaatctttacagtagtataactgattttatctgtgatgaaaatcccaaatatttattgtcacgatttttgttttttaatgtgtttttctacctatgtgttagcttctttaattcgaatgttattctctatgaattaaaaatattttaatagcattctcttaggatcttgcgtttatggttcctttttctttgcagccaaagattttctatctcccacattcgagactgagaaacaccttctatctgccctataaaatcttataatcagcaacgttatgtaccctttgatatcatgcttcgagaagggcatatcacctctgtggtatccttcgcaatcattcatgacctcaatctaatcatgagaaaacatcaggcaaaccgaacgggaaaaatgttctgtacaatagccgaccagtcctcttggaaattttacaagtaactcacattccattaaacaagccatgttgtcgaaagcacacattctatcaatttgacaaagattgaaaatccctgaaaaattattcttttagaaagatattttattaaatcaatgaaaagtgatcaaaatgttacctgtcagtttgcctaaaataagtgtgaacaaatagttttataacacttttccatcacttctctctgcaggtgactctgctaatctaacctgcagagctttctttgggtacagcggagatgtcagtcctttaatttactggatgaaaggagaaaaatttattgaagatctggatgaaaatcgagtttgggaaagtgacattaggtaattttttttccttttaacctgtatagtcaagattaacatttactccattagtgaatagaaagtaagctgaaaggatttttttttgttttactagtatcataataaaaatactacaatatttaatgataaagaagcaaaacactgttaacagacttactatggaattgcaaaacatgaatgccatttgcaaagaatttaagaaaaataacgaagattgttcattaagccacatactgagtgcggctgggggtggtggctctcgcctgtaatcccagcactttgggaggtcagattgggcggattgcttgaggccaagagtttgagactagcttggccaacatggagaaacgttgtctctactaaaaatacaaaaattagccaggcatggtggtgcgtgcctattgtccgggctactcgggaggctgaggcatgagaatcacttgaacctgggaggcagaggctgcagtgagccaagattctgccactgcactccagcctgaacaacagagtgagactctgtctccaaaaaaaaaaaaaaaaaaaaaatatatatatatatatatatatatatagtgagatcaaaataccataaaatatagaaaatgttagtgtactttttgtatatgagaccttttttttaaaaaaaaaaaaaaaaaatgttctttgggaggccgaggtgggcggatcacctgaggtcaagagtttgagaccagcctggccaacatggtgaaccccgtctctactgaaaatacaaaattagccgggcatggtggtgggcgcctgtagtcccagctactcgggaggctgaggcaggagaatcacctgaacctgggaggtggaggttgcagtgagccgagatcgcaccattgcactgcagcctgggcaacaagagcgaaactctgtctcaaaaaaaaaaaaaaaaaaaaattttcacaggaaacattaacaaggtacagggactcaagcaaacacaatctctgtcatttcctgctacgtatttttacatatttgagccaccaagtggaatataagcttttgatggtagtgataaggatacacaaaatgtgtttatcgcctttcttagtctgactttaaggtcgaaatatttgtatagtgggaatgataacatgaaaatatttgaaggcataatgcctaagccccttttttgttcaatgtgtttacttatttattcatttaagtatcaattataattcattcaatgctagctgtaattatgctttggcatagatacttatttttattcataatgtaaatatgcaagaacgttaataataataagtaagttacaaccacatcaaaatgatgattacttctaaacatactcccatctaaagattgcatcttctgggtatatacaaacattttaatcatggtcccccattctaaatgtcaagacttttaaaactttatcaaaggtaaaaaagaaaatgattttcaatagaaaaataacacattttctattgggaccttctttctggcaacaaatacataagaatattgtactctagaatgccccagtgggattccagaaggctagatggacaattgtctaatatgtactaaaacatttttctgctgattttcgtatttaaaacttcactcttatcttttacccatggtctatgaaatgctaaaataaatgaaggacaattaacctcctaacttttaccccctctggctttgtgtgtgttcagggaagtttctagaaaggtagtttaattctgcatttaaaaatgttgaacagagatgacaacgaggttagtgagcatttaccattaattttaatgtcagagttaaatacttcaccagaacttttagtctacaggtttatagtttcacgttccttcaaaaacaggcaatttgttagtatcattaacaaaagtcagactgaacatttcaactgaaatgtcaaaatagctcagaaattttcttttcttttttaaaaaattaacctgacatgtaattaggccttcagcctgagacattagaatttttatctcaacttacataatatttcttcttaaagggaaagcaatttgtaaactttttcttcaaggtctttctcacctctttattatgacagtgtgattgtcctgctaagggagataattaactgcaacttcattagcatctacaaagacaagcttcctcattacaagtgaagaagaaaagggcataacttaattaacacagcatcaattcatagccaaattagaagcacagattttgtaggtagttttacatcagattcggattcatctacatttctttcttgtttgtgtatgtgtctgtttgtgtggatttttgttttgttgctttacattttagaattcttaaggagcatcttggggaacaggaagtttccatctcattaattgtggactctgtggaagaaggtgacttgggaaattactcctgttatgttgaaaatggaaatggacgtcgacacgccagcgttctccttcataaacgaggtgagtgtaaccttctaagcttcggtggtcaactgaatgtatgatgggagaaaaaatcattgggaaccaagaaacaaatttagttttgtttttctccacaaagttctcctaaataaaataatcatatttgcattagagccaccgaggcaaacagcacagtagatgggtgagtaactcagtctctaaaatcaaatttgaaatccttgcttttctttaataccaactgtgtaactttgggcaaaacatttaacttccctaagctttagttatctgataaatagaatggggaaaataatagtatcaacccttcagtatgttgtcagaataaaataagacaaaaaaatgtgaagggcttgacagagcctatacaaggaaagtcgttaaatgctatttattattattagaaatagatattaggggccgggtgcagtggctcacacctgtaatcccagcactgtgggaggccaaggcaggtggatcacttgaggtcaggagttcaagaccagcctggccaacattgtgaaaccctgtctctactaaaaatacaaaaattagctggcggtagtggtgcaagtctgtaatcccagctatttgagaggctgaggcaggagaatcacttgagcctgggaggtggaggttgcggttaggcgagattgcgccattgcactccagcctgggtgacagagtgagaccctgtctcaaaaaaaaaaaaaaaaaaaaaaaagaaaagaaaagaaagaaaagagaaaaaaaaaaaacaactaaatggttttaagtcaaagattgtatttcttactggaagattgctcctttagtgtaagaactgtctggtgaattccccactgcagtattttttgacatattgtttctgccttggataactttcatttgtacaatagtctccaatgatgaataataatgcatttttaagtaagataagctgtggttaagtgcaatgtctgttgtgctaactctgcctctacagcaccccatcaccttttgcatagggttaagtgcatttaaatgtatattgaattgtttgaaataagtgacaactgtaaaatgtgagccattcctgttagtaaaattgtttgtgtatattacaagagaaaaataatttttctacattatgctaagttaaaactttctactctttggaacaagcacacttgatgttctcttactcagcaaatttacaacgattttaatttcaaagcccgtgtttaatcctagactctttgaggtttgaaaagaaagagaacattgaaggctgttcccccttctttattgggcaatagattccctttgaataatattactgaatgctgttaaaatagacacctctgttgtcaaggtgactatggtactaaaatagtctaccttttagggatgtgagtcaaggagaaaggtatgcagcagctaacaatatgattgtatctttctatagtttagtatatagccaatcaaggaagagattttagtagaaatatcatacatatacaaggacagaagtagcttctcatagttaaaagcaacttaagtgttgtgtaattgaacttcttatcctgccataacatcttctgaagtgatctatcagcttatactggatcacattcccttctcaaggaagtccattttatctttggaaaaatccgttagaaagcatttcactttcactgtctatccattggccctagttctgtacttttaatcactcttccccaagacagcccttcaagtgtttgatgacagtcaccatgagtctctgaacctttacttcactagattcagcctctttagcttcttttactcattcttcatttgtattagcgaaatacttttaccattctggtcactctcttgaatctgctttaattaaagagtttgaattagtcctcaaaaatggagttaggggagagaagatatagggcacataaaaatgtgttgacttgaacaacatattttggggggggacaagggaggggtgacagttaagtaggaatcaaaggagaaggggaggaaaatgaattatatctaaggataaagctattaaagctctgtttttacagagaggcacacagccaagaaggggtcaaaaaacctccaggctaagttgcccaaagctatgaaaccttccatttctagaaaaataaatgaagaatgaagaaaattatttgaaattttttccagtaatatttgatttcctaaacatgaaaaaaatgtggtcaatgttagagtattcttcagtacttaagtcttttagtatgtttttcaaatatgcgtttataccaacggcattttattcttgataaataaaagcattaacaagccaaaaaaaggtccttccaagacatgtactccaaaagtccctcttaaagtgaatgtatgccttccttttaagggagctgcagcaaatgagtcatcaattcacaaagacaccaatggatgcaatttcctgctcttgagggactcatgattatatggaatgatctatcccacccatcttggggggataaaaaggactttcgttcacatatgacatgacctgaactttaccagccctgcaaggttcaggagaacagcacacagcatatatgaaattataggtttgggtctttgatcattgagtctctaaaaagtcaaatgtctgtcatgctaacaattatgtaattatcaggtgagttgctatattactcagaatactaaggcttagataaggaactggaagctttcactattaattgtatttttctgccacttactcataaattccttaacttataagccttcacagtcttcccttttaaaacctccctagagagacatgttcaaacatttgttgaatactgatcttgtataccacaagctgtcattgcttctgacaggtaaaccttccaggacattcctttgccaaaattatctaagcaatttttccttcactgttaccttttgttcattatcattgacataataaaatgatttcagagccctccaatgggtggtatggattctttgaaacattgcttccttgtatcaaatgtgtcttccttaatgccaaggggatactataataaataattcagctacatttgagctaggctatgttctgggtcagccttttatctgcgtaaaagaatcataattccatgaaagcctgcagaaaatctaccaagaaatttgaccatagaaaaatcttgctcgagaatatccaaagttgccaattcctgcagccagaaaaggtattaggttcatcagaatctcatcagacatgcaatatagatatatttcacttactatacagagcactagaatatgcagcaagagaaagacagagaatgaaacggcaaggcccatgggccatattggtttatgactgccctgctccttactcttcactcctgccagaagcttctattcaatcctctttgccagactctggcctggcaagcttgagcattagatcctggcttcaaaaataataatcaaagtaaagcgctgacaaattagatattgggttacttcttgttcttgttattgctcatacttgattgaattccacatctgagtctttgaatcttttacccagatacacttgctactgcctgtccaacacacactgaacactgaccttcagttctcctccaaagctctgatctgtcctattctctccattttttacattttccatttctctgacacaaacaatagtccaggtagatacctagaagtattgtgctctgacctcaggcctagacactcttgtacccatcaagctgtctcagattccttcttcactctctgtgccttctgtctatactctcattttgaatgacctcacagtgtagacatgtttattatcttaatggttaagagcatggacttaggagtagggctggctgtgttcaaaacccaactctgttcttactagctgtgctatctggggcaaattacttaatcactttgagcctcaaatttctcttctataaaatgggaataataataagacctctcacatagagcagctgtgaggattcaatgaactcgtatgtgtaaatacttatcacagtgtctgacacatacttagcacccaaaaaatgttaagctattacaagatttccttgctctaactatgtgatactctggctaatgaaggatgcagcaattgtgtgttccattaaaaattccctgaattctaattcatctttcattaaaatcatcagctttagctccagcaattttgttctgtcaattctgaatttgactttataatagatatactgtggtttgaatgtactgtcctaaaggataattttgtttatttattcatgcatttaatgatgactaagaacctactatgtgcctggcatttgtgctggccaaagttacaggcatgaaaattaaaattaaatgaacaggaaataaggactaatataatttggaatgccatccactactttttaaattacagtgatattaaacattcctaatgtatgattgtgcttcctagtgaatgtttcactttgaaactgtcacattggggatgttcattagcaatcttactctgaagggttatgtttccttatatggattacaaaaatatggcaattcattaatcaaaatttagtttgggaactggcaaagtatctatctgagagactcagcactagttaataatgataaacatctaggttttctttatttcccatctaacccattttacttcttgtgtgcactctctttatcccttcaaagaatgtaatcgatagaaattagacctgctcaataaactccctagacctaaaagtatctttagtaatgtaattaagtgcacatcatttaggatgcattgttttaaagccagatgaatttaaacccagtggactcctttaacccttcttgtaacgaatcatccttgtaatatgtgccccatccttgttagtatttgcctagtgaatttatttactgagagttacagtaaggtcataaaacggtgcaaacttcttttggggctggccatttgacgtctttgaccattgatttcagaatatgttaaagccaaacttcgttcagaaatcaaaacctcctacctctctttatggcagcatttccctagaaagacaatgacccattaaaagctgagctaatgtcaatgaaatggatacttttactgagtcttagcttatgcagtgccaaaatattaaggaattttagtaatgttgctgcagcatctccaaataaaagtcaacaagtttaacaaattctctccttggataagatttgacattttatagtcaaaattttcttctgtcccgtaactgtttttttttttttttttttttttttttttttttgctggggggggcttctctgctcatttgtataagacgtctaatagcacaaattatccaatactaatgattttgtacctctgcacttcttttattatttatgtttatttttacagacaaggcctcattctgttgcccaggctagagtgcagtggtgtaatcatggctcaccgcaacctcgaattcctgggttcaagcaatcctctggcctcagcctcccttgtggctaggactacaggtgcatgccactacacctggctatttaaaaaaaaaaaattgtagagacagggtctccctatgtttcccaggctggtcttgaactcctcggcttaagcgatcctcctgtctcagtctcccaaagtggtgggattacaggcatgagccactgtgcccaactccctgtgtgcttcttgatacggatattccaacaaggctattgattgccaccaaagttgcagacatgactattaaccacttgagctatttccttagacttagaatatattatttaaatgagattaatcccaagttagttatttttttgcctcaaccgtgaaatgttttgaaggcttttttttttttttgagacggagtctcgctctatcgcacaggctggagtgcagtggtgtgatctcagctcactgcaacctccacctcctgagttcaagcaattctgttgaaggccttttgatcctagtttttgctaatcagttttaatatggaagtatgtcatgtaacattgtttggcctcttagccattttggtcacacagttttcttctctatgaatgagaataaccaagtagcatcattgttagaaaagaaaaggaccattgtctgctgatgattaacttttttctcaattaataaatgacaagagggtgatcctggacaaaaccaatgtcgagggccaagaataataaactctttagtctttaatcatgcctgttgatcattcatgtgggccaaagctcttaaatatttaattatacatggttatagtcactggaagtccttttttgctttattgagttttacacttgttttcttaactaaatgttcaattcttgatacagatctttaactagtatttctctcttacatgcttcaaagtaccaaacccacttagtaaatgtgatgaatgggctgattaagtgtattctgagtgatctaaactttgtctatagcaggatttctcaatcttgtcactactgacattttgggcttgataattctttgtcgttgtgggggctgtcctgtgcattgtagaccgtttagcagtactcctagcctctgcccactacatgtcaatacaaccttcctcagttatgaaaatcagaaatgtctccagacattgccagatgtccccaggggtcaaaattgctcctggtgacaagcactgctctacagtatagatataaaaaactcagtcttcctggaaatgatttcaacacttaagctgctcaatgtagggaaattcaaaatagaaggacaagtattttaatcttgaaaaccttccaagattataccaaatgtgactagaaggtcaacagaatggctgttcttacaccataggaattgacaaaagttaggtttcttctatttccatgcttagagagtcagctaaaagcccctagaccagtgcttcacaaactttacagtatgcacaaatcacctgggaactttgttaaaaagcaattcattagcctggggtaggactcaagattccaatttcaatcgagttccttattggtgttgccactattggtctgtggaccgcagctggcataccaaagcccttgcctagacaatagatctttctaattagcttggtagcctctaataggtaaagagaaactagttatcttgagctcactgtctccatgagaaaggaaccaaagctgagtagagccagtcagtaggactgtttttaattaattgcctcattctttttacatggtcaacacctttgaacctatttgaacagtggttcattgccctcacactctactcttaatgaggttacttgtttcacctattcaatgaattgtgctatataacatacttgctactcagagagatgtctgacagggcattttcttcaagtattcaaataattaacctcttaaatgaagagggccctcactgttggacccatttcctatttatctcattttttaaaaaggaaataaacttaggaatgtctcaacgacatatatatggatatacacatatgttttagcctatgcaaataggttgaatctcagcctatgcaaataacatatggaggaacacgatgtatggtgaacacgaaatactgctgattttctgttttgaacacttacttgtattcagctaactctcaattaagtgtggtaagaaaggatggaaatggtatggaaattgaactgccacatattattggtcaatgatatgcttcaaaagcaggagggagggagggagggagggagagaagggaagagaagggaagggagggaaggaaggagaggaaagaaggaaagaccatagaccatagcaacacagactggttaaaaccatctctccgagttcaaaagtttaattcattttaaaaggcatctgtctagcatctaacagaggctataaaacacaagtatttttacagctgaagcaactaaactagtgtgtgtatagtcaacagtacacaatgtatttgaatactgccaatttttatgtgaccactgagctgccagtggcagcagtctactcaagtgagggcagaaggaatccactggaactcatatcgatgtattagaaaatgataaacaggcagtgtagaaaaaataattaagtttaaaacatttgcaggaagcccacagaaattatctagcacacagcaaaattccacttgtgtaatcagagattccaaacaagatagtatattcctagccaccacctaccaacaaccaacccctcactcctccttctcagaaccaccttcatattttcattatttctgggtcaaaacaacctgttgattgacaatacttcataatcccactacaaatctcacttcactgcaggctgcttaaaagagataattcatataatgctgttgtttgaaaaagcgacaaatcattctaattcaacaaatatgtattgagtgccagctatgggcaaagcactgggttaggcatccttactagtggactgactgaccgctgccagaaggatatctaccaccatcctggagcattaaaacagcatttttgggaagagggagatagctgtgcatttttatggctgcaaattcctgcatttggtagagaaatggcacaactgggtcataaaatgcaaggtataacttttaataagtagttcctgtacgttgaacttttgacaaccaggtcagtaaagtgagaaattagacatgacgcatacaaaaatgctaactactatctcgggtcatatagtagggagaaaacgtgttgatttccagtaaattaccatggtaacttgtatagattttagtgttgagaattacatttgccatctgtgggaaatatattatctttttgtatctaattttagggcatgtgttctatttttagcatgtgttctatgaaaaataataaattgggaggccaatttggataaattaaaagtggatattaaaatgctataaaaatagaatttatttttaattcaaaaagaaaatccagtagtacatttaggaaagcacacaaaggtcatttttaaaaccacctcaaaattgttaccattaagcgaaatttgatatgaatgagaattgactaaaaagtgagaaattctgaactgtgataaaaaaaaatggacagttacctgagagtattttgcttttgactctttagctttgtgtgacctagagccaatctctttgtgtcattgttcttcagttttatcatttgtaaactaattgcccctagccgcactgtgggaatcttgaaagagcatatatgatactgggtgactaataatatacattagaccatttgtcagattttacagattctctgagtttttacacattgtgcctcaattttgccaattttgaaagtgagatatggtggttgctcttcctagggattttcttatgccttaagtgtttgaaaagttgactcagatctttagatggcaagtttctgtaactgcaaagtagaaattacaattccttacgacatgcaactgcagttcaaagtaccgacttacaatggttgccaaattcatgcaaactaaagtggaagaggccattttcaaagcctgaaagtattaaatataaattacctgacttaaatcagcttagaattataattctactctgtatgtgatgtaaaatgaatttgacttaaaaatttatttataccacctcacaatttcaaggtaatgactcacaactgcttgggtccatttctaattctccccaaacaaatatgtctgtaacatttaaataccttaatgttgaaagcaacttaaagaaatacattaaagataccgcaataaaattctatttagttaggcttcttcggtagactgctaccactggcaattcagcagtcacataaaagttggcagtattaaaatacattttcttctgtgggctgttcacatactagtttagtttcttcatctgaaaaacaatgcaattagtcaaaatgaaatttgaaatttttacctcctctaaaatcagatgattgactccacgttttatgtgaatattcataaactgttgccaaaactgattattatttatgaagagaaaagctccacagtggtgtttaaaaaattcctgttagacttgcattgctgaaccaggcatctttaaatgatagttgcataaacagataggcaaataaataaataattaggctaaagtggttaccaagagaactcttagcagaacatagcttgcaaaccacactggacaaattccattccaaactgtccagaataaaaggcaaaatataagctattttgtagtactagtatttaaagccatagatcaattacctatgttaaggctacatgaaaacctaatacattagaaagagatgcattaaataatttagtgaagtattaacagtggttacctcgaggtggcatgattccatgtgatctttaatttcttatcatccttatgcatttttcaaattctttactaaaagcatgttttatagagtcagaagaaaagtgagaaaataaatctattttggtatagctactgaatatttttgaaaatgcttataggaaacctatcattactctctgctataaaatcaagttatttacacatttttcaagtatattgaaatctatttgcttgaatatgtactcttgctcccactttgtctattttataaaaaaacattttaggggacaccttacttctacattattttctcaagccactgctagttttcatatgctgaaaatcaatacatacagtgggatgataaggtaatgctctattctttgtgaagcagagctatgttatgctattttggtaaaagataattcattattgaggacaagcccttcatgtataccagtacagaggccactaaactatgtgagccacagacttcttctcaagtttgtcatggtttaaggaaccatttactgctccctttggatgaggcaagtaatggtagggtctcctattggtagctcccaaaacatgctcattttttcatagattgttaatggggaggggggattttttttttaaaggttaacagagtcttgaaagcatctctttacaaaatgagaaagaaaggcaaatttaccactattttcctcagcatgtttatgaattcagaagtgttcataaacattcaacatagagaataaatatatttttctgttattcccactgggggaaatgaaccaacatatgatttttgctttaatgctttgtaactctggaatcaccaagattttgcatgaaacttgtctcaagagataaactattaccaacaaattttgccacacacattttcttctaatgctttcagtaagtcagaaatccattaaacccctaaagaaacaatattaaaataataacataaaattctgaagtttattaatgtatcccatttgtatattgcaatacaatcagtttatatgtgtgtacaatattttctaaatgtagttccatcaattaaatatactataaatcatcatactatatttgtttagaagagttcaatatttctgtagaaaacatggcttcttctattggttatctaggcagtccagatgttctgggttctttggccaatccaaagcattcccaatggaagaccaaattgttctaactatgacaatataccctcttgaggaaaattgctttcaggataaacatcacatcccttaacaaggagtaaaatggcaatgccaccttcactctgacagttttctctcaagagatgttttgtaacattccatctgtgcctgtctgtttgtatgacatgttaagaaggaaattcctagtagagggaaagcaatacttttctaaggtattttcttttaggcatcagtgaagtttgacaccttgatatacaatagccctgtcttctaagctggtcacctgaggccctttttgtttgttattataacagtatcttccttctttgtctgtcttctccccatcatacttaatcttatgagatctgagataaaggaagccccatctgaatactttgtacctgtatgtgtgtgcaaacacacataatggtctgtgtacatctcacattatagtctttagatagaaatatttcaaacactgcctttataatctaaaggggaaaggttttctgcaataaagctctgtctgtgttagtaacttcacagtatacattttgaaaatatatggcaatttttcccaagggagaatcattgtcctattgtactgacctaactttgcgaaacctggtttaatgggttccatgaatccgcaaacaaatatttattgaaaaggtacatgctatttgctttgaaaataaaaaaagataacatattctagctgagaaatcaaagcatgagtttgcctaccttcacctatcacatcacacattcattttcccagtgctccagaccaaactacttgccaaaatcctttgcagctacctttgcattgtgtcattctgtgtctgacccctgtctctaaaatactcctacagaaacacacacacatacaaataccccaactgaatttctcatctggcttataattgtgatacttataatgtagcatttcttatataaaaggggtctagcacagtgacacttaagtgctcaataaatatcagctcttattattattatttattattatctgcttacatgtctgactctgaaactagacatgagcacctttaacgcaaaaacatatttcatccatcactttcactttatcactagaactcaaaagcactgtacctggtacagagaaggcacttataaaacaaatagaaaatgtatgtattagtaagaaaatttgaatagcagtatcaaagatgtgaagcagtacatgattgatttccaaatgtcaagtgaatacaaacattcttagttctgtaagtctatacaagactgtattgtcattagctttgtgaatgaaaaaaagaacagaaaccaaacaccacatgttctcactcataagtgggagtagaacaatgagaacacagggacacagggaggggaacatcacacaccggggcctgtctcagggtgggggcctaggggagggatagcattaggagaaatacctcatgtagatgacaggttgatgggtgcagcaaaccaccatgccacgtgtatacctatgtaacaaacctgcgcgttctgcacatgtaccccagaacttataataaaagaaaatggaacaataatttttaaatctatactatgaagttgatcatttttctatatattaaaagtttattcctaacttaatggactgaatattaatgctataattataccttatcagttgcttgaaccttaggatacattgactagatacacagacatattcttggaattttagaatagaaacacataaaacctagctttttattcaaaattgggtttgttcttaatcatctaatcagtcattcattttcactgaatatctttaatgtgtcagatagttagcaaggtatttgggataagtagtgaaagatatagacaaaatagacaaaaaaaaaaaaaaaagagagagaagacaaaaaacttgtcctgatggaatttaaatcccagtggaagacaaataataaacaataatacatttattgataagcaaatgaaatattatgttatatagtgatgaatactataaaaaataaagacaagtagatgcaaaatgcagccacaggtttgtgacttggaacgagtggtcagtgtatccaattgagaaggtgccgtatgagcagagacttgaagaagcaaagagagaggcatgtagaaatctaggggaaatactctctagtcagagggaagccagagcaaaggtcctaagataaagtcattgcttacaatgtaaaacaataaacaaaactaactctgatataattcaatatggtaaatgaaaaaaaaaaggaacaggaaatacatgttctaaagaggaaaaaaatcacgtttagttggaaaagttatattggaagtgcaagatcctaacctttccttgaaggactggttgggttttggtaaatgaagaacttctggtttggaacaaaaaactcatgtcaaatttaatttacattagaaggatgattatggctaaaggttagttagctgcttcaattaaaggaataaagaaacttaaatgcccacataaggggtttagactttgttccatgggcaatgtaaatcagctaagagatcctgcagaaaattccagggtgaagacatgatctgggaagatgaaattgaaggctttgtgcagattcgtgtacaatagctgtaaataacagaattttaatacaaaggtaatcaacctgaagtacactctaattacaataacacttgcaattattatcttacaatttgaccttttattttttaactttctattttggaatacaaaaactgcagatattatagaaaattacaagaacagtgcaataaattttcatatatcttctccacctagatttaccaattaatagatttgccacatttaccttatctctcttcctacatataggtaggtaaaaagagctgcactacatatacacacacacacacaacatatcattgctaaaccccatgagagcacattgcagacactgaaactaaattcttcaatgtgaatcccctaaaaacaagaattttttatgtaaccaggatacatttatcaaattcaggaaaattcaaaattacaaaatgccattgcctatgatatagtctatattcaaatttcaaaaattgtcccagtacataccctttacaccatatttaccatctaggataatgcactgcatttaactgccaattctctttagtctcctttaatctggtatggttcctcagcttttcttcgtctttgataacactgacatttcgaagagtagaagctagatggttttattttttatagttgtccctcagtttggattggctggacatttccttattttttttggatgtttatgtgtttctggctataatactacttaaatgatattgtgccctcttattgcagtacaccgggggtgggggggatgatatcaagttgtcccgttattggtgatgttaaatttggtcacttccttaaaatgatgtccatttttccccagtgaggaggtactatgagacggtgtgaatatcctgcctcaccaatctttcaaccaataattttaacgtctattgataatttttgcctgaatcaattattattatgatggctgaaaaatggtcatttctaactatatcgttcatttcatatttaccggttgacattctgctcttagggagagctttcccttcttgttggtttatttgtaactaatatgaacacatggatttgtgctttattcagttactgccattattcattttaactcatcttttaaaacataccacctatgaatacttcttaattcacagagagaaaaaccagcttaacacccttcttgcctagttgaaagagaaaaaaagcacattccaagggtaggctctagcatgctgtgaagagaatgttacactttttcttctagcctttcattttatttttcactttgaatagttcattaacacataacaatgaagttccaaggacctgtgggaccttagtctaactgggctctaatgatgggtcctagccaacaaccatatttgcattttgattggcagtaagtagaagttaatttggtgcttcgtctaaaaacctctttccaaatggcaaaatatactactttggaggtaatcttttgcccaaatgtttggtcatacagattaagccgctccattcagggatcatttttatttttattattataattttgggggtttataccctgacttcccaaaaaggacttttgcaagatcaaaactgttattcttacatactggtttgtactttcccaaaacattttcttcctttatgtgaatagcagcttgatttgttaatgtgtttcccccaccccccgcaaaaataactgcttttaaattacactgatgtattgtagaactgagttgagtatctttgtaggctgagcataattatcctcctgccaggaacaaataagttatactgctccagagaaataaatatgcatatgaatttatgtggatggataaattcttataaactttagctctttataacacaatgagagaaaaagaaatgtacctggtgaggctaatgaataaactgggatcattataatgtctgtcatgcattttccccacaaacttgcattttactgcatataaatgagggaagaacacttcaaaagactttttataatgaacgaaccaactttaggataaactacacaaaagtaagccatctaaaatcttcagttataccttctggcaaaattctatatatataggaacacacacacacacacacacacacacacacacacacacacagatcaaatagagatactgactaaaaactgcaagtcaagagttcaaaaatacatatgaacttttacttactttgttaaaagctttaccttttcgaagatttctagcagaaaatgtttgcaaacaataacaccaggtacaggccaagaaaagaacatagtttcccatagtatactaggtaattgcagcaagatcagtggaaaccaaatgcatttattatttgcaatgtaattcaatatactaagagatggcacgcactttattttaattagctgtttcttttaaggggttgcttgctcccactgtcttgataagaaaaaattgtagtcattgctcaaaatgcttgtagcaaatctagttttaaattgaaacaatttattccaaagcagtctactactgcagcaataatcaatgtgttttcccttagcctgtactggagctttcctaggactattgttaattgcctgtaactaaatgatcgctggggcccttaaatgcaactctttggcacttgttcatttgttgtttttaaccaaatgccagttttccctaggttttgcctagcaattttgctttacaattttcaatattcagtctcagtcccttaaagggggcagagtctatcattttaacaaaatacacaaaggctaaacagattttaaaaggtctgcatttctccttctgtcctcagatgttgaattgtgctgaaatgatatctttttattttttaaatgctgccactccaggcaacttgaactagagctgaaaagtagatcccatttcaaagggaaaatgacatttgctggggcaacaccatttacattgtaatgtaaagataaaatacagcagtgggcccaaatgatttctcttaactgtgacagaatttaatccttagtaattttgtataacccaaaggataagcaataataggtagcgcatgtattaatgaatctgtctggcttggagcaaaagaatacagaggctaaatctaatgcacaattttctttgaaagggttttcatatgctatataaaccagtgtgacttaaatagaaaaaaaatttaacttgcatacatgtataatgtgtaggcttgtatattacactcctgcatagaaatattgtaataactgaggggcaggcactgtgcaccatggggaaagacacatttccattttgttcctgacctctttataaggacattataagaacactatgcttctgcaatgtaatactacagaagtctctgggggaaagtctgtgatgctctcaggatctcaggataaattagctccttgtaaattctgtttctttagacttgtttttggtattcctattattagtaaatgactatctatggcccagaagaattattcttgcttattgctcattctctaagcatatataacttttcatatgtttgtaccctaaaggagtttttcatgtgacacaagactgtttctgtaactgctaagctacatcaaccctgctctctttttcttattatattttaaacaacactattgattggctatgtagagtattctaagtaatgtatatcatttcttaaatggctcgtgacatgtagcaatgggagtaactcctatctgggtaattactttgctaaaaataagaaggacttattttcatacaatttttctctaatttacctgtattcaatttctcaaaattaaaaaagtatgtagagaccagtattataaataccatctggagaaaatgagagttctgtttattagattgatcagattatatttcaggcaaatattttttattatttccaaagctcctcgactatctatgggcacttaaggcatgccacatgcccagcccctgtgtagtgcctccagatataaagaatgtgcttgggggcaccgtaaaagaatcattccctgcctgggcccttatctacagcagagcagctttcctgactcccagctttcttcccacacttctccccacataggcctttggttagaacttacgtttttcttaaaaaaagaaaaatcaaaatgttaaagaattgaaatatgattcacataatataaagcgtgtagctctaagtgtttggctaaatgagttccgacaaatataaacacttgtgtatccacaccataaacctatttcctttaccccagaaagtttcctcttgctccattccaacaagtttcccttcactcatcatcaatgaatctattttctgatttatgtcactatggatcatgttggtctgttcttgagtgtaatttaaatagaatcatacagtaggtattatttcttgtctggcttcctttttctaacataattttgtgagagtcatgcatgttttgcgtatcagtagtttactacttttattgctgagtatattctatcatatgaacatacaatagtttgttcatcatttcctgttaatggacatttaagttgtctctatttgtggctgctgtgaataaataagactattctgagcattctcatacaactcttcttgcagatatctgcttatatttctcttggacaaatacctaggagtggaactgctattgatatggtagatttttatttaattttattagaaattaccccaaagtttacaatgtggtaatatcactgggtactctcactagcaatgtttgggagtggaagctaagtgttcttgattctttttccatttctttttttgtacaagaaatttttgagtggtaaattcctagtgtttaatatactaaattagaaaatcttaaaagaagccatagtcaaaatgcttatttctcacattatatccaatgtattttaaatcatatcttcctgatgtataaatcaccctgtgggcataagttagaattttacacaggcttctgtgtatggtggagtttattatcttgagtgaacaagacccaatgtatccccacaggattagccgctcaccctttctgttcatataatagggggaaaacattatactgaagagctttttgtattttgttcctggtatttttgtagtactgtcttgtgtggttccccacaatgttaatcagataagctgctggaggtatttttcagtgttttacacttcatattaatttacttagactctaaaagagttgatctcactttattttttcttagatgcatacagttcaatcgttttaaataagattttcttcaatttcccatttaattttaataattacagaaaaacacacttgattaaacagcagttaatgtgttgtttattaaactgtagaattagaaatcaagggctaggtaataggaaatatgaatgaggatttttttttttttttttttgagacggagtctcgttctgtcgcccaggctggagtgtagtggcgcgatctcagctcactgcaacctccacctcctgggttcaagcgattctcctgtctcagcctcccaagtagctgggattacaggtgcctgccaccatccccagctaatttttgtatttttagtagagacagggtttcgccacgttggccaggctggtctcaaactcctgacctcaggtgatctgcccgccttggcctcccaaagtgctgggattacatgtgtgagccaccgtgcccagtctgaggactttttttcctgtaattattacaggaaaagtgacatcacctgcacacacacacatacacaatgttcttgtaagaaaatgatggccgtgcttttcagattatttgtcactcatattacaccagtcccatcatgatttcaccccatttgtgagaactcaggactgatctgataacctgagggtacttgttaccagcaaaaccgtggatcattttaaagttctcagtctaagcttacattgactgtgttatgaaattagataacttactggtggattctgaattacagaatcaagaataacattattttacagctttaatttcagaaatgtttatatttaattgtagttaaggaaactagtacttttcaaggtagttgtcaactgcagggaacaatggctacccatcagtaacaacatttgggctgtgatgattaccgacaacgcttaaagtgagtttcaaaaatctatgcatgatggcttactatttaaataccaatatccttatttttgttacaatgtccatggttctaaagaaggaaaaaataacaaaaaattttatctccaagttttcctgataagttttgatctaaggtagatattcagtagaaaaaggagaatttgtatacagtgagtgtcaagaaaattccttttttggatagaacgtagtaacatgcctggtaaaaggggaagcaaaaatcttaaaaagtaaacggttgaatgaaaataaaacaccaccaacatattcatatactgtcccatccactaggaggcctacttcttacacccaaaaagcattcagcctccaagattatggtagaccaccttggtatcactgtattcaggaagatacagcagaggagctattgctcctggcaggagtcagcagacagcattcattagatagtcttcccaacattctatgcaacaatccacagtgctctcctgaaactgtgttgtttgacctctcacctttctttggcccccaacccacaggtgacagctcaagtgagagggatcaagattctcattgggagaggccaaaagtcatcctggcttaaaagcttcatatccacaggaatcagtatttattttatcaaccccataagcatagcttccgggatctccacaagtgatacatttatataagagagttatggtactctgttaaacccaatattatagtttccaatcagatatttacaattctcttaatccaaatgcaagctaccaaccaaggttcatttttaccacaagcaatgttgcttagcaacatggttgtcacataccaccttatctagttaccaaggaaacagagctagaaagttatcaaaaggtcaaattctcatgcaaaaaggaaaggggttgtgtcaacccgttaacccacatctgatctcatccaggaaaatgtgaaatcaaactgagtttaatttatgattttggatgtgaataccatataattccccattgtggttttttctttctagagctaatgtacacagtggaacttgctggaggccttggtgctatactcttgctgcttgtatgtttggtgaccatctacaagtgttacaagatagaaatcatgctcttctacaggaatcattttggagctgaagagctcgatggaggtaggatgttacctcttttattgttctttctgaatgttctaatttctttcttgtctttgttttattaaggggaaaaaaattacgtgcataatcaatggcagcagctcgtatattctttcagtgctcagtttgtaaatttctcttttgtaaggaaatgtgtgatgctttatagccaatactgtaggtattttcctctgaaagttgtaaagcaacacctatccattttagaattgtattccaaacacttacaaattacaaacactgattgcaatgccatcagagtgttccttttctctcaccttgtaatcaggactgaaaggccagttttacttttttttaggtaaggagtgtctcttttaattgtgttttctagcccagtagtttgaagcgaatctcaatttgctcctgtttagactgatccgttataataaactgtactgagtattttaaattcatccagcagtcttttcaatcttgtttatttagctatatttagatagcctaatttttattccaagtgtggaccaacagaaaaatgcacaagcacattaatttcatagtaatgcatctcatatttttactgtacgtagacaaataaatattgttttgtggaaatcataattagtatttgcttctggtcaccaatgaatatgtgtacaatctaagaggaaaatggagtccttaaaattcagctccctaaactgcacattagacttatgtttttaaaaaataacaaaaaggaaaataaactaagataaaccagcaagatgggaagcatatgcaaactgacaatgaatagtacagatgacaaagctttcttcatcattttttttttttttagtgaggtggagtttcactcttgttgcccaagctggagtgcaatggcgcgatctcagctcactgcaacctccgcctcccgggttcaagcgatcctcctgcttcaacctcccgagtagctgggattacaggcgcccgtcatcacacccagctaattttttgtatttttaatagagacagggtttcaccatgttggtcaggctggtcttgaacccctgacctcaggtgatccccccatctcggcctcccaaagtgctgggattacaggcacgagctactgcacccggtctcatcatatttatatactgtttttttttcagtgattttcagttttgcagtaaatggtaccaaggaaaatgaggcaattgcctatgttgccacgtttccagggtcctctggaataataaatccacaagcaaaactagttttgcaggtttgtaaagagaagtggtttattcagaatgcctaacactcctcttggtttacccttctctccttcccattagggtgaagcctgagctgcagcaaaaccctttctttttcttaagtttttaattgctgatttgcctatttgtttctaactttcttgcctattgatgcaaattattattattactattgctgctgttttaaagaaatataaggactttgccattgtcggaactactgttgaatgagcaccaagcatagtgctaggcattcttagagtcattcttgctaaccctcacaaacatcctgaggtcaatattgtaatctccattttactgataaggcaactgagactttcagaggttaaataacttactcaagaagataacacaaatactgtaagtgtccaagatgggatttgaaaataagtctattcccaaagcctttatcttatcggatactctctattatttgtattttttttaaatttagtatgttcagtatcatctaaagatctactgttgtttgcacaattagcacagtacatggtatttgaaaaagcacattacctaaacaagtctccccttttctattaaccctgttttgaatatgtttattttgtgttctgaatgagatgaatcattttaccaaactatcaatttctagggcagtaatctgtcattttctgaatgtagaaaattctggaatataatgaaaatgaattaatcatacgcagtggaactttcagtgattcgaagtttcgtttagtgggtcctgctaattgtaaacacttcagtgactgacttgggtagccttaccatatttcattgctgttctgaagctgctgggttctcagttttttaaaaaatgttttaagtaagaaaacaaagcagacagacactaacaaacagtattctaacagatgagaaggttctcttggaaagcaatttagttaataaatcctttagcgattcttagaactctgtctctgaggccatcttaagcacaatcgagggtctaactattagggcttttcttgaaatgccactgaaaatgaattagacccaaagaaaaccaagataacaaacttaactgtcatctggaatatgttaatgtacaagttattcccctaaaaagcggggggcagggggaagcaaagactgtcaaggcagtgattgttcaaatggttttatgggaagaaattattactagaaccgcaatcacatgttcagcctccctatattaaagcagacccgttcctgctgaaatggtggtcagggccccactcttaactcgtatctcccgctgcatcacacctaacctctagaacttccagacactgttttatcagaaccatacagcagtactaataattatatagcaagtttaaaatctatatcttaacaaaagttagaagtgtataattgcaactttctttaattctctagtgctctaaaaccattcagcttggctctcaagttcccatttctactgagaaaaaactcataaccttgcttctccaagattactccgtcacttctggtttggaattcagcttcttgtgggttaacactcagttgaaaattggaatattccatttcccttcttctcttttactcttgtttaaacctgtttccagggaactcatatgtagctttctggtaaaggaaaaagtcacctggtgcatatgccatcccttcctcacttgagatactaccacctggtctttggacatgttgagcactgacttctgaaggcgtagatccttgtcatggcctccagtcacaagtttcacacacttgcccagatgtttctcccttgggaatttcagacattcttacctgtgtttctagtcccataaactcggctacacgcatacccaccttcccattaaaaaaaaaaaagtaatcatcttcttcatcctttgcctctttcatatacggtttccacattgagtgcaggatttctctatgaagtttacagtttcccaagattttccctgggaaacttgacacaaatcctcgcccttctcagattctgcctcaaaccatatgaagttctgttatcctcttctcctctctgtggccctgagggcccccttctcagaaacccatgcaggctgtaaaccttagtcacagccccttagagcctcctatacatgcttttatggtcaaagaatggtctactcttccaatagtgaaaaacttctctgacatcatcaaatccccatgcttcctagctctgcaagctttttcctcttccaaagaagagatggctattcaacaaaacccaaggctttgtaaattcttgtcttttaaaaaatgtaatttagagtcaaacctgagtattgccttctttattcatggctatcatatttaccttccctgaaggggtaatttataaaatacttttgaaagtaagataaggcaaaaagtgtgaaaaataaccagggaaaaatgtttaataatatcctactatagcaatatgataataatagattcaatggccatttattgaataacaagtgatgtgttgactactttatcaataatcagagaatcacacaattagaaagacagaatttaagctccggtctaaatggctctaaattccaagatatacagccattttatcagacttgcagatggagtttctggcatcagggacacattcactcagttcctttggagtcattacaaaaggcattacctggctatatcagttctttatcagaaggattatgattgatatagaaggattctaatattttttaaagatagaacatattgatgcttttctctctcagttcgttcacatcactccttgttcccctctatataaccttacattttattatctcccctgcattcagtccttagcatttccaattccacaacactccccgcccatactcattctttgtcatcctccattttacacctcagttcctggtatcaccttctatctcattggccacactttcccctcatatgccatttctaattagtcatcaatatcagtcaattgcacctctcaaaaatagatattttccttacccttaattgcaactgctttgtccaagcctcctacaccaccctcttgttttcattctctacttctctatcttatccttcacattctaacagaattatctaagtacaaatttactgttccattttttaaaatgcctccattttgcctgctagaacagtctagacttagctcagaaagcaattgccatcaaagggtgacccaccttacttttgtagcattgccacccccatgggatctcaacatgcagagttctagttagaataagatgttagtctttgtaataacacagctattgagaatgaacctaagacaatgtaatcttgcataattctctgaggtttttggggaaaatgaagtaaccacaatggttaaggggaggagaagatacgctatccccctaccactttgattccacaataaaaggaaagaaagtttggataaattctgccagaaaaatatttattagcagacagccttatcactcaacttataaatcagaagaagttccaattctgttgtatatgtgtgtgtttgtgtgcatgtatgaatctgcatgtgtgcatgcttttcagaaaccttgcaagaaattttctcccaaggcaaatgtggcaatactccagtggtaggattgaactcaccttctgttgacatccaagaataattttcatcaagaccattttggaattaagcctagaagatcttctccaagggggcagaccactggccctgctagatttttgtaagggtgggaatgtgtttctaaattgtgttaagtaattcatatgtcttgattaacactgattttaccatggaaataccatttccaagacccattgtacacagtaaaaagccactatctttagcaatgaaacttgatttctaatatccattgtgttaattgatgaagcatctacttttgatcagaaatatagtttaagtgcttgtagtgaccgcctctggagtgttgcctcattttagttaaatgcttgctgaccatcctaataagggcaagctactgtctttagagtagaacttatactaacaaagtaccaccaccatttatgctggaaagattttaaaaaacaatacagacatcacaacagtgttagactcctttgctcctccatgtctctgaatggagtgtcccttcaagttttgtttaaagttataatcctactttatatatttttttcagagtgtaaaatggtttttgttgttgttttcagctttttttccttctctgactatgaagtatgtggggcatgcttactcataatgacgccagggcaagcttataagaacactgtaatcactaacacgaatcctattttaaagatgaagaaagagatctcctagtcctacgttgggagttattacaggcattgaacaaaattagttagagcaattttttataatctccacctccatctcagaaaatgtgaacatctgttccatttcaggcatattaagcacattggcatctatgaaatcttaggccatagaatttctttttctttctctttcaatgacaaggtcactcactattcatagtttcaggaattattgtcctcatgtccatcagtgaaacatagtacctctgcaaatcatttaaaaaccttatagggattttttttggtgtttttttttttttttggtgggggggtgggtggtggtggtagttagaccatttacatacacaggaataatctttagaagctagaacaagtttttggatcccagaaggagagatgtagagttgttctgggtatatgacttgcctcaaatcattaactgttaaatggtaggaaccgaggcttcttatcccaaatcttgtgctccctttgctattctgctactttttaatccccttaagacttctgaatctatgttgcctgctgccctcttagggatacaagagaaggaaataaatatctatagaatgactcctttggaccaggcattttgctatatgatggggtctcatttaattttagacatcttcaggaaggtgctattttatagatcaggaaatatagtcccaaatgagttatataaaaagttatggcaatcaagatttgagctaagcttctgggtgtttttttcactactttataccacagatattttaactagtatcaaatttaagtgtttgagaacttatagattcaaataatccagaaaagtaccaaatggcacaacatgtgaattagaacagtactgtaaatacttcaaactgtacaagtcaagcaaatttattttacaacaattgccagaggttgtcatagcagaattgaaaagcaaaatttattaagacaatgacattcaataatcataaaatcaaaccattaaggttttatatatctaatgtttattcattcaaagatatatgatctctgaagataattttatttgaaaaatcatatcttgaaaacttgagaaagcatatgatggcaaatctgagacataagaagaaatgtgacttactttttgaaaactataatttattcaaattttatcaatgcaaatttttaattatcacagttttctgtgatgatatgccacacttaaacatacaaaatcaacttttaggattaaaaaaagatgaactatacaatttatctttgaaccctcctccagtttcattttaggaatccatttactgaatgacagcctctgccactagtcaatttcacttatgtgattcatatatacttgagaacaaaaaaaaaaagaaaaaaaaaaaaggaatggccagctgccaaaaacatttgacaactattcagtaagtgtttagaggttaaaaactcccccaaaccggatgtcatacttaaaacatttctactgtcagtaaatcttttttctagccaaatccaatacagccactaccttcaacttgaaaagtgagtcttcaacctacattttcttaaaagctgtgttattctaaaataatcccgcagattccttgcttcctcagtcattttaaagaacattgagggtattatcctctcatatgttaaagagaaaggtgcatttatctataacctttccaaaccctcttttcattcctgaacataatgccattttttccttcttcatcaagagttcttaatattttaaattcatattttttatttgttaacgccacagagtccaaacttccttctttcctctcaaaaatgtttttataaaacatcaaagcttttagttaattcaatttaagaagaaatatctgctggacttgttgattgacttcaagtaaccaaacaactagttgaatgattggatcttgttttttgtttgtttggtggagcatatctgccggggtcttttgaaagtcataagaaagagtaacttaatgactacattgcagattataaagaattactacaaagagtgtgtataccagctgtttttcatctctgctgtgaacagaattatagttgatgcttaaattgcagaggattttgagaataaagctcagaataagaaatagactcttgtaccaacctataactacttttaagctgtttataaatgaaagttgaatttaaattatcctagccctatcctttaaaaatattagcataattttgtttttcatggttataaagatgtcagcttttcaaagtttcaccagtcacatgaagttcatacacattaaactatgtcaatttatgttctttcttatatcaaaacaatctaagatgtactatccaagatgcatatacagttggtaattgaaaaagggaagacaccttagaatccatatgattttgagtcaaaaaacattgctgaatttagtatggcatctggcactctgcttccggtctgacaacttttcaaatcatgggtttgcttctgatggtaaataaatgcctaacccattactgcactgatgcagactctggagaaagagagaaattagatatcactcaagtgtcccattggtttgaggatggtgctgcagatgcttgaaagaggctttctaccagtataatctacttggaaacaactccattataactgggagatactaacttaagtactataaatacatccagatgacataaggagatagaaaactaactgatgtcatagcaccaattcctaaatttcatttaagattaatatggttatttcatatattagtctaggcaaaaatttatcccctttttgataaaaacatgaattcttagctattttattgggagtatatctcctctaagtattaggacgatctatcatggagccgagggggcaaggtttagtttttatgatgttgtggtcaaatacctggcagataactgcagttgtttggtgtcattgagacctctgcatgcctatatcctgttctagaacagagtttattgaagtgtggtccctcaatcagcagcagcatctcttgagagtttgctataaatataaattctaggaacctactcttcacctactgaatgagaaactctagaggtggggctcagccctccaaatgatggtcattcatgctcaagtctgaaaaccactttcctagaggcatttacacagatcctaaggccttttttttttttttctttttttttgagacagagtctcgctctgtcacccaggctggagtgcagtggtgcagtctcggctcactgcaagctccgcctcccgggttcacgccattctcctgcctcagcctcccgagtagctgggactacaggcgcccgcaaccacgcctggctaaatttttttgtatttttagtagagacgaggtttcaccgtgttagccaggatggtctcgatctcctgaccttgtgatctgcctgcctcggcctcccaaagtcctgggattacaggcgtgagccaccacacctggccaaccctaatgtcttttcatgaatcacagtaagaagctacagttcaagagtattccaaaggagccttgctaaactctgaaccacagctcctagtaattccttgagaagtcagagcagcatggagtctacatctccaaagcagtctctcctgagaaatgatccgagtcttgagaaaaatctcaaaattagctatcgggtgtgagtcatgtgataccaaaatgaaaggccattcgttcatttcatcaactgataaacttgagcatctactaagccccagtcacatacctgagctaaggatctcatagtctaagagagaagataagatataagcaaaatcatataatacatgggaaaaatcatcacttccaactgagggaaatcaggctaaccttcaaggaaaacaagctaaaaatgcagctgctgattatttagacaataagtagccacagatattttttaagccaccataacacatgatcagtggtaaggtctgggaaggtaaatttggtgactctcttctccagaaggagaaggaaatggaaagggaagaccactcaaatataattataacagctgagatatgagtagggcctaacctagaatggaaatagaatccaatagatttgtaccaatgaatggcgatgagattattagtaaagataagggataggtggaacgcgcatctgaagttttgacattaaagaaatgagatttttatgttactaaaattaaaatgaaataaaagatgaagaacacagcttgagatgggaagcttgttacgttgtgagcatgtgaagtgtgaggtgcatgatgaagatgcaaattaaagtgttcaggttacaggtaggagtgggggactgtcataattcaggagaaatagaacaggatcatgcatccaaattgaggaggcatctacacagaagtgatgttatggaagttgatgttatggaaggaaaggatatttttaagggaaagtgggctgaaagaaaaatgaagtggaccgcagaaaacatcttgcagaaagacggtatttatgggttggaagagaggtttccatgaaagaagcaggggaatcagagacataatgttatataagcaaaggcgatatttatctgaaatttaccagtatgggtggaccagttgtttacatctcgtctgatttctgaatgctccgttcttactggtgttcatatgttgatatggctttaaaataatcttaagcctagagaagatatgaggcaatgaatgaggatctaattattacacaaccccagttgaggggagtttcaacactttgcactactttgtggcaaactggaaaagaacagattaccagaaagaaaatagcatatgcccaaaataatactacaatccacaatctggcctgaggagtccttccattattagcctgtgactcctgaactacccttagtaatacatttatctcttaggaatgtactatttatttgtctgcatctcctgctaggctagaaactaatgaccaatattgtaaagaaagtttaatatctcataggtaatgcatgtgaatagttaatgaatattttaattaattattaaccgatattatgtactgactttattgtgtgctttcatgatttcttactcaactaaagtgtttacatcaatgagtggtacaattatagattgtactggcctatgggcatatagcttttctatagcaaatataataattatttttggagaaaactagattttgttttttaaaatgtacaactatatgctggctaaagaataaaggaaatgccaaaatatgacacatttggtatgattgtttttcttaaacttttttgccctaaaagctgctgtttaaaaaactcttctatagctgaagtttttattccaagtatcctatagtgaagttgttagtgccttatatacctgtgttaactttacatgtagcaaacacttttctgagtttgccctgaaaagttataatcatagaatgatttctagatggctcaaaattatcagactactagaattaacacacatgtatatatctcaggaagtgaattttagtgtccttgaagtcaaaaggattgtcccaaagccacccagaacaatggtgaagaatgtccctctatcgttgatgtttcatagcccaaatattttaagttctatgcttaatgcagagttcattttattctgaaatttatgagtgtttcaatttaacttgatctaatcatcaagtaatacactgcctatcatcagggaagtgcaatagagagctaaagacattgatattggtagactcagcatatcaacagtatttaaaatttaagtgaactatgaatcttgatatcttagtcgaaaaaggaaattgaccaaagaaagactatccggaagataaatgatttcttattcttagaaacaacaagtgagaaatctgagatggtatattagaaaaattaagataaagataacaaatgattgatagtagtcctcaaatatttaaaattttctcatgtaaaaagggggaagagtaaggagagaaatgagattttagaactaagtttcttttacttacattctacttcttgattcttatgaacaaactgattagcatgatgaaaaataacttggcaatattttatgtgtaagatgagtggagaccagaaaaataatgtctttctataatcattcattttaataatattctccatcccaatatgcaagaactgactcctagtaaaaaattaattctcacaagtttggttttattttctccccaacagaaaatcaacacagcacacataatctaaaaaatcattcattcacaattaagtcagttgccgttttctctctcttttttcaactgggtaaaatggccaagggtagaatcagttgaacgtaagagcatactgatatccaaacatatggcttttacaagcagtcaagattctctgtgatctgtgcatcaaaaatggtgaaattctgctgggtgcggtggctcacgcctgtaatcccagcactttgggaggctgaggagggtggatcgcctgaggtcaggagctcaagaccagcctggccaacatggtgaaaccccatctctactaaaaatacaaaaattagctgggtgtggtgacgtgcacctataatcccagctactcgggaggttgaggcaggagaatggcttgagcctgggaggtggaggttgcagtgagccaagatcacgccactgcactccagcctggacaactgagcaagactgtgtcccaaaaaaaaaaaaaaaaaaaaaaaaaaaaggaagtctgcatttcattactcttttcattgatttttctcctacttttttcacaacaacaaatcaaaattcaaccctttgtacctccaaactagttttagaatcattgaactcaatgaaacttaatgaaggcttcatttttcggtctttcagaaatgggacatttggagacgtttatgaaaaaaagtgcatgttttcatgtcctattgttatctttgtagagtagtgacttcgacttttctttggaattttttgacagacaataaagattatgatgcatacttatcatacaccaaagtggatcctgaccagtggaatcaagagactggggaagaagaacgttttgcccttgaaatcctacctgatatgcttgaaaagcattatggatataagttgtttataccagatagagatttaatcccaactggaagtaagttaatgttttcatttgagagtgtgcatattcatgtgagtgtctgtgtagtcatcactttttcatggaattttaatgtttggttctttacttcaaaatttgtatctgttagtttccctagaaagaaacgtctttgtgtgttcacatgaaatttaatttttgctagctcagagaaaagatactccattactgtataaagcatctcattttgtgagccttgacattgaaagaaaccaaatgagagatttgtaccgggaaaaaaaaatattgctgacattaggagaagcaagtcccaaactctattcagtgaactagtttcatttaatttctgaaagagaatctactaggactttctggaccaaattttccattcactcattttgatgcactcttttatcttttgtagcatacattgaagatgtggcaagatgtgtagatcaaagcaagcggctgattattgtcatgaccccaaattacgtagttagaaggggctggagcatctttgagctggaaaccagacttcgaaatatgcttgtgactggagaaattaaagtgattctaattgaatgcagtgaactgagaggaattatgaactaccaggaggtggaggccctgaagcacaccatcaagctcctgacggtcattaaatggcatggaccaaaatgcaacaagttgaactccaagttctggaaacgtttacagtatgaaatgccttttaagaggatagaacccattacacatgagcaggctttagatgtcagtgagcaagggccttttggggagctgcagactgtctcggccatttccatggccgcggccacctccacagctctagccactgcccatccagatctccgttctacctttcacaacacgtaccattcacaaatgcgtcagaaacactactaccgaagctatgagtacgacgtacctcctaccggcaccctgcctcttacctccataggcaatcagcatacctactgtaacatccctatgacactcatcaacgggcagcggccacagacaaaatcgagcagggagcagaatccagatgaggcccacacaaacagtgccatcctgccgctgttgccaagggagaccagtatatccagtgtgatatggtgacagaaaagcaagggacatcccgtccctgggaggttgagtggaatctgcagtccagtgcctggaactaaatcctcgactgc

SEQ ID NO: 668 - DNA, 1200828 bp, Homo sapiens
tgtgaggcgagcctggagctcatttccaggcgcccttccctcttcggaactaagggagacttgtgggcttttgcacactggctgtagggttcccgggaaagactggagcagcgaacaggagggagagaggtggacaggcagagtctgcacctgccgcctgcacctccgttagggcgacagggcagctggtgtttcgctcctggagtgtgcctacctcgcaaggggggcgagggccacaggctgaggcgcccgcgtcccggagtgcaccgcttggccgaggcaaggtgttgctggggcaaggctgctccgaagcgaagtcgcgcaaaaggaagagtctgggaggcaggcgacttaggagagtctagtcactgagagacagaggcagcatctgccattctaactacggagctgagtaatttagaaaccctccttaactctccctttccagctctccccaaagtccacagaagctctgctgaactctagaaatcttccctggctggggggaagtttactagtatcctctttggctaagacagggagtggaaaaaacaggcggggctgtactgtccgctgtttggggagacgcggtcttcctcgcgcccccttcagccactccgactgcctgggaagtcccagcccgcgctctccggaacccggctcgccgtctcgccctggacatggaactacgcatctgagacctgctggacgttttgctggccgttttgcaagactcaggtaatgtccactcgcagagctggagagttgactggcaagggccaggggagaacgcgctgcgctctcagttggcagcggggcaggccgcagccaatggaggctttatctttcctgcagctctggtctccgcgcctggaaatttgccagttggctttctcttcctttagccttcccagaaagtttagggaatagagctccgaaggccaggggctcttcgcctgggaggagcgtgcgccgtccttcaggtgcccgcgagcccaagcgttgcgtttccgcggcgggatcttcatgctctctgcggctggcgcgcgggctctgcagcctggaaggcaatttccaactgggcgcttctgactgcccacatttctgccgcagctgggagagcaactggagctgggaagaggctcaaggcggctcctgggtggagcagcgaggggttccccagcaatacgctgccgctcctgggattcccaccaagcactaggcaggggagatcgctggatatctggggccatctctgtgctcctgcactgagagcctgaaggtacttcccctgtggttcccgagacgccccctttcctcttcccgcaagaatccccgatacccctagagtgggtttcccaggtccccactgctgctcaggcgtgaggatctgcccgcgccaaattgcgcttcagactccttgtgaaggaaaactagagtgggagagtagggatagccactcgcgagtggctcgccttgcctctctgggcctggcattggagcaaacagcttgatctgtcaccatcagacgtttaagaaaaatgctttggcaaggagaccctggcaagggaaatgtgtattataacaaatgtctgcttcaggggtttctcctggtccctgcagccatcccctctccatctgtgccgcccaaggacttagagacattagtaaacaagtattcaagattttccccttgccacccacaaaagttgtgactgcacagaagtattggaaaagtacttctcagttgaaagctactctagagcctatcacaggtgttttttttagggggagtctatttaggagtatcttgtccccgaatgaggaagcgggacctgcccaccaccactaccttcaatcgaatgtgtagacctccaagaaggaatcctcctttcttttcctggccaggggaatcaagctgtagattattaaacatgcggcatagctgggaacagaccccaaggaagtaagggagggagggaggaaaggacacttctctgagcctgcaagttcagcacgggcgtcctacagttcaggaagactacctcagtgacagagtccctgggaatgaaggagttaagtttttgggacaagtgtctgggactggggtccattttcccactgacatcctcatctcccaccccaccgcagcagccgacccaaggttttggcttcatctctgagccgacccgtacggtgtgaactctctaatttgcgggccgccctgggctagatagcccacaattacccgccgtggaagcagattatttggggcactagtatccatgcattgttgtaccactgggctctttgccagcagggtctcggatacttaggcttccaccccttcttgccgcacagaacgcgttcttctccatgcttccggcttccccaaagatagcaattgggcaactaccctgggacttagggagggtgaaattcccaagtattcctgagccgaggcttcagcagaagtgcctatcttcgccacttgcatcccttctactcctctcctccgtggagcaacccctgctctatggccagtacagtcgcaccgtgaggctgctggacccgatgcggagactccagtttgaaaccacctgcttacagttagctctccaatttgagggctgccctggggtagacagcctgcaattactgaggtggaagcagctgatttaaatagcgtttaaatgtggataaagggctgtggcatcaaaggctcctggcttgcccactctaacctcagctggtctgaaggagaggcaagttgcgaccaaagctgcctccgtgaacagacagctgcagccgcttctgcttctgccctataggtcaaggccagacctttggagcagtagggttgaggatttaaatccggctttgtggaatagcctctgcttccctctctgatatctggccagtcttaggttgagcaattggccatttttagtttctgcggggcttctaccactttgacctctctgtgcagaggctaaaggtactggtcaggggtggtggatagcagggtgcccctggactgtggcatttacaggtaaaatcaagtctgaatcttgatttacccattcatttcctgagaaatagttcctcaatgttgtagaacattcttgtttgccaataactggcaatagagtccatacacacatatgctgcttattagggtgaactgatggtgagataacctggagaacagccccttataaccatctggaacatgtctccacagctgcaaagcccattgaaattttatttagctttaaaaagacatgctgtaaagaatctgaccatataaaaaagatgaattatgaagtgactatttcagttttgtttaaaagaataaacttcactttatcaaatacactggcttccatagtttattgaagtgtctcagtgcaaacatttgctatttgggaagaaggggaaagattgggaaggtgaaatgagttaaaatatggttgaaatgatcgtatactttggtaaaacagaactttgtgttcacatctgtgccttaaataaaatcatcacgatgtgatgtgaggccctgagtagattctgtgacaggttgtagcactatgatgaaaccaaaggggaacatatatttatcctttgtatttggaaatttcctgtaactgcagcagtaatgattacagctgggactgttggaagacaaatgtacacactgccttcttcgtttgagaagtaccataacctcctttgtgaaaatgcactgtaatcaagtggaagagataaaaagtcccaagtttgaggtcttcactaataatatataaaagaaaaatcattgccaaacctcgagatgtagactaacagggttttttcaaggctggtttctagctgtagtcagaaactcacaccttttaatctctgagaactgtcccttgatcctaggtcagaaagctgtgattggagccaacttggtagagaaaggtaaatgtggaatgtgcaatatgtgctttaattatcctgagctaggacttgaaaataagcctctcattatctttagacttggagctgcaagtgccaaggaatttgccaaaataaaatgtgtctgtccaggctgggcatggtggctcacatctgtaacaatcccagcactttgggaggctgaggcgggaggatcacttgagcccaggagtttgagattagtctgggcaacatagtgacaccccacctctattttaaaaatgtgtctaatgtaaggcctgatgcaaggatgtaacacatggatacatctggccaaagctaccgctatttgggctggttcactttgagttatctcctaatgacatcagaggcactagagtgagtccactgtggggcagtttcttttgggcttccccagccacagacatggttccaaatcttttgtcaaatgatctaaatacatattccctgtgccaagaagcctagatttagtagccttcttgctttatttttcccattaatctcacagcttcgtgtagctataccttggcttctctcttgagtttcaaaatgctttttagctggtttgctttattcctgtatttgggtgttctgttgtcatgaaaatgtattaagacactgacttgacattttccccaagcaaacttttgttttttttttttatcccttccttttaatgaggtccttattctctaaccctagcacctctgatctcattcatctgtgactgctcctgtgtgcctcatccatcactacctcgtgcatcctgtcttttattaaatgccctgaattctgtctctagaataggttttctcctttgcatttgtactgccaccacttgcagttaggtcttctagattcttgatctggcctgctacaaaagccttttcttgctgtctttgatctgctctctaattcagtatatcctacatgttaggattaatcttcctgtagctcatgtagttctttatttaaaagtgttacttagtgagtggttgttaagtcatacagattgttattgaatctaaaataatctctaaccatttgagttgcctgatgcattaaataagttgcattgtaaccttaggaagtgatatggtttggctgcgtccccacccaaatcttaccttgaattgtaatagtccccacgtatcaaggatggggccaggtggagataattgaatcatggggatggtttccccactactgttcttgtggtagtgaataaatctcacaagatctgatggttttataaatgggaattctcctgaacaagctctcttgcctgccgccatgtaagacatgcttttgcttctcctttgccttctaccatgattgtgaggcctccccagccatgcggaactgtgagtccactaaacctctttcttttataaattacccagtcttgggtatgtctttattagcagtatgagaacaaactaatacaggaagttctctaacattgcaggtgagtacacagcacggccaaccatttggtgggaactcaaacatcagatttgggacatttgttgcctaacccagagagtccatatcatcctttcaatatccagggacccaaatagtgtgttgtttcctatcagttggcctgctgaaattacaccttttaaaaattattagaactgtgttttatagtcttttgtttgttaacagtctattgctatgcccaaataggtcattttgctctggcttacttgggtgtgcatcactctaggaatcatctagatcattgtattatgttatgaatttttaacatttatgttgtgcttgctttatactttggggaatgcccttcccctttctttaccttgcttaatatttataattatttgtgaggcaggtggtctgtccaaattgggaaactttgttttattggtatcacaaagctattattgctctggggtcctggctcagatagcactagactaaagggattttattctctcctcattagctgtaaaactaagtccaaattctttagccagaagtttaaggctctttaatatttagcctcagtgtacctagtaagccatatttcttactaccttcctgttcacataatctagccagactggatcactcaccattatccagttataacctttgttatatatcttttgtgcccttgcttatgccattcttttccctgaagtatttttcctcccaatttccatctctacttctctgcctgttgaaaacaaaccatattcaagaaacagcttaatgcaactctccctaatttatctctcatacctcatagctaaaataatctgtcccttttctttttctttcttttcttttagacagggcctcactctgccacccaggctggagtgcagtggtgtgatcacagctcactgtagtcttgacctcacaggctcaagcaatcctctcacctcagcctcccgcccccagtagctgggactacaggtgcatgccaccatgcccggctaatttttgtatttttttttgtagagatatggttttgtcatgttgcccacgctggtcttgaactctgggctcaagccatctgcctgccttggcttcccaaagtgccgcggttacaggtgtgaaccgctgtgctcagcaatctctcccttttcataactctcttggcacattgttgatcccccttttatgatatttaccttgttctgcaaacattattgttatttgtgtatcactctatctcctctactaaattttaaacttttggaaggctgtcttttgttctgcagagtgccaagggtataggaagcatctgttacatacttatttaattgagctgcctttgagatctcagtattagccttagcattttactatgtaaatgatagtttcaggttaagtaggaaattgccaaatctattatttgccaataatgtcatgaagcagtataatagggcactgatttttttaaaacagctatgctctagaagtgctctattcaataaatatgcagttgtataaatttaaactgattacaattaaataagactaaaaatttcggttcctcagtcacctagccacatttcaagtacttgatagccacatgtggtcagtgaataccatattggaaagtacagctatagagtattcccatcaccagagtaagttctactggacagcactattatacaacaatggttctcaacacttgtttccaccaaaaacacgttcacaaaggtgactgctttcatgggtttatgcagaattcccagtgccatagtgctgccacttttcttccttctcagaacacaaattagtaacattacaggaatcatcttgactctgtttgggagacaaattagatatttatgtcatatcaaacaccagaataaattccagataaaactctgaagaagaaaaaattataaagaacttgatctatcacgtataacttatattggaaattataatgattaaaatactatggtacttgtgtaggatcagacacattactataacagaacagtgtccaaagaaataatcttaagtatattatggattttaagaaatgacaaagatttcaaattcatgcgtttgagggaaaagatagatttttcagtaaatgtgattaggacaacagctggtcattgaggggaaatttaataaagctacatctatacccactatttaaaccaaagttaattccagctttctcaaagatttaaatgtaaaaaaaactataaagacactcaaagatattttagattatttgaaaatctatataattacaatttaacattttattttatgatatgtttatagtcttgagatggagaaggtttttctaattatgaagactgaaggcttaaaggaaaagattgatacatttaaccttcaaaaaagtctttatggtaaaaaataccataatcaaggttaattaaaaaactaggaaaaatatctgtgacacataacaatgggtagttattcttaacataaaagaacttccacatattaattacaaaataaatctcatagaaaaaatggggaaaattcatgaatagaatactcaccaaaaaaggaataccaaactcactttgcaaataaaaactaatagttttcacatatcagattaagaaggcttcaaaaccaacataaaacatggttttggcaaacctgtgaggatatggatgatccaacgtactgtttaaattggtccatttccaaagattgcattggcaatctgtataaaaatgtaaaataccttctatgacttagcaatttcactaagtatttattctaagaagataaatgcaagtactaaaacatgtatacacaaggatgttcattaatgtttcatttatactggcaaagctttgaaaacaatataagtggctctaatagtgtattgactaggtcaattgggatgtatcattttaatcagttacttggacacattaaagacaaagcagacctacatttattgatatggaaatatatccataaatataatttaatggaaaaggtagcttacaaagaaacacaattcaattttttcacttgtttatgtatttgtgtacatctatgtgtgcatataagcatatgaaatgtatagaaagtttttcaccaaaatgttaattataggtgaaaagactgaattttctttaaaaaatcagcctgtgcttttgtttatttacagtgagaataatacaagcatatattttataatgcatttaaaatgcttatggtactcaatactctgcttaaagcacagtggcagttattatgcttatataatttataagataagctagtcaaagttaaatgtgaacttcagaaggattcaagtgttaaatgtaaaaaaaggaaagtatataataactaaaatataataaaagtaacctgggagcaggactttctaataataataaaagaagaaatcagaaaaatcaatagagcattttacataaacatagaaaatgtatatggataaacatataataataaagataaattggaacaaacaaacaattgtaatatttgatatgtaaaggtttatattagctcaaaaatataactttccatcagctaaccacccacaaataataaggtgttatttggactcttattttttatattataaacatattgtatatatcctataaatatatagagttattgaagtattttacatgctagctctggtaacacttgcagtgattctagaggaatatggattggggaatatggggaaaggaccatgtagtgtaattttctgctctaactagacaaggataaagcctcataagatagtggcagatgctgcatatcttggcatgaacttacctgctccattgttctctatagatttacagctgccagtgccactatcggtacagggaatggtcttgccagtgccactatctatacagggaatggtcttgccagatccaaaaatacagctgactttttcccctatacaccattagttttttaatattcagcatctatgtcaccatatttccatttaaggggatgtttagaactaacagctctcctggttcttgaaccaaactcagaatcaaaaaggtcacatcctcatctgaggaaagaaaaccagatcagggcccagatatcctttagtgaaatatctgctttaaactttctagaaaatggaaaaatcaatttccctaacgtctatttcctaggtcttatttaatgcccctaataatgggtagttgtgacacagaatttagactaagggctatgaccacaaataatgatagctaacattcagtggagactaattatattctgggttctattcttagtacagctttatatgtattaaatcatttcatattaataattattttactgggaggtaggtggtatttttattacaatttttagatgaggaaactgagacacgagttcagtaatttgcctagtcacaaagctattgaaatggctgttctggggtgagaacccagccagtctcgctctaaaatccatgcatttaaacgtgacacaaaagtatgtatactaagagtagtaacagatactatttagctcagttatgtagctttcaaattttctacaattaagatatgttacttctataatcacaaaatatatgatattaaaaattaaagcttcagatggagccatagacatagccctctcaactcttcaattttgtctttatattcttttttacaaaagtatcctaaggcgttgtaccataggatatatcatttaaaaagcctacttaatatttggaggtggtaattgcaatctgttgaccaaagataattgcattttgcaaccagaagggatgatggggtaaaacctctgaaacttttgcttcagagtctaaaatgtacaattatttcccaattgaacctaataactgctttataatatcatttcctttgttatccagcctaaactttgtagtattgtccttttgctaatatcttcatctgattctagactcattatcttgtcactaaatctgcctacaacacctccctctccgtttttggatcaatctaaccaccactttctctgttccaacatctctatggctgaactctagagaagttcatacctgtgccagaaacagtacatggtctaaaacctcatttgggccctgcagaggtgctaggaagaccttttacatgtacatattcagctttctttcccatctgtttcccatggtagttatttcaaacacccactgctcatctcagactacatttttccattcaggcagttgttcttgcctttgactttactttcagacttgactttctaactccattcattctcttgcctcctccccttccgttcccatactcacccaattccctagtgttttgttcaaagtgagtaattccattggatcctgtgtttaagagttccatgtcctcagttatcctctgttttctctgggaagtagcagtagttgggaaggaagtctgaatagccaattggagcattggagcttgggggaaagaggtcattaataaatgcagaagaatatttaggtaagagtgagagttccaatgaggttagggatcatgactttataagtgaaaatagtctacacagctgtgcagttttttcaagctctgctcaggtgtaagaatggaggaagtggacagttgtgttgatccagaactgagttttgccaggatccatcacagggacaaaagaatgagaaggtgaagatattagtacaagttgtggaagtgatggattatgaattgaaactgtatagggaaggaagcatcagggactgataagtaaggtaaaaactggttgtgaggtgggaagaaagtacaagggtggtcggggactgataattaaggtaaaaactggttgtgaggtgggaagaaagcacaagggtggtcggggtctgtatgaggaggacacaagagcagggtgatgatgcagcccagcagtggctagggcttatgtcaggagagtatatgagggatggtagccttgcaggggtcaggactcatacagagtggggtggcagtctggcaaggccggatagttgactacatgctgggagaatgagcaaataaatatattaagagtaataggagtgggcttctcactgtcatagaaggcagttacaaatatggaaaggcgggaggctagaagggactctgtggttttgaattggaattatcagagtcattcatggctatttctgtctccatctatgtatatatttatgtttctatttgtctatgtaaatgattatatatcttacacatatgtatatttcctaactttgtccactgagagggccaggaatagcaacacattagtagtgataaacataacaaacacccacatcttagtttgtcaatagtaatcttcactaaaagtaatcagagttctttgaagaaattgcttatctcaggcctggggcagagaagcaaaaagatgagggtgggcacatcttgtgctgccagaaagtaagaagtgctcaaacaatgataggggcatgtgaaaagacagaaagagagtttgaaggggctcctactagtgctatctccaagaatagagagaatgctaaagctgaatggcatgagcctcaaagaggcagaggtttttacatgaaggcagtgatagaagtggcagtgtgaagacaccttacacatttcctgatcctgagctggatctaccagagagggccgaagggggttcttttaatgttgaatcagtcccaaggcagagatcacgtgcagaatggtggtaagggatctggaagggcacacagaggggatccagcacagtagtaaagagatacaggcaacagggaatacaacaaagataagaggtgaagagaaactctagcatttcagttgtgcaaataggtcaagggaacaacttattgagattttcagcaggaagagagagggctccaggagggatgttccaggaaaattattttcatgagtttttaatgatctgttggaaagtttgggggcacttggttatagagatatagaaaaatgagtcacgtgaaaatgagacaattttcatattataactgcaggaaaaacaaaaagttcaagaaaggaaatgaaatcataatatactatttggctcacaacttaatattcataataatgtaaaattatcacatagctatatttgaataattgagagaggacaactggttattatcttctgtattaggaactcaatagataatatgtaatattgactaagaagcagaaatatgaacatattgtttataaacatggagatacataacagatgaaatagcttaaaaagttgaagttgtctttaagaaaaaggacttggggtaggggcagagaactgctgttttatatgtattatagaattatgtataaagatacatgtcaaaaagttatggtgcagagaaatcaaagacctaaaagcaaaaataccattcaactcagcaattccattactgggtacatgcccaaagaaatataaatcactctatcataatgacatgcatatgtatgttcattgcagcactattcacaatagcaaagacatggaatcaacctaaatgcccatccgtggaagattggataaagaaaatgtagtacatatataccatggaatactatgcagccataaaaaagaatgaaatcatgtcctttgcaccaacacagatggacctggaggccattatcctaagcaaactaatgcaagctaatgcaggaacagaaaataaaatcccacatcttctcacttataagtgggagctaaacaacgagaacacatggacacaaagaggcgagcaacacccgctggggcctacttgagggtggagggtgggagaggatcagaaaaaaatactcatcaggcactagccttagtacctgggtgacaaaataatctgtatacgaaacccctgtaacacatagtttacctatataacaaacatgcacatgtatccctgaagctaaaataaaagttagaaaagaaacttagggcaagaccaaagtgaggaggactattttaaaaacagaacaatctactggggagttttgaaggggggagccaaaggagcaagaggaaaaaatatgcatgtcaaaatctattttaaccacttttctcaaactagagctcactctgtgctgccctcagcactatttatattagaatcttccccacccctatccccacacaaacatccattgatgtgcaggactcctaattaattgcccaaattacctgattctactcttctgccacagtttcagttacattctacagcacttagagccacaaaataccaagaggaaaacaaagcaaaacatgtttatattacctctcactatattcaggattgatgtattgattaaacctctctgtcacttccatagtgaaaggttgtcctgccattggtccattgtattattttcttcccccagtactttctggcttcttacattgcaaatactcactgtcatccttctcccactatgtcaccttctatatagacatctgtgttctgtcacagcttttacatttgaacaactattcattttatagacattacaagtaaaatacattgtcctgcaaggaatattacagttgtacttcaggcacgcctgctttacaatgtcaacaagagggatccattaatttatagttttgtgtttggtaggggaaccatataatattctacatatatttagttctccagaatgtagcttaatcaatatggcacctcaggcaacctgaaatactgaaggcaacataagattgtcagaccaagaaattttatgtctgctgatgggggtttaactcttttggaggctgcagaaggtatatatatttagaagattatagtaaagtcgatgataggaaagaatcaaactgatgtgtataaaaggtactgagggagagagaagtctgtatttaggaccccaaggcagaaacttccaggttctaatccttgcctgccaaccttgagcactgtagaggtttcaataatattttctatctctgagtgtcattagacatttataaagggaatgcctcatgtaggaaaacctgcagtaccaccttgagccaaccactgacctctatgcctgagtttggcacctgccaagtgagatgggcagttgaactatgtgcctttaggtgcctttgaatcctgtggttctatgattttagtaccatgctctgcttatctcaaagagctattctgaggctcaaatgaaatacttgacatgcaaatgccacaaaagtttcaagtgctatacgaatgaatgtaaaagtgttttaaattatgcatctctaaatataaccaacaacttgcacatgctctcccaaacaaagcaaatgggcttctgggcttcgattttcaattagtctcaaaacatatgattttacttgttccaattttcagaagcaaaaggagcaaaagattcaaattatgatctttattaagaaggtactaagccacttagaaatgctgggcacattatgtggctcggccaactttttcactgttgtattgtgtgggtctcccaaatagcttttactgtgaagactaataaaaatgataggaaagttaaaactgagcagaattagattaaatctcaatctgtattctgcaagggtttttatttgtgtgtgcatacttttctatatgcttctaatctcttcatatggtttatagatcagctattagttaataggttctgacatgtgattaatatgtaggtatttgaaaattcatgtggtgcatgcctatgtctatggagcaaggtgctgaatctgcacattcacctcaggaacattggggatggaaagtcaagcccagaattatcttttgcatgaaggatgctagctagggcctttctaggtccccaagggagacactgaagatcttttttcattaaataaacatccactaagaacccgataggcttcatatactatactattcgctgggaacttctgacctcaagtgatttgcctgcctcagcctcccaaagtgctgggattataggtgtgagccaccatgcttggcccagctttttctttcagataaaaattttttctttcagaaaaaaaattgctccttccttaaaagttcatcatgaattctcaaagagagacacaatggtcagctcctatgacactaaaatttagataccagaataaagaatggaaggtaaaaactgcccaaactctttctggggtggtggtcaggaggatcagtccctgagaagacagagaacttaaaggatatacttgaaatttttatttaatgcaaagtataacactttctgcctaaatactgctgcattagaagcattttattgtaaaatctctttccaggcacatacactccgctgctatgtacacaactacaaaaacaggcaaggccaagagcagtcacaccagctactatggtttgttagtggacagaagtgcttgaatttgattaaagcaaatgcaacaaaggtttacatactgtgagtaaaaaaaatgcttcagagcacccaactagcaaacaggatgtgcacacctcaggcctacctgaaatggagagcaaacagtgatgtaaagtgtgtttgcatgaaaaaaagactgctaaaaccggcattaggctgattttcaatttatattaagggttggtatacttttttctaacttggtgaacagtcaacaagtaatcatacagctttttcttttctctctctctctctctctttctttctttttctttccttctttccttccttcctccccttcctcctttctcctctttctttctttttctttctttctttctttttctttctttctttctttctttctttctttctttctttctttctctctttctttctttcttttttttcttttttctttctctttctttctttctttctctctctctcctttatttctttctttctctctctctcccttccttccttccttccttctttctttctttcttttttctttctctctctctttctttctttccctctctctctttctctcctttctttctctttctttctttctttctttctttctttctttctttctttctttctttttcttttcttttcttttctttcctttcttattgagatgatggagtattactctgttgcccaggctggagcacactggtgtgatatcggctcactgcagcttcgacctccaggttcaagtgattctcctgcctcagcctccctagtagctgagattacaagcatgtgccaccatgcctggctaatttttgtatttttagtagagtcggggtttcaccatgttggtcaggctggtctaaaacttctgacctcaagtgatctgcctgcctcagcctcccaaagtgctgggattattggtgtgagccaccatgcttggcccaggtttttctttcagatagacatgcatatacacatatattatcattattgaggtacaatttacataacataaatttatccatttaaagtgtataattcaatattttttagtatattcacagagtcatgcaaccatcaccacagttttagatatttttatcatctcaaaaaggaacccaataccaattagcagttacactccatttacccaacatgatgcctcaagcccagacttacgcaaccattaatcaacttactgcctctatagatttgcctattctaagcaattcgtataaatggaatcatacactatgtggcattttgcatctagctcccttcgctctggcatgatgttttcaaagtgcatccattttgtagcaggtgtattttattcctttttaattgacagataatatttcatagtatctatatatcacaatttgtttaccattcatcaattggtagacatttaggttgtttccacttttttgctatcatgagtagtcttacagcttcttacatcagtttctaattagcatgcacatcactaagcactgatccagatattaaaagatactagtcttcataagctggccatcccccaattccttgccaaatcaccaaaatcagttaaacatatttggaaaactagacaataggtataggcagataataggcacttaatgtttcctgactcaggaattaatggatgagaaaaatcattccttcagttctaattctccttacaataacatccctaccagtgccacctggatattgtgtcaaggtatgctagagctggaatgaacgtggagtcccgggttcctcaaagtgtgggtcaagaaccacatgtgtcagatccaccaggggagcttattaaaaatacctatttctgtacccccaccccagagaatctgattcaataaatctcggggtgaggccataggaagctgcctttgtaataagcaccccagataatacaaatgcatgttagagtttgagaatcattgatttagtccaacctccctactctataggagaagaagtttaggacttgggtggggaagggacatgctcaaggttacagggcatggtaaagataatgcaacagggagttgaggttatgaatcctgatatagcactttccattaccttgggtactcttctttatcacatctccttcttttcctggtgaatacatgcctccctcacagacttgctccataagtgtcagtgtctgacataccctaagtgctcaataaatagtttttttttttttaagcttagtcctgtgtgaactgaatgactaaaggatctccttttggggcagtgtttgctaaaagtataaagtaacaagtataaggcttaagaaaagaataccagacccaggagggagatctcagtggttcctgacccaaatgttgaaaagctcctaagtgaaaaactgttcaaccatgggtttttggtgaacccatgaagctatgtagtgacatttcctatccaaggtccttaaaccactctatacacccactgtgatctatttaaaggagccaggtctttttagaaaacagtttctgccaagttttctatcagaggaaaatcataaagtaggtgagctacagccatgactaaaaggtagtggaaatttttctaactgaaagttgttatgcctgtcaaaaagatagactcagtaaaaacccattactgtgcagcagaggaaaaaatcatgggagctattttaaaattttttcttttatagttttttaaattacaaaagtagtgatttgttgtaccgaatcaaacaaaacaggagtgaataaagaaacattcagttatcttttctttttccttctggtcttcctctttaaaatggattcatttggaatcaatccttccacactttctctatctttatataaaccatacataacatatgcacaaaaagacatatatacacacacacatatatatacacacatatgtatatatacacacatacacacatgtatatgtattatatatacacatatatgtatatatgtgtatatatataatatatgatatataatatatatataatatattatatatattatataatatattatatattatatattatataatatatattatatataatatatattatatattatatatattatatatattatatatattatatataatatatattatatataatatataatatatatataatatatatataaatgaaatcatgcccccttcagttctctgcaccttttaagttcaggggtacatgtgcaggtttgctacgtaggtaaacttgtgccatggaggtttgttgtacagattatttcatcacccaggtgttaaacctagtacccatcagttatttttctcatcttctccctctttccaccctacaccctttgataggccccagtgtgtgttgtttccctctatgtgaccgtgtgttctcatcatttagctcctacttataagtgaaaacgtgttatttgtttttctgttcctgcattagtttactaagaataatggcctccagctccatccatgttgctgcaaaggacacgatttcattctttttttatggctgcatagtattccatggtgtatatgtactacattttctttatccaatcttccattgatgggcatttaggttgattccatgtctttgctattgtgaatagtggtgcaatgaacatgcgtatgaatgtgcctttgtgatagagtggtttatattcctttgagtgtgtacgcagtaatgggattgccgtgttgagtggtatttctgtttttaggtctttgaggaattgccacactgttttccacaatggttgaacacatttacactaccaccaacagtgtataagcatttctttttctccacaacctcaccaacatctgttattttaaaactttttattaatagccattctgactagcgtgagatggtatctcattgtgggttctgatttgcatttctctaatgatcagtgatgttgagcttttttttcatatgcttgttggccacatgtatgtcttcttttgaaaagtgtctgtttgtgtcctttgcccactttttaatggggtttgatttttgctttaaaatttgtttaatccttatagattctggatattagacctttgtcacatgcatagtttgcaaatattttcatttattctgtaggttttcctgttttttctgttgatagtttctttggctttgcagaagctccttagtttaattagatcctatgtttcaataaacaagattttcaggccaatattttgagagatgttgcttaaattcatctaaattcactttgtctatggctccacccagctcttaaataattgctaccaaactaaactgctacttggactgtgaaattttatttcctgcagtagccagctgtcagatcacaagcaactttactgaacacccacaagaattttctttgggttgtaaagtcaagcatcttagttatcatgtaagcattaatttttaatgctttaatttgaccaaaagcattgtgttgtttgtgaaaggcctcccacttcttttgctgtggaaaaaatctggagtctgagtccaagcttttttcctttcttaattagaaaagcaattttctcaccttattttctttctcctgagaaggactgaaagtgtttgactaagaaccttgtgcacctcttctttttttagttgctttttgttttattcattggctcaatccttcttaggttgctgaaaaacagctcctcaattctgaacccagtgaagggaagggcagcatcattctgggatctgtaagccttgcaatttgggaggatcagagtacttttaagatgtaggtgccctaaaataaatttctaggacaggggtactgaaccagcttcacagagcatcaccacttactagctctgcagctctgggtaagttgcttaacttctttgaccttgtcccagttattatacatgtacaatgaagacagtaatgatacctacctcaaagaattgtgtggggaataaatgaggtgaagcgtataaaggatttagggcagtgcttgctttgctattatcacattatttgtcttctgcaaccaccaccacagatggccaggcctgccctcagaagacatcttgacatagtagtcctggaactgtggcacaggcatgtgcattctaagaaatctccttggggattctgatcactatagacagtgattctcaaactttaatgtatattggaatcaccccactcttagaaattgtgctactttagttctggaagtgggggcccaagaatgtgcatcctttgggaaacactgctatagaggaatcgcatgagcacccctccttctctactgtatatatctattgtgataatcttttaagactgctgacatattgttggaatagacataccacacaggtaatgctgccaactcactttcagtgggacaaaaggcataaactacagagtgttttctttttcaatcatagtaataaattagcacagatacacatcctctatctcctgaacaaaggcatgtagttgcaaagtgactgcatggggtatagttgtatagccagtttaccatgtgggaagatcacctttgacaatagaaataataactttgaccattatcgatagccagccagcagccacaagtaactgtaggaagaagggagcaggattgcttagagtttatgttaggtattcattatgtaactggtgcttaatgggcctggtgattttttttgttttagtggaaaaatgttttatctgatttgtttgaaatatttttccattctgtcacacctgaaaagagaaaaatgagggctttgaggaattttgaaccctcatttgttcttagcccatgctgcgtatcacctgcctctctactcattgtagaaatggaacttttcattcagtaattttctagatttctatagcattttgaaaacccactaaccactaagttgtgcgtgacttaatgactgcactcccctccccgcccctccacacactcactcatttaagtttatcatctctacttcttgagccctgttccttttcaagtcaacagtaccacccctgaactttctgagcagcatgtacaaggcaggagtttctggaggtatttatcccccacttgcacattcttatgattcaagtcatatctaggatcatcccctggctgtgttggtgctaagaattgaaaatagggaaagaacattcttgaaagttcatctttttgaaacttagtagaaatctccagtcttaaacttacttctagaacttagaaaaccaaattatcttaatgcccattaagtgttgtttactctcagattttccaagtgttgcaaaaaaaaaaattgtttagaggtttggagaattaactcttgcttttaaaggatgatctgttttgaatagtataccaagcaaagtttaataaagtaagtgagattaatgaaggatagtctcctgaatataagcaaacaagttgcttgtttatacagatctctatatttcttaagtccagtggaaaacttgacttctgaataatcttcactgtggctttcacagatagcagcaaaccttgctttctcagtgcctgaatgtttgctttggggcaatcatgtttcttgaagtatgcatgcaatttgagttttaagaggtgaaaaaaagattatgtccaagacatggtttatataaatagaaaagattggttgtttagtttcttcatttttgtaatggtatgaaatatagctgtccaaccatcttgtttttggaggttgtatcagtcagggttctgactgggatagaattaatttatctatgacggaggttgcaaatttttttgtgtgaaaaatcagactttggcgatgaccttgagcagcaggatataaataactcctacaagtttagcattccaataatggaacactaggcaaaaatggattaataggctctgcatataaaggggagttcattaagcagtattaactcacatgatcacaaggtcccacaataggccatccgcaagtttagaagcaaggaagccagtccaagtcccaaagctgaagaatgtggagtctgatgttcgagggcaggaagcatccagcacaggagaaagatgtaggccgggaggctaagccagtctatccttttcacgtttttctgcctgctttatattctggctgtggtggccgctgattaggtggtgcccacccagattaagggtgagtctgcctttcccagcccactgactcaaatgttaatctttggcaacaccctcacagacacacccaggatcaatactttgcatccttcaatccaatcaagttgacactcagtattaaccatcacagtggtattgagaaaacactttgaggttaattatatatttttgcgacatgtaggcataaccttatctcttaataccatttgattttatgatgtctttttttcactttgtgacatggggaggggatttgtataattgttagtagccgatgttatgtgtaaagactcaaaaggggctaacctgacacattttgtgtcagcactttgttttgagaaagcgaaccacatgtttgccttagtaagaccctctaatttgagaccagttatcagattgaccctttgttcctagagtgaaataaaagactcagtgaaattttaacaagttagcatttgctcacttacactgaagaaggcaggaggctttagttgaaacaaattgttagcattgacaataggaagaaaagaaaattctaattaatataatagttaccctttctaccatccatagtagcctaagttgggttttttgtttgtttgttgtttgtttgagacagagtcttactctgtcgcccaggctggagtgcagtgacatgatctcagctcactgccacctctgcctcccgggttcaagtgattctcctgtcctggcctcccgagtagttgggattacaggcgtgcgccaccatgcccagctaatttttgtatttttagtagagacagggtttagccatgttggtcaggctggtcttgaactcctgacctcaggtgatccatgtgtctcgatctctcaaaatgctgggattacaggtatgagccactgtgcctggcctaagttggctctttatccttgacacacttatcagactagttttgaatattttatcacatgatttttgatgacattcttttgaaaaatcacagtttcttgaatgaatgaacctattgttcttatctagatggaacattctcaaaaagatgatgggcactctaaatcatagtctttcttcccctatctaaatagaatccaaactggtaccaacaacactcaggaaagaaacatctgcatgtgactttcttgtgtgtttttatcaaagtgcagcacctatcaagagagacaagctgtgatctgcatcttaccagtaaccagaggtgctgggctatgggtcaggaggtttgtgttctaggctggcctttgctgctgacctcctgtgtgacttatcacagatcatttttggcctcggttttctgacttgttttcaaaaagaaagattgttttagatgactacttaggtccctcacagtactaaaagcctatagtctgtacttttaatcacaatctatgagatgattcgattgtcttaatttgttcatactctcttcctttaatcccactgagtgtccttaacatacaggtaatggaacacattgacctttatttttgaagttagtcccagatcaggaaatttctcataatgccaatgatttcttagaatacaggactcttctgcatcccattaccagtaaaggtacacatacacaggcaaggaaaataagtatattcttcaggctatgggggcaagtgtctgaaattattctgatctacctagaaactatcttactttttttccttctctgctttatgagttgagagagcctggttgatctgcttcctttcgtttgactttgtaattattgttcaggcaaatataaatagtactagtattggactagtaggtagccaagaaagagaaactggaacagctatatgtgcccacctccccactccccactcccataaccaacagaaagtatagcaacaaaaaaaggaacaagcactacagtggatttccatgccccgctagcatgcatgtgtaatatactatagcctatcagatggtttccacatttgtcctagctgtaagtcacaaggcattttgatacaaataatacttgcgaataagctgtataaaatactcaccaagcaacactgaagctgtccctggaagtgacagtttgcagtcatgaatgatgaaatatcctttgtgtataaggcaattgtgttggttatagaaaaagaaatgagacttcctaggtttcttccttctgtggcttttttttttttttttggaaacaggaaagcttcctatacaatgatgttaggacctatatttcatttcatttcaactttcatttacagttgttgttgtaaagggaaaacattttaatcagtttctgcatgaaggtcagataacactgtgaacaaaagtaatttctttatgataatatcaaaacaaaagcattgctacacttaaattatgaagcatgtttcccttatctgcagtacaattgtatgacttaatagaatctgggagcgtatctcatttatgctactggtaaactcaagaaattctcttccttttaaggtctgaagttgtgatatcgcctaagaatgagaccagataatattatgtcctgggtataaattaagttactttgaaaaggcatgagaattattttaggtatttgtttgtttgtttgtttgtttgtttttgtaaactgaagcagtgttgacattttctatccttttgtggcttagaagatgccatatgattttttttaatgcccgtatatgtgtgtgtgtgtgtgtgtgtgtgtgtgtgtgtgtgtgtgtgtgtgtgttattggaggtaatgaagtggggcagaggtattcataataaagtcacttttatctggttttggagtgcaaaaagattcacatttagtagatacacacaaacacgcatatcctgaacttctgcctgtacacgtcttcttcccaacctccttctacattgtgcttatcagttgcctgcaaaggaaaatttgagactgtctactccaagatcgtggagaaattgattagagttgcaaatgcagactattgcctgaagtaccttcaggaacatggtatagagctaggtgatgtatagtgataatacaacatatgcatccacccacccacatccatactttcacattctccaatatcctttctggtccatcattttaagaagttccataaatttaggctgcagtctaaagcacaagaagagttttaacagtcgcacaggatgtcacaaaaattgtggtacttctaagaatttaatccaggagaattattccatcccattcttaaactgtaaccacaaggcatttccccagaccctcaaattcttatccatatctttatggcaccatatatgtttctagaagtaagaaacatagccggttccattttggaagtcttcttaagcattgtgacttcatattttactagtgagaatgctggggaaaagtaacatttcatctttcatgaacatttctaggattatgtagagaggaaagaatatttgaaatgttttctagccactgaaaagtactgtaacactcagacaaatcccatctcccatgatatctaaaagtgatccagagacttattacagtaattttagatggggtctctgaaccacattgatcagaaagaaagattatctagtaacataggcaaaacaaattagctgtccttaatatctagttgaaatccttaaaaaggagaattactgtctttcagtatctgcagggctgctaacattggaaattataatggtgactatatacatctttataatattatatcaccaggtccctgggctactctatcactgagcttcttaatctcctttgaccaaatagcaatttaaaagggaattggtagcattcaggcatctgctaccctgtagaaatattttaaagcattttcatcttgccttcaaggatccaatgtaatgacttaaaaaaatattttggggagaaaccattgctagaaagagcactaaacttcaacttcagaaaacctggattccatcaataagcagttgagtaaccttgagaaaatcacctagaaatttgaacttcaatttctttatctgtaaaactgagtaactaaaactaggtgagttattgtgataaccttctaattgaactgtctgcttctgggctcagccccatcccctattttgcatccctgttgtcaaaaataacatacaagtctgaccatttcatctcttccaaggactgttacaaatttctccccatccttctttcacttccagttttatttcctaccacacccatttttgttttatgctacagttataccaaaaaaattgaaattttcttagtttaacatgctgctttacctttccatgcatctgcacatgtgttattccacctgcgtggatgacccttcaacagtgtcctacactctggtattcccaataaatttcctttagtctttgaaatcccagctcagattgatgctccctagcgaagccttttctatctaccaaagaccctactgtggactatctttgtgattttttcacatttctattattgtatttatcccaaaatgttgtaacatatttatttcttatctgtcttctctttaatattttttcagccagggcttatgcctgctttcttgcctgccttccccccaacaaatacttatagaaggcttacttttgccagacagtgttgtcagcccagagggatacaacagtgaacaaagcagacaagaatacctgtcattatggagcttctgtgtcttattcaggtctgtatccctagaacctagcacagagactagcatttagtatgtaaacaagcaataattttggtttgaagccaagaaatcagaattatggttacattggaaactcccatatctttctctttcttactgcctacactatgcatttagtgttctacttgtacatacattaatatttagttataatagttaatcagtgtgtcttacttgcctaagtttctatataactttgtttccattggtgctgtctgtcaaacaccattgtctgtcaatcagcttctgggggtgctatgctctcttagttgttcagacccaacacactaaaaggggtgccctttcattcatttattcaatcaataaatatttattgaacatctactattatgtcaaataagacatatgtgctcctgcccttttagaacttacagtctattgagcaagacaagcaatgaacaagtaaataaataaatatgttattacaacatatgattgttgctatggaggtaatgaccatgaagctgtgatagagagtaatggggacagctaccaactttagagtaattgaggaaggcctctcagaagaagtgacatgtaggtcaccccaaaggatgaaaagtatccaaccatgtaaaaggttaagggacagcatcaggggacaaagggacagtaggtgcaaagctcctgaggtggcaaagagcttagtgaattggttttggggaaaagagcagtgtagctggagtttagatagtgagaagatgattaaattagagaagtagcaggtggcttcgtatggcatgttgaggcacttagagtgtatcctaatgggaatgacaaaccgtcgaatgaatgattttaagctggagagtaacaatcaaatttatgttttgaaaatcccattctgaagactgtgtagagaatggactgtgtgtgaggatgcagggacagcagtatggacctgctgcagtggtccaggagagagatggtagtcacctcaatgagtgtgaatccaggagagatgaagagaaatgtcagatttgggagacattaattagacttacaatcgtatttaatgttgaggtgggaaggggaaggagtcaaagattatgcctaggctctggcttgagctagtagctggctggaggtgctatgaactgagatagggtttatggcggggtgcaggagacaagttgggtggatagaaaatgcattttaatgatgacaaacatggtggtggcaatgatggtggtagtggtggtgatgttggatttactatagttggaggaaagatttaaaaatcttgcaattgtcaataactttctttagtgtgttggagaaagtccagtatatgtaatgtatttaaattttgcaagtcttctggatgcttgacctagaaaatatgcctttgtcctgtcctttatcccttcccaaagtgactaggattacattttctctaaatataccattaggaattaaaagatctcttacaattcaggaagctatgagaatatttaagacacaaggaatagagagagtaattcttaaaaggtaacaacttttcatttgttttcatcttgtgcaaatggtttattttctcaaagttaggtaacatttttaggccagtctctatcaaagtaatatccaaggatctcttacataaaaatcacctagggatgctggttcaaagtgaagatccttgtctacacaactaatcagaatctctagggttggggcccaggaaccttttttatttttttttttcaggctgacatttaaaaagcattgcttgagacaaggtattcttaacctttttggtgccccagtctctttggtagtctggtgaactctgtggatcccttctcagaaaactgcttaaacatgcattcaataaaatacaaggaaaacaagtatattgaaatataatgatcaaatattttaaaaacaaattttatataatattttacatacttttaattaacatattaataatgagatctaatactgggtctaatactaccataatttgaagtaataggtgaacataaatagtattttaactcatttgccacaattctaatgtgatatgaaattatctgtaatttctattagtgacaaagttacaggttcagctaaaaccactgtgatttgttgcctagattcataatggaaggaaatgctaaatttcagtcagaagtgaatgaaaataatggtataatgtttttcccatccaagttcacagataccaggcttagaatccttggctttgagattgtgaccaactagtacagagactagtgagggtatagtgaagacaaactggaatccagatgctagtcaacagaacaaaactcagggatgaagtcagtgagcctcaatatttggtattattaatttaaataattaaaagaagattcagggaccaaaaaaattgtccctgcattgtttggcttttaattggttggtttggctgttttgcctgagtgtacctggagaggcttgtctgtatactcttgttattgtccccttctcttgaaccctggctctttcagagggtagctatggagaaaagtttagattttgaccattttggggtgtttaattaagaacgttttccagaatggagagagacattcaaggatgaggaagtaacatgcgcagtaatgacagagtcaggaacaggctagtattagaaaacagaaggaagttcaaagtagctgaggcatacagtgggtgagtgagagagaggcaggagatgaagctggagagatggattagcctaagtccaaagagggccttcagacttcatgtacatgtacgagtttgggtatcatgatagagtcagcaggaagccaaaggagaactatatgctgaaaagagacatgataggccaggcatggtgtctcacgcctgcaatcctgtaatcctagcacttttggaggctgaggcaggtggattgcctgagttcaggagttcaagaccagcctgggcaacacagtgaaaccccatctctaccaaaatacaaaaaattagctggatgtggcagtgtgcacctgtagtcccagctactcaggaagctgaggcaggagaattgcttgaacctgggaggtggaggttgcagtgagccgagatcaggccactgcacgccagcctggggcaacagagtgagactccatctcttaaaaaaaaaaaaaaaaaagagagagacatgataaagtgtattatttcttaggaaaataaatctgatggcaaaatgagggatgggttagaggaaggcagaccacttttgaggctttggtaagaatgcaattgagaaaagtatggttctctgaagtaaggctatggtcatgagacagaagagggaacagctatgagagatgttaatgactgatttggatatatgccatgaagaagaagagtttgggatgactttgaagcttctagcttgagacttcaggtaaatggaagcaccattaacagaggataccaatcatgagaggcacagcaggtttttgggggaaggtttttagttccttcccctaaagaagaagaataagagtttgggatgactttgaagtttctagcttgagacttcaggcaaatggaagcaccatgaacagaggtgccaatcatgagaggcacagcaggttttttggggaaggtttttagttcagttttggataagctgagttttaagtacctattgaacatcaaatgagaaatgcatggagtttccattttaaccatttttcatagtaatcttttaatgtaggtaaatgatgtgagatattctttttgtctataaattgactgactgaaaattgtggggcagttatgtttcagaaatatgtaggattgggtattatattgtctttttattctaattttgatgaaatgtcaaccaatggctgtcctccaaagagttatagttgtatagttaattcttctggattaaagaaattcttcgtatacttatggtaattaattctagcaacatggaatatcagtaggcttgccttcttatgtctggagtttagactttttttgtgtgtgttttgtattacacattttttgttgttcttcacttggctttctatcatgactgctggaaggcagagggttgtaggtaggatgggagcaagaagcagtggaagtgtttgtgcagtcattttttgtaacagctccatggcatgaaaactactctcagcaactggtgtgaacacaaagggaaccggctagtcgcagccatctccatattcattggccttttaggttttggggcctagaatgaggggagaatttcactgtgaatgcaggatgttgaaatgcaaaattggcttttaacaaaattatgagggaagagatatttatctttgtgttccttttacctctgcctcactattctgaatccctgtacctgatgcctctgtgttaggttctggttggatcatgggccacactttagcatcttgcttagacttgttctctctaacagccattgttcctttgacctttctctttttgtgataaaatttcttgttcctatttatatttgataaattattctatatgaatatctgtggttacttacggcttaaaatatgctataccttccaagtagcaactacattttaagaggggtcctgggacaatgctttaacctagagttactctaatggtagggacagtacttatcatagttggggtccacaggtcttccctaatattttaaaaataatattgatagcatacacatgtgaaagacatttaacaaatacagaagaaaatgtcttcatttataaaggctgaggtaatagtgagtaaaagtagatataccaggcagaagtcatttgtagaagcttgactgaagtagatgagttatttttgaggatagtgatagaaatggggtgaagtgggataaggagaaattgcagattttcactgaaatgactttgagggcagggaccatgcctttatatttatgtcctccataggacctggaagaatgatctgtatatagtgtgtagtaatggttagtttaaatgaatgagcaaatccatgtggggaactattgattttaaatttttttaaataattaatttatttttttgagacagggttacccaggctgaagtgcaatggcgtgatcatggctcactctagcctccacttcctgggctcaagtgatcctcccatctcagcctcctgagtatctgagactatacgtgcatgccacatgctcagctaatttttaaatttttttgtagagacaaggtctcactatatttctgaggctgatctcgaactcctgggctcaagtgatcctcccacctcagcctttcaaagtgctgggatcacaagcatgagtcaccatgcctggttgatttttttttaaagaaaccttctgcatgtttatttttcccttaagaatatcctaaacccagatcgaatttagaaaggaaaaggaaacttttgatggatttagcacacacacacacacacacacacacacacacacacacacacacacgtaatcatttaaaaaggttggtggagatatgaaacgacttaggcaaaaatgaaaacccatttattcatcaatgaactccaggttgaagaaagttctatgactcataacaagttgtgctgacgagggagtctttaagttgtccattcatccctttgtgagatgtgagttttttttgtgtgtgttttatttggctttttaaatgttgacaagtctcaggtgtatgttaatagaaattctgtgatcataggtccattagaacagcatctgggaaggaaaactgatgctaagaaatcagcagtaagagggaataaaaatgcaaccaaaaccctttcgttgatatgcagcacaagctggttggaagcaaagggagtgatgcgatgatggaaatcctcattaaaattaaaagccatagaaagcggggaatagtatcaaaagcaatgcaacataaatcattatctacagggataaataaaatacaaaagaattagtgtttccagtttatgctttatgttgaaaataaaaatttgtttcttagaggtatctttgacatgtaacctaacaatggcaaactgccattgagagtccaggccttgttttaatgagtacctcataactgtacagaactagaagctacagagctctccagagtattagtaaatccagttttatgctatgaaaatagaaagtgaaagcacgttcactgtacctattcaaaagtaggaacaatattaatattctatttcattacagaatttcagttaacctaggttttagatatgatatgcaaaccacagagcaattttctatattgctatttttaattttttttcaactttttttttttagattaaggggatacatgtgcagatttgttacatgagtaaattgtgtgatgttgagatttgggtaaagaatgatcctgtcaccaagatactgagcatagtacccaatagtttttcaacacttgccccattccctctgccttctagtagtccccagtgtctattgctgccatcttgatatccatgcgtactcattggttagcttccaattataagtgagaacaagtggcatttggttttctgttcctgcattaatttgtttaggataatggctccagctccacccatattgctgcaaaggacatgatttcattattttttatggctgcatgatatcccgtggtgtatatgtatcacattttctttgtccagtccaccattgatgggcacttaggttgattccatgtttttgctattgtgcatagtgctgcaatgaacatgtgaattcatgtgtctttttggtagaaaaatttgttttcttttgcatatatacccagtaatgggttattagtaaataacccattatttattagtaaatccagttttatgctatgaaaatatttagatatgatatgcaaaccatggagcaattttctttttttttattatactttaagttttagggtacatgtgcacaacgtgcaggtttgttacatatgtatacatgtgccacgttggtgtgctgcacccattaactcgtcatttacattaggtatatctcctaatgctatcctccccctccccctaccccacaacaggcccccgtgtgtgatgttccccttcctgtgtccatgtgtttccattgttcaattcccacctattagtgagaacatgtggtgtttggttttttgtccttgcgatagtttgctatattgctatttttaatttttcttcaacttttgttttagattcagggggtacatgtgcaggtttgttacatgtgtaaattgtgtgatgttgagatttgggtaaagaatgatcctgtcacacagatcaccatttgacctaggtcaaatggcagttctcttttaacttctttgagaaatctccaaactgttttccacagtggctgaactaatttgcattcctaccagtagtatgtaagggttcccttttctctgcagcatcaccagcatctgttgttttttgactttttaaaatcactattctatggctattattaagccacattatgaaaaagttaagaaacaacaggttgcagagaaaacagaatgcttatacactgttggtgagaatgcaaattagttcagccattgtggaaagcagtgtggcaattctgcaaagaacttaaaacagaattaccatctgacccagcaaatacattattgggtagatccctaaaagaatataaatcattctaccataaagatacatgtgtccatatgtttgttacagcactatttataatagcaaagacatgtaatcaacctaaatacccaccaacagtagattggataaagaaaatgtggtagggatttcctggcaagatggccaaataggaacagctccggtctgcagctcccagtgagattgacacagagacgggtgatttctgcatttccaactgaggtaccccattcatctcattgggactggttggacagtggttgcagcccatggagggtgagccgaagcagggtgaggcgttgcctcacctaggaagtgcaagaggttggggaattttctcccctacccaagggaagccgtgagggactgagcctgaggaactctggcccagatactgcactcataccatggtattcacaacccgcaaaccaggagattccctctggtgcccaccccaccagggccctgggtttcaagcacaaaactggttgaccatttgggcagacaccaaagtagctgcaggagttctttttctccataccccaatggcacctggaacaccagtgagacagaatcaattactcccctggaaaagggtgctgaagccagggagccaagtggtctgactcggcgggtcccaccctcacggagcccagcaaactaagatccactggcttgaaattctcactgccagcacagcagcagtctgagatcgacccaggacattcgagcttgttcgggggaggggagtccgccattgctgaggcttgagtaggcagtattacgctcacagtgtaaacaaagccactgggaagtttgaactgggcagagcccactgcagctcagcaatgctgctgtggccagactgccagatttctctactctgggcaggcatctctgaaaaaaaggcagcagccccagtcagggacttatagataaaattcccatctccctgggacagagcacctggggaaaggggcagttgtgggcgaagcttcagcagacttaaatgcccctgcctgacagctctaaagagagcagtggacctcccagcacagtgttcaagctctgataagggtcagactacctcctcaagtggatccctgaaccgcatgtatcatgactggaagacacctcccagatggggcagacagacacctcatacaggagagctctggctgacatctggcaggtgaccctctgggaggaagcttccagaggaaagatcaggcagcaatctttgctgttctgcagcctccactggtgatacccaggaaaacaggattgggagtggacctccagcaaactccagcagaccggcagcagaggggtctgtcagaaggaaaactaacagaaaggaatagcacgtccactcaaagaccccatcttaaggtcaccaacatcaaagaccaaaggtagataaatccacaaagatggggagaaaccagtgcaaaatggctgaaaattccaaaaaccagaacgcctcttctcctccaaaggatcacaactcctcaccagcaagagaacaaaactggacagagaatgagtttgatgaattgacagaagtaggcttcagaagatgggtaataacaaacttctccaagctaaaggagcatgttctaacccaatgcaaggaagttaagaaccttgaaaaaaggttagaggaatggctaactagaataaccagtgtagagaataacacaaatgacctgatggagctgaaaaacacagcaagagaacttcgtgaaacatacacaagcttcaatagctgattcgatcaagcggaagaaaggatatcagtgattgaagatcaacctaatgaaataaagagaaaagacaaggttagagaaaaaagaatgaaaaggaatgagcaaagcatccaaataaatatgggactatgtgaaaagaccaaatctacatatgattggtatacctggaagtgatgaggagaatggaatgaagttggaaaatactcttcaggatactatccaggagaacttccccaacctagcaagacagaccaacattcaaattcaggatatacagagaacaccacaaagatactccttgagaagagcaaccccaagacacataatcatcagattcaccaaggttgaaatgagggaaagaatgttaagggcagccagagagaaaggtctggttacccacaaagggaagcccatcagactaacagcagattgctctgcagaaaccctacaagccagaagagagtgggggccaatattcaacattcttaaagaaaataaatttcaacccagaatttcatatgcagccaaactgagcttcataaatgaaggagaaataaagtccgttacagacaagcaaatgctgagagatttcatcaccaccaggcctgccttacaagagctcctgaaggaagcactaaacatggaaaagaacaaccagtaccagccactgcaaaaacataccaaattgtaaagaccatcaacactatgaagaaactgcatcaactaatggtcaaaacaaccagctagtatcataattacaggatcaaattcacacataaccatatttaccataaatgtaaatgggctaagtgctccagttaaaagacacagactggcatattggataaagagtcaagacccatcagtgtgctgtattcagaagacccatctcatgtgcaaagacacacataggctcaaaataaagggatggaggaatatttactgaggaaatgcatagcaaaaaaaaaaaaaaaaaaaaaagcaggagctgcaatcctagtctctgataaaacagactttaaacctacaaagatcaaaagagacaaagaaggccattacataatggtaaagggatcaatgcagcaaaataactaactatcctatatatacatgcacctaatacaggagcacccagattcatgaagcaagttcttagagaattacaaagagacttagacccacacaataataatgggagtctttaacaccccactgtcaatattagacagatcaaagagacagaaaattaacaaggatatacaggacttgaactcagctctggaccaagcagacctaatagacatctacagaactctccaccccaaatcaacagaatatacattcttctcagcaccacatcacacttattcaaaaactgactgcataattggaagtaaaacactcctaagcaaatgtaaaagaacagaaatcataacaaagtgtctctcagaccacagtgcaatcaaattagaactcaagattaagaaactcactcaaaaccacacaactatatgaaaactgaacaacgtgctcctgaatgactactgggtaaataatgaaatgaagggagaaataaagatgttctgtgagacaaatgagaacaaagacacaatgtaccagaatctctgggacacatttaaagaagtgtgtagagagaaatttatggcactaaatgtccacaagagaaatcaggaaagatctaaaattgacaccctaaaatcacaattaaaagaactagagaagcaagaacaaacaaattcaaaagctagcagaagacaagaaataactaagatcagagtggaactgaaggagatatagacatgaaaaacccttcaaaacatccatgaatccaggagctggttctgtgaaaagatcaacaaaatagatagactgctagccagactaataaagaagaaaagagagaagaatcaaatagatgcaataaagagtgatataggggatatcaccaatgttcccacagaaatgcaaactaccattagagaatactataaacacctctatgcaaataaaatagaaaatctagaagaaatggataaattcctggacacatacacccttccaaatctaaaccaggaagaagtcaaatccctgaatagatgaataacaaattctgaaattgaggcagcaattaatagcctaccaaccaaaaaaagcccaggaccagatggattcacagccaaattctaccagaggtacaaaaggaagctgataccattccttctgaaactattccaatcaatagaaaaagagggagtcctccctaactcatttgatgaggccagcatcatcctgataccaaaacctggcagagacaacaataaaaaaagaaaatttcaggccaatatccctgatgaacatcgatgtgaaaatcctcaataaaatactggcaaaccaaatccagcagcacatcaaaaagcttatccaacatgttcaagtgggcttcattcctgggatgcaagtctggttcaacatatgcaaatcaataaacataatccatcacataaatagaaccaatgacaaaaccacatgattatatcaatagatgcagaaaaggccttcaacaaaattcaacaccccttcatgctaaaaactctcaataaatgaggtatcagtggaacatatcacaaaataataagagctatttatgacaaacccacagccaataccatactgaatgggcaaaaagtggaagcattccctttgaaaaccagcacaagacaaggatgccctctctcaccactcttattcaacatagtactggaagttctggccagggcaatcaggcaagagaaagaaataaaagtattcaaataggaagggaggaattcaaattgtctctgtttacagatgacatgattgtatatttagaaaaccccatcgtctcagcccaaaatctccttaagctgataagcaacttcagcaaagtctcaggatacaaaaatcacaagtattcctatacaccgataacagagagtcacatcatgagtgaactcccattcacaattcctacaaagagaataaaatacctaggaatccaacttacaagggatgtgaaggacctctttaaggagaactacaaaccactgctcaatgaaataaaagaggaaacaaacaaatggaaaaacattccatactcattgctacccccatcaagctaccactgactttcttaatagaattggaaaaaaactactttaaatttcatatggaaccaaaaaagagcccgcatagccaagacaatcctgggcaagaagaataaagttggaggcatcactctacctgacttcaaactatactacaaagctaccataatcaaaacagcatggtgctggtaccaaaacagacctatagaccaatggaacagaacagaggcctcgggaacaacaccacacatctacaaccatctgatctttgacaaacctgacacaaaccagcaatggggaaaatattccctatttaataaatggtgttgggaaaactggctagccagacacagaaaactgaaactggaccccttccttacaccttatgcaaaaatcaactcaagatgggttaaagacttaaatgtaagaaccaggaccataaaaatcctcgaagaaaacctgggcagtaccattcaggacataggcatgcacaaagacttcatgtctaaaacaccaaaagtaatggcaacaaaagccaaaattgacgtgggatctgattaaattaaagagcttctgcacagcaaaataaattgtcattagagtgaataggcaacctagagaatgggagcaaaattttgcaatctatacatctgaaaaacgctaatatccagaatctacaaagaatttaaacaaatttacaagaataaaacaaccccatcaaaaagtcggcaaagaatatgaacatacacttctctaaagaagacatttatgcagccaacaaacatacgaaaaaatgctcatcatcactggtcatcagagaaatgcaaatcaaaaccacagtgagataccatctcacgccagttaggcaatcatcaaaaagtcaggaaaaaaaagatgctggagaggatgtggagaaatagggatgcttttacactgttggtgggagtgtaaattagttcaaccattgtggaagacagtgtggaaattcctcaaggatctagaactagaaataccatttgacccagcaatcccattactgggtatacacccaaacgattataaatcatgctagtatacagacacatgcacacgtatgtttattgtggcacagttcacaatagcaaagacttgtaaccaacccaaatgtccatcaatgatagactggataaagaaaatgtggcacatatacaccatggaatactatgcagccataaaaaaggatgagttcatgtcctttgcagggacattgatgaagcagaaaaccatcattctcagcaaactatcgcaaggacagaaaaccaaacaccacatgttttcactcgtaagtgggagttgaacaatgagaacacatggacacgtggaggggaacatcacacactgggccagtcagggggtggggggctgtgggagggatagcattagcagaaatacctaatgtaagtcatgggttgatggttgcagcaaaccaccatggcatgtctatacctatgtaacaaaactgcacgttgtgtctgcttggtccagagctgagttcaagtcctggaatcccttgttaactttctgtctcgttgatctgtctaatgttgacaatggggtgttaaagtttcccattattattgtgtgggagtctaagtctctttgtagttctctaagaacttactttatgaatctgggtgctcctgtattgggtgcatatatatttaggatagttagctcttgttgttgaattgatccctttaccattatgtaatgaacttctttgtctcttttgatctttgttgttttaaagtctgtttttttagagactaggattgcaacccctgcttttttttttttttttttttttgctttccatttacttggtagatcttccctccatccctttattttgagcctgtgtgtatctttgcacatgagatgggtctcctgaatacagcacactgatgggtcttgactctttatccaatttgccagtctgtgtctttcaattggggcatttagcccatttacatttaaggttgatattgttatgtgtgtgaatttggtcctgtcattatgatgctagctggttgttttgcctgttagttgatgcagtttcttcattgcatctatggtctttacaatttggcatgtttttgcagtggctggtaccggttgttcctttccatgtttagtgcttccttcaggagctcttgtaaggcaggcctggtggtgatgaaatctctcagcatttgcttgtctgtaacggattttatttctccttcacttatgaagcttagtttggctggatatgaaattctaggttgaaaattctttcctttaagaatgttgaatattggcccccactctcttctggcttgcagggtttctgcagagtgatctgctgttagtctgatgggcttccctttgtgggtaactcgacctttctctctggctgcccttaacatttttttccttcatttcaaccttggtgaatctgatgattatgtgtcttggggttgctcttcttgaggagaacgtttgtggtgttctctgtatatcctgaatttgaatgttggtctgtcttgctaggttgggaaagttctagataatatcttgaagagtgttttctaactggttccattctcctcatcacttccaggtacaccaatcaaatgtagatttggtctcttcacatagtcccatattttttggatgctttgctcattgcttttcattcttttttctccaaccttgtcttctctctttatttcattaagttgatcttcaattactgatatccttttttccgcttgatcgaatcagcttttgaagcttgtacatgcttcacgaagttctcatgctgtgtttttcagccccatcaggtcatttgtgttattctctacactggttattctagttagccattcctctaaccttttttcaaggttttagcttccttgccatgggttagaacatgctcctttagcttggagaagtttgttattacccaccttctgaagcctacttctgtcaactcatcaaactcattctccgtccagttttgttcccttgctggagaggagttgtgatcctttggaggagaagaggcattctgttttttggaattttcagccattttgtgctggtttctccccatctttgtggatttatctacctttggtgtttgatgttggtgacctacggatggagttttgttgtggatgtcctttgtgttgatgttgattttattcatttttgtttgttagttttctttcttttttcttttttttaggtattgatgggacgtatctcaaaataataagagctatctatgacaaacccacagccaatatcatactgaatgggcaaaaactggaagcattccctttgaaaatgggcacaagaccgggatgccctctctcaccactcctattcaacatagtgttggaagttctggccagggtaatcaggcaggagaaggaaataaagggtattcaattaggagaagaggaagtcaaattgtccctgtttgcagatgacatgattgtatatctagaaaaccccattgtctcagcccaaaatctccttaagctgataagcaacttcagcaaagtctcaggatacaaaatcaatgtgcaaaaatcacaagcattcttatacactaataataggcagacagccaaatcatgagtgaactcctattcacaattgcttcaaagagaataaaatacttaggaatccaacttacaaaggatgtgaaggacctcttgaaggagaactacaaaccactgctcaatgaaataaaagaggacacaaacaaatggaagaacattccatgctcatgggcaggaagaatcaatatcttgaaaatggccatactgcccaaggtaatttatagattcaatgcgatccccatcaagctaccaatgactttcttcacagaattggagaaaactactttaaatttcatatggaaccaaaaaagagcccgcatcgccaagtcaatcctaagccaaaagaacaaagatggaggcatcacgctacctaacttcaaactatactacaagactacagttttctttctaacaggcccctcagcagcaggtctgttggagtttgctggaggtccactccagaccctgtttgcctcagtatcaccaatggaggctgtagaacagcaaatattgctgcctgatccttcctctggaagctttgtcctagaggggcaccttccagatgccagccagagctctcctgtatggggtgtctgtcagtccctactgggaggtatctctaagtcagggtatacggggttcaggcacccacttgaggaggcagtctgtccattatcagagcttgaacactatgctgggagaaacattgctctcttcagagctgtcaggctgggatgtttaagtcttcagaagctgtgcccacagagcaccttcccccaggtgctctgtcccagggagatgagggttttgtctacaagtccctgattggggctgctgccttttgttcagatatgcccttcccacagaggtggactctagaggcagttggccttgctgagctgtggtgggctcttccctgcttgaacttcctggcagctttctttacactgcaagcataaaaccgcctactcaagcctcagcagtggtggacgcccctcccgtctccaagctccagcatcccaggttgatttcagactgctgcactagcagcaagaatttcaagccgggcacggtggctcacacctgtaatctcagcactttgggaggctgaggcggacagatcacaaggtcaggagatccagaccatcctggctaacacggtgaaaccccgtctctactaaaaatacaaaaaattagccaggcatgatggcaggcgcctgtagtcccagctaatcgggaggctgaggcaggagaatggcgtgaacccaggaggtggagcttgcagtgagccaagatcgcgccactgcactccagcctgggcgacagagcgagactccatctcaaaaaaaaaaaaaaaaaaaaaaaaagaatttcaagccaatggatcttagcttgctggggttcatgggcatgggacccattgagccaggcaccagagggaatctcctgggatgcagaccattttaaaatgtttcttggccacttgtatgtcttatgagaaggatcttttcatgtctttgcccagtttttaatgaggttgtttgttttttgattgttcatttgtttaagttgcttatagattctggatattgaaccttcattgggtgtatagtttacaaatattttctcccaataggtaggtcgtctgtttattctgttgataggttcttgctgtgcagaagctgtttagtttaattcagtcccacttgtcaatttttgtttttgtcgaaattgcttttgaggacttagtcataaattctttcccaaagccaatgtccagagtggtgttgcctaggttttctttcaggattcctataatctcaggtcttatatttcaatctttaatctaaagttaatttttgtatatgatgaaagataggggtccagtttcattcttctgcatatggatagccacttatcccagcacaatttattgaatagggagtcctttccccattgtttatttttgttcactttgtcaaagatcagatttggtgcgcagccttatttctacgttctgtattctgttccattggtttatgggtctgtttttgtaccagtaccatgctgttttggttgctatagccttatagtacagtttgaagccaggtcatgtgatgcctccagctttctttttgtttaggattgctttgggtagtcaatctcttttttgtttccatttgaatttttgaatagtttttttttctagttctgtgaaaaatgacattggtagtttgataggaatagcattgaatctgtagattgctttaggcagtatggctattttaatgatattgattcttccaatcaatgagcatggaatggttttccatttgtttgtatctataatttatttcatcggtgttttatagctgtcctagagatctttctcctccatggttagctgtattcactggtattttaattttttttgtggctactgtaaatgagattaccttcttgatttgtctctcagcttgaatgatatttgtgtatagaaatgctacttatttttgtatattaatttagtcttctgaaattttactgaagtcatctatcagttccacgaatattttgacagagtctttagggttttctaggtatagaattatatcatccatgaagggaaatagtttgacaccttcttttccaagctggatgtcttttatatctttctcttgtctgattgatatggctaggactataatgaatgggagaggtaagagtgggcatctgtgtcttattccagttgtcaaggggaatgcttccagtttttgtcctttcagtataatgttggctgtgggtttgtcataggtggctcttattattttgaggtatgttcctttggtgcctagttattgagggtttttaacatcatgagtagatgttgaattttattgaaaactttttctgtgtttattgagatgatcatatggtttttgtttttaattctgtttatctggtgaattatgtttattgatttgcatatgttgaaccaaccttccatcccaggaatgaagcctacttgatcatggtgaattaacttattgatgtgctgttggatttggtttgctagtatgttgttgaggatatttgagtcaaagttcatcagggatacttgtctgtagttttttgttgttgttgttgtgcctttgccagattttgggatcagaatgatgctggctttgtagaatgagttatgggggattcctccctcctctatgttttggaaccatttcagtagaatttgtatccaccgtgatttgtatgcctggcagaatttggatgtaaatccatcaggtccagggcatgtttttttttttttttttttttggttggtaggtttttattttgattactaactcaatttcagaactcgctattggtctgttcagagtttcaatttcttcctgattcaatcttgggagagtgtgtgtttccaggaatttatcagttttctctagattttctagtttgtgtgcatagaggtttttcataatagcctctaattatcttttatatttttatgggttggttgtaattttacctttgttgtttctgattttgcttatttggaccttctctcttttttcctttgctaatctagctagcaggctattgatcttgtttatcctttcaaagaaacagacttttggttttgttgattcttcatatggatttttacatctcaatttccttcagttcgtctctggttttacttattttctgctagctttggcggtaatttgttattgtttttctagttcctctgggtatgatgttagatcattaatttgagttctttctaactttttgaggtaggtgtcttctatgtaattatgtggttttatgagatcttcttgatattaatttccatttgtatttcattgtattccaagagtatgattttattttttgaagttattgagacttgctttatggccaagcatgtggtcaatcttggagtatgttctgagtgcatatgagaagaatgtatattctgaggttgatgggtggaatattctgtagatgcctatgaggtccaactgatcaaatgttgagttcaagtccaggatttctttgttagttttctgccttgatgatctgtctagtggtgtcagtggggtgttgaagttccacactattattgtgtggctaagtcttttgtaggtttagaagtacttgttttatgaatttgggtgctctaatgttgggtgtgtacatatttaggatattttagtcttcttgttgaattgaaccctttatcaatactgttgttggtttaaattctgttttatctgacataagaatcatgacccctgctcttttttggtttccatttgtctgatagatctttctctaatcctttatgggtgtcattacatttatatgtgagatgggtctcttaagacagcaatggatttctctcattttttaatccacttaccactctgggccttttagatggggcatttaggccatttgcattcaagattaatattgatataggaggttttgatcatatcatgaagtttttagctggttgttttgtagtttgtattgtgtggttgctttatagggtctgtgggctatgtactcaagtgtgtctttgtcgtagtaggtatcattcttttgtttccatgtttagaaatcccttaaggatctcttttaagactggtctagtggtaaaaaaatttcccttagcacttacttgtctggaaaatattttaattttaattttaagttctgaggtacatgtacaggatgtgtaggtttgttacataggtaaacatgtgccatggtgttttgctgcacctatcaacccatcacctaggtattaagcctagcatgcattagctatttttcctaatactctccctcccccaaccccaccccccaacaggccccagtgtgtgttgttcccctctctgtgtccacgtgttctcattgttcagctcccacttataagtgagaacatgaagtgtttagttttctgttcctgaattagtttgctgacagtaatggcttccagctccatccatgtccctgcagaggacatgatctcattccttttgatggctgcatattattccatggtgtacattaccacattttctttatccagtctatcattgatgtgcatttaggttgattccatgtatttgctattgtgaatagtgctgcaatgaacaattgtgtgcatatatctttgtaatagaatgatttatattcctttgggtatatacccagtaataagactgctgggtcaaatggtatttctggttctagatctttgagaaatcaccacaccatcttccacaatggttgaattaatttacattcccacaaatggcataaaagtgttcttatttctctgcaacctcaccagcatctgttgtttcttgactttttaatgatcaccattctgagtggcatgggatggtatctcattgtggttttgatttgcatttctctaatgatcagtgatgttgagctttttttcatatgtttgttggccacatgaatgtcttcttttgagaaatgtctgttcaggtcctttgcctacttttaatggggttgcttttttaaaaaaatttgtttaagttccttgtagattctggatactagacctttgtcaaatggatagattgcaaaaattttctccgctctgtatgttccctgttcactctgatgatagttgtttttctgttgttgttttgttttgttttgtttttgctgtgcagaatctctttagtttaattatgaaactgcctttgcaacattatgatggagacagtgaaatagatctaacttaatcaactccatgttgcttctaacctccaagctgtccttgttcattcatgggtataggctgaattaactttgggagaagcttacttcatagtttatagtttaatatgaagacaataacagccctttcccaaagcagacctccttcatgcctgggaattagattgcctttgtaggactaacattagccacaagattagaaattatggtttgaaagtcatgcggctggaggctacaagtttctgacccttcctaaactgctcctaagatcagtgcttgaaatattttgcagaccctgcacttgatggatcagctggcactacccaggttgataagttgtctcatctaatcatctaatcttgtggcccccacccaggtactgactcagtacaggaagatagcttcgactccctgtgatttcatttctgaccaatcaatgcttctggctcactggcttccctcaaaccaccaagttgtccttaaaaactctcctccctgaatgctcggagacactgatttgagtaataaaactctggtgtcccgcacagccggctctgcgtgaattaccctttccctattgcagttcccctgtcttgagaaatcagctatgtctagtcggtgggaaaggtgaacccattgggtggatataattagatacaatttgtcaaattttgtttttgttgcaattacttttggtgatttcatcatgaaatctttgcctatgccaatgtcctgaatggtattgcctagattcccttctagggtttttatagtttggggttttacatttaagtctttaatccatcttgagttaacttgaagcttaggttggtgggatatgaaattcttggttggaatttcttttctttaagaatgttgaaaataggcccagaatctctcttggcttttaaggcttctgctgagaagtctgttgttagcctgatggggttccctttgcaagtgacctgtctcttctctagccatctttaagattttttctttagcattgactttggatagtctggtgactgcatgccttggtgatgtttcttttgtatagaatcttccaggtgttctttggatttcttctatctggatgtctatctctagcacgattagggaaattttcttgaattattccctcaaatatgttttccaggctgtttactttttcttccctctcaggaatgccaataatttgtaagttacatcactttagataatcccatattccttgaagactttgttcttgtatttattttatttttgtctgggttagtttgaaagaccatcttcaagctctgaaattttttattctgcttggttcaatctgttgataaagatttcagttatattctgaagttccttaactgagtttttcaatttcagaagctctgattgatttctttttaaaatgtttatctcttccttcatttcctggattgatttagaagtgtcttcgtgttgattttcaaccttgtcttgggtctcagtgagcttccttacaatccattctttgacttctttatctgtcatttctgagtttccactttggttagggaccatttctggagagctagtgtgatcctttgatcatgtcactacattcagattttttatggtgccagaattcttgcactgtttctgtctcatctggagacactggcacttctaattttttaattattttcatgcaggtaggatttcttcttattttttccctgtaatattattgtttttcttttcctttcccttccctgcagggggtacaactgtagagaatgctgggtaggatattttggcttcactttcatagccctatgcacttttggggggcaggttttatattgggctgtgtagtttgacctataaggtagttgatggtacttacaggtaagagctggctgtggccaatgcagtggggtatgtacttgatccttgttcactggcacaggctctctgttgcctcaggcaatgggttgactcatggaatgcacagtggtctgagctccctgctcaggccggggacagggaagcccaatgggtggggccagaccaggcaggtccacttacaggttctctgatggcaggcataagcactgagggtgaatctagtgggtggccaccagacacccagaggtgtgcctacgtatggagctgagaaacctccttagccccaggttctttgcacagggatggtgggtagctcatgctcctattccagaggaatgggtgctccagatacctggagatctacctgagtgtggagcagagggacccctgcaccaatatttctgcaaaggaggggtgggggtgactcaggctgctaaaccaggaatgcaggtgctctaaatgcctggagctctgcctgggtgtgtagcagagagggcccttctgtaccaggttctctgcacaggaagtgtgtggtgactcaggctgctgatccaagcaagctggttctctgaatgcctggagttctgcctggacatggagtgcagggggccttgctataccaggatctatgcccatgaagggtcaggaagctcaggctgttggtccaggcaagtgggtggtccaaatgtctggatttctgcttaggggtataccagagagtgcccttgagtgatacaccatctcaagggggaaagctggagcacccagcaatggcacacacagactggtttccagtcatcaagctggccttggctgcaagtgtcactgtccaggagaaactgcagctgtagcagctctcctcctgcctgaggcttgcaatggaggagagcagaattccagtgcctacttctgaaaccctttccacagttctggctgtggatgtccttatcccagtccagggcaggcactctagaggtctggtctgagacggcaatgcctgtgtggtcatgctgccaggttgccacagaatggctgactttgtatgtgcccagattaaaaatgatatcctgctctcagtcccacatctgggaaaatgcctgcaacttttcctggtgtctttcccttgcagagtctctaagcctctcctcaacttacctccaggtcttgggagaaacaaagtgttctcccttggtcttggttgctcagattcccagtggaaaggtaagtcacagagggaggctctctgcttctctcacatgctggagcttcactcacttaatagctaaatgctgtcacgggggctgtttgccagtgttctccacaggaccagggatatctttcatgattctagtggattcccattttcctccttgaattaaactgcacagagtttatatttatgcactgtcttgctacttccgagtggctgaggcatgctaaaagcccctaatccaccatcttggaaaatgaaactgtattgctactgaagacgtgggatgtccaatatggcattgcaaataagcatatatctatagaccaacatttatgtatataatactgtgttaaatactacagggaaaatattaaaaaataagcaaagatagacattgaagaaatatttacaagcatgctgagtgttatcatggagaagtacaggtgcaatggaaatgttaaagtgagggatcttgtcaactctgcaaatcagaggaaacgctctggaggaattgtctacttaaatgagacttaatagatgagaatgttaaccaggtgaggaagtactagcattctagggagagaggaagcatgtatggggccctggagatgagagagaaaatggcatattctaggaaccttaaaaagcgcagtatggctgaagagtaggaaaccattaggagtttggctggaagtaagattggagagtaagttagaagtcacattgtgagggacaatgggaaactataaaaggttttaagaacagaaaatgaccggtgagaagtgcattaaaagatgtggtgtaattgggcacagtgtacactgctcaggtaacaggtgcaccaaaatctcagacacccccactatagaacttctccatgtaaccaaaaaccacctgttcccccaaaactattgaaatacaatttttttttttttaaagagatggtggctgggcgtggtggctcacgcctgtaatcccagcactttgggaggccgaggcgggcggatcacagggtcaggagatcgagaccatcctggctgacatggtgaaaacccgtctctactaaaaaatacaaaagattagcggggcatggtggcgggtgcctgtagtcccagctactcgggaggctgaggcaggagaatggtgtgagcctgggaggcagagcttgcagtgagccgagttcgcaccactgcattccagcctgggtgacagagcgagagtctgtctcaaaaaaaaaaaaaaaaaaaaaaaaaaaaaaagagatggtatactcttgggtgaggccatcttggaagacagtaataggtagttggttattttttgttagtcagtttagtacccatacttggctcttggactgtgcttattagaccttgatatggagtagtccatttgtgttccatgaaacttttgaaaccagctgattgtcaaatgtcaagcatctcaagagattctgcctgggttggctttatggttccatttatatgtatgttctatataatatataaattctataatttatataataatataatatataaattctataatttatataataatataatataataacatatacattctataattctagtacctactgctgacatgtaatattatatagatataactgctgatctgtaatatatataattcctgacatgtattatatattacaatgtaatatatattagatgtaacatatattacatctcataatgtatacctctcatacattatatatatattacaaggtctaattagagaagtctaactagagaaatcacatcaaggtctaattagagaagtatgtacatctcagcagttatatatatatataatattacatctagaattatattacaatagaatatacatatatatgtgtgcatatatataatattacatctcagcagtaggcattaaaattctgctctcccccattgcaagcctggggtaggaggagagctggcatccaggaccagcttggtgacctgcatccagtctgtgtgccattgctgggtgctgcagcctgctcccctgagaaagtggtgcagcagggtgctctctctgccgtacccccagggtgctctctctgccatacccccaagcagaaatccaggcatttggagcacccacttgcctagaccagcagcctgagctgccccacccattatggacataggtcctggtacaacagggccctctccactccacacccagactgaggccgatctccagtttatatatgtattaggagatgttggtaatgatttggagtggttattagccaatcaggagacaaattgataatttttttctcccaaaatagaagaaagacaggagagaaatgaagagagaggaaaggtagagctatataacccagtagcaagatggactatgaacagtactcagtagctttctcatatgctgtcaatggatggagtgtggttcaggaggtttggattcagttatattattttcatatgacttaccattttaacttccttagggaatcacttaaattagtcatgccttagttcttttcatgtaaagacattctggctcagaaccaaccattgtgcagtttcacttgatgaaatcatgtcatttagagcatcttgaactccagagagaggtatctcatgcgagaagtttttattacaattgttatcttctgcttgtttgcacctcagttccttagaaaagaaacacattttgaagaaattcctttaataaggacttggcaatgtaggcagactgccttgtgatattcacacttttctaactgcaatattgagtgtgtgtctttgatgggtctcttatggcaggtgtactgactttttttcccctcctggtgtcggtgtaatatttttacagaacggcagagggtatatgaatagatcctgatgtaaggtgtgaacaaggaagaaagatgtttgctctggctttggcttatcttctagcaaagttgcctagaatgtggttgtaaatgactgtcatgtagtaaactctgcctaccttccctgtctcttctctaagctaaaataactagcactgttttgttcatttatgcaaacttgtgctttttttttttaatatgtagagagatgatgctaagtcatcagcagcattgtggctctgacttgtttttactagtagatgggttgcatctgagcttttcacttgccttacttcactgaggaccaatatagtgtctctgggggacaatggtcaaggtgaggcttttcgtctgtggctgtgatatagagtgagtctcattggcttacacaggatataactgcaattttgacctcagtgctatgctcaatttagttgagtgaggttgcttatggggtaccaatgaatcccagagggcagaactcactctcaaaaatgtaacttgtctattagtcagtggacaaacatataactgaagagtatgcagatgtttcccattgaaatgagaaaataaattttaataacttttttttgtatcttttaaggaagagcctggaattctccattcagttgccacccatagtgtgtctcattgttttctgttattgtaggtttctaggtcagatgctgatcacgaaattatttgtcataaccttctgtttgaaactgaagcatttttttttaaaaaaagttttgtctcataatgtctagaaactgcctttacattataaagttgcttgtatttatccacagcctggaataatctattgatggtattttacttctaaacagtaagaaagatatgctgtaatctgttgggaagactgtattctttgtacttatctaggttaaaggaaacagtagtagcttgacctctagatatttggcttcatatgccttggctgcttggtagaagtcatcccatattgaatatacattgtttccaaaggacatttctgcttctggagtagctccaaacacacactgctatgcttataaaacagggctgagggaagtagtttgctggaaccagtttgctcttgctagttaagagtcgattgtgtacatttcttttcaacactgtgttgaatgacataacattggtagattgaaacaggtcatgatgggagtattcacaccacaggaataggcaaaggctacccatcaggggtccctctccccttggagagtcagttgttgaatacttaacaacacaccactggttggaggttgttatcccagccattgaggcctaccccagagtagacttgacatattccattttattcctggaattgggactgactcaggcctccccaggttttgggggaactattctaaaggaataagccaattcaaatccacacttttgaaactgggtgagaaagagccaagtcatctgaaggatgaaggtccagaatggggctgaattaccattcagtttatcgcattcagagcaatgttgtctaacagactgattccaggtgctagccatttactgtaaataagaaatatgaactattttgtcactggaacaatttaccaaacaagtaccttcctgtcaattcatggtaaagtaatgagagaaacaagagaagtcctcaacttgagtatactttgtaagtggtttagcttcctggcaggcactgatgtatttcatgtgtatccatctcatccctgcagattctcttagcttaatgattgtcaaaacactgtaaatagtcggtgatattgaagatggcaatttccataaactatttattctttctttttgacaaaaaatgacttcctatttttttaagaatgcctcaaacacctgggttttggtgctttcatttttagaatgaacattcctcctacttggcagttaatattttcgactttcagaacacttttggaatacggcttgactttaaaacttttaccattaaaatatttacaacgcatgtaataggtatagggatactttcattacaaatcattaaaaaaaatctgaacacctgaatgaaaacttggacaaaagatatgagcaaagctatctacagaaaaaaggaaatacaagtagtcaataaatatatgaaaagatgatctatctaattcatattgaaaatgtaaatgcaaatgaaaacaccatatcaatgttggttgagaatatgaagtaaataagccatctcatatactattggtgggagtatacattggtattaggtttattggagaaaataaggcaatattttcaaaaggtaagatgcatttagttttgggcccactgtccttacttccagaatttatcttacaaaaatatttgtgtatgaacattacatatacatatacatacacatggctattcattataaaattgttttaatagcataaaaactgagaagtatccatcattagggatgatctaactaattagttaaattaatatggaaacaccaggcagtggtgtactttgtattcactagaaagtatgaggtagatctacttacactagcatagaaagatgttcactaaatatagatggcacttggtgaaaaaaatattgtccaataatatgtcttgtattacctcactttcatttaaaaattatatatcactcttcactatatatacttctgtagaattgaatatttgaaaataagcaggcattactcttgtgtttaaaatctattggaaaatacttttgtttttatactgttctgtaagcttgttctcctctattaacaacatactttgaacttatccctccctcactcttcccaactgacgtgcaacatcataccccatggataagccatcctccatccatccatgcatccatccacatattcatctatccacatacctgtgcaccaaattatttcttacttacttatttaaacaatttctttttccagttatagaagcaatgcttacccttggccaaaacaaaacaaaaaatgaacaagcaaaaacaataacaaaatggtacagttagagaagggtacataaaaaaatacagcttggactcattctccagaggcaaccactttaagagtttttgttctagtggttacttttttgccattaaataatgtacttattataataatgtaagtatttatatcaacattatattataatattagtaatatgcttatatctccatttgttgtcttctttttcttcttctcttctctgctctcttctcctttccttgtctatctgtgtcaggctcagaagaaagccataatcaggatatctctaaccctggcatagttcatgccttgggatatttgaccaagatgggaagaaccagagaggaaaatggatataatcatagaggggtggaccagtaaagaaatgtggcccctcgtctgtgccagttccttacctgaaaccagagaaggctagattgcagttggtgttttagctgtggataaaactttaacccagagttcctgggactcttaatggtatgacgaaatggagaaaaacatggcttttgagtccaaaagactggattttgaatccccactctaccactttctagctgtataatcttcaggcaacttgtttaactcctttgggctctagcatccttatctgtaaactgacagtattttactcaatattatactgtggaagttagatgatgataataactagcatttgcttattactatgcatcagatatgattctaagtgctagattgggtctctgattacaatgtatatctccttctcatgcttactataattatgattaaataatttattgtttaatgtgtgtctctcccaatgaatgttagtttcatgagggcaaggatcatgtctgtcttcctcacagtactgtatttttagtacctgctaagtatatatattgattctcagtatttattgactaaattaagagatatctgggttgtgactgtctcatgcgtgtgtgtgtgtgcgtgtgtgtgtgtgtgtgtttgtgcgtgtcagacttttatgaccctgaggcataattcggtatttgacttcaaagtgagatgaccagatggtttgttttttattttaccaatgtcctaacagtcctttggtagccccaaataaatatgaaatatagagttgaaaatatttgggattaataattccttataaaaataattctgcattgatggtcaccaagtagtaatacatgcccagaacttggctgttttattaaagtttatttaaggaatagggaaatttggtaggaaatacagatcagtgtgctcaataaaaaatcctgccaacttttctatctgtaaagtgtatctttaggctataactcataaaaaaaaaagtaatgttttaattgcagatgacatatcagtttctaccagtttgttgttatataggtaatgcaattgattaagctcaattggaccagatcattcttttactgaatctttgttccaattgtagtgttttgtagataacttttttttttttttgagacagagtctcactctgtctcccaggctggagtgcagtggtacaatctcagttctgtagcctctgcctcccaggttcaagcagttctcctgcctcagcctcctgagtagctgagactacaggcacgcaccaacacacccggttaatttttgtatttttagtagagacgtggtttcaccattttggccaggatggtctccatctcctgacctcatgatccgcccgcctcggccttctaaagtgctgggattacaggcatgagccaccaggatatctttgctcaactgggttggacagtcgagaactgattttaattttattgagggaagcattggcttgaatttgtctctttaaaacatcaatctcattgttcaattcccacctatgagtaagaacatgcagtgtttggttttttgtccttgcgatagtttgctgagaatgatgatttccacatggacacaggaagggtaatatcacactccggggcctgttgtggggtggggggaggggggagggaaagcattaggagatatacctaatgtaaatgacgagttaatgggtgcagcacaccaacatggcacatgtatacatatgtaacaaacctgcacattgtgcacatgtaccctaaaacttaaagtataataataataaaataaatcaatctatgtttctattttaacaccaaataattatgttaacaaagaccacagacagcagttgcttttgcttatccttaatcacttccctaagtataaagattttggtaattcaactttaaggctatctattcctattgtgaaaaaggaccccctccccacatattcccatgtgtcaatgagggaacataaggctgatgtggtaaagactatgatgacctggtacatttcaagatgttttatggtacttaaaaccaaagggatctgaaaagggagcctggtgatagaggaggtttaaaccaaaaagactctgggttgaacgtgaccagtaattgctcaacctgcctggtatgtctaaaaggaataacacacttggtatataatctagaactgtgattttgatgtgtgaacatatcattgaaaagaaaaaaaaatctatcaactgatctattatgatgttaaattacttatttgaccaattttaaataacgttaagatgaaatttacatatacttcaatgatttaaaggatagaactaaataattttatatttatttacttttcatgatacataatatttttacatatgtatggggtacatgtgatattttgttacatgcatagaatatgtaatgatcaagtcaggatatttagggtatccatccctcaaacattcatcatttctctgtgttgggaacatttcaagttctcctttctggctattttgaaatatataatatattgttgttaattatagtcaccctactctgctatagaatattataactcattttttcatctagctatatatctgttcccattaaccaacctctctctgttccccctcccctaacacccacccttcctagcctctggtatctatcattctactccctacctcagtaagatgaacttttttaacttccacatatgagtgaggacatgcaatgtttgtatttctgtgcctggcttatttaacttaatgacctcacattccatccatgttgctgcaaataacattattttattctttttttatggctgaatagtattccattgagtatatataacactttttctttgggaataaagctgcaataaatatggaggtccaggtatctatttagtgtactgattccttttcctgtggataaacacccagtagtggatggctggattgtatggtagttttatttttagatatttgagaaatctccatactgttttccacagtggctgtagtaatttatgttcccaccaagggtataagagttctgttttctctgcgtcctcaccaggaattctttttgtatgaatctatactacagcaatccaaatggttatgcataaaaatatgtgcacatacaaggatagccaatgcagtatgcgttgtgatggtgaaaatctggtaacagactaaatacattttcatgggtggtggtggtacattcatactatggaatactatacaaccattaaagagatggagatagacgggtatggatagaaatgggtagatctacaagatatatgaaaaacagatatgattccacatataatggaaaaatctatctatgcatgcataagaatgtgtgtatatctgtatggaaatctatagaaaaaggtttggaatttttaacattactataactcttaggaggggagtggttaaagtctatggttgaagggtaaatttcacttttgtcattttaataataaccattctgactggagtaagatgatatctcattgtggttttgatttgcatttccatgatgattaatggtgttgagcagtttttttcatatacctgttggctatttgtatgtcttcttttgagaaatgtctatttagagcttttgcctatttttaatgagattgtttctttctttgtgaggttgaattgtttgagctccttgtgtattctgtatattagtctcttgttagggaatagtttgtaaatattttctcccatttgacgggttgtcctttcactctgtttcttgtttcctttgctgtccagaagctttttagtttataatggtttcatttgtctatttttgtttttgttgcttatacttttgaggtcttagccataaattattttcctaggccaatgtcttgaagtgtttcctctgttttattccagtagttttattgtttgggattttacatttaagtctttaatccattttgagttgatctttatatatggtgagagatagggatccagtttcattcttctgcatatggttatccaattttcccagcaccatatattgaagagtgtcctttccccaatgtgtgttcttagagcctttattgacaataagttgactgtaaatatatgaatttacttctgggttctgtattctatttcattggtctatgtgtctgtttttataccaataacgtgctattttggttactatagtgttgtaatatattttgaaatcaggtagtgtgatgcctcaagccttgttcttttttttgtttgtttgtttttgagatggaatctcgctctgtcacccaggctggagtgcagtggtgtgatctcggctcactgcaacctccacctccctggttcaagcaattcccctgcctcagcctccatagtagctgggattacaggtgcatgccaccacacctggataatttttttttttttttgagacgtagtctcactctgtcaccagggctggagtacagtggcgcgatctcggctcactgcaatctccgcctcctgggttcaagcgattctcctgcctcagccccctgagtagctgagattacaggcgcccaccactatgcccagctaattttttgtatttttagtagagacggactttcaccatgttggtcaagctgctctcgaactcctgacctaatgattaacctgcctcggcctcccaaagtgctgggattataggtgtgggccactgcgcccggcaggctgatttttttgtattttttttttttttcagtagagatggggtttcaccatgttggccagactggtctcgaacttctgacctcaggcaatccacctgccttggcctcccaaagtactgggattacaggcctgagccactgtgcctggccactttgttctttttatttaagattgctgtggctattcaggccattttttggtttcatgcaaattgtaggattgtgttttctatttcagtaaaaatgacattggtattttgataggcactgcatcaaatctgtagattgctttgggtactgtggtcattttaacaatgttaattattcctatgcatgagcatagaatattgtttcatttgtttgtctcattcattagtgttttttttttcaagcttcttttttttattatactttaagttttagggtacatgggcacaacgtgcaggttagttacatatgtatacatgtgccatgttggtgtgctggacccagtaactcgtcatttaacattaggtatatctcctaatgctatcctacccccctcccacaccccacaacaggccccagtgtgtgatgttcccctacctgtgtccatgtgttctcattcttcaattcccacctatgagtgagaatatgcggtgtttggttttttgtccttgtgatagtttgctgagaatgatggtttccagtttcatccatgtccctagaaagaacatgaactcatccttttttatggctgcatagtattccatggtgtatatgtgccacattttcttgatccagtctatcattgttggacatttggctttgttcccagtctttcctattgtgaatagtaccaaaataaacatatgtgtgcatgtgtctttatagaagcatgatttataatcctttgggtatatacccagtaatgggatggctgggtcaaatgatatttctagttctagatacctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttacatttctctgatggccagtgatgatgagcattttttcatgtgtcttttggctgtataaatgtcttcttctgcgaagtgtctgctcatatcctttgcccatttgttgatggggttgtttgtttttttcttgtaaatttgtttgagttcattgtagattctggatattctgaccctttgtcagatgagtagattgcaaaaattttctcccattctgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttaatccatcatgaattaatttttgtataaggtgtaaggaagggatccagtttcagctttctacatatggctagccagttttcccagcaccatttattaaataggggattgtttccccatttcttgtttttgtcaggtttgtcaaagatcagatggttgtagatatgtggcattatttctgagggctctgttctgttccattggtctatatctctgttttggtaccagtaccatgctgttttgcttaccatagccttgtagtatagtttgaagtcaggtagctcgatgcctccagctttgttcttttggcttaggattgacttggcgatgcgggctcttttttggttccatatgaactttaaagtagttttttccaattctgcgaagaaagtcattggtagcttgatggggatggcattgaatctataaattaccttggacagtgtggccattttcacgatattgattcttcctacccatgagcatggaatgttcttccatttatttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgcacattgattttgtatcctgagactttgctgaagttgcctatcagcttaaggagattttgggctgagacgatggggttttctagatatacaatcatgtcatctgcaaacagggaatttgacttcctcttttcctatttgaataccctttatttccttctcctgcctgattgccctggccagaacttccaacactatgttgaataggagtgttgagagagggcatccctgtcttgtgcccgttttcaaagggaatgcttccagtttttgcccattcggtatgatattggctgtgggtttgtcatagatagttcttattattttgagatacgtcccatcaatacctaatttattgagagtttttagcatgaagggttgttgaattttgtcaaaggccttttctgcatctagtgagataatcgtatggtttttgtctttggttctgtttatatgctggattatgtttattgttttgcatatgttgaaccagccttgcatcccagggatgaagtccacttgatcatggtggataagctttttgatatgctgctggattcggtttgccagtattttattgaggatttttgcatcgatgttcatcagggatattggtctaaaattctctttttttgttgtctctctgccaggctttggtatcaggatgatactggcctcataaaatgagttagggaggattccctctttttctattgattggaatagtttcagaaggaatggtaccagctcctccttgtccctctggtagaattcagctgtgaatccatcaggtcctggactttttttggttggtaagctgttaattattgcctcaatttcagagcctgttatttgtctgttcagagattcagcttcttcctggtttagtcttgggagggtatatgtgtcaaggaatttatctatttcttctagattttctagtttatttgcatagaggtgtttatagtattctctgatggtagcttgtatttctgtgggatcggtggtgatatcccctttatcattttttattgcgtctatttgattcttctctcttttcttctttattagtcttgctagcggtctatcaattgtgttgatagtttcaaaaaaccagcccctggattcattgatttttttgaagggtttttttgtgtctctatttccttcagttctgctctggtcttagttatttcttgccttctgctagcttttgaatgtgtttgctcttgcttttctagttcttttaattgtgatgttagggtgtcaattttgggtctttcctgctttctcttttgggcatttagtgctataaatttccctctacacactgctttgaatgtgtcccagagattctggtatgttgtgtctttgttctcgttggtttcaaagaacatctttattactgccttcatttcgttatgtagccagtagtcattcaggagcaggttgttcagtttccatgtagttgagcagttttgagtgagtttcttaatcctgagttctagtttgattgcactgtggtctgagagacagtttgttataatttctgttcttttacatttgctgaggagtggtttacttccaactgtgtggtccattttggaataagtgcggtgtggtgctgaaaagaatgtatattctgttgatttggggtggagagttctgtagatgtctattaggtccacttggtgcagagctgagttcaattcctggatatccttgttaactttctgtctctttgatctgtctaatgttgacagtggggtattaaagtctcccattattattgtgtgggaatctatgtctctttgtaggtctctaaggacttgttttatgaatctgggtgctcctgtgctgggtgcatatatatttaggatagttagctcttcttgttgaattgatccctttaccattatggaatggccttctttgtctcttttgatctttgttggtttaaagtttgttttatcagagcctgggattgcaacccctgcctttttttgttttccatttgcttggtagatattcctccatccctttattttgagcctatgtgtgtctctgcacatgagatggatttcctaaatacagcccactgatgggtcttgactctatccaatttgccagtctgtgtcttttaattggagcattcagcccatttacatttaaggttaatattattatttgtgaatttgatcctgtcattatgatgttagctggttattttgcttgttagttgatgcagttccttcctagccttgatggtctttacaatttggcatgtttttgcagtggctggtactgactgttcctttccatgtttagtgctttcttcaggagctcttttagggcaggcctggtggtgacaaaatctctcagcatttgcttgtctgtaaaggattttatttctccttcacttatgaagcttaatttggctggatatgaaattctgggttgaaaattcttttctttaagaatgttgaatattggcccccactctcttctggcttatagagtttctgctgagagatccactgttagtctgatgggcttccctttgtgggcaacccgacctttctctctggctgcccttaaccttttttccttcatttcaactttggtgaatctgacaattttgtgtcttggagttgctcttctcgaggagtatctttgtggcgttctctgtatttcctgaatctgaacgttggcctgccttgctagattggggaagttctcctggataatatcctgcagagtgttttccaacttggttccattctccctgtcactttcaggtacgccaatcagacgtagatttaatcttttcacatagtcccatgtttcttggaggctttgtttgtttctttttattcttttttctctaaacttctcttgtcacttcatttcattcatttgatcttccatcactgataccctttcttccagttgatcgcatcggctactgaggcttgtgcatttgtcatgtagttctcgttccgtggttttcagctccatcagctcctttaaggacttctctgcattggttattctagttagctgttcatctaagtttttttcaaggtttttaacttctttgccatgggttcgaacttcctcctttagctcggagtagtttgatcgtctgaagccttcttctctcaactcgtcaaagtcattctccgtccagctttgttccattgctggtgaggagctgcattcctttggaggaggagaggcactctgatttttagagtttccagtttttctgctctgttttttccccatctttgtgtttttatctacctttggtctttgatgatggtgatgtacagatggggttttggtgtggatatcctttctgtttgttagttttccttctaacagtcaggaccctcagctgcaagtctgttggaattttctggaggtccactccagaccctgtttgcctgggtatcagcagcggaggctgcagaacagtggatattggtgaacagcaaatgttgctgcctggtcgttcctctggaagttttgtctcagaggagtacccgggcatgtgaggtgtcagtctgcccctactggagggtgcctcccagttaggctactcaggggtcagggacccacttgaggaggcagtctgtccattcttagatctccagctgcgtgctgggagaaccactactctcttcaaagctgccagacagggacatttaagtctgcagaggtttctgctgcattttgttttgcagtgccctgcccccagaggtggagtctacagatgcaggcaggtctccttgagctgcggtggactccacccagttcaagcttcctggccactttgtttgcctactcaagccttggcaatggcgggcacccctcccccagccttgctgccaccttgcagtttgatttcagactggtgttctagcagtgagtgaggcttcgtgggcgtaggaccctccaagccatgcatgggatataatctcctggtgtgccgtttgctaagaccattggaaaagcacagtattagggtggtagtgacccgattttccaggtaccgtctgtcacccctttctttgactaggaaagggaattcactgaccccttgtgcttcccaggtgaggcgatgcctcgccctgctttggctcatgctcagtgtgctgcacccactgtcctgcacccactttctgacactccctagtgagatgaacccggtacctcagttggaaatgcagaaatctcccctcttctgcgtcgctcactctgggagctgtagactggagctcttcctattcggccatcttggctccacccatctcattagtgttttatagttttccttgtagcaatcctccacctcataggttaaatttgttcctaggtagtttgggattttttttttttttgtagctattgtaagtggaactaacatttttgtttctttcttggctggatcatgattggtgtatagaaacattgctgatttttgtacactgattttgtattctgcaactttactgaatttatttatcagatctgatagttttttggtagagtctttagttttttctagatcatggcatcagaaaagagggactatttgacttcctctgttccaatttggatgcatttttatttctttctcttacctgactgttctggctagtacttccagtaccatcttgaataggagtggtgaaagtgggcatccttgttccagttcccagaggaagactttcagtttttccccattcaatataatgttagctgtgaacttttgatatatagcctttattatgttgaggtatgtttcttctgtacctggtttgttgagagttttttttttttatcatgaagggatgttgaattttatcaaatgctttgtctgcatctattgagatgattgtatgtttttttcgttcatgtgctatatcacccttattgatttgtgtatgctgaaccatccttgcaaccctggaataaatctcacttgacgatgatgtattatcttcttgatgtgttattggattccatttactagcatttcgttgaggacttctgcatctatgttcctcagggatattggcctgtagtttttgtgtatgtgtgtgtgtgtgtgtgtgtgtctgtgtgtgtgtgtgtgtgtgtctgtgtgtctgtgtgtgtgattatatggttttggtatcagagtaatgctggccttgtggaatgagttagggagtattccttcctctttaattttgttggaatcatttcaggataattggtggttttctttagaagtttggtagaacttggcagtaaagccatctggtcttggatgtttcttttttgggagactttttattactgattcaatctcattacccattattggtctattctcattttctgtttcttcctgattcaatcttggtaagttgcatgtgtccaggaacttatccattttctccaggttttccagtttgttaacatataggtattcttaatagtctctgatcatcttttgtatttctgtagtatcagttgaaatgtttttttttcatttctgattttattcattgggtgttctatcttttttgttggttagtccagctagtggcttattaattttatcttttcaaaaaagccaacttttcattctattggtcctgtatccttggtattattcttttagtctctatttcatttagttctgctctgatctttatttttttctgctgattttgagtttggtttgtactttcttttctagttacttgaggtgcactattaaattatttatttgaaagctttctactttttcagtgtaggcatttattactataaacttcttagcattacatttgctgtatcccacaagttttaggatgatgtgtttccattttcatttatttcaagacattttttgatttacatcttaatttcttcatctacccaataatcattcaggagcatgtggtttaatatccatgtatttgtatagtttccaaagttcttgtttgtattgatttctggttttattccattgtgttctgagaaagatacttgatataatttcacttttaaaaacaatatgttgagatttgttttgtggcctaacatatggtctattctggagaatgtttcatgtactatggaaaagaatatgtattctgaagttgctggacagaatgttctgtaaatgtatattaggtcaatttggtccaaagtccagtttaaatataatgtttctctggtttttctgtttagctgttaggtctaatgctgagaatgggatgttgaagtcccccactcttcattgcagtctatctttctttttagatttagtaatatttgctttatgaatctgggtaccccaatgttaggtctatacatgttcataatagttatattttcttgctagattgatacctttgtcattatataatgaacttttttgtcttttttttaactacttttgatttcaagtctgtttgatataagtatggctactcctgccagcagtggactgggtgggtgggttcttaggcccctgaatagcaggcatgacataagttatgtcagtagtacatggctttttatttccatttttgtggaatgtctttttccattcctttactttcagtctatgtgcatctttactggtaaggtgagtttcttgtaggaagcatatagttggattatttaaaaagcccatttaactattctatatcatttaactggaaagcttcattcttttatattcaagattattattgatctgtgaggcttttctcctgtcacattgttaattgttttcaggttgttttatatattctttgttcttttatttttctgttattttttggcattgtggtttggtagatttctgtagttgtaccatttgcatcctttcttttcattctttgtgtgattgctttaccagtgagttttatactttcatgtgtcttcatgatggtaaaagtccttttgttcccgggtttaggactcccttaagtatttcttgtgggtttcatctaatggtaatgaatttacccagaatttacttgtctgggagagactttatttctccttcatttatgaaggatacttttgctggacatgttattctttgctggcagtttttttctttcagcactttgaatatgtcatcccattcgctaaatctgctcttagtctaatgggggaattttcttataaatgactagatgcttttattttgttgtttttagaattctccccttttctttgagttttggcagtttcactataatgtgctatggagaagacctttttgaattgtatctgacgggatggctgagcttcctgtatctgaatgtctaaatcccttcctagacttgggaagttttcagctattattttgttacataggttttctatctttcttttttttcaccttttgggaacactgaaaattcaaacatttggttgctttgttgtatcccatatgtcatgtaggctgtgttcattcttttaaattactttttctttatttttatctgactgggctatttcaaaacacctgtattcaacttctgaaattctttctgctgcttgacctagtctattattgaagctttcaaatgtatttttttatttcatgtgttgaattcttcagttccagaatttctgactggttcctttttatgatatgtatctctttggtaaagttctcattcatatcctgaattggtttttggatttctttgtattgtgtatctgagttgtattgtacctcactaagcttctttaatatcattatttaaaattatttttccatgatttcataaatttctttttcattggaatctgttgctggagaataattatgtttctttgtaggtgtcatatttccttgcttttttgtgttccttttgtccttatgttgatgtatgtacatctggtataatagtcacttcttccaattctttttgaatttgctttcataggggagtactttttcctgaagatgtatctatgatgctggttggggaggactctttggctttgatctgagttcatgcagtagtgtagtaatctccatatgatttcttctgctatatagcatcgttaatgcctgtgatttccttagtagcttagggtatgattgttaatggagactgtggtgaagttgtgctggggactgagatgacaaatgggccagtcttcaggccctggtggtggcagtggcaggccaagtatgcctgtccttgggccccatggctgtgtatgctggcatctgtgttgacaatttctggcaggtcagttcttgggccttcaggtggcttgctcagatgccagctgtgtcagcagtgactgggtaggtgggttcttaggcccctgagccacagacaaggcatgggtaatgtcagtagcagtgatgtgatgattctttgtctcccaagaggtgtacattgatgttggtagtggctgtggtgggctgggttggttacgcttcaggcctgcaggtggcacttgcaggtagatgccagctgaggtggtagtggctaggagtttaggcccaatattatgcctttgggaggagtgctcaggtgcccacggtggtagactgggttgggtaatccccaggatcccaggctacgtactctgccttggggttgggaatggcaaaactagtctgggtaagctgctgcttaggccccctaatggtgagagatggtaccacctgtggtgagtagaggtgtagtgatcctcagtccccaggtggagtgctcaggtgagggatgatagcggctgtgccgagtccctgccactggagagggtgggactgtctttagtggctataacctgggctggtgggtgaagaatgtgtattccttttatattctggtcccactggggcttggctcccagacttgccagtagtagcctatgtctagatcatgcccccaccccagatgcaggagtccccactcagctggcaaccaagtcccagtggaaactgatgccttacccacatcccattctttatcccagcagtgctcacttcccaagaccggcagctgcagcccacacctgcatgccttattagtcctggttgtggaatgctcccagcttgctcctcagtcacagcactgacagcctgatagcccaagtttccataatgccccagttccagtgctgttgggctccaggactgtgttcattctgccaaaaactatgcttgaaaatgatgcctttttgtagctgcttaggtctcagaaatggtgtggcacccagcacagactcactccctggaacacttccctcccgtggtctcctggcagctccatatgttagtttcagggtttggcagggggtcaaggggttctcccatagccaagattgcatgattccacagtgtggatatgggtcactggaagtctctcatttaccctttccctcaattggaaagtcgctcccagctgccactcaatcctggccaggcagcctacttctctccctctcctttctccacttttgatgtttcttgtcacttctctgttgaattccagtattctctcttggataatgtattttaagtgtgactgtccatacactattttcgttcttctaagtggaggaagaggacatgaaatacttctaatcagccatcttgaagctcctcccttaattgttaatgatggtgtaatattccaccatatgggtatgccataatttatttaacaatctattattggacatttacattattttcaactttggtagtgtaagtattgttgagatggacataatagtgcataaatctttagttacatttgggattcttttctttttttttttgacggagttttactcttgttgcccaggctggagtccaatggcacgatctcggctcactgcaacctccacctcccaggtccaagcaacttttctgcctcagcctcctgagtagctggagttacaggcacccgccaccacacccagctaattttttgtattttttagtagagacagggtttcactatgttggccaggctggcctcaaactcctgatcttgtggtctgccaacctcggcctcccaaagtgctgggattacaggcatgagccaccacacctggctggattattttcttaagatatactgggtaaaaaggtttgaattttgtttttgcctgaaattttgcattaagatagaatcatgcttcatcatagagacacactgtacctgacataacccttgctgtattttcgggtatcttttagttttgttattaggaatgttagaataacatccgtgtacatgagtctgactgtattttctgagataggtaatttttaaaggttattatataaacttaacagctaatttgttctccagaaaaatgaatgacaatttatattctcattgccagtatatgagagtgttttgctgcaggctttctaacattgagttaggttgttacttttaaaccattgctagtttgatagatgctaccaatgttgatcagcaaaagggggatcaaaaaataggatatcagttgggagaaagaggtaaattttttgaaggctttaagaaacaattagtatgatcccagggtgtagttacatatttgcacggacttttatgcctgtattgaaaagatatgtgaacaccagtgatctggaaataagatatccaggctagtaatcgttacgattatggctattattataaaaagacctactgttcatttattgagttaatccctagaagactaaattaaaatacatatcactgaggattagttttttaactttctcccattggttcattttcaaaaacaattatgtgtggtgaaccagttgctacctggggccttaaagaggttaaaacagaagttttaaaggggaaaatatcatttttttcacaaagaagtgaagtaggagtgcccaattgaaggaggcagcagattcctggtttcctgatttgtgctgaatatgagttgtagggcagcaggataaattttactcaattctgaaaatggagggaggggagagagatacttgcacttttcttttgcctaagtgtaacttcagagtattatggttattgatcagtgaggagaaaatattaaatcattaatattaatgatccctaataggaaagaaactttataaaatgtgaattaattgatttgcctccaattgattccttgctgtagtaaaattacttagctcactaagcctccgtttctctgtattttacacaagggtaatgaggttggtccacttcttaaaatactataaaacctcaattagctggagtgtggaaaagggaaagtgtaaggattaaaggggttagaaaagttttttggcatggtggtaaacagagaagatgccctttcagctattgccacgcaattcttgttgaaaacattttttttaaagtttattttattattgttatactttaagttttagggtacatgtgcacaatatgcaggttagttacatatgtatacatattaaagtcatagaaaaaatgcaaataaagaatattagatgtatttaatgactcaattggaaacaaagcaaaaacaaaaacttggcctccagaaatttgaatcagtgaacttaacattcaatgctaaaaaaatcctagaatgaactacttaactattgagaagatatatgcctcctcaaacctccaactcttccttttctacagataaacttgccagctgtttcacagaaaatgtagaagccacaagatggcaactccccaccataaaacacttacctgcaccatcatctgtaatttctgccttcctcccattttcaattgaagatcagaaaatcctcccgtgtatgtcaaattcttccacttgagctccagaaacctttttttaatctgttttttttaagtgtccttactccatacaataaccttgtgttttctttcttttcgaccattcccccttttctggcttctttccctaatcatttagagcttgttcaagtccctcctattcactaaagaaaaaaaagtctgatggtattcccccaaaccagtaaattcagtctaatcatgaggcaaacatcaattaaaaaattattctctaaccttctgccatatgcttaccctatctctctctttcctatcacagctaatctttgtgaatattgtctccactcagtgttctacttccttaccttcagtttactcttcaatctatacagtctgattctaaccccgctacaccactgatctgtttctgacaatcttcttttggttaacagcctttttacttggctaaatataaaggacacttttgagcctctgactcacttgatcacccagcgtttaacatagttgtcattcttgaaatatgctattcccttggtgttcctcctggttttctttgtacctttcttgttacctttttctcagtctcttttgtaggctactctgaaccttcccaactcaaatgttggtgtttctcagtactttatccttcgctaccttcttattttgcctctatcttttggtagttcatctactcctgtgacatgaagtaccatctctgagcttaagactacaaaatatttataccaattctgtttccttaacttctattagtatcctcaatttttcactaacatctattcttagatgtactataggcaactcaatctgtacatgatcttaacccctgatcacctcaccagtgtcaactgtctctattcctcctatctattaataacactctgtgattctgccatattgaactcattctacttcaatgaacattccatgccctctcagctccaggcctatgtccaggctattacctctttttagaacgatctttcctatcgcactctaggtttcaacttagaagtcactttctccagacacctttgtctttctcataaacatgagtttgatttcttctctctttcctttcaaaacactccatatttctcctcttattacatttaaaatacttcattgttgttgtctgtggttttttcttttctactagactgtgatcacacaaaaagtagatacaatacctatcatgttcccattgtattcctatcataggcatacattaagtttattgaataaataaattaatggatcttaggagcaaatcagactaaacaaagttattattttcctttggtaaaactgttagaatgatatatcactatgaaagcctagtctatcacatgcatgatctctcatgacaagatgtgccaatatggtctagttaaatggattttagtatagttaaatgattcataccaaattggtcaaccagattaatggattaatgctgacatgtagagagatctatggtggtaggccacagatctctgttatatgtcatatcttattcagaattttaaaaattattgacttgattgaaggcagagaaagcaagcttatgaaatattcagatgacacaaaagtaggtgggagagttaataaaatgaataaaagccttatgctttgaaatggtcttcatgatttggaataatagaataaaactaacataatgacatttcatagggattaatataaatctataggtttaggataaacattttaaaatccatttaatattcaagaagaatggattgcatacctactgtgttctagtcaatggtgctggggatgcaaaaaaaaaaaaaaagcatagcctctgcccttgaaatagttaaattttgacgatgatattgaatctagatcatggtacataataggctcattgcactttgtattttctacatagagaatgttgtatgctgttgtaggtatcatattaattttacaatatatgcagaaagtatactatttagtttaaaatttaaacatttcaatggtatcagtcggaataatttagattatgctattgtaataatccccaactcttggtggtttgtaaaaacaaagttttatttttcacttatgtaatgtgttggctagaagctctgctctgtgactcttcattctgtggcccagggtgatggagcaaccaccatcataaatattaccagtcactgtggcagaaggaaagatagctgtggaaggcgtcacattgacaaataaatgctctggcctggaagtgacatgcaactgtgagcaatgacttctggtcacaaataattggccagaaccagatgcatcactccatcaatcacaatggggccaggaagtgcggtcatatcatgtgaccgaaggcaaagaggtgttaagtattttgagaacagagttaatgatcaccattactatattgagtaaaaagtgaaaattacccttcaaccttagactttatccactcccctcctaaggattatagtagtgtcaaaaattccaaactttttttttttaagagatctgaagtgattttacctttatttccttcactttaagccagtgatgaaatttcacagtgatttctgggataggggcagaaggaaggtggtgttaagaatcatcagggctgtggcctagtcagcctgcagaggtgcaggcagggtgggcccccactgggacagctggaggaggcaggtaggtgatgttctcagagctgagagctggtatgtgatgtcctctgcagcttccagcacgctcagctcgatcaggccgtcccctgcggtggccagtgagttggggatcagcttggcttccatggagtcaccctcagcagagatgatggctgctattttctgctgctcagccttttccaccacaaatctggccctctctgcttcctgctgatccacctctttggcttccactgcttctgtgaactccttcccgaaggtgggatgtgtcaaggacacatcgtccaggatgagcccaaaggtggctgctcactccgtaagattgtcactcacctgcctggagagcagctctctctgggtgattagttctccagcatcaaagtgagacaccaccgacttgaggatcttggtagtgatggatggcagcacacgctcatcatagtcctctctgatgctggtgaagatgcaaggaagctggctagcgacaggccaggagaggatgtgcagtgtgatgttgacattctgtaagtctttgctaccagtgatgactggtacattaagtggtcgagaatggcagtcaaagataattggtttctgtacccatgggataggaaagtgagtcccttcccctaccacaatgtcctgtactccacagaatcggtcaaagatgacagctctgtgaccagcatccacattatataaggcagagttcagcatgcttcctacaacagctaaggccaggccaaacttgccaatggacacaaacactttggcagccatgttttcttctgctggaccctctcacacctgcttccactctgacctccacatgaattccccagccacacatccaaacctcttcctacagatttccatacacatacacacacattctcaggcatgcatacatacatagatttttccattatatgtggaatcatatctatttttcatatatcttgtagatctacccatgtctatccatacctctttatctcagtctctttaatggttgtatagtattccatttatgaatgtatcacccctacccatgacaaggtatttagtctgttatcagattttcaccatcacaatgcatactgcattgaccatccttgtatgtgcatatatttttatgcataatcatttggattgctgtagtatagattcatacaaaagcaattcttgagcactttaatttttgccaaatactaacaaattgccttgtaaaatgctgtcctaatttataatgtcataaacagaatatgaatgtgtacattaaattttgagaagactattgacaaacacttttattgatggaagaaaatgttagatgatgagggatttagacaccacatcaaaaattgagtaagactcattgatcaatgagtgtgattgaagactttttgtctaaactgcttgtaacaccttatacctactacttctaggtttcctggctggagaaaccctgaaaaagactagtccctgtaacacataacacttttgattttatcttaatggtcagaactcaagattatatcttaatgatcagaactcaatacctttccatatccagctgctagggaggctgtgaaatgaaattttcatttttgtggactatgtatggagcccaaagctggggactatgatcactacagaaatcaaaaagaaaccctatagttacttatgccagtttttttctttatacttgcttctccttgcattctctcctgagatagtcccttctgctgtctctcaatgtttcatcactcactattcctcttatctattccccttttttgctatgtcaactttttgagtctccacttctaattttttctctctctgcttcttcatgttttttctctttctcctctacgatttttttccctccctttctgtgtcctatccacctgactctatcttttgctatctctgttttcttacttgtgtgcctttggctatgttggtttcagtctctgtgtctctttatttctacctctgattctaatggttagggctaacaacagacttggctgccactttatgcagttattttcaaatgacagaagtgcttgagaataggctagatataggaatgctgtaaaaaggatttcttgattggttgaaagttggactaggtaactattgaggtcctttccaaatttgagtttgagagccatatttccctccatagtagatagaatctagttaacattattgcatctctgttttctgattgaatagctaataggacctcagggccatctctatgtgaataccagacttcattgcaaattactatagaattataaaatgtaagagatagagataaatgtgtgttgactaaagaactgtctttctctgtatatatgtatgtacgtgtctgattttatacatatatatacatatatgaaaaccttgtgaagatatcaaaattttctttgattgcaaaaatgtaacaagaaatgattataattgtgtgctatttgaaactagctgatattttagattgggtctattaactgtgtccaaatgtatccataagttaaatgtgttttggtttctagagtcaagagtttgccatataggtactgttaaaaattagcatgaaccagaaacctgacatatctggtactttaagggaggaagggaataaagtgaaaaaggtaatttgcaaactatacttgaaagtcattgaagcataacatcattacaattatctgtcaaaagatttagttcaattacagttttaaagctctctcttcaatatggcattactcatatcaggatttgatactccaatgagaggaatactaatgccttcattagccattgtcttagcagcttcattctttagaattcattacgtggccttttgggatttttatatactaaccctagggaatcagtaaacacaaatctctcaggggaatatgaacttcagaaataagaaccattgcatatttatagccatggcaggggggaagactctttttaggaaaaaaagtaattttgaaataattgaataacagtataattgccatgatagtaggtattatacatgctcctgtacactttcttcacacagcagtaagttggttgtaaaatcaccaacaggaaaaagttataatgtaataaacctaaatttcagtgtaaggtttccaggagtaactcgagctgcttctgaaacttttactattgaaacagatgtgtgggaaccatatgttgggagcccagtggtcactgttgtaagacattccttgatcaatgatgatatttcaggccgactgatgctgtagatgaacactgctactagattgattacactggcctttctctttgactatttgaattgaggcagtttgacagattttccctttcaatgggaaatctgaatcacctactgaacatgctaaaaaaaaccacttattttactaggtattcccttagcacttaacaaatataggttgctcttcattgtcctgcacttgactaagtactctactatgcatgtatcgccacagtgaggttatagttccttgaagaaaagaagctacattttataatcttagacttggtttatgactcccatagcatctaacttctagggcaaaaatcgttcagtagtggttaagagattggggtttgttgtcacacagacctacattcaaatcctttttccataatttattaatgtcatgaacttgggtaagtcacaaatgtcagtttcctgaaaagtaaaatggagattatagtaactcataagattgttgagaggataaaatgacatataacagtttagcacaatgtctggcccacacaaagtgctcaataaattattatcatcataaagtataatcattgttcagcaaaatttgttgaattaattgactcttctgtggaaatgggattggtaaatatatggacttaaaaactttatatgctcactttttctaattctgactgattttaactgacaggaaaagtagcatatgaaataattctgtagttaaattgtacagttccaatgattatttccctattcacagtcaaacattaactattttatttcacaaagaatagggaggggtgaattaaatagggaagtagaaatatttctgcatcagttattttccacataaaatatctctgaatatcagttataaaatctagttcatgtttttggtgaatatgatcacataatgtccacttggcaaacagagtttttaaagggctttctcaaatcaactttttttgccaccatttataaaatatcagaattataaaaatgatatttgattttagcaagttatggtccctacacactgtcagctttcagacagaaatcgtgaaggtacaatcatagatagaataggtttgcggtaaggagagcttggcagactcctaaaatctaaccagtatggttgagttggtaactaagtgaatatatatagcaggaagagctatagcagagatgagccaatgttcttaacaaagtcactggcgttatataagttctaaattggggggtaagacagaggagctagaatgggcacgttgttcaagaaaattttgaatcataagccttcctttgaaagttcagagcctacataatcatctggagatctggcagataaggtctatggaaaacaaagaatcctgtggagtacttaatggtcttttcagtcttggtttggggtctccaaaaagcagaactctaaggatttgaatgtaggtagtttatttgggaggtgatcccaggaagtactgcaaggaagtggcaaagtcagactggaagggaggtaaagcaaataagcaggttgccactcaatattactggaacataccaaagggtgagggagctagggtatttattcatgaactttcacaattgattgagaatcatttagtgaatattaacaacctggcacttctagtcatctcctatactggccaagctgcttttgcagttaaagaagcccctctggcagagaaacataggaagacttctgcagatgacttttagaatgggtcaaagaagacatgggcagggcaccaacagtgtttatgacagcaggaaatatggtacctctcagatctggataatcccatgttagacaagagatgttctatttcaaacaaatgagtaacttgaaaaaacactaaaagtttccactcatttgcattatttaaacatttgataagatgttatctacatagattttgttcttttattcattaaaaatatttattaattagttatgtgtcaggctctatgctaggtgatgagaataaaacagttagtgaccaagtggctgccctcatgaagtttacattctagtgggcaaggagtaggcaaagacaaccaagctaataaatttaaccgattcattaagtgtttcaactcattggagtataaacttgaaatggtattatttttccactaattgctatttactgtgttctgttgtatttaccctcttccactgagagattaggacaatgataaacatttcaatctgattgtataactttttagctgctttcagatattaggagagtctcatgctgattttaaagctttggcttgcttactccaagcccctatctgatgaaaatgcttctcttcctttttcttcaaacagatgggacatatggctctagcggctaggagtttggggacatgtatggtagcctttcatacatctcttcttatttcttccctttcccctgtgcctgttttgttattgctttgggaggagagttgctggggaaaagggagaggaaaaagacagatgcttgtgactgtgtgtgtcttctccttggttggtcacaattgctcttctagctgtctatgggcactatataaacaggtagttataacagcctgctgatgggaggcttctccaagcatctcctctggacattggaaatcccttgcaagattattacatcttctgttagaccttcagctggtgccatcagatcactttattttcacatgcattcatcttgccccatgttgcaaagcctctggcaagaattatgcagttacctagtccagcttggacctttgggcatatgccaaattcattttccatgtctcttgggacccatatatggctgtgtgttgggagtaggtgagaattagtctcggtcctcttgtcatctggaaatctccaatatcccacctctcccgagggttctttatcctagctccagtggtgcagggaaagttcagcatgtctaatggtaagtatatggttaactgggaaagaaaaagcctgttttccttgtcaaaacgtagccttctcctcctttccaggttcctttgtttattgatggagttggggtgaggtgatatggaactagctgcattggttcattgtgctggtggcttcagacatcaaactggaagttttctgaatttaggatatcaggtagatctttgaggtcaattctgggaaaagaggatcctaccaagcacttgatatcaccctgttactcttatattctgggtaaggctctatacctttaggtacgaactaattatttttaaaaatctttacatagaatactggacctttacatgtcatccagaggctattgcctttccaggttttcttccattcattatttcagtgattgctgtagtttcaccctcatacctcccattgccatttttgtatcttgaatttatcatgagcccaaagtacttcagtggtacttatattccgattattttaaaggaccctagctgaaccaccatataggtaaccaatttactgatttttttaactcaatagggacaaaaacttaaagataatttcccccccacccccaatgtctactggtggcactttacaaactcctttccctgttattggatgtggagatttaataacagcttggttcaattccttacccttttcagttatttttgattttggaagagtttcattctaagtgcttgagactcaatactgttcatttaaaaatgaactcaaagtagtgtaaaaactcttcctatcacataaacaactgtaaatgctgatcagtcttatgaataaaacaaacaaagaggtgagctagagattgacagagttcagattgggtagttgagaaaggcctttttgtgggactcagacatgtaggatgttaagaaactgagtgaacagtggagagtatctcaggaggaagacaaagtgcaaacaccgtggggaaaaaaaaatgccttggcacattccaggaacagaaaaaatgaccatcatggctggagcataggcagcaaggaggagagctttgtgaaataagatcaaagaggcacctgggggctccacctataggcctttgaaagtctaatgatttgaaattaggtacagtggtacctccagctttgttctttttgcttaggattgtcttggcaatgtgggctcttttttagttccatatgaattttaaagtagttttttccaattccgtgaagaaagtcattggtaggttgatgaggatggcattgaatctataaattaccttgggcagtatggccattttcacgatattgattcttcctatccatgaggacaggatgttcttcttccatttgtttgtgccctcttttaattcgttgagcagtggtttgtagttcttgaagagatccctcacatcccttgtaagttggattcctaggtattttattctctttgtagcaattttgaatgggagtccactcatgatttggctctctgtttgtctgttattggtgtataggaatgtttgtgatttttgtacattgattttgtgtcctgagactttgctgaagttgcttatcagcttaaggagattttgggctgagatgatggggttttctaaatgtacaatcatgtcatctgcaaacagggacaatttgacttcctcttttcctaattgaataccctttatttctttctcctgcctgattgccctggccagaatttccaacgctatgtcgaataggagtggtgagagagggcatccctgttgtgccagttttcaaagggaatgcttccagtttttgcccattcagtatgatattggctgtgggtttgtcataaatggctcttattattttgagatatattccatcaatacctagtttattgagagtttttagcatgaaggggtgttcaattttgttgaaggcctcttctgcatctattgagataaacatgtggtttttgtcattggttctgtttatgtgatggattacatttattgatttgcatattttgaaccagccttgcatcccagggatgaagcccacttgatcatggtggataagtttttgatgtgctgttggattcagtttgccagtattttattgaggatttccacattaatgttcatcagggatattggtctaaaattctcttttttttgttgtgtctctgccaggctttggtatcaggatgatgctggcctcataaaatgagttagggaggattccctctttttctattgctaggaacagtttccaaaggaatggtaccagctcctctttgtacctctggtagaatttggctgtgaatccatcaggtcctggactttttttggttggtaggctattaattattgcctcaatttcagagcctgttgttggtctattcagagattcagcttcttcctggtttagtctttggagggtgtatgtgtcgaggaatttatccatttcttctagattttctagttaatttgcgtagaggtgtttatagtattctctgatggtagtttgtatttctgtgggatcggtggtgacattccctttatcatatttttattgcatctatttgattcttctctattttcttctttattaatcttgctagtggtctatcaatttttttgatcttttcaaaaaaccaacccctggattcattgattttattgaagggtttttcctgtctctatctcctttagttcttctctgttcttagttatttcttgtcttttgctagcttttgaatttgtttgttcttgcttctccagttcttttaattgtgatgttagggtgtcaattttagatctttcctgctttctcttgtgggcatttagtgctataaatttccctctacacactgctttaaatgtgtcccagagattctggtacattgtatctttgttctcactggtttcaaagaacatctttatttctgccttcatttcgttatttacccagtaatcattcaggagcatgttgttcagtttccatgtagttctgcagttttgagttagtttcttaatcctgagttctaatttgattgcactgtggtctgagagactttttgttgtgatttctgttcttttatatttgctgaggagtgctttacttccaactatgtggtcggttttggaataagtgcaatgtggtgcagataagaatgtatattctgttgatttggggtgtagagttctttagatttctattaggtccacttggtgcagagctgagttcaaatcctgaatattcttgttaattttttgtctcattgatctgtctaatattgacagtggggtgttaaagtctcccattattattgcatggcagtctacgtctctttgtaggtctctaaggacttgttttatgaatctgggtgctcctgtattgggtgcatatatatttaggatggttagctcttcttgttgaattgatccctttaccattacgtaatggccttctttgtctcttttgatctttgtaggtttaaagtctgttttatcagagactaggattgcaacccctgctttttttttgttttccatttgcttggtagatcttcctccatccctttattttgagcctatgtgcatctttgaatgtgagatgggtctcctgaatacagcacactgattggtcttgactctttatccaatttgccagttggtgtcttttaattggagcatttagtccatttacatttaaggttaatattgttatttgtgaatttgatcctgtcattatgatgttacaaggctatagtaacaaaagcagcatggtactggtacgaaaacagagatatagatcaatggaacagaacagaggcctcagaaataacaccacacatctacaaccatctgatctttgacaaacctgacaaaaacaagaaatggggaaaggattacctatttaataaatagtgctgggaaaactggctagccatatgtagaaagttgaaactggatcccttctttacaacttatacacaaattaatttaagatggattaaagacttaaatgttagacctaaaaccataaaaaccctagaagaaaccctaggcaataccattcagaacacaggcatgggcaaggacttcatgactaaaatgccaaaagcaatggcaacaaagccaaaattgacaaaggggatctaattaaactaaagagcttctgcacagcaaaagaaactaccatcagagtgaacaggcaacctacagaataggagaaaatttttgtaatctacctgtttaacaaagggctaatgtccagaatctacaaagagctcaaacaaatttacaagaaaaaaaaacccatcaaaaagtggacaaaggatatgaacagagacttctcaaaataagacatttatgcagccaacagacatatgaaaaaatgctcatcatcactggtcatcagagaaatgcaaatcaaaaccacaatgagataccatctcacaccagttagaatggcattcattaaaaagttaggaaacaacagatgctggagaggatgtggagaaataggaaagcttttacaccattggtgggagtgtaaactagttcaaccattgtggaagacagtgtggcgattcctcaaggatctagaactagaaatagaatttgacccagcaatcccattactgggtatataaccaaaggattataaatcatgctactataaagacacatgcacacgtatgtttatcatggcactgttcacaatagcagacttggaaccaacccaaatgtctgtcaatgataggctggattaagaatatttggcacatatacaccatggaatactgtgcagccatataaaaggatgagtttatgtcctttgtagggacatggatgaagctggaaaccatcattctgagcaaactatcacaaggacagaaaaccaaataatgcatgttctcactcatagttgggaattgaacaatgagaacacttggacacagggcagggatcatcacaaaccagggcttctggtggggtgggaggcagggggaggaatagaattaggagaaaaaacttctataaatgacaagttaatggatgcagcaaaccaacatggcacatgtatacctatgtgacaaacctgcacgttgtgcacatgtacactagaacttaaagtataataaaaaaatacaaaaaaattgaaaaagaaagtctaatggaaggagttcagatttcactctaaatccagtgggaagccactgaaaagttttaagcagggaacctgacatggtttaactgtgaactttcatgttttcttctatttgcaaaaaataaagccagaagaccccagattgtcattgtttctctaatggagttttgaaaaatgtaaaattataggtgtggttttgttgaggccaagatctgtggttcaaactttatatccttttttttgacttttcagctgtcaagaaaagtgaaggatgaagccaccatttcttttggcccttgtggtctgttctgtagtcagcacaaatctgaagatggtgtcaaagagaaattctggtaagttgctggcaacttgccactatttggtcaaaaatgtacagttttgtgagcacccagagggcacctgtgcctttaactatgaatgtctttaaatagaagcactcgtattccagttatgttggaaagtagccaaaataaaaatgatgtttaatcctaccactgagaaattgttgggaaatcagtggaattttgttaaacttcaatgaccagtatactctcagtggacaatgaaatgttaagggcctacttagagttggttacatttgctagtgaataaatacctgggagcaaacatttacaaatgagaaggtaagaaacctttaaaaatatacatcctttgcctcctaattgagtgtgtagcattgcaatttaaagactttgataaatatctgagttttagttccttatagttgtacccagttgctaacaggcaggggtctacagcctccaagttcagaattattagctaattgcccgaagaggaatttctcgagaagaaaaatctattcctagaacatgttggtctggcaggcagccatgactgtactaagagattagctgtagccagtacatagtccagtcaaagcttaatcattgtttaataatacttggatatatatgtctttcagttttgattatacattctagctgtaattacaaactttgcatgagattttaagaattgattttctgtctgtaatcattccagtaagacattgaggaatgtgttattatatggaaacaaaagattgtgttgagactttctactggcttctaattcatttatttctgagaattaaatgtatttgctttactttctcattaagtatcaaatctagtcaatgaaatgcatgcttacttttcaaagcaaaaaatgcggattggggggaggtgcttggagtttggctaatgtttgtttcctgagataagaatacttactaattgaaatacctaacaaatagttttgtcttcaattgatagcatattaataaatgtttccaaaagtgagagatttatcacagactataaaatagagtaacactgctgaagtccaaaggatcctggagtgataaagatagggcaatatattgtctttttctcttcttatagattcaggtctatatttaaattacttttgtatgttgtgactctctttcagctgaatttgtgtttaatattttacctattatctctccagctcagcatatcattcatggctgcctttccttgctttacctttgaagtcccattttactttcaatcttggttcaaattgatagttgctgaaataaaatatttagagagattgcttaacagcaaacataacctgttgaaccagattgcattttccttactcggtcatgtcataatgtctggagcagatccgaaaggaaaaaaagaaacgagggtttaaaaagtcatctgtattatggtagcttaattgaagtaaaatccaaactgaaaaaaaataagttgctgtcaatgtattctgtcttataccttggtttgcttattatataagagaagagaggctgttaaaatatatatatattttatatatatttatatatataaaatatataaatatatatatacacacaaatatatatgtgtatgtatagacacacacacacacacacacatacacatatagctgggctattacaggtggctcacacctgtaatcccagcatttgggaggccaaggtgggtggattgcttgtgctaaggagtttgagaccagcctgggtaacatggtgaaaccctatttctacaaaaatgtaaaaattagctgacattgtggtgcacacctgtagtcctagctaatcaggaggctgaggtgagagtatggcttcagcctgtgaagcagaggttggtgagccgagatcatgccactgcactccagcctgggtgacagaaccagaccctgtctatatatatatatatatacacacacacacacacacatacacacacacatatagaaggttatcattaatgcacagatgtcattaaaagatcaacttttcaatgctttgcctctttatttttgcttgttaagcgtgaggctatttgtggcttactagggtttcttagctttgttttcttagtgtggacaaatggtatcatatctgcagtcagcttcattgaagaaacattacccaaaaagatatttcacttacagtcaaagtgttagaatggtttcagtctctgcttctccttccctttatgctgcactccccctccatccctgccaggacaatagcaattgtaatattggaacaaaacttcttacaggtctgtgcagttgaaatcatttgaatgcacagctggttcttttattttatgccttactgcttctgtttatggtgtatacggagtaggcagaaaagactaataggttagtgttggtttgtgcttgtctctgtgtgttttttgtttgtatgtttgtttattgtttcataatgcaaaaaagatagggcatgggatgaataaaagacatcttaagttgctgatgaaaacgaggatactttggagcagttcttttcaactctacctttctgtttagccacccccatcataaccccctctccagccctatacctctgttaatattattattttatgtagaaaatataattatttgcactttcattatcatagtgctatttgagttaccttatcttttgaagaacattaaaaatgctttggcaaatctgcagtacaaatttttgcttcatgtagcttgtgaagtcctttgctcattgccaatcaaagagatccaggtttaagctcgcatggatgttcatcatggaatcactaacggaactcgtaacttttatttttttcccctcttcccttccctcaagtcaagaaatgaaaaacgattgcaccctttattcattaacatttatgactgtttagtgtctgatgtgaagatagttataatgatttctatgcagttcattgtagacacaaatccctttcactgagatccctacaactgctgttgctaatggccacccttatgcacaagacagagagaggaccaagggtggaagttttttcttctgtacttgtcaaacatggaaaagaacttagtaacagatgtgagttaggtttttggttttggaggttggtttgtttgttttaatctactctgggcacatattggagcaaacctgcttttgggtggtgtacaatttttagaggtgatagcacaggctatgtttccatgtaatgcccattcacactgggcaagtccaacaatcaaccctggcttgggaaacagcaaagatggctctgagactgcatctagggcctgattgctttagaacatattaaaatgcacagcatttaattttaaggactatagctgattattcaagtgtaagtttttggtcttcttcacataacactccttcagtattcactttttataaatttaggactggatagataaaagtcatttggaaagcctactctatcaaaaacaagtttacttaaaggtgtcattctttatgtcaggaaattggctaatatcttgatgatcaatagcagaaatggccatttctttttcctgtagaggacacaggtacctaaaactaatttttaatagggtgggtgggagaaattactcttcctcaagaagtcactcaagaccttctatttagctattttttaacctgaaaaacgtcctcagaatatacatgaactttattatttgggacattaaatcatccccttaactttcttttggcttttgctgctgctgctcctgcatgaaaatgtgagccatgttatgcagttgttggcattcagttcttccagcatggacctctgtatcagagaaagcatcagtctgatgagtgggtatgttaatattcaacccaaattgggtcatcttacagtcagttcatctggaggatgatctagcacaaaaacttctcagtgttgggaggaaaattgcagagctacctgcatatctcaatcagctagaaaatgtagtccccagtggtaagaagaatgtgaagacttgctggcacacagtgggtatttaaagatatattttggatggacttgaaagaaccactcagttccacgtaatgagagaatggctttatttggggctttggtttataaaattatgatattttctgattgttgatgaggaaataacagcttgttttcactaaaatacatttgttttagaatttccagttagataactgaggacgaccataaaggcaaaagtagaggttatatgagcttacatttctggccaaagctagaaagggactcttataccacttccaagtaaaaagaaaataacttcttttgtgaaatttattgttatataattaaaaataaaaggaaccatgctttgaaccctcaaaggaaacaataaaatgttttatttaaaaatgctggttagaagtaatgttgctctgtggatattcacactgtgcttttagctgtagagtgtaagaacactagaagttagaaaatcaacaatgtgatattgagatctcatctcctaaatgtattctaatgagctaagatcaaggaggaaaatacttccctatgatttgttctttaattgaaagggacaatctgagacatggtacttttatctctttaattagggtgacttctctggaggaaaatggatctttgaaggaagggaaagtggtactagaagaattggttaggtcattggaagtgatataggacaatgtttggagtataagacaaagtttacagcaactagataataggcagggatgagagatatcggtcagaaagaatgtgtggccagaattgagctgagtgaaacacagttattgaataagttgaaggggaaataattttacagttcttatcattgaatttgatatggccaaaggcatacttgttgaactgttactgtatgtgcaatattccactagtcctgaggtggggctgacggggagggaaaataaatcaaaactcccttgtttaaaatacttaatatcattgagatcaatgaatggctaagcaaataatggttttagggttagggagggtggagtgtaggtcctgttctctggaatgttccattctctaaaggtagaacatttctggagttttagctggatgcccagatgttaacaagatattccctagcactgctaatcctttaatatcttcttccattatcaactctgtagtggtcgttccgcaatgataagcctttggcagtcttttccagggcatgttcagtccagttctcaatcagggatccatagaggacctccacatagatctcatgggctcccctctgggaagctctctccttttactgggagttccagccattttaaatgccttgaactctgatctctgtagctccagctcaataatactactgggctctgttaggactctaactcaccaagccatagttggggaattgtccccagtcggagagctgggttgattgtggggctcacaccattagtcctccttttctccgagatcacagcttaacacttcctgaatattattgctttacacatttcttccacttttgttgttgcttactgtgggagagttagtctagtttcagttacttcctgttaccttcgataccccatcattctttgggtgctttctgtcataaagaagttgtgctagggttaccttgatactgattctttttagtggaaaatgaatttagaaaccttctttttcttttaaattgttatttcattgagatacttccaattcaaatccagcatcacagggctcttccttacctttctccattccatatttgtatttcctttttccacagtgagaaccctcattctcatcaacatcaatatatttacttgttttgtcctataagttatacaaaatagttttagaatgtctacaccaaaaccactacaagcaacaaacttactaaagtacaagatattttataattctttttgtctttagaattcatcccactaaagttgtacagtcagagtgatatgttcaaaagttgcttgaattaatttctttttctctgtggtcatgttattaattcaatatataaataagttaatttgtgtttctatgcaatttgcttttttatccttttggattaaattttatttttgaatacataaaatttttacatcattggaaattcaaaattatagaaaaaataataaatccaagaagtctcactcccatgcctatcccttctacctggtctcacacatgtcctagttgtaactaattcctttagtttctgatatttcctttctttttcttttttgcacaaatcaatgtgtatatttttagttccacttgtttcatagtagcaaaaaataattatccatttaattttttggttcttgattttttcactaatgtatcttggaagtcaagcattttggattctgttaatatttttttcttattacaattgtgtatcatgcttaatgaaatttaaaataatattaaaatagaaaactctcttgtttatatccctagagttaactcatgattgaattttttatagattcttccagatagtttctttggatatatatgtatatagatgatttatgtatcctaaatcatatgcatttttcaaacttggaatcatactgtacgtactattctccaacctgatgttacttcacatgatatttatatctgtaacttctaattcttgacactatataactaaatcatatttttaaatactgtgaaatattccattgtgtggacttataataaaattaaaaccagtgctctgtttatggaaattagagttttatccctaggttttgctattgcaaaacaatgctgcgaggagtgccctattacatagatcttagtacactagaagagtaaacatttttgtaggctagattcctagaagtggaaatgttggataaagtttttatttaaattttgaaatgatactgacaaattgcccaccaatgtcactgtgccaattttgccaatctaaatccaaatgaaaaacatttcattgtttactaaaatccccaggttggctactatgagtatgttctttggattcaaataaccttaaaagtgtgtgtgtgtgtgtgtgtgtgtctgagacatagagagagagagagatcagcagcaaaacaatccatacagtgaaaatctctgcctattccattaagtttggcaacaaagaatggcagagaagagaatgtgagttaacaactaagttcattattattttggttgttctacaacatcaacatctgatatgattgaaatattaaagttccttatgacactggttctctttaaatgaaaaggtgtggataattaagctaattatttaatgaaagctggaaagtccgaaaacaattccatgggggatttcatccagctctgtagcatcttccaaatacagaagtcaccgagcttggtatcatgttggatttgttactgtccataaggttaaaggatgagagagaaggaagaataattgagccttctattaattttgatattgggatttatcccatccataagtacagccaagaactgcagtgaatgagctcctttctactctgttgttttggaatgaaaagatattttatctgccagagtggagacatgctttgaatgtctgttatttctgccaggtgagtttctatcataacccaactcatgtaggcacatcagtctaaagtgcatcccttgtggctttgctgacttctacaggtgtaatttgccctaaacgaagtatgtgctctgcaaaagcacacccttaatgcctactgtagtttggtccctggagaaagctagcacccagagatttcttagaatatgcatgactttcctagtctatgagaaggacactgaatatgcagttttaaacttccattcatattcctattcttgcctcatatttgcttccatatatttatttgagactgtcatagagaagcatgatattttgtgaggcttgcaccaggactattttctaaaagaaatgctttgacattcaatgaccttcccccaggctaagaagagtcaggccctgcctctctctgtgggtgtgagttatgagagctgtattgtaagtgtgctctccctaaatggttacagacaagaaacacatggttttaagaggcacccattaaacccttaagatgaatggcatgtatttggcatctctactttgtggagaaacaagacagtggtttcctgaaatcaaattctgccaaggattgtcttagaaatagggcatttattaattcaccaaacatgcaagcaaactaaatgcaagcaagcaaaataaaatgtcttatgatgggtccctctcagtgattcagaaattgaccagacatgcttttagccccccaagaaacaagtaaatcatagggggaagggagaaactaacatgcatcgagtgctcctatatgccaggcactttacatacattgtctcctaatacaaagacactgaggtaggtaggtccaactcttgttctccatatagggaaactgaggcttagagtagctaaataatttgaccactctcttacatagctagtaattggcaaagccaggatttaaacccagatttgtctgaccccagagtcctgctcttaatcactcgtccatgttgtgcctttgtgtggacatcattagcctcattttaaagatgagaaaactgaagctcagggagggtgagtttatctgaggtccccaaccattaagtggaaaatttaggtttcagatgatcgactgattccaaagtttatgctctttccacaacaccatggatatgtcttatttacaactcttataaaaggcataatataataagagtcatataagaggcatggatatagttcatatcaaggagatattattttcagctgggtgtgagggtgattagggaaggcttcatgggacaggcatcatttgacattgactgtgaagactggattgggcagactggattgggaatagtgacgggggatggtattctgagcagaggttaaaataagagcaaatatgtggatgcataaagtgcaggatatttttgaatatcaagtggcctaaattgactggaggatagtataagattcaggtagttaggaaacatatttgttgagaaacaagtagctagacagatggtgttttgaatacctccacaattttaaaattataggatatatattgaatccagaaaggaaatgttggttaaggcgctttagattggaaggcagggggcaaggttgctgagacattctagctctgtgctagtgtttcttttttatttttatttttatttttttattattattatactttaatttttagggtacatgtgcacaatgtgcaggttagttacatatgtatacatgtgccatgctggtgtgctgcacccattaactcgtcatttagcattaggtatatctcctaatgctatccctcccccctccccccaccgcacaacagtccccagagtgtgatgctcgtgtttctgttcacatgctttacatttgctataataggaaggttcaatcaaagctttgttttcaattatgaaaatgttttgaatttaaaaaaaactgagtaaggcattaaccttaattaaaaatcagaataaagcttatttgtatcttcagcttcagggaattaatgatttttttttttttacagtaaaggaacttgtttctggtcttaacattaccagcgggtggcactgtaatacattccttctgcatctctgaagtagcgttttaccatctcatggctgtcttcagagtctgaaattagaaggaataacagctttatagtcaccatagtgtgattggtctaatctttgaacacatttactaagcaccacccccacaaccacgattcttcagtttttgagagctattctgcttaggttctcaccaaactacctctgaatcttttcatttttttcccaagaaggtgactgtgaggcatagctctcgttacttttcaagtagttcttcaaagttaggtattcaaaagccaaaggcaggagaagttatgagactggcaaattttacctttggcactccccctggctactttgcttttaatatctttgcttgtttcttgtgcatttcgccctccccaaggctaaagagaattcaaatgattcacaattttcttgacctttactcagaactttcctattctttgataggtgacagctagtttaatctttaaaccaatccagactgatacactgaaacactactgagcattcggtgttattggacacacctcttcctttttgacactctcttcttctgctctagtgacatcattttatcttggtcctatctgtatctttctggccattttttcccggtctccatcattatctcattttcctctctgtctcttaaaagtcgcttttctccagcattttctccttgttactcttttaacaaaccactccatacgtttccaaagtttctactcccttggtattaactatctaccctcttggtgcttctcagcagtgtctgcatattggaaccacccagggagcttttaaaccatattcctgtgcaagtaccactcccagagttactgatttatttgggctggggcctcggaatctgttggttttttgttcatctatttgttttaactacaaggtgattctaatgtacagccagggatgagaacccctgacctattgaggtttctagcaatccagtctttatgtctcctctgagttacatgcattattttccttctagacatcttcccttggctgtcccacaggcactttgaacttcaaaactcaatttttaatctatttaaattccacccttcttgtgtaccccatcttagttaaaattacattatcattctatttgggccagaatatatggtgtgactctcaaatctactgcaagtttccatattcagtaatcaccaagttctgcagtttgaattctcaaatatcttctaaactacctgtattagtcagagttttccagagggaaagaactaataggatagatgtatatatgaaagggagtctattaaggagaattgactcacacgatcacaaagtgaagtcccacgataggccatctgcaagctgaggaggaagtcagtagtggctcagtccaagtccaaaagcctcaaaagcaagaaagccaacagtgcggccttcagtctgtggctgaaggcctgagagcctccagcaaatcactggtgtaagtccaagagtgcaaagtccaaagaacctggagtctgacgtccaagagtgggaagcatccagcaagggaaaaagatgaaagccagaagactcagcaagccagcttattccaccttcttccacctgctttgttctagttctgctggcagttgattggatggtgcccacccatactgagggtggatctgcctgtcaagtccactgactcaaatgttatctcctctggcaacaccctcaaagacacacccagaaacaagtactttaccagccatctggcgtccttcaatccaacaagttgatacctaatattaaccatcacaccactccagtcatgttttttttaaacaaattttgacttttattttagattcgggggtatacacgtgcaggtttgttacctaggtgtattgtgtgatgctaaggtttgtggtatatatggtcctgtcacccaggtagtgagcgtagtacctaataggtagtcaccccacacttcttcatcctatctgttgctgacctagttcagcctttcataatttcttccagcccttctacattactgcccattttccataatacttgcaaatggtgtttttacttgtttgcttgtttttagttatagatgtacagcaatttcaagcatttattccattgtctaatgaacatttgtagatcaactgctagatgcaagacctctacttatgaaataaaactcctttgactccctattgcatacaggataaaggtaaaatgccttgtagcatataatatatggcatacaagacccttaatttattccttagttcacttattcattcaatacttaaatattcaatggcctgtaataggtactatgctaatttttatataaatataaaaacacgtgtgctattatatatgtatgtataggtatatacatatgcatgtgtatacacacacacacacacgcacacacacaaacacacaattcatttaggctccaggcttctcagtcctatttttgtgcccctcagtcctatttttgtaccccttgccacacacctcttcacacaagagccatcctgagttatttatcattctgaaaaaagaactgttcatattcccagctctgagcattttatcttatgcttttcttcacatgtgaatcacttcccaccttctctgacttttgatactattcatctttgaagaaccatttcaaatgtcattttctctgtgtacctttcgttggattgcccccatcgacccacctcttccaggcagaattaattgtccttcctctgtgctcctgtagcattttgtttagacttctatactggaactggtcatattgtgatttagttatttgtacgtctgtcttttccaccatacctgggagctttttgaaggcaaaaattgtttcctcgattctctatacctggtagactgccttgtacataatagttgatctacgaatgtttattagataattgaatagatgcttgtggattactggcaccctagcagtctttaggagcagaacacatgtgattgaaagtcattaaacaaccttgaaaaactgagtatgccacctatcacagtttggaattgtggccagagcacagcctgcctactctcaggttttgctgttttgacaaggaggatttatcagtgcaatcagggcctttgaaactctatcctcatctgcagagcccacattcacatagactttatagtttataatgagattttaatgtctgaacaccacccacctcagtggtcagtgacttggcttatttaggattcatgtggtatgaactagctaagaacagagagcatggtgggctgggaaagggcaggccaattgctttctttcttttttttttatactttaagttttagggtacatgtgcacattgtgcaggttagttacatgttacatatgtatacatgtgacatgctggtgcactgcacccactaactcgtcatctagcgttaggtataactcccaatgctatccctcccccacccataacagtccccagagtgtgatattccccttcctgtgtccatgtgatctcattgttcagttcccacctatgagtgagaatatgcggtgtttggttttttgttcttgtgatagtttactgagaatgatgttttccaatttcatccatgtccataaaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttccagttctagatgcctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatgaccagtgatgacgagcattttttcatgtgtcttttggctgcataaatgtcttcttttgagaagtgtctgttcatgtccttcgcccactttttgataggattgtttgtttttttcttgtaaatttgtttgagttcattgtagattctggatattagccctttgtcagatgagtaggttgcaaaaattttctcccattttgtaggttgcctgttcactctgatggtcatttcttttgctgtgcagaagctctttagcttaattagatcccatttgtcaattttggcttttgttgacattgcttttggtgttttagacatgaagtccttgcccatgcctatgtcctgaatggtaatgcctaggttttcttctagggtttttatggttttaggtctaacgtttaagtctttaatccatgttgaactgatttttgtataaggtgtaatgaagggatccagtttcagctttgtacatatggctagccagttttcccagcaccatttattaaatagggaatcctttccccattgcttgtttttctcagttttgtcaaagatcagatagttgtagatatgcggcgttatttctgagggctctgttctgttctattgatctatatctctgttttggtacaagtaccatgctgttttggttactgtagccttgtagtatagtttgaagtcaggtagtgtgatgcctccagctttgttcttttggcttaggattgatttggcgatgtgggctcttttttggttccatatgaactttaaagtagttttttccaattctgtgaagaaaggctttggtagcttgatggggatggtattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaggcaattgtgaatgggagttcactcatgatttggctctctgtttgtctgttattggtgtataagaatgcttgtgatttttgtacattgattttgtatcctgagagtttgctgaagttgcttatcagcttaaggagattttgggctgagacagtggggttttctagatatacaatcatgtcatctgcaaacagggacaatttgacttcctcttttcctaattaaataccctttatttctttctcctgcctaattgccctggccagaacttccaacactatgttgaagaggagtgttgagagagggcatccctgtcttgtgccagttttcaaagggaatgcttccagtttttgcccattcagtatgatatcggctgtgggtttgtcatagatagctcttattattttgaaatacgtcccatcattacctaatttcttgagagtttttagcatgaagggttgttgaattttgtcaaaggctttttctgcatctattgagataatcatgtggtttttgtctttggctctgtttatatgctagattatttattgatttgcgtatattgaaccagccttgcatcccagggatgaagcccacttgatcatggtggataagctttttgatgtgcttctggattcgttttgccagtattttattgaggatttttgcttcaatattcatcaaggatattggtctaaaattctctttttttattgtgtctctgcctggctttggtatcagaattatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagatcctgttattggtctattcagagattcaacttcttcctggtttagttttgggagagtgtatgtgtcaaggaatttatccatttcttcatagattttctagtttatttgcgtagaggtgtttgtagtattctctgatggtagtttgtatttctgtgggatcggtggtgatatcccctttataattttttattgcgtctatttgattcttctctcttttcttctttattagtcttgctagcggtctatcaattttgttgatcctttcaaaaaaccagctcctggattcattaattttttgaagggttttttgtgtctctatttccttcagttctgctctgttcttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttaaatgcgtcccagagattctggtatgttgtgtctttgttctcattggtttcaaagaacatctttatttctgccttcatttcgttatgtacccagtggtcattcaggagcaggttgttcagtttccatgtagttgagcggttttgattgagattcttaatcctgagttctagtttgattgcactgtggtctgagagatagtttgttataatttctgttcttttacatttgctgaggagagctttacttccaagtatgtggtcaattttggtataggtgtggtgtggtgctgaaaaaaatgtatattctgtttatttggggtggagagttctgtagatgtctattaggtccacttggtgcagagctgagttcaattcctgggtatccttgttgactttctgtctctttgatctgtctaatgttgacagtggggtgttaaagtctcccattattattgtgtgggagtctaagtctctttgtaggtcactcaggacttgctttatgaatcttggtgctcctgtattgggtgcatatatatgtaggatagttagctcttcttgttgaattgatccctttaccattatgtaatggccttctttgtctctttcgatctctgttggtttaaagtctgttttatcagagactaggattgcaacccctgcctttttttgttttccatttgcttggtagatcttcctccatccttttattttgagtctatgtgtgtctctgcacgtgagatgggtttcctgaattcagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagtctggatgatctttacattttggcatgattttgcagtggctggtaccagttgttcctttccatgtttagtgcttccttcaggagctcttttagggcagggctggtggtgacaaaatctctcagcctttgcttgtctgtaaaggattttatttctccttcacttatgaagcttagtttggctggatatgaaattctgggttgaaaattcttttctttaagaatgttgaatattggcccccactctcttctggcttatagagtttctgctgagagatccactgttagtctgatgggcttccctttgtgggcaacccgacctttctctctggctgcccttaacattttttccttcatttcaactttggtgaatctgacaattatgtgtcttggagtttatcttctcgaggagtatctttgtagcgttttctgtatttcctgaatctgaacattggcctgccttgctagattggggaagttctcctggataatatcctgcagagtgttttccaacttggttccattctccccgtcactttcagatacaccaatcagacgtagatttggtcttttcacatagtcccatatttcttggaggctttgctcatttctttttattcttttttctctaaacttctcttctctcttcatttcattcattttatcttccatcgctgataccctttcttccagttgatcacatcggctcttgaggcttctgcattcttcacgtagttctcgagccttggttttcagctccatcagctcctttaagcacttctctgtattggttattctagttatatattcaaaatttttttcaaagttttcaacttctttgcctttggtttgaatgtcctcccatagctcggagaaatttgatcatctgaagccttcttctctcagctcgtcaaagtcattctctgtccagctttgttccgttgctggtgaggaattgcgttcctttggaggaggagaggtgctctgctttttagagttcccagttttcctgttctgttttttccccatctttgtggttttatatacttttgatctttgatgatggtgatgtacagatgggtttttggtgtggatgtcctttctgtttgttagttttccttctaacagaccggaccctcagctgcaggtctgttggaataccctgccgtgtgaggtgtcactgtgcccctgctggggggtgcctcccagttagggtgctcagggttcaggggtcagggacccacttgaggaggcagtctgccggttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgtgctgtggtgggctctgcccagttcgagcttcatggctgctttgtttacctaatcaagcctaggcaatggcgggcgcccctcccccagcctcgctgccgccttgcagtttgatctcagactgctgtgccagcagtcagcgagactccgtggggtaggaccctccatgccagttgtgggatttaatctcgtggtgcgccgttttttaagctcgtcggaaaagcgcggtattcgggtgggagtgacccgattttccaggtgccctccgtcacccctttctttgactcggaaagggaactccctgaccccttgcgcttccccagtgaggcaatgcctcaccctgcttcggctcgcgcatggtgcgcgcacccactgacctgcgcccactgtctggcactccctagtgagatgaacccggtacctcagatggaaatgcagaaatcaccatcttctgcgttgctcacgctgacagctgtagaccagagctgttcctattcggccatcttggctcctccccccaaaattgctttctttttattaagagaaaatatcatctatacagcatggaattacaaaaagccttaagaaaatgctgtgtaaatgaacagccaaagtaccttcctgcaatctagaccgtgggatcccatatttaaacttatgcctgtgcaacaaaatattagacaaaacaataccagagggagaatggtggtgaacagtttttaaacctatgtagagtaaatatttgtggtagtgttttcctttacacagcatatgcagtagaatgacaatataaaggaagtagaaccccatttgtcaggggagtaggaaggcctgatttttatcagcatgcttctattggctacgtctaagttagcctttttatagagccactgcatctcatccttcctttttacttttgttcaaagtcgagtctcccagctctttgagctcttcctcagtcactctaatttctgctttgatagtagatcctagacttcttttacctctttccattttattcagtccctaagtgtcattcgcacatcctctgtgcttcacctaactacaacttggccaaagctgttgctactaatttcagtttacttagaattagttcaattgttcaattcccacttatgagtgagaacacatggacacaaggagaacaaggagaaaacatggacacagggaggggaacatcacccatggggcctgttgggggatgaggggcgagaggagggataacattaggtgaaacacctaatgtagatgacaggtcgatgggtgcagcaaaccaccatggcacgtgtatacctatgtaacaaacctgcatgttctgcacatgtatgtcagaacttaaagtttaataataaaaaaagaattcaattttcttaaagagctgatcaatttgtgcggagatgtataaaatctgattttgaactaaagaaacttaccttacatcctgattagatctttaatgtcataaaaatgtaaactgtacagtgaaggggcccttagcacacaattgtttaaaatccactacccgttgtgtacttttgtcccttccttttctagttgttccttcaagatatggactggagcccatgaatgacactaaaatgtggctcacctactcatcctgctgattaaaaaaataaacaggaaacacatcacttctggtgaatgtcatgaccaggatgttagataaaaacacccttaggggccttaacaatttgtggccagaatgacctttgtttttgcagttgtttttcagtctgcaaggggcctttccatttcctcttagaaggtatgaacactgaccacagcattttgaggcccaggctgtgcggcttaactctcttgcatacaagaacaaggaagagaataaacagttccgtttcctgggtaatcttaccttcctctttcctaatgttgttttaggatttttatctttgcacttttattccttgaattttatgatggggattgtcatattctctgacttttcatggattttattagaaatcacttgtatcatcaggcttcttggatctaccactttggatttggtgccctttttgctgctcttggtaagagctttgtctgccattttcacattcttgattatttatgctgctttgaatgtccgtttgagaaagtaatcagatttttttccctctgagaaagcaggggaatgatcttttgcatcactttgcataaaattaacatgttgattttctataaacccataggttcaggttaatttacataaacctggcattcaggaagctcaacctttacattgtcaaggaaaatgaaataaatcaggacagctgaaattaagtatattcaagccatcagaaaatggggtgggcaaagaggcgctatggggtagaaaatttcatagttccttatagttacactcacaaaatcttaatgtgttaagggaccagacaggtttttcaatccagccttttcccagtgtaggaatcccattgagagcacaccatgcaagtgatggtccagctgacagttacacttgcaaaacaaagtgcctagtaaagcagactctttactttggaatgcctttaattgttaggaaactaaaatctgttcttttgtgaactcctattaatgggtcttagctctgcctcctggaatcaatctaatccagtggttcttaatttggaatccctggacaaggcttaaatgagtccacaacccccctgaaactgtatgcaaaattgtatgtgtgggcatgtgtgagtgtatgcatgtatcgatagctttcataaaattttcaaagggacatatgatcctcaatcagggataactttataagcatacaatttgtgcagctgcactaagccccacacttaaaaggaatttgtacttggattaatgcttttctgttgccatcctgaaattcttaataatttttaaacatagagcccgaattttcattttgctctgggccctgcagattataggggaactacccccaaagacatgaagttattaaaaaaaaacactaaaatttctataaaatgaatcattggatagttctactttcaggaggcctgtaccatccttctgtttaccttctgaccttcttgtgtttccaaacattatcttcttgatttagaatgaaatgagggcagtctacttcctctttaaattctttccaatttcttccctgccctatatgaaagattcttaacttggaatattaacttggattcataacttggaatccatgcccattattttattttacaacttatctaatttatctatatagtatttcaaactttgaaaccaatttaacacaacaactgtattgtgtctgaagaaaattaaccatttttattaacactgggacagttcttatctttttatccttgggtatctgaaattagagcacagcgagttctgtcagagcaaaaaatatacttttaaagcaaatcattcagatgtatccaattcaattttactaacttctgtcttgcttcatatgaaagcttttaaattgatctctttctttgattgatcagggtctttccccctcacatataatactctcaataaatttaatacactgaaatgtatattctcataccaaataattcacttaatttataacatcaaatacagaaaaacttaatttaaaattttaattgcatattttatgtcagcatgttattaaaacgaagttcataacacattagtaattttattggagaagtacaagttcccctgagggtcaataggtaaatgtgttattactctttggtgaccttggactctgctgtgggaagaatgcaaatcatagccactctgaacaacgtgagaaagagaaagaaaataagctctaggacgaaagtttaaaagtactgcaattatttttccttggaataaagaagtctaaggataacctgaaacaaatgaggtatttttgatgaagaagagttgtcttctatattcaagagaaatagatgatttgagatttaggttgacatttgaagaaattttcttttaaactaatagaatcatgtcctgtgtaggttagagacttacttacctaaggcaaaggcttcagccagatgatatcttgaggttccttcaaattctaagtttccacccttgggcttaaaattccacttctgtgatacaccaaggctggcatggactcttttgctgatttgcctttcatcttggactcttcattttcattcttaattatgtgttgaacacatgtccctcctggggaagaatgagtttggaagtaatgaagttaatttgttgaatggctagaatgaccacccataaatatctaagtgaggattgtctctttcaccttcatcatctgggaggccaaaactgaaatatagttatttcaattttgttgtcattactcaaatgtttttgcatctattatttgagaactcccttcagaacccatggcataatctgggtaactccagtttggacctaacctttgagtgtgatttgcttctttaagatagccaacaacaacaaaataaccaacatacatttgcacccatatcttactaagtaggtcagtgtggtaatatattttctgtgaaaatcatgttataactgtaaggtaatagagggtttctttggcttgcaaacaaattggatatgaaggcacaattaggacagaaatttcaaaaaattacaatagatcctaaaactgtgctagttggtagactatatggctggtgactaacataggtgactgctttgttaactaaaggaaaatattcatcccaaatttaaaaatcaaaatagtctcattatatcatacatatacagccaatcaacagaatagaatcagagaataatggaatattagcttttgaaatctcttggagatcattttgtctaatgtcttcacctccacctctgtgattctcacattcgtgtttcagctgaagtttcattctgggaagactgtcagtggactcccaagaatagcttagattccttagtgcctgagtcagggcctaataaataatagctactcaataaatattcattgaatgaatgagtatatgaacatatttagaggtttggaagaagctagaagaagctggaagttacagtgtcttgaagttattatcataaatgttaataattattcaaaacagctaggggagaagaagtaatccggttgtatgagcattctgattgttgcaattctagttaaatgagatttttctataaacatatatgtaaagattgtcctatctcctcagatattaaaaagggttttatttttttaaggctatgtttggaatttgaaccaaattcgaatgtgactgcttcttgctcttataactgctaattgccaagcactgtatagaatcgtttggcctgacattgcttctgaaaggagctaaccatgctctggtaagaagggaccggatctatggaaaagaaatgctctgctgtatacctagctttcacctgatatacacttcacttcttgggatgtacacttgctgtatactgccctactgcacaatcttcctcacttttctccctgcctggcatagttgtacccatagaacagagacctgatctacttcagccacatgtaaagaatccatatggatcaagtgctggatgaagattctgtacaccttgattctagtcctgggaatatcactctatctatagcactgtggttaagtactttctgagccttagcattctcatgaaaaaaataatgaggggtttgggcttcatccaaattgttctcaaattgtcttctgtgcattcctaggggttcattggaggcacttctggggctaatacagaggtcagagaaagaagcagaatgacggggactttgggctcacccactccacttcaaccacagcagcttcacttttgtttgatatgcttctgtgaaatattttgtttgaaaaccatatgcactgacatggtgagagtgcataatagatataatttagtcattcaggtaggtgaaatgattccaccgactgtttcatgatccaatattatggctttttgtgttgctgattgaactgaatgatcatgcaacaatctgatcaattgctgtaagcagctatcttcttggccacctggctgcatctattcatgtcaactcagcagtagctttagattaaagatgtgaaaattatgagcccaggaatagaagagtctggctttccttctcatggagattgaggtgggggtatgtgaatagttctgggcaggactatatggagttctattaatagaccctccacctcacctacttttccttccctagacctggagctggactttctataaatgattgcctgcttatatactaaaagctaaattgatccaagtaagagtcacacccagggtacattttatcattttattatctctcatcctttcaaactcaatcgattgtttactataagaagcacgattagtgctcctaataggctgacaggaagacataaagtaccctagagatggaccagaaaagggggaaatacatttggtctgaaatatgagttttattttcaggtatccactgatctgtggttcaaagtgtgatgatttctcaatgggaatgacctgatttttttcttggattttgttactatttagcattgattgtgtgtagcattttccatttacctaatggctagaggtcatgcaaccagtcaccactctcattccagcgtcacagatgaggagccagaaacccaaggagaaactagtaagttggctctagctcatatgctaaattgatgcagaggtgcagggaaccaacatcaattttctaaaacccctaatgtacatctccttactggttccaatctcctcctgcagggacaccatacagtacaaataaacccttccactaagctagttggaggccttgattataaaatgtcagagtggggcttgtgccttgccctgatctttagggtcatctgaagagcttgcgctgtggcttgaccttatgggaataaagcagcaaatgctttaggcttcttgttgaaaacctgcaggagaagatgattggcagtacaattgttgtgacattgttcatttatgaagcatcagaagtgggtgtgtaggcatggcagagacactcaccaaaaattatttggttttgctggaataaagtgcatcttggattgcttataggaggattgtattcagggttcgtttgacaatctaacttccacactctgatttgcccaaaaagctgtggcagcactgtgtttggagttatggattatcagttttgtcagccaagatagcttctgttttcctcttcaactcaagggtcagcattctttgctcaaaaatatttaaatccattttaaagtgagcagaatgagggagcagaaggaaggcaaattgagacagagacaggaagggagtgggtagattatacgtagagttaatagttgctatgtgaaattcaagcttctaggtttatttgttcaataaatataaattaaacactcacttgtttgccagatgcatgcaagaggtaaaagattattaccttttgattctcttaactgacagaaacagtaaccttgaaagtccactcaggcattacccctatcctcttctttcaagacttccatgactaattgagcagtaggaaattgttcctgttccatttcaacttaattgtgaaaatttgttctcttcttgctgtaagatatgcttttatctatttgcacctgctcaatatacatgcattatttctgtgtaatgtgggtacctgttcggccaagttagataactaagaaagaggtaattgagggggccttgctctggagctgtacctacttagatttaaatctgatatatgcaataggtgactacctatgaaaccctgagcacattgctgaatcatcagtacttcttctctacagtgaagttatctactgggcaagagtcactgtaagaactagagaaaacatgtagaaagaataacctggggtgggggaagggggaagggaaagcattaggagatatacctaatgtaaatgacgagctagtgggtgcagcacaccaacatggcacatgtatacatatgtaacaaacctgcacgttgtgcacatgtaccctagaacttcaagtgtaataaaaaaaaattagccaggcgtggtggtgggcgcttgtagtaccagctactcgggaggctgaggcaggagaatggcgggaactcgagaggtggagcttgcagtgagctaagattgcgccactgcactccagcctgggcaacagagtgagactctgtctcaaaataaataaataataaataaataaataaataaataataaaaacttaaaaaaaaagaacatccacataggccttgctatatgacataatgctcaatagatggcagttgttttgttgttgtcatattctttagatcaacatttccttagttaccgtaaacaaaatcagaatgtgagagtagtcccaaagaggggtctttagttctgcttttctggtcagagagaacattttgtgtatttaagtttaaagggtaccaccagacagtaggttttattatttctcttatttcacttttccacttttccataactagcagtcatctgtagttttctttagtgcttaaggtgttatgaaatattcatatcattttatgaaaggctatttacacagaggaaccagatgtaaccgagtgtacatacaaatactggccttatttttcacgcttggtaagtagcgcataacttgaaagctaagagaagatactttttgttttggcaccaataattccagaagaagggcatcctattaaaaaaatctattgatctaagagggactagaaatttggctgaatattttagaaattgtttgtttgccctgagcttcaaaaactcatggcttagagtttcctgggaagggtagaatcactgaatagatagggtccagctagctaagtttcctggtcagcccctgaagaaagtttcattgcataaaaagcgtagatttgtcttcaaagttttccccaacactttatctctgaggttttctctattcatcttgagaataaagccctgttggtgaacataaatacactcccagagttgcttatcaggcaagacagaattgagcagttgggcctgaactctcccaccgtttaaaccaacgttctcaaggagttgttagagcaatttatgcttcccacatctgttcctagatgttatgacttgtttatggaagcaatgtaaataccaattctaacaacagctacaactaatactcaatgtttactccatgccagatcctgtgctgagcacttgacatgtaagacttccttcagtgcttgcaacaaccgtacaataggtgctacacgaaacagaagattctatggtcaaaaaaagctctagagcagtgggtagaaaaagttgaaggtgtttctctactataggatttaccaaggacttggagtgtgcagcttttccaagtgtattggagcatggaggcattttttctcctgtcttagtccatttgtatggctataaaggaataactgaggctgggtaatttataaagaaaaagaagtttatttggctcagggttctggagggcgttcaggaagcatggtgccaacatctgcttctggtgaggacatcaggcagcttccagtcatggcagaaggtgaatgggagttggcacgtgcacatcacacagccagagaggagaaaggagtggggggaggtgccaggctcttttttaacaatcagttcttgtgggaactaatagagtgagaactcactgattacctcaaggatggcaccaagccatttacgaggaatctgccctcatgatctaaacacctcccaccaggccccacctttgacactggagatcaaatttcaacatgagatttggtggggacaaatatccaaactatatcattccccaagggccatctggagagatggaacaccatttgggacatgctatcctatgagtttcttatggaacccatgcttattaactttggaaattggatcaaatttcaaaaatttctgtctttgccctggccttatcttgtccttaaataacccatactacctaatcttaaaacaacttataagtttatatatgtgtcctggagaactggatctatgttgcttatctaccaagtccaagccaccatcatccctcagctagactattacagtcacctcatactcattttcctgcttccattcttatcttcttgtaaactcctatctatgctgcagccaggttcgttctaaataacaaagaaacaacaaaaaaccaaaactgtgccacactactattttgcggcaaacctttgaagacttaccatcacattcaggatttgaacactgtaccatcacctacacaactatgcatgacctgaaccatgcccatctctccccgccaggctcctgctgctgtagccaaactgtcagttcttctagtgtttcagactaattcctgctcgaggcatattctaattccctctgtctgaaatattctgtcacccgtctttctattcctactcgtcctttgtttctttgcttaaatgctgttttctcagagaggttgtcactaaccacccccaaaattaggtgtacccagtttttgtgttcaataaagttaaagggattttttttacagtaggacttatcagggcctttgatatgttaacatgtattatgaatttcaagagggacatggagtatcctgcttttttttccttcagatcacttatcacaatgtttatttgtttaatggctatctccccactagactctgggttctatgagggcagaaatcatgcctctctactgatcctacacccccaacgcttaatgcagtacctggcacatggtaggggataagtgtatgtttgttgaatgaatgaggaaatgaatgtgattcttcctgctgctggactgcctttttacagtggggctgccatggaatgatttaatatttttcatataacctcttcctactaagattttcacctctcttgtttaacccaagtcacttttggaggaaaaactagaattatattcagcactgattggtaacagttgaggattaatgagagcaatacctggctcttatatttttaaatattaatcttttaaaattattgaatattttattaactattttaacttttttaatatttaaaatgatttccaattaatggaattctttaaaacagctttttaaattttaaaagttctagttcagagcaaaataacaaagtaagataatgcattacaactgttgtttcccaattagccatatctatgggaagcaatccttaggccatgaagtctaagcccaatgtgcgcctagtaccatctgaccttcaaagttggtccagagaccctgagagaaggaaatgcctttatgagtgctgagtctgcaaatccaaaaaccaacgtataagtacacgctaaatatgtgttggtagatttttatgtaagaccttggtggtgttatatatattctttcatctgatctttcttgttacttatgtaacacattttcattgctaccaagcaggattacaagttcaattgtgacctatggaacaaaatgactgactagaccttgtgatattttaaaccatgacgtggggtgcattaactgggtcctgcaaccaaatgaggcacatgcttacctaattttcagggtcctctgggccactttgagagggctagtgcaggtagagccagcaggataacagaacagtgtacagcccagaaggtcactttctggtagttggaaagggcaagctgtccagtgttagttctttgacaagagctgcccctaggtcagtgtacacacacataaaatgtgtgtgaaaagatgtagacaaaaggaattctctgggaggttattagtgtcagttacttgtcagttacatccaagggccacagcactgctggtatagcttccgttgagtttctgtgccatattttggttttacgggcaagcagccttcaccaggatatgctaaagagtcatcaatggattagtatcactaacaaaaggaagattcaacttaatgagagaaagtgtgcctcattaatggttgggaaattaagcagtcagtttctaatcaatgctaagtgatagaacttcagtggaggctaaagctcattagtagaatacacatagatggtaatgacctcaaaggtatttaaaatataggtgaaaagaactacattaataaggcaaatctattccacctgtccatgacttggctcactgttcccctgtgttatctgtatgtcatttggtacatttatttatgagaataaatttgcatttgtgtggcgcaattggttggtatgcttggctccaactctggagaataaatttgcctgataaaatatatggttttcaaatttctacatagataatggattatgagcaacacaataatttgctttcatgaaaaaagtctataggaagaattgacttataataagggctttgtttattcagtaactcatttattcaagaataattgccttgagggaaaaatggatagcaaacctaatgcaataaatgtttatttggaattgtatttaactatttcttccttttcttccttgtgaaatgctttctcaaatgtgatctgttaataaattatgccaatatcgccaagggccttgctgaagatgttcatattgaaatgttccaaaaatatgccttagtttccctggcagaaagccaatggtgacatcagagatggcatgactatacttcaaacaggacaatgcatatgacagccaacttactagctctattcttatcccacgcttgccaagctactgcaaaagcctcaagtggtaatgcataggtaatttgtaagtcttgtatctcctttctttcacctggccaatctgtcctccttaagaggcaacttgaagactacaacgaggagttttaataaaatcgtactctcctatcttctcttcctcttgcctatcctttaaaatttccttttcttgttcattcttctcagaaatcctcagttggttctggcatctttagtgaaaacagccagatgaggtgtttatcaattcctagggctccttttgttttcatttagataagaaactccccaagggtaagacctttatttcttgtttggcgaagtgcaacatttgttcacagctctctatccccgataaatggaattaggaaatatgtcttgaagtagagccaagcactgatacaaaggcatccagcctgctttccataccctttgcttaggagagtggtgctgtgacaataaatggcccctggtcatttgtaattggttaatgtccaggggtagagcaatttaaaagtctagagagcaaagtgtaagaatgattttggctcttttgaatatttccccaaccaagatcatcggtagattgtaagatctgcaatcagtagaggttccagatatttgcaggcttttaattaataaggctaaagaatggaatcaaccattttaggagctctgcaatggttaccatgtgtatcacattgcttaaagcagatgctgcctcttgtcacgtcagggcctagcttctccctgaagccttcttcccctcatcctgtctctgttagtttttcttctctgtcatcctctaccactttcatacttaccaggctctgggatttctttaaaggtctaccatgttggatgctcactgtcacctcagttgtgaaaacagactcatttatacctcaggacatatggctgttttggttaaactccaagggccttggtctatttatttgttggaatctttctagtttgttattaaatgacagacaagacaaatgaataccacctctgggtaaatttacaaattttaatgacatttctctccattaagttttgaccttaataagacagcagggaccttcatataataaagtagttcatgcattttgtttagctttatagacagaggaacaccagaagcattttctcttgaaaccaaaatgagctgtaagcaactgtactgagtctctagaaaggaattagttttgccagcgagagttgaaacaaggacgctactgctatgttctgagaccctgaattctgttccaaaatagataagactggatcttggcatctgactttttgttttttcagtggtagtctgttttgagtcacctatatctgtatggtaacgatagagtgaggagccataagtattcatccagacagaacaaggacctgaacagtcaggtcttctcaagcaccagatggctctattttacagaaaaggaaaacaatgcctagttaggtaaaacagccagaccagagtcactctgcaagttagaagtggaatcttgctctcttgcttgtgtgttactggttagcacatcactatcctgaagaacaattaataatatctcatttcttgccttaggagaagtcttttaaattactggtgcctcagtttcccttttatatagatgggacaaatgacatcatagtttattcactaatccattcagcaaaaatagtctaggtactacaaagacagccatatatcaaatgtagtccatatctggatatatgcactttttctatcaaaaagctacacacaaaaattacaatacaccttattttgcactgctatagagtttaggacaatgtactgtaagaggattatatatatatatatttattattattaaagttttagggtacatgtgcacaacatgcaggtttgtcacatatgtatacatgtgccatgttggtgtgctgcacccattaactcgtcatttagcattaggtatatctcctaatgctatccctcccccttccccccaccccacgacaggccctggtgtgtgatgttccccttcctgtgtccatgtgttctcagtgttcaattcccacctatgagtgagaatatgcgggtttctgtccttgcaatagtttgctgagaatgatggtttccagcttcctccatgtccctacaaaggacatgaactcatcattttttatggctgcacagtattccatggtgtatatgtgccacattttcttaatccaatctatcatcgttggacacttggcttggttccaagtctttgctattgtgaatagtgccgctataaacatacgtgtgcatgtgtctttatagcagcatgatttataatcctttgggtatatacccagtaatgggatggctgggtcaaatggtatttctagttctagatctctgaggaattgccacaccaacttccacaatggttgaactagtttacagtcccaccaacagtgtaaaagtgttcctatttctccacatcctctccagcacctgttgttttctgactttttaatgatcgccattctaactggtgtgattatatttttaacagtagaagcagactttgctggactctttcgagcccatgaaagaaaaatgtagggtgtacatgcacaggtataccctaaaactttttgaaaattgtgtataaacatacagtgttttcatctctttttcgtcatcatcccctgtcaagcatgcatcatgttcataccattgtacatgtgttaggaaaaaactggaccattcaaagattggcaagattggctggacccttcatcccattcttctatctttacctttcttcattctgtcactcctccttagaaccctctaccctgtctatccatatcagctttgtttttcaaggatccacttgagggaccaataggtttgtatttaggttatctgtagaggatcttaaatgcacataggacattacattttaaagttagctaactcttattttaaaggcacttgtcaagcactggccagtactcaggggtttgctgcatgatgggtcaccttcattgaggagcatttgcagaaacggactgccacacggtgataacttggctggactaaagcacacagatgtttgagctgttctttaatcatagatttaaatttcctattttcagagaattcactttggttataagaagaaccttgtagcaggaatggaccccagtcatccttttattggggaaaattttatgttttgaaaatgttaactaagccataaaacattcagccatccagtttttaggactgaaatatgggaatcatttctggatttagctctgcctttgtaattcagctcccccaatattagagcagcctccatatgtcccaattaagtggccaaagcttggcttctgtggattgattccataatgcagaccgtaatagctcataatgactctgaaagaactgtctagccaatcttgccaaaactaaaattgcctttcatttttaatatccccaactgttctcaccctgttggggatagcaaatatatttgcatttggggggaacctcatatgcagctctgtggaaaacatggcacttctcgctgtgattttatgagctatatgtagccaagccatgcatatcgtgaacatatctgcacacagacttgccaggacctgtgattcttgcaagccttttcattgttcctcagaatttgtcagtaggaagttggtgaaatacatctgcccaccctcctccttatttgggagcagaattcataccaggcatttggtttcttcagactgtaattaacaactatggacttagaactatatcccccaccctagctggtagtataaacaggacacgtggacaatagcctgaccattcactagtcctgttatctagtgctgctaagactggttaaatgttctgacctgaaatataagtattttgccattctctattgttctgtaccatttattctagttgatgtcacttctgttcgtaacctatagaactctttgtagatgggagagagattttgactatctagaaatgagaggggtaattaatgcagtaaagacctttagaaggtgaaggggaatggggtccagagcccaggagggcgggctaaaaaaatagagacagttctttgattctaaaagtagggaaggaaaaaaagttgaggatacacgcaagataggtttgggtgacagtcaaggtgacttccattttgtaaactaagttagaggtaaggttgatcaactgagggggaaagggggagtgtaagagtaaaacttgagaaagtggctagaatttggatagatcctgcttttccccaaactaattgtctctatcagcaaggactgggccagctaccctgaaatgattctgccacgcagtgaccatattaaaaatcttgaaagcttcatcagtaaactgctttaatgagtagggctctgcagcactgatcccacaatatgagttggtcccattacaaactgataatgtccagcctcagctgggctctcactgtcactcaacaatccattgatgtgtcttggtctgctacttctgccattacacactaccttcactcccaataaatacattaggtggtaatacttgggctagaaaattttcagtgagatgattcctttgccatggcagggacctagcttgtgtgactatcacctaatctttagtgctaattgtgaaaaggcatgagtctttctggacttctgagggaagaaagtcttctattcttttcagttaaatcaactaggatgcaaagcagaatataatttctctctaaagtccagattcctttgccttttgtggggcagcaggagagagagagaaagagagagagagagagagagagcgagcacgagagcacatgacattcctatgagtgacattagtagaagagctagaatcttctaccataacaggaatatgtttatgtatggctaatggtttatatgaaatgaatgtgcatatgactaagggaagactttgagatgaaaaagtgagaaactttgggatgagtgaacttgtgatgaatctaatgggtggcctagcatcagaaccataacatgagtagtagccaggtgggccaggtagatatagcaggtcagatgaaatccacttttcagaatacgggactaatattgagctgaggtatttgaagaacaggcatccagatataatataatattagggattactgtgtttcaggcactgttctcagtaccttatctgtacagtattaactcatttaatcctcacaacagccctgtgaagtaggtactgcggttttcgttttgtttcgttttgagatggcgtctcactctgtcacccaagctggagtacaatggcctgatctcagattactgcaaccactgtctcccgggttcaaatgattctcctgcttcagcctcctgagtagctgggattacaggcgcccgccaccacacccggctaatttttgtatttttagtagagacggggtttcaccatgttggccagcatggtctcgaactcctgacctcaagtgatccgcccttctcagcctcccaaagtgctgggattacaggcatgagccactgcgcccagcaaagtaggtactgcttttatccactgaggagtggggagtgtaagtaaattgcccagagttacagggctaattaacagtagaactacatttcaagcccatgcatttaattgggaagactgtgaagaagctatcacctgtttttaaaagagaggggtaaagcaaattacacaaggttaaacagctaatggaactaacttgttcaggaacccaggtgttctgtgtgtaaggtattgttttgttactgcacccttagtactcaaagtatcagcagcattggcatcacttaggagcttattagaaatgcaggctctcagtacacttctcacacctgctgaatgcaagtgtgcatacagttatttgtgtgcatattaaagtttgaaaaacactgagctattacttcattggcactagtttgcgggacagatatttacaaatactgttagccaaaggcagaaactacatcccaattatccatctaagacagggaaagtatgaaatttggcagggtttgggggtggagttcacatagtaggaaacacagggatttgaatagttgaccagccagtattggagaggttagagttcagaggtaaataaaatgggattctacaggaaatgaagttctatgcagtaacttcatcacataagagttcctgactaagtgaggtatgtaggcaagcagtaccagaagctagccctcctagagctcctgttatttatttgtcaaagggcagagctggttttgaagtgaatctgacttttgcagtggttgcagcagggagggtcaaaggatagatttggcacaccgtctagttgatttttcagcttccctgtcctgggggaatcacagatttctctgctttaagtaaacttgatatgtgaatatctggatttataaaacagtaaaaattataggtgtggcaatctcagtttatagactttgtaactaaattattcattttattagagagcacatgatatgttgctttttaataatgagctcccctaacacatttaagacagaattcaattttcagccctgttaaaaattcaacctagtaaaaacatatacaatataagtaagctgcccttgcatgagccgggataatttgcctaagcaactgtgtaaaatggtctgaatgtttcctgaattcaggacaaataggattttggtatatgtcaccctttgaaagacaaaagaggtgctttctggagaacacactgctcttgactttaagcctccttcagttctgtttcacagtttttattcttcatggtctgttgaactgaacttgtgacttcaagtggttcactgaactgagatttattgcagtttgaggaaggaaacagtaaaataagaaggcagttttgctatttttgtacaagacctcctaagcaacatttcacaaaacacatggtttcaattacctctgtggcatccacccacccacccactcatccattcagccaatattgtccagtgtcactatgttagggctgggaatgcagcagtggacaagatacatacagtttctgctctttggagcttatagtctagggtgagatgcagccaggttaaccaggcagtttccagtagagtgtgattaacagctaggatgattgaactctgggctgtcatgagaacataaaaaagatgtctatgacccaaaccagctgcaatgaatagacagaaattatattagctatctgtggctgcataagaaattacccccaaaattagtgttttaaacaatatgtatttgttattccacagatttccatgagtcagacacctggtcatggtttaacttagtcgtctgcttcagtgtttctcattggttgcaatctagggattgaccagggctatagtcatctcaaagtttaactggggaatgatcaattctaagctcacttgcatgatggttggcaggattcagtttcttgtgggttgttggactgtgggcaccagttccttgacggctgttggctagaggctagcctcaattatttgccatggggccctttccatagggcagctgacaacatggcagctgggttcatcgaagtgggaaagtgagggagaaagaaaattccagcaagacagaaatcagtattttgtaaatgaatctaagaagtgacatctcatcagtttcgtcatatactgctccttagaaacaagtcactaggtccaactgtactcaaaggcaacagcccaacacccaaagaaaagagaaaaggtttatataaggatgtgactgtcaggaggcaggaaacattgagagccattttagaagctggctaccacagaaatgtcctcctgtacagagatgtaagttgtagctccttaatggctctgttgaactattcttagtctcattcttactcaaactcaaagtttgtcaccaggctaccctgcctccggttcatagtatattgtcatagtgttacctcgattggcatgaaaaatagttatcaactcccttatttcttcgatcatttcaatcataatggttgggagggtcaggaaaatgccttcggaaagcaaggatattggaacaagtacaaatttaatgccggctttcatgatatctgtctaagatttctggtaggccttttctctgagacacctgtttttaattagattattttgatttctatggcttattcaaggtgcctttagtaatggataatgtagaacaagtatatttgtccattgggatctggaaaaagcttgaaaaccagctctcaggaagagaggtatattagttagggtgagggctatacttctataagagactacaaaatagaatgacttaagtgagatgacaatctctctcttattctcactctgtagtccctctccctcctcatccccttccctgccttgctctcttctctctctcattacattatagctggtataggctggtagggaagttgtgctccatgcagtagttcaaagctccagataccttccattgttgttctgccatcatctagaccagcggtccccaaccttttttaccagggactggttttgtggaagacaatttttctgtggacttggtggggggatggtgtaggcatgattcaagtgcattacatttatcatgtactttatttctattattatttcattataatatgtaatgaaataattgaacaactcaccataatgtagaatcagtgggagccctgagcttgttttcctgcaactacatggtcccatctgggggtgatggagatagtaacacatcatcaggtattagattctcctaaggagcccacaacctagatccctcacatgcatgcacagttcacaatagggctcgcactcctatgagaatctaatcccgcccctgatctgacaggaggcggagttcaggcagtaataccagcaatgggaagcagctgtaaatgcagatgaagcttcgctcgcttgcccgccactcacctcctactgtgtggcttaggtcctaacaggccactgactggtactggttcacggcctggggcttgaggacccctgatttagaccacagattgatagattatggctggcagatcaaatctggcctgctgcctgcttttgtaaataaagtcgaattggaacacaaccagccccattcatttatatattatctatgtctactttagcactacaacaccagaactgagtagcttttgacagagaccttaccatctggccctttatagaacaagtttgccagcccctactctaggacatggtccttgtgtgcatgttttcattccagattgtgggaagagggatgggcaagagttcagagtaaataactatattttaagaaattgttgaggaagttgtatatatgacttttgctcagaagccattgatgagaactagtcatgtggccacatctggctgtaagggtgaaaggaaaacgcagtccctgattgggtggctttatattcagacagtactcatgacaagaggataatgtatactgatataccaatattattgacatttttcaattaaacaatctaatgtacagataagcaaatttactttcttaacgacacaggggtagtaagaagtactttctgacatcagcagaaaatataatagagttgagctgctagaaaaacaaaaacagttaaagaattgggctacatagagattgaagctagaatactattcagaatccagggcagcttcagagacctgaatatcgggataggtgattttcagaggacctactttctttctctcctcctgaaaactggctttctaattttgtacttggtatagcttttctctgtatccccttttcttcttactcttgtattttctccttatttttctcttgaccataatttcctcatgactctagttttacggcatggcatttcttgattgatcttttcagtctcacttctcaaggtcctctttgttcattgccttgttttcacattattaccctgttcacatttctaaaaggcagagtgaattctgtccagattgttgtcttcagagtttctggccacttttgcaatggcttcctgagggttaagaattacgcttgtttgtggcattggtgactacagagggtggggtcatttggtataaaagattataaaagatggctttcaagggctttcccttgaacaagggaatggatatgggcagttgacaggtttactataataccatagtcataagagctacagcctctcttaaacacttaatactgcccagggccgttatgtgtatctttttatttgtcataactaaagcttgtcagtctgctcttatttgtgaataagccaaatatcaccaattcttggcattatgtatttgtaaaaaacaattctttgaagtttgaggattcccctagtgtagatagctgctggcagttacaatttgttaatgaacatgaacctcttggtaggtttagctgtaatagagggactgagtaaaaactcaaacttcttagatgtttgagaaagttggatttataacttcacattttattgtgttcatcttatcacttcccacagcagcaattttcacctcaaaattctcttgcattgtaggaatgaaggcttagtgtgtggaaggcactgtgttgaatgctctacaatacatttatttaattttcacacaaatgttgcaaagtaggtaccaatattatccccattttacagttgaggaaactgaggtacagaaaggtcgagtgactttcctcaaagtcacagagctagtaagtggcaaagccagaattcaagctcgggtggtttgaattcagaggcaagtacttcacccccatagttcataaagcacttgagtatcccgtaccccaaattttctagtgacacagattgtaatctgttttggatcccttttctcctcataaactactttcaggaatgctctaagagctctgtgtttaccagctactgatgtctctagaaaaaccatcagagtccatcaagtaaactatgcatgttaaaaaatatttagtgatatgtattcatgatggatgctaaatcttccaacggagccatgaaggtccattggctaaatgaatgtgcttctagatttgtctaagtacttactgtctagcataaatagttcacattatcttggtaaatgcagagggttgattttcttagtacaggttatttatacagccacaaatagtcccagttggtaatgacttttgggtgagtaatatgggttttaagtcttttacaaatatatgaaattttatggtaagtatgcagtgttacattaatatacaactaatgtcagaatggcctttgctgggatagtaatgctgataaaaattttttttgaaaacattcaggctgcaaatataacagttggtctgcaaaatttgaatgtactccttatccctatttactctcatcttattctgtctataaattatgctctacccttcctttaacacctggtacaaaatgcacgtccaggaatccagtcccaattaacttcacctaatgcatcactccctccctatgtgctcttagcacctctagatacagttcatagagacatttgcttttgttttcatgttttttgtaagtggtcttaagtcacttcatgtatgtttgttttgtcacattatataaattgaattgtcttcatgatgtcaggaagagccgttgcaaacagaaggtgaacagtaaataatgttgactgactgcccttaaagaatagaaacatctgtttgcttcaggtcaagactcttagaatactcattgaatatggatttccttaatcacaaggacatgccaggaagaaggaaaggaaagcacttatagtttttacaacaaaaaacataaaaaaagaataaaacaaaatccctctctgtttgattttcttcatgcccactctgattgcttcagactgactgattaaggctgtccaacagtattttgtaaataagggataaagtcctcctacacattaatttcttgaaaagaatatatggagatttgggtgtttcattcctccttaaagttgccataatgctttgtagaatgtgctagtgcaccatcttgcttctgtggtcaggtgaagaagtgaacagggaggtggtggtggtgtatgtgtgtgtgtgtatagagtcttctgtcataatattgacccccttctgctgagatttgtgtgatccctgatttatcatcagaaattgatcacaagagtttatctgtataggagaaaaagcaaagccttggaattgaagcaaggaaattaagagctcagttttgcttgaactcataaattataaattatgaagggaagttgacaggcctgaatttggtatgatggagaagtattttagaaaagatcaatgaaattcataggtatttaatagagaagcatatggacaagcatggctccaaatccagaagctttggagggaaatgtcctggtgatcatagttctcctataccatccctggtcccgagctgtgtccaaagaattggctcaattattttctagctctaaggatgctggtctagcctaggaatgacctaaggagtcaactctgctggcttatttttgctctcttaagactagtttaagttaggatatccagtgccgtccttcaaacatgaaggcagaccaattaatctgccatccataggacacgggtttgtgtagttgatcaactataaaggactgggcattcttgatcttctactctttctcactaggtctcctttatgaccagtacaaccttatgcttggtcctgtgctcacagctctttgtgtgtttccactatcacagaatgtgttccattttacttggtaaaataattttttatgcaactagtaaatatagttagctatttatatgactgtttccttcatcagactgtcagctaaggacagggtcatgtcttattctcctctgtatcaccagcacctagtaaaaagcctgttcataaatgttctataaatggatgagcccaagctgtggcctaggtgaagttagttgcagtaatgaaaatagtaacagataactgatatttagcacttactaataccaggccttgcactgagcactgaaatgaactatatcacttaatcctcacaaactactctgtgtggagttatcatctacattcataagtgaaaacacagaggccgagagatgttaagtcatttgcccaaagacacacagctattaagtattagagtgaaaattcaaaccaagggatgtcagattccaaaccttcaacattacactgcctgctaggatgtcaatctcatgagaagaaaataagcttggcccatttggtggagagctcagagtgacttcaggtttctgaacccaatctagtttcatattagaacagactttaatccaaattatcccagaaatctggggacttactagtgaaatcagatttttttccagaagaggtagactactcctaatttggggataaggatgctagtgctagaagagacttatgtggcatggtggcatttggtttaaatagtttctttataattctccctcatcagactgcgtgttttctctgttatattttcctaatgtcagggattggacctctaagaataggtgaaaagtgtccctggcagaaggaatataacttatgatggtcttgaagtgaaaaggagcttggcataatcaagcagcacaaaagtggccagtgtggctggaacacagggactgagtggcagaaacgctagatgagcctgggggcaggagggttgtggtagtggtgaactaattcagagcctccacagtacttggggtgagtttagtgggacagtgttacgaatgaataaataataataggtggagattctcccttactctcagtgaagtaaatcccttgaatatattggacatggcctctttgttgaattatctgctataatggactgtgttctaaggaaatccagagtgcagtcaggccctgaattatactcagaatatcttcttaaagaacgtagtctctatgaaaaattcaggagtagagactttgggccaagattatacagttatatctacagagagatataaatatacagataatttaatgaaatgaaattatttaaactcaatatactctaatagatttattaggtatgttgaaacctttagtcgctaattacaacttaatgaaataacaacttaattcccgttcctactcccttctttttcaatctacagttcacatagcaaattattcatctaatggttaatcatctgactcctctattagactctgatgagatagcctgaggtttgaagaaaatgattcttgaaagacacaaggatttatgaaacccagggggctccaggcatctgagcttccttacttttctattgggaagatgggaaggtggggaggtcccacattttgtacttttctccacagaagcattggagggggaggagaaggtatgctgggaggtgacctggcaataaagggaatagaactaacaattactgaatgcataccatgagtcagccatcttacattcattatgccatttaactggcacaacaaccatttgatacaggtaccatttgttatcattttacacatgaggagatggagactcagaaaggctaagtgacttgcccaagctcatacagctagttaggttgtggagcatggaatctaataacgtgcaactgtgggtgcctgcaaagtttgctcttccaacttactctgtgcctgcttctcatttttcctaatacctgaattctccttgcctctcagattttcatcaggaggtggcttctcaatctggaaatcagggcccatgagggaggaaagctgtagtaaatatgctttggtgagcaactagcttttctatttccaggatatgaacatctcatcagctgaataaacttaaggttatttctgcccacccacccacctacactgtcactattgctacctgacacttcatgataacatcacccttcaggattctccaactgcacgaaatggaaccccagagataatttgaggctgagctcagaatttatgtaccatgtatcaaaaatgaaacgttttagtcaggtttcctgagacccgatagccccagctaaactggaggcgagagggaaatctttttgagtatggttggttagggaaagttcaagcctctgtagaacatgatggtgaaggacctttgacagcctaaggccagaataaaggcaatgggtgcttggagtcactaggattaatagttctttaaaggcggggaccaagttttgtttttcgtttctagcacctagtacagtgacttgcattaagtaggtgctcaacagatgtttattaaacattcaagtgtaaaattctataaaatattaatacttgaagataagtacctatttgttaataggcatcttttaaagtaattcaagctataagaacaaagtcaagaaagtatagtggtcctttgggggaatagctatgattaagagatagggaccctgacaatgatgttgcagagccctagatttttgccccaactctgccattaactggctgtgtgcccatggacaagtcacttgactactctatgccccatttgtcttatctgtaaaaatagagggtaaaatgttcctacaagtgttttattcatatgttcattattttatgcacataataaaaatacccaatattcatttagctcctcgcagattacagactcatgtatatcacctcgttgaagccttccacaatgtggtgaggtaaatattatctcagttttacagataaagaaactaaggttccggttatagaagtaattgtagaagactactgctaagtaagtcttttgcctcaaatccagtcctctttccaggtaccacagctcttttcacatagtaattagctgtatgtaaataatgcttcccaagtgcttgaaaaatcatttgttcccttaagtcttcaaacatctctcctccaattgtgtttgattgttaatttactcagcaaattcatttccaaatttcaagccagctgaagttgacttactaggaatttcacattctctaggtcataattaacaaggcttgcctttatttttctgcaataagccttggttttttggtgaaggaaatgcacatgccctgctggaagcttaggcagattatgaggggccgtactttttagcttagctagaaatggaatctatgtgggaattgaactacctctatttcagctaacagcagaaagtacacctgcctttgcttgtatgcagattcatatatattggtgcagatatgacattattaacaaacctgtacatgtacccttttagaatattttgtcttccattaatggaaaattaatatatccaatgacaaaatatcaaatctactactggatattttaacatatattatgacaaatcagattcccttaccactttgtactgttgggaatgagtcctcaaatgtaccctctttccctagggcatgacacactggctacattttcataatttaacaaagtataaagggactttggcagatatcaccgaatctgtcagatttaactgcttgtaaattcaattagtcgggggaaaaacagctctggagaatatatcaaaattcaattagtcagcaaatcgaggtttttagcctactcttttgggtaatctatcaaaagggaaagggtacttcacacttatgatcaactaattaaatgcattaggccctgatgggatagtttttaatattcaccaccctttcaagtctatttggccagaaaacctagtatgaaagagttccaacagtaggcgttatctaaacaagtgtatagaatgtctaattaaggtacaggctgaaggtgtttccttgccttcttcttttaattgattgaaagagcctggctctaaattttcaataccttttaataaccaatttaagtgttactgggatgataattttattgtacaccaaatactgctttcttttgaaaatcttatcactaatgaaggtgtttatagctattaactgattatagtagtgctccttcaaaaaatgggtttctagtgagctaatgatatatcttaagtgttttgaatgatgtttagaggaattacaatgtggagtgactaaaccagaggctgcaaacattgtatgggggtgttctttcaaagtaaatatgtcatttctgtgactcataacttaactttgagtagatttatcataggcttgctgtaattgaattgtttcaaggctgtattttcttttgtttgaaattcatcccacagtagtgcaaatgttaacaatattgttttgcttctttataatcacttgtcaccctccccactatttgggcaaacatttactgggaagctttactccctcatccctgaaaggagaggagtgtggcaggtcttgtcattctaagacagcagttaagaataacaacccatgaggaatggtctggattaatgtttttgccacttgcagctctgcaaatatccctgcttgctctctgactttggtgaagttacagcttctttcaattttggcttcctcatccatgaactcccaatctcatccagtttaacatttccattcctttttatctgttggcattcatatcatcacacagttgttcttacctttctttagtcttttgctttctatctgactgtctttgggtaaccttggtcttgtagtccttttcaccttgaaactggctcaccttatttttatctcctcatgccttctatttattaatgcaggacagcagagccacctgctttctaatatttgcgctaggcccttttttgatgacattgctttccagcctttctctctgtaatggggagacctttttatctgtcaagtgtcactaccctacaggggaataaatgaattgaaggcaacacagaaatataaattaaactaatttatacttatctgatttttaattagagcaggacacatcaaagtttgatctgtgggtggcaaatacatttatttactagatattgcatcaatttgttccctgcataacacatccagttgaactgtggtgtgactgagaggtggaatgatataggaagcaaggaaaatattatagaacacaggaattaagggattgttatcatctgagcagggaattggggaacattgaccttaaagttgttataatcagcctcaattatcaactctatctagggcagatctttcaaatccaagttagtttctctctggcttctagaacactcctgggctgcttttctgattggtaggtgcttggggaatacaaactaattttaatactagcctgccaaatttaattgagaaggaatatctgctactgaaaattaaaaatttgtaagatagatgattggttttggataatctgccctttcagattaaatgtatgcaatgaatttaacatgttataaggaagatctatatagcgcagtgcttaagaatgtatctctggattcaaataagttgaatttaaaccacaggtacactttggctctttgaccataggtaagctacctgtcactctaaacactgctgtagcagctcagacagtggtttttttttttccatagtgggctgttgagcctgtcccattcagagaagacactctgaaattttaagaataaaaagcctggataatggcaaacccactaactgatgtttcacagatgactgtaccaagaggtgctgaggcttcaaaagtaatttctataagtaaaaagcagagaatggggaaaagtagcctaacacctttgaaccagctcaacttctctcttttttcacacctcgcttgaatggtcatactgacgagtactttctatatgttacctctctcctgtccctttttctgtcacttgcactttgtcttctccgccattctcttcttacccatccctcttctgtgtgtattgcctttcccctactccccatattcctatctctgtgtctcctctatcattcatgactcttctctttttggcatgtgtaatattgaattcgagtttagttaaaatatttgttaacatcatcaaaacaaaacacttttatgtataaccgtgatcaagaaagtgaaaagataatgtacagaatgggaaaaatatttataaattatattgctaatcagatattagtatccagaatatataaagaactcttacaactcaacaatgaaaagataagggacacagctttaaaaaacagcaatggtcattgtttcaaagaagatacgtaaattgcaaacaatcctgtaaaaagatgctcaacatcattaatcatggaaatggaaattaaaaaaagcagtgaggtaccatttcacatctatttgtatagctataataataaaaaaaagaaacaaacagcaaagttgtggggaaattagaacactcctgcattgctggtggggatgttaattggttcagttactgtggaaagcagtttggcagtttctcaaaaggttaaacagagaattgccatatgacccagcaaatctgctcttagatatatatgtgaaagaactgaaaacagagactccaacaaatacatgtacagccatgtttgtagcagcactacttaaaattgccaaaaggtgcaaatgggccaaaagtttatcagtggataaatgggtaaacaaattatggtacatacatacaatggaatattatttagccgtaaaaggtaacgtacaatgtggacaaaccctgaaaacatgttatattaaagaagtcagatgcagatgtagaaggctacatattgtgtaatccacttatatgaaaatccagaataagcaaatccatagagacagaaagcagattagtagtttcaagggctaaggtgaggcagagatgataaagaaaatgcttaatggctatggggttttgcttagggattagtgaaaatgttgtgggactagactgagatgttctgggactagccttgtgaacgtactgaatgccactgaattgttcactttaaaatgtttgttatatgaatttcacttcaatacattttatgtacagatgtacatatactcatttgctgcgtaacatgggtcaatgatgaattacatataggatgatggtctcataaaattataatggatctgaaaaactcctatcatctagaaaagtcatagccataatagcacaatgcattcctcacctgcttgtgataatgctggtgtaaacaaacctactgcatcgccagtcatataaaagtatagcacatacaattatgtacagtacttaatgcttgatagtgattataaatgtctatgttactggtttatgtatttactatactctttatcattgttttagagtgtgctccttctacctataaaaaaaagtcaactgtaaaacagcctcaggtgggtccttcaggagatatgccagaaggcattgttatcataggagacaacagctctctgcgtgttattgtccactgtacctttcctatgttcaggtctgtttagatacacaaatactgacctttgtgttacaattgcctacaatattcagtacagtaacatgctgtatacatgtgtagcctaggagcaataggctgtaccatatgacctatctgtagtaggctataatctaggtttgtgtaagtacactctgtgaatacatgactgtatgcatgttctgagatatacacacacccattaaagctattgatcttgtgttttacctttatgtgacactttacctttaaagttctctttgtgtgcatgtgtacaggggttgggaagaagcagttcagtatcatttaataagggggagaaacccaaccccaagatacttgatgaaatctaaggaatacagtctaagtaacacctacctgctcctcccaccaatataagaagagctaaaatcattaatgcatgtatgtataggaaaataatgaaagacaaatatggcaaaatgaggtcagttcaaaggatttatctgtgtgctaagagatgagatagaggctagtggcatgagaaaagcaaaaatggaaataagaggaaaatgaataggtagaactgagggcaatgacctggctcattggaaaaaaaaaagattttttggtaaatattctgtattccaaccatgtctaatagggatttatgaagtgggggaggagacactggaagagagagagagtaaatatgaatgtatttgtattaaaatctctagaataaatgtagtcatataaatctctggaatacaaattttcacttcagtacttcactgtgcaaaatagtttctgaggcaatgaaggaacataccagggctattagagaaagctatgggattggcaaatcagtgagggaggacttgccagctttgaatgcctagtaagtttatttacagtatacccctgcttggtccatgaactgtagtcttaccacagaaatagctggaattttgagaaaaactgtttttgaagttataaatgatcagctgctgtaatactggcttataagaccagatagtgtggccacaagtgaaaagagaataacctaggaagttcccctcttctccatgagttgtcattaactgtttgattgttcccagcagtattataactctcccttttccctggagcagtctgccatttttgcaaagtgaggaccaatttaatggggtttacttaatggattgataaggctgaggggcaaaggtttgccacagggaataaattgatggttaatgtatttttgcctccaaggccagaaaggagacataatgaaaagagtgaagtgaaaagataagactagggtttaaacgacagcttgtggtcctctgcagatgattcatttctgctgcttggcatgtgctttagacctatatgtttacaaggacaaaaatgggaaaattactccctgatcctctatatatgtacaatatatataaggacctattcctaaggtccttgtaaatccctagcccttaaataaatatacatttgagagaaaatatcacaatatagatttaacattgtatggagtagggagtagaccagtaattttttttctcactgaacgaacatttaaaacattaatatcctcttgcatcactaagagcagtaagactgcaccatcccctggttattagtgttcatagcaagctgtgtgaatcttgttggcaaaactttactagcctttgtagcagcccctgacccaggggcatctctacaaatcccctttgacagctgttttcatatgcactgagaatagacaagaagaggtagattttgactgaaacaggaggcattttggtgagagttatttcaaggaattttattgggaggaactttttttcagattgataataaaaacaggtccataggcaaaagctttataacagtattttaatggcaaattaggtgtgtttgcatcagttctgtaagctttcaatgctggtgttttaggagacaaatgtcctactttcctacagaattgtccctggtgttactattggagagcaaattatgtactgcatgggccctgggatatctttaattagtcagtgacgaaagctgggaaatctttcaccaatattctttaactttcaggtttaggatggctctaacctggcctgggtaaagaataatggacttggtgaccctccaaggccacttccatttcagtgattctattacctacttctgtcaatatttctccacttcctcctcccctgcagaaatgagagaaatacaaagcaatttgtgatcagcttccctaacaagccccctacacagaccacgaatatgagctcaaagcacattacttgaaattgtttaaaatgtaatcccttccaccttactcttgttttcactcaggacagagaacttgtttttgaaattcagactcttatttctatactcagaggcatgcaaccacaatcaagatggggtttggttgaattcaagttttttaaacctattcttcatgtataacatcacatctttttatgtgtatatatatatatatgtagaattatatgtgtaataaattacttcagttaagttgtgtgaggctagggtaggctgcagtaataatcaacactcacatttcagtggtttaacccaatagaagtttacttcttctgagagtccaggttgctttccagggaacccgtttccatatagtgactcaggggcttagactgctttgatctgatagtttcagcctcatctctgaaatgacatatgttcacttcccctcatgggccattggtcagaattaattacctggctttgcctaaatttaagggggcagagagaagccgagaaataagtcttccatgtttccagaaggagaggagaatttttgatataggtgaataatagggatatatacaagtttagtgaatgagtctgcttaagaaaattttgagactatggggtttttttagatataggatcatgacatctgcaaatagggatagtttgacttcctctctttctatttgggtgctctttatttctttctcttgcctgactgccctggccagaacttccaatactatgttgaatacgagtggtgagagagggcatcctggtttcatgccagttttcaaggggaatgcttccagcttttgcccattcagtatgatgttggctgtggatttgttatatacatggctctcattattttgagttatgttccttgatgtggtttggctctgtgtccccacacaaatctcactttgaattgtaataattcccacctgtcaagggtgggaccaggtggaaaaaattgaatcatgggggcagtttcccctatgctgttctcatggtaatgagtgagttctcaggagatctgatggttttataatgggcttccctcttccttcggctctcattccatctcctgccaccctgttaagtggtgccttttgctgtgattgtaagtttcttgaggtctccctagccatgcagaactgtgaatcaattcaacctcttttctttataaagtattctgtcttgcgtatttcttcatagcagtgtgagaatggactaataccttcctttaatgcctagtttattgaaagtttttaacatgaatagatgttgaattttctgaaagtctttgctgcatctactgagataatcgtgtggtttttgtctttagctctctttatgtgatgactgacatttgttgatttgcatatgttgaacaaagcttgcatcccagagataaagcctacttgatcatagtgaataagctttttgatgtgctgctggattcaatttgccagcattttgttgagaatttttgcattgatattcatcaagaatgttggcctgaagttttcttttgttgtagtatctctgcaaggttttggtaacagaatgatgctgacatcatgcaatgagttgggtaggagtcccttttcctcattttttgggaatattttcagtaagaatggtaccagctcttctttgcacatctggtagaattcagctgtgaatctatctggtcctgggctttttctcattggtaggctatttactactaattaagttttggagctcattattggtctgttcagtaaatcaatcttttcctggttcagtcttgggagggtatatgtatatgggaatttatccatttatacccagttttcttgtttgtgtgcatagagatgttcatactattctctgatggttgttggtatttctgtgggggtctgtaataatatccccttgtcatttctgattgtgtttttttgaatcttctcttttttcttcattactctagctagtagtctattttattttctattttttcaaaaaaaaaaaaaaaaaccagatcctggattagttgatcttttgaacggtttttgtgtctctatctccttcagttgagctctgactttgattatttcttgtcttctgatagtttgtcttagcccaaactcttcttaagctgataaacaacttcacaaagtctcaggatacaaaatcattgtgcaaaaatcactaatattcctatacaccaacaacagccaagccacgaaccaaatcaggaatgagcttctattcacaattgctaaaaaaaaaaaataataaaataaaatgcccaggaatacagctaactagggaggtgaaagagctctacaaggagaactataacccactactcaaagaaatcagagatgatacaaacaaatggaaaaacattccatgcctattgataggaagaatcaatattgttaaaatggccatactacccaaagcaatttatagattcaatgctatgcctattaaacaaccactgacattctttaccgaactagtgaaaactattttaaaattcatatggaatcaaaaaacagcctgaatagccaaggtaatcctaagaaaaaagagcaaagctagaagcatcacactagccgacttcaaactatactacaaggctacactaacaaaacatcatggtactagtataaaaacagacacatagtccaatggaagagaatagagaacccagaaataagaccacacacaactatctgatcttcgacaaacttaacacaaacaagcaatggggaaaagatttcctattcaataaatgttgctgggataaatgactaacgatatgcagaagattaaaactagatcccttccttacaccacatacaaagattaactaagatggattaaagacttaaatgtaaaatccagaactaaaaaacctggaagacaaaataggtaataccattcagaacatagatacggacaaggatttcatgattgaagacaccaaaagcaattgcaacaaaagcaaaaattgacaaattggatctaattaaactaaagagcttctgcacagcagaagaaactatcaacagagtaaacagataatctatggaatgaaaatatttgaaaactatgcatctgactaaggcctaatatctagaatctataaggggcttaaatcaacaagcaaaacacaaacaatcccgttaaaaaataggcaaagaacattagcagacacttctcaaaagaagacatacatccacccaacaagcatatgaaaaaaagcccaacatcactgattattagagaaatgcaaattaaaaccacaatgagataccatctcacaccagccaaaatggttattattaaaaagtcaaaaaataacagatgctggcaagtttgtggcaaaaaaggaacacttatacactattggtgggaatgtaaattagttcaaccattgtatgtgacagtgtgacacttcctcaaagacctaaaacagaaataccattagacccagcaatcccattactgggtatatacctgaaggaatagaaatcattctgttataaagacacacgcacatgtatgttcatttcatcactattcacaatagcaaagacatggaatcaacctaaatgctgacgaatgatagactggataaagaaaatgtggtacatatgccatggaatactatgcagccataaaaaacaagatcatttcctttgcaggggcatggatgcagctgaaggccattatccttagcaaactaatgcaagaacagaaaaccaaatattgcatgttttcacttatgattgggagctaaattatgagaacacatggacacatagaggggaacaagacacattggggcctatcagagggtggaggttgaaaggagggagaggatcaggaaaaataaataatgggtactaggtttaatacctgagtgatgaaataatctgtatagcaaaccctgtattacttcattgacagaacccccatgacagaagtttatctatgtaacaaacctgcacatgtacccctgaacttaaaagttaaaaaaaaaaaaaaaaaagaacattttgattccttcttttatggtctttatccaagggttcatacaaaaatgggaaggtaggcctatttatttgtaagttttcaaaactgaattgagctgagttgcctgaggagggggggcagacactcaatcaacaaacacattcttttttttaattattatactttaagttttagggtacatgtgtacaacgtgcaggtttgttacatatgtatacatgtgccatgttggtgtgctgcacccattaactcgtcatttagcgttaggtatctctcctaatgctatctcccccccccaccccacaacagtccccggtgtgtgatgttccccttcctgtgtccatgtgttctcattgttcaattcccacctatgagtgagaacatgtggtgtttggttttttgtcattgcgatagtttgctgcgaatgatggtttccagcttcatccatgtccctacaaaggacgtgaactcatcattgttatggctgcatagtattccatggtgtatatgtgccacattttcttaatccagtctatcattgttggacatttgggttggttccaagtctttgttattgtgaatagtgccacaataaacatatgtgtgcatgtgtctttatagcagcatgatttataatcctttgggtatatacccaataatgggatggctgggtcaaatggaatttctagttctagatccctgaggaatcgccacactgacttccacaatggttgaactagtttacagtcccaccaacagtgtaaaagtgttcctatttctccacatcctctccagcacctgttgtttcctgactttttaatgaccgccattctaactggtgtgagatagtatctcattgtggttttgatttacatttctctgatggccagtgatgatgagcatttttcttagtacctgatatggtttggctctgtgtccccacccatatgtcgacttgtcttccccatgtgtcaagggagggacctggtgggaagtgatgggatcatgaggatggatttccccccatgttgttctcatgatagtgagggagttctcacaagatctgctggttttaaaagtggcagtttcccctgtgtactctctctctcctgcagccatgtaagacgtggcttgtttccccttcaccttccaccgtgattgtaagtttcctgaggcctctccagccatgtggaactgtgagtcaattaaacctcttttgtttataaattatgcaatctcaggtagttctttatagcagtgtgaaaacggactaatacagtacccatggtatatgcagcctcaatttttgaaaaatgatttactgcaggattcttttaagttaagagtcagcaaacatttttctgttaagggccagatagtacatatcttcagttttgtaggccatacagtctctgtgacaactatttaacttccattactgtgtgaaagtagccgttgacaataagtaaacgaataagcttagctatgttccaaacaaagtttgtttacaaaaacacatagtgggttgtagtttctgactcctgctttaaatagagagactcccttgtgaataagaaagtttaaagatacctgtttaccaaaaggtgagcaagagcagagaaattttaaaactaagtcagtgacagttcattagaaacaaagacaaaactactgtgaaataagccaatgtgaaaatagtttatcatttgtcacaagtgatttacattttgtatctaattatatgtgaacctgtaagttaagatgctcttgatcacaaggaatagaaaaaaattcaaactggcttatgcatataaatgtattggttcatgctatacaaaagttctgaaatagtctttatgtagtttcatcagagcctcaacatatttctctttcattatcttgactctgcctttttgctagcatcagctttgtcccctggctggccaacattaattggggctacttgctttcatagtcacatattggagaaagaatggatatctcttttttagccattgaacaaaagcactgtgctttctctgttttatgtgcccttaaaccaattaatgtagcaagggaatagcattactctgattgtctcataccaatctgggtattgggtgcattgctggagctagggttgaggtcaaacctatccagctgaaagactgaatgaatgtttaaaagcaactccattaccttccacaatgaccgcttcaccctgttgcaacttgtagcttcaccgtttcatcctgttgcaatttgttgtagcatatatgtgcagagaggtgggaaggccataggagaatttttattattagcaagaacctcaacccagagatctttgaatgtggataccatgttgtagcttttgctgaaagccatgtagacaccgcataatgtccctgatttgcctcagggaagatcagatttcttgctgggagtgatggtggtcacaaaggtcattggatatttctgtgtgctttctgcagatagtcatactggatataattaaggtatacaagaactgtggagaataaatatgttgttaggggaatgaacagctaatggtaagctgatatccagagtatcctgtactacatcaaaagatctcaatctgagtccattctaacagtattctatttctacattccattatgctatgcttatttttggttgccatatcttaaaacaatgcatcagagttgaagaatgtccagataaaattaccataggcatatctgtcacaaaatccagaatcagaagcaaatcgacattgttgggttttattagtgtcagtgatacaatggcatcgcaaattttccaatgtaattcagagagatccaagatgaacaaaaatattggggcttttcagtctggacaaataaatactgaaggaatatcattaaaacctataaaataagaaattaaacataaggtatacataaacatatttattaaattctaatatattaggacagatggacacatattttagctcaaaacaattttaaggcaaatgaaaagacatgcaccttcataaaatgagaaatcaggtcgtagaaataataagcacctccagcaattgctactagctgggcacatacccttgaaaaacaagttcatggtagttaaagactgatctgtctgtatcaaatgatgaagggcaatgaagatgttttgtagacatcctggaactttgagtttagcagcagtgagaacagctttgctgtaccttgaactatacccctttatggttcatgtagcaggactggtattttcttcttctaaatatctactttctttgcttgctgtacctgtttgtacctaaccttcaagctgttccattttaaaacactgtcagtccaactgcctgatgaactgagaagagcttaaaatggacaaagggcatgaacaggcactactcaaaagaagacattcatgtggccagcatatgaaaaaagtctcaacataactgatcattagagaagagcaaatcaaaaccacgatgagataccatctcataccagtcaggatggcaattattaaaaagtcaagaaacaacagatgctggtgaggttgcagagaaataggaacgcttttacactgttagtgggaatgtaagttagcttaaccactgtgggagacagtgtggcaattcctcaaagatctagaaccaggaatactatttgactgagcaatcccattactggacatatacccaaaggaatataaatcattctattacaaagatacatgcatgcgtatgttcattgcagcactattcacaatagcaaagacatggaatcagcccagatgcccatcaatgatagactggatgaagaaggcatggtgcatatacaccatggagtgctatgcagctataggagggagtgagatcatgttctttgcagggacacagatggagctggaagccattatccttagcaaaccaactcagaaacagaaaaccagacaccacatgttctcacttataagtgggaactgaagaatgagaacacatggacacagggaggggaacaacacacattggggcctcttggcagggcagagggagagagagcatcaggataaataaccaagggatgcggggtttaatacctaggtgatgagttaataggtacagcaaaccaccatgacatacgtttactgatgtaacaaacctgcacgtcctgcacatgaaacccagaacttaaaataaaaatttaaaaaaatgcatacaaatataattgaatagaatacctatacaaagatataaacatagaactgtgtaatttaacaaatacctttctttaagactcaaaaactcattctcaatatattattgaccataataatgctgcaattgtcaaagtctggattttcacacagataggtttgaaattcagccatgtattttgataagcgctattgtataggaattggagtgtactttcattcctgcttgcccttttgttctttctggacaatatccaaagcacagtatcttgctctaatagctattcttgactggatttctggcaacggcatttccttgcattgctcataggtgccttgtttagtgccctgcccatttttagtcctatctacttctaatcgtggtaaaagagggtgattgttcatagcagaggtaataaaacactatctgtaaagaggcaaatagtaaatacttcagggtcataggccatacagtctctattgcaattactcaactctgccattgtagcatgaaagcagccatgaatgatatataaatgaatgagctagctgtgtatcaataaaattttatttataaacaaaaatttgaattttatattattttcatttgtcatgaaatattctttaaaaaatttctaggtcattaaaaaatgtcaaaaatgtttttagctcatgggtcatatatagaaacatgggatgggctggatttggccagtaggagtagtttgtggaacacctagtttacagtgaggatattgagagggagacagggtctatgttttggctttgcttcaattcctttacttgtagtgctcttatattgtggaagtcagctttattttgtgttagctgtttcctcacttaaggtgataactctgtccatgtgttcaaaatgttaagtgagcctcaacttgaaagaactagaggaggtggtttctactttgtctctcatattgcttttccatagtatatgtttggaaactctgtaagaaagcagatcaaatattttctccatgcattgttttacagtaaaagcctgcatgtagcaccatgtgatgtacgagttgtctgcaaagattaaatcctaagtggacatacacaggacatgcatggaaaccagcagaatctgacgaatggatggtatagcaaggagcatatatgataatataatgcagagcatgcattctaatgaaatatattgttgccagtagcattattttgattacaaaaatataattaagtttaattgtaatggtaataataatgaaggagaaggtaagaaatagggaagccttcaagaacatagattccttctttgccatgctatggtaggatggtcatccccttatcagattgctattcacccagtatgaactggtgtaggcatttcagttatttgcagctgacatccattttgacagagccagtctccattgtgtttgaattggtacccatgatctattttgaaaatttaaatgtgtgttaatcaaaactgctagattgagtcttgcaatggagcataagaacaaagttgaagggtgaagtatcaccactgattgtagaaaatatttttaaaatgattaatttccaaaactgtggatgataaaatataaatatggtcagttttcagaaatattgcagatacatgtaacgtcctgttactaacccttggaaattctgataaaatgtaacacctcaggatgacacaaaaaattccaacttgccagaaaaaaagactgtaactgccaggggtggggtgcagtacagtcagactgtgtaaattaggaatgtgggttttcatgaccatgtaacaaaggaggtgaggtctcaggtgtttgtaaagtgaggttttggaattacagatccctaaggagagctggtacccttgaatttctaacctttaataaaagggtgaacaacaacaaaaaaatcctacccacagagaaatgacaaggaatttggctctttgcctgagatttggatggaaaaaaaaatctcctacagagatttgtaactataggcttacaattcgtttgtgtttggagtttcattttctatgatccccaaacttagaaggtagcaaaaaattggttctgagctagtgtctcccctgagtttcctggcagaagcagtcaaaagagcttttgaggaacatacagtacaggctacaaggtattgttgcagaaaaagtaaccctttataagacaaattcacaataaaatgttaccaacatgtgactaaacagttcaccctgatgaaagtcagtagacacaacaaacaatagaattatatccctaagaattagacatagcagaatagagatacaggagataattgaaaattaatgttcatcatagtgactgaaaagaagtcaaaatcctaagaattgaacaacaggctttgagaacaaaagatttacaacagaagaaaataaaagttttagaaaggaaaagtatgatttgatttgtgggctaattattggataatatggagctacagagattagtaaactgataaatagtctgaggcagtcactcacaatgcgacagagggatgaagggatggcaaaatatgagaggttaagagacacgcaaatgaaaagattcaacatatatctaaaaggggtgctaggatagcattaggagatatacctaatgttaaatgatgagttaatgggtgcagcacaccaacatggcacatgtatacatatgtaacaaacatgcacattgtgcacatgtaccctaaaacttaaagtataataaaaaaattagcatggtggaggagcaatattcaaagagataatggctaataattcttcaacactgatagaaaacccaatgcagatttaagaaactcagcaaacatcaagcatattacgtaaacaaaaggaatccacatgtgtaatgaaactggagagccccaaagaaaaatggataatgttaaaaaccaccaaaaaggcagatcatctataaaggagcagcaaatagagcaactatagacttcacaacaaaaataattgaggccattcttgttcatatggcaatgcaattttcccaacaccatttattgaatagggtgtctttttcccactgtatgtttttgttgactttgttgaagaccagttggctgtaagtatgtggcttcatttctgggttctctagtctattccattgatctatgtgtctattttttaaattatacttaaagttctgggatacatgtacagaatgtgcaggtttgctacataggtatacacgtgccatggtggtttgctgcacccatcaactcgtcaactacattaggtatttctcctaatgctatccctcccctagctccccaaccccgacaggccctggtgtgtgatgtttctctccctatgtccatgtgttctcattgttcagctaccacttatgagtgagaacatgtggtgtttggttttctgttcttgtgttagcttgctgggaatgatggtttccagctttatccatgtgcatgcaaaggacatgaactcatcctttttatggctgcatagtattccatggtgtatatgtgccacatttcctttatccagtctatcattgatggacagttgggtaggtttcaagtttttgctattgtgaatagtgccacaataaccatacgtgtacatgtgtctttatagttgaacgttttataatcctttgggtatatactcagtagtgggattgctgggccaaatggtatttctggttctagatccttgaggaatcaccacactgtcttccacaactggtgaactaatttacactcccaccaacagtgtaaaagcattcctatttctccacatcctctccaacatttgttgtttcctgactttttaaagattgccattctaactggtgtgagatggtatctcattgtggttttgatttgcatttctctaatgaccagtgatgatgagctatttttcatatgtttgttggctgcataaatgtcttctttttggaagtgtctgttcatatcctttgcccactttttgatggggttgtatgtttttttcttgtaaatgtatttaagttacttgtagattctggatattagccctttgtcaggtggatagatttcaaaaattttctcctattctctaggttgcctgttcactctgatgatagtttcttttgatgtgaagaagctctttagtttaattagattccatttgtcaattttgggttttgttgccattgcctttggtgttttaatcgtgaagtctttgtccatgcctatgtcctgaatggtattgcctaggttttcttctagggtttctatggttttaggtcttaggtttaagtctttaatccatcttgagtgaatttttgtaaaaggtgtcaggaagggatctggtttcagttttttacatatggctagccagttttcccaacaccatttataaaataaggaatcctttcccccatttcttgtttttgtcaggtttgtcaaagatcagagggtatgtggcaccatttctgaggcctctgttctgttccattggtctatatatctgttttggtaccagtaacatgctgttttggttactgtagccttgtagtatagattgaagtcaggtagcgtgatgcctctagctttgttctttttgcttaggattgtcttggctatatgggctcttttttagttccatgtgaaatttaaagtaattttttttctaattctgtgaagaaagtcagtgttagcttgatggggatagcattgaatctataaattactttgggcagtatggccattttcacaatattgattcttcctatccatgggcatggaatgtttttccatttgtaagtgtcctctcttatttccttgagttgtggtttttagttatccttaaagaggttcttcacatctcttgtaagttgtattcctaggtactttattctctctgtagcaattgtgaatgggagtttgctcatgatttggctctctgtttgtctattattggtgtataggaatgcttatgatttttgcacattgattttgtatcctgagactttgctgaagttgcttatcagcttaaggagatttttataccattaccatgctgttttggctgcgatagcctcatagtataatttgaagtcaagtaatgtgatgtttctacccttgttgtttttgctcaggactgttttggctattagggctcttttttgtctttatatggattttctatctctcatcatatacagaaaccaactcaaaatggattaaaaacttaaatgtaagacctgaaaattaaaaaaaaaaatcctagaataaaacctaggaaaaactcttctggacattggctttggcaaaaataattcatgactaagacctcaaaagtaaacccaataaaaataaaaatagacaaatgagatgtaattaaattaaaacgtttctgcacagaacaagaaataatcacagaatgaacagataacttgcaaaatgggagaaagcatctgacaaaggactaatatcaagcatttacaaggaactcaaatgtctcaataacaacaacaaaaacagccccattaaaaagtgggcaaaggatgtgaacagacattttaaaaacattcaaatggccaacaagcatatgaaaaaaataatcatcatcactaataatcagaaaatgccaattaaaactacaatgagataccattttatactagtcaaaatggatattattaaaaagtaaaaaataacggatcctggaaagattgcggagaacagggaatgcttatacaccactggtgagaatgtaaattaatacaacctttatggaaaacggtatgtagatttctttaagaactaaaaattgaactgccatttgatccagcaatcccactactaggtatctacccaaaggaaaataaatcatttgtataaaaagatgtttgtactcatatgttgattgcagtactattcacaacagcaaagatatgaaatcaacctaagtgtccatcaatggatgattggataaagaaaatttggtacatatgcaccatggaatactattcagccataaaaataaatcattttgcagcagaatgaattttgtttttggattttttttttttgcagcaacatggatggaacaggaggccattatcttaagtgaaataactcagaaagtaaaatactgcatgttctcacttataagtgtgagctaaataatgtgtatacatgggcatagcaagtggaataatagatattggagacttagaagggtgggaaggtagtgagggatgagaaattacttaatgggtagaatgttcactctttgggtgatggctacattaacagccctgacttcaccactacatagtatatccatgtaacaaaattgcacttgtagcccctaaatctataaaaataaagaaaaagaaaaagaatgagaccaaaagagaaaggaatattatcttcaagagctgaggaaaataacaatctagaacttctgtactgaatatcataaaagagtgtgagcaaaataaatgtaaatgtcactgaacactgaaataatttactactcatagacacttggtgaaagaactactaaaaatatatgtgctagtagaaagaaaattgaatccagaaagaagccagatgcatgaagcaatggtgaacagtgaaattggtaaatagaggtatatctaaataagaggtacatctaaataatgttgatgaaccacttacaggttacaagtatgatatggtttgaattatgtcccctcaaattcatatgtggaagtcctaagccccagtacctgtgtatttgaccttacatttggaaatatgtttgttgcagacataatgagttaagatgaggtaatctcatcttggatagggtgcgcacctaatacaacatgactgacgtccttataaaaaggggaactttggacacagagacattcacacatggaggatgtcatgtgaagattggagataagctgccacatacctgcaacaggaacaattagatgctaggggcagggcctagatatagatcttttcctaaagtctgcagagagagcacgggcctgttttcttaatcttagacttctagccttcagaactgtgagacaatacatttctgttgtttaagccactcagtttgtggtacattgttacagcagccctagcaaactaatataaaatacaaaatggatcaagacacttgaaaactgtaataggtaagtataatcagaattacattttctctaaggctcttgtattatagtctaggaggaggagtagagatgttgatcacctttagactttaagtcaagtatgcatgttaaaaatttaggagtaatcaacaaaattatttaaatagaatctgtatatccaaatcagtagaagaggacagaaggaaattgtaaaaacttcactcaatatgaagcaggaaggagaaaaaaagaagaaaataaaaagagtgataagtaagacatacaatggtagaaataaattcaagtataaaattaagttcaaaatgtaaaacaattaaattcatatgccaaaggtatagaagctcatatcaaaaattttttaacaaaattataaagctttagaaggctagtagggcttgatcatcgtcccaactattggttggagggttgttgagatttcacatgaatagttggaattttaacatgggagcaatattctaaccaaggggtgagcaaatgatagcccacagcccaaatagggcctgctgccttttttttttttttttttttttttgtacagcctgcaagctaagaatggattttacatatttttaactttgtattttagtttcatgggtacatatacaggtttgttatataggtaaagtcatgtcatgagggcatgttgtacagattattttgtcactcagctgctaagcatagtacccaatagtttttttttttatcttatccctcctcacactctgcaccttcaagtagaccccagtgtatgtttttccccaccatgtgtccatgtgttctcatcatttagctcccacttacaagtgagaacatgtggtatttggttttctgttcctgtgctagtttgctaaggataatggcctccagctccatcatgttcctgcaaaggacatggtctcgttcttttttatggttgcatagtatttcacggtgttcatattaaatttttaagattaactgtatgctcttgaccagggagaaatgtaaaacaacacagaataattgaaaataaatgaataaaagagatggatgagaaatatcaaccgaaagaaagccagcattacaatgatgatataaggaaaaaatatttaaagcaaaaagccttattagggacatggaaggtcactacttaatgataaaagacaaaactcactatgaagatatatattttaaacaagttagtctcaaatatataaagcaatatttgaaagaaatactaggaaacgttgaaatattcacactcatatttgaagactttttaaaaattaaactgaagtaatttattaaaataattttattatactttaagttttagggtacatgtgcacaatgtgcaggttagttacatatgtatacatgtgccatgctggtgtgctgcacccattaactcgtcatttagcattaggtgtatctcctaatgctatccctcccctcccccccaccccagaacagtccccagagtgtgatgttccccttcctgtgtccatgtgttctcattgttcaattcccatctatgagtgagaacatgtggtgtttggttttttgtccttgtgatagtttactgagaatgacgatttccaatttcatccatgtccctacaaaggacatgaactcatcattttttatggctgcatagtattccatggtgtatatgtgccacattttcttaatccagtctatcatcgttggacatttgggttggttccaagtctttgctattgtgaatagtgtcgcaataaacatacgtgtgcatgtgtctttatagcagcatgatttatagtcctttgggtatatacccagtaatgggatggctgggtcaaatggaatttctagttctagatccctgaggaatcgccacactgacttccacaatggttgaactagtttacagtcccaccaacagtgtaaaagtgttcctatttctccacatcctctccagcacctgttttttcctgactttttaatgatcaccattctaactggtgtgagatggtatctcattgtggttttgatttgcatttctctgatggccagtgatgatgagcattttttcatgtgtcttttggctgcataaatgtcttcttttgagaagtgtctgttcatatcctttgcccaatttttgatggggttgttttttcttgtaaatttgtttgagttcattgtagattctagatattagccctttgtcagatgagtaggttgcgaaaattttctcccattttgtaggttgtctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacatttaagtctttaatccatcttgaattaatttttgtataaggtgtaacagactttttttttgggatggagtctcactcctgtcatgcaggctggaatgcagtggcgcagtctctactcactgcagcctccacctcccaggttcaagtgattctcctttctcagcctcctgagtagatgggattacaggtgggcacaaccatgcccagctaatttttgtatttttagtagagacaggttttcaccatgttagccagtttggtctcgaactcctgacctcagtttatccacctgcctcggcctcccaaagtgctaggattaaaggtgtgggcctttaaaggcgcctggcctgtttgaagattttaacataactttcagtaatcaatatgcaaggagaaaaaaatcagtgcttatgttaaacagacttgatttaatggacataaatagaactctgggcccaataattacagaaaatattagagtaaaaataattaaagaaataattagagaaaatactttttcttttgagttacatgtgaaatatttctaaaaattgactgtgtactaggtgacaaatctcaaaaataccccaaagcctctataaacacctctttctctgaccacactgcaaagaaggtatgcatcagtttaaaaatagcaaaaagtccttgttaattttgaaattaaaaatactttgatgtaattcattggttaagaaaattttatgtgggaaattagaaaatatttagaattgaataatgatgacacagcatagcaaaacttgtgggatgctgccaatgtcagagttgaattttcagtgtagaatgtgtaagagaaggagaactaacagaagctgtgtccactttaagtagttagaaaaggaacaagatagttgattaaaaaagggaaggaaatagaagtagaaatgaatgaaatagaaaacaaagaaatgatagagaatcaacaaaaccagcatttggtctttgaaattattagtagacaagcataccaaaataaacttattgtaacactgattttacaaaaagacttgacaagtcatcagtattaagaatgaaaagggagatgctactgtagatacagtcaaatttaaaaacacagtaacaatatcttgaaaaactttgtacaataaataaatcatagaattgaacaaatggatactgtcatgcaaaaataaaatatattaaaagtgcctcaaggaagaataattaacctggataaatctagtacctacattaaagaaattgtatcaatagtcaaaaatctacatacaaaaaaatcaccaggcctagaggatttcacaaattagtttatcaaattttcaaagaacagataatctccattttatataacttcttcagagaattaaaaaagagggaaaattcccctgaactaattttcagagtctaatataatctttttacccaaacaagatagatacactttgagaaaaataaattacagattacctcacatacatggcagctaaatgtcataaatacaatatcagcaggttaaatccattaataagttttattaatgaaatactgcctcatgctgatctgaatttataccaaaaatatttaagaatggtttaactttttaaaaaattatttaatgtctttgataaccttaaagaaaaaagtaatataaccacctcaacagattaaaaaagcacttaatataattcaatataatttgattttaaaaactcctagcaaactcctagaaaactatacaaaaaacttttaaaattagataaatgttattgaccaaaaaccatttgagacaaagtaatcttgcctgctatcactacctctaagcaacaggaaataagaatagaaaaatgaaagttatgcgtattggaaagtaaacaacccaaaacttattgtgaaagaatgattgtcttgatataaatttaaaaataatattcaggaccgggcgcagtggcacacacctgtaatcccagcactttgcgaggccgaggtgggcggattgcctgaggttaggagttctagaccagcctggccaacatggtgaaaccccatctctactaaaaatatatgaaaacaacaacagcagcaacaacaaaaacaaaaaaccggggtagtggcatgcacctgtaatcccagctactcaggaggctgaggcaggggagttgcttaaactggtgaggtggaggttgcagtgagcagagatcataccactgcattccagcctgagtgacagcgagactctgtctcaaaataataataataataataataataatagtaataataataatcatgcaaactgttaaaactaaaaagagttcagcaacatttcttgataaaaaatagaaaatacaatactataaaacttctagaaaaacacataggaattcattttcatgacctaggattaagaaaagagttcatcataaaaattataaacttcttttctgggaaggacactgtgaagaggatgaaaaggcaagccacagactgggagaaatattggcaaatcacatatctaataaaggacttgaatccaaaatatataaagaattctcaaaactcaggaataaggaaaacaacagcctaatttaaaaatgggtaaaagatttaaacaaccacttcaccaaagtagacttatagttggcaaataaataaagtacatgaaaagatgctcaacattattagccaatagggaaatacaaattaaagccatgatgggatgtcactacatgcctatcaaaatggcaaaaataataattttaagaatacaattatcagtgctaggcagaatgcagagtagctgaaatttgcatacattttcagtaggaatgtaaaatggtacagctactctggaaaaacagtttggcagtttcttataaaactaaacatactacttccgtacaactgagcaattgcgcttttgggcatttatccaaaagaaatgaaaacttgtacacacaaacctgcatatgaatgtgtatagaagctttgtttctaataacccccaattggaaacaactcaaatttgcatcaacagatgaatggataaaacatattgtggtgtatctacatagtgggacactattcagcaataaaaaatgaacttttgattcatccatcaacttggatgaatcataaagacagtatgctaaatgaaagaagccagtctcaaaaggctgcatattgtatcattttgtttatatgacattctgaagaagataaaactacagtgacagagtggttgctagggtttaggagtagagggagagtgtgactacaaagggatggcatgaggtagtgttttggggtgatggaactgttctgtatcctgattctggtattggttacataaatctatacatatattaaaattcatagaactatataacaaaaagtcaattttactgtatattaatttaaaataaaatttaaaaatttaaaaattacttcataaaaaggaggatatgtacagtatcagaaggttgatcatacatcctagtgggcctcaaacaggcccactttatgcttttatcctggtgtaattattaatagtgtcaattgtagaattctgtttgaatggtaaattatatgcttatcctaaatatgaaactgtattcttactgtaaatatgaaaccattcattttaattttaaagtatacaagacaaaattaagaatgtattgcttttgattaccatttatatgtagtagcatggaaattgcatggaagagaaataaaatctttaggaagaaagggataacaaaagaatgggggcttcagctgacataaatatgacaaaattagaaataaaaaattcaaaaataaatataaggtggctctcaatggaaattccagaaaataagaaaatggtattttgattaacagcttatgtttatgttagaaccttgatcagttcttgaagcaaataggtgataaaaatggtggtcctcttggtttgctgaaaagtgaaatgatatgtgctgatgtcacatatcctctgactgttcctgatgaacctacctcattgtctgatgtccatgaatggcagttgctatagaagtctgtgcatggcagttatatgaacaataaccattgtgacaaagggaaccactattaccctaatggaaagagagaaattagagacacagtagccacacaaaactaaaatatattaaatattagtgttgtctacttctttaatggggaaaaagagcatatcattagtgtcaagcgcatcccacagtaggctctctttagaagaataactcagtgcaataatgtgaattgctttgtctttgattttgaacatgattaaattggcaggcagtgggtgggagtatgttgttcaggatagaagtttgcataactggtaactgtagcatttttctcagacactatcattgtgtcaaactatgatgcacaatgatacacaatgctgtgatacacaagctgtgatacacgatgttagttatcattgtgtcaagatctcatccttaacatctgcagtgatttgtgctctctgcactaagtcaaaccttcttagcctggcatctaaaaccctccatattatggcccaccctatctatctaagctctcataccaatgtttcccatcacacaccatttactgtagtcatctgtctccttcattattctagaagcacactgagttctttctcccctcctcacatgttgttttccttaagtggaatgccctaacttctcttccacactaatctaaaccctgcaacactcaatccaaacctctctggtccatgaagcctttcttggctagatcaaccttcactgatctcctttgaactatgacacttactattatgaatacagatttatagtaatgacattttccattgtttgttgttgtttcaaatgtattactattctcttcctcagaagattatataggctattggcaaggcagtgctcatatctcataagtctttttgactccttgtagcgcatgatagatgctcaataaacatttctgactgacttgaatgcccattccaaattatgtttcactgttttaaacatcacaaactgatcacttttattgtcagctactcccagaacttcttttctctcctgtgattttcactctttagttaatcattgagtgttttagagatataagaccaaaacagtatatccaccatgaagtcattttacagttctatgcttctatctgcatttcctggtgctgctttctatcttataagaacacaacactaccaaaagcaaacatgacttcttaaagcaattttaaaaagtagcctcttgtcctccaagggagcttaacctctgctgaagaacaagaaattaacttcagattctgaccaaatttttgacaagagcctaaagttccttggaggaatggtataataatcatgcttgtggttgtagtgattgcaatgttagcaatcctggcctgaaaatatttttactgtaggcatagaacatgaacttttcagtaagccaaaaatagtgaatggtgatcattgatggaggtgaggataaaaggttagaaccagaattaaagtctcagctgaactcagagatacatgcaaaagttggatcagtacagctaggcagtcaagatctaagcaatggtacaggcatagcagagatcataaaagttctcaaaagaacaagaattctttaagttgaatcaacgtcatccagaaccattttatttacttcccatttgggcatgagcccatctcagttcaagtcagctcaaggccatggaaaactaaagtatgtgtcttaatctgctttgattgggaagtgtggaaccacaggaaaaaaaaatcacacttgcattccagcaaaagagcattctaacaacaataagaacagaatggtacaagcaatatgtatgtacaggatttacttgaggtgtgccacaatatattgtaaattggaatgcagaactgctttgtagacgactcaatgactattgattttgatactgctgaaataagaagttattcatgcgtataggttctgtctgatacaattcacagcccaattgattagcctccaataaatctgaaaaaaaggaggatggcaagctctgctttaaataatgaagaatcattacagcttattaagatattctggcatgaggactgaatctgtcttagcatttcttccagcatagaaagtaggcaatttgagaactagaatcatggtagaagggatgaatagatgacagttactgcccatgttgctctgctggtaatgcctggcaaggtaaacattcaagacctgtcagtgacttggcctttcagtcagtgagatgactatcaactctcactagtaaaggtgagaagtattttattattcatagacaccaagcagagcctatgtgttcatgaatcttttggctttgctctttttcttgttcttcttccagcctcatttttgctcttctacagctatcattgctcatgctattcttcctttccactctaaatactctctcactgcctgcctaacaattcaaattttactcatccttcaaggctcagcacaagtctgactgtcacataaagcactatttggtaattcccgtggactagttatgcttgttctgatcttctagttttcttttgcagtaaaatatcagtcagcattcagtcattgtaattttgtttctttcattcaaattgaagttgaatattgaaactcacacatatatttatctaatgcttccacagtgcctggcaccaccatagctacacagctataccatattcacacaccacatttgtttcagaatagggtcattgtagaatttattgtccaaaccaggatacttttgagtgtaaaagaggatgcccattaataattatcctggacttcctttgaaatgcttctaaaaataggataagctaatagatgggtagagagaggattaatgaacagatgtgtgataaagtgcagtaatatgctaatggcagattttaggtggtggtcgctgtaaaatcattttcaccatttgtgtatttttgaaagatttcatgagaaaatattgaaaaaatataattatgctgagacaacacaggtaaactgaaatgttatggtcaacccttgctcagagctgctgttattgacctcagagagaaaagtatgagtaggtagacagaggaaaaggagtgaatagaaagcagtgtagctaagtgggtgggtatagtataaactaacacatgaatttaacacctagaattaggtatctggctttaacatcaagacagttccaggccagatgtggtggctgatgcctgtaatcccagtgctttgggaggctgaggtgggaggattgcttgaggccaggagttcaagaccagcctggtcaacgtggtgagaccctacctctacaaaaaattaaaaaattagccagatgtggtggcacatgcctgtagtcctagctacttaggaggctgagaacagaggaccgcttcagccctggagtttgaggctgcagcgagctattattgcaccactgcattccatcctgggtgacagagcaagaccctgtctcttaaaacaaacaagaaagagtgacagttccatttgtctgataccgagaatgatgtagtttggttgataaggagcttttggccattctatttcaaatgggttctaagagggagcaatgatataaccaagggaggagaaccagtgagtaggagtcattatatgaacctccaacctggcacttatgtagcaccagacctctgtgaagcatgtctttgggaagcagaccttttggtttgttgatttcagtagcagtagttggcatatcaggtggtaagcctagaaacattcattgaaaagccccaagaaatgttggttctcttatttgttagtttgctttgcatggcagatgtgtttctgaaaggaaaatgtggattttatttatttttaaaaaaacaggctgtattttcctaaggtctaacccagtggttctcaaacttggcttcacattgtaatcatctagatcgttttatgacatactggtacctggggccacccccattggttttgatttataataactgcgtaaggagtgtggtctgggcatcaggatttaaaaaatctccccaagtgattctaaagtttgagaaccactgatttcactcttaaagatgctgacatatcttctatttgaaggagctcttgaccatatggattgctccccagtgaggctgaaactgttatggagagaacagggttgagtccctctttgtaggagagaaaggcaagtaagaaagaatcgtgtgaagttttgctctgtggatcaaaatttaaactacagcactacttctaccaattttcatgtcttttgtcttacctcctgcaatccatagtcatatatttaataatcattttatcatgatactatacccctaatttttccatcttgtatatttggatatttatttattggattttctcagattgaggtccacctgttgttttagagcattatatatctaattaggtcatgtaatgcaaaacacctgtcacctgactactgtcatgactaatggtgaaacactgctagatggggatggtgaggaacattgtactatcctgtttcacctgtttgatggaggtgtcttaggaagtgggtaaaagtagtattttactagaaactatcagcaggaagtagatagtaaacagtctattttaggcacctacatttttttcctccctcgatcaataagaccagtcactacttacattatctgttgcctatctgtaattgcttgcaacagtgacatgaacatcctttttgcagagttctagtacatggtttcaggtcatcagaacttgagtggtttggtcacttgtcaggtaggaatgtcattgggtagacaatgtatttgatttgctggtgaggacactgattttaaaagtcattgcttatttaacataaaatatcaactggagttgcattatgattttaatctttttgggatatcaattattagaacacaaaattgttgtctgttatattagtgtccattttacattatttttaatatgcccagaaaactgttagatttatctcctctatgtacgttttcaaagtaataacctgagctttaatggaattgggattcatatttgagaaaatgaagtctgtgatattatgaaaacccatttattctatctacctttcctttttgtttttcttttctttttttcatagcttagtttataattattgctctaaacctagtccgttatttatcggggaaactcaactctacgtttgattggccttggctttattcaatctaactataataatttgattttttttatataaaatattcaatcatgctttaccatatgatgaacttcatttatacataaaagctacttgctgttctacctttggaaattgttaaagaatctcagtaagggttttctagccatctgcttccctttgaaaccttgtgttaatgtagatatctacagtggtgactctagggttattaaactgcagtgtccagttaaatgccgttgttcataattatctagaactccagtctacattaagaaatcacttctattgttttgatatcaatgtgtcttaaagtggactttctagttttactgcatggaggcatatacctatctcacatgcatctgtctttccagtggggtacctctctttaagagagccattgtaataagattcatacttaccaaacataatagttgtggtgcaactaatcacattattaaagtcgtcttcactttgttagaaataattctccatgatagttctttaaattggagtttctctagtacatttaagcatctgtttataaatctgtaattgacagaaaataaaggaggtgagaaaaataagcccaagtgctataaactactgccaaccggtccagaaattgaaataaataatctctaatactgtaatataaatcaatggggaaatgatgcaatttacaaaaactcaatttagacttgaattttgtaaaacacattttttgcccagggtgatgaatatttgtatttggattaatggtatcgtaaatttttttaaacaaaagactatgtcttttggttaacaatttaactattttatctaaaggaaaatgtgtagtgagatatgaagtgaacctattgtctctagcctccacattaatttgtaataacatctataaatttttgtttgtaatatttataaacatttcacattttgatggtaataaacttaaaaacatgtcaaccagagagcaaagaagcaaaatcaagaagaagtttgttgttgttgttgtttcagcactgaggatcagtgaaatgacttaacatccatgaaatgataagttattcagttatgaaagtaacctccaagtactgcagttagttaggagcatcaattttgacattcagtgcaagaaaaaagtcacttttctataatgaaataatattgcagtaaatagtgagattcctgtaaacctgtaattcatggcactttgcacagctatcttgatctactgagtgaatttgtaagaaacagtaagagataattttctcattttgtgcagagtgtttccattctttctatgactaaatacagatctctgaactaaattataagcacagagtaatattcagggtacatgaggagaaaaagcaatttagtgaccgttttgtcattaaaaactgaagcaaaactcccaagcctgaaaaccacaaaatctgtttattgccagcataatcttggcagtgatgagttatattcacgttattcaatgagacaaaagaagggtcaactactttttcaaaaacattttacttgctttataagcatttggaaggacttactcctgtttcctcagggctttcactgaccttatatgttggggtatattctgaaagtgagtaactttgggaagttttagcagcctaaaggaaagaaagggcaaggctgggacaatattttcactgcactaaaggttgagtgtgtttgtacacatacaactgaattatgtttctctggccaattgtaaatggctcaagggtgaggctctcagtctttgatttatttggaatttcacaataatacagggctagctcatagtaggcactcagtaaatgtttgtttaatgacactgagaaaatgtgtcacatggtgtctgtacagtgccaagtccatagaaagcactcacagttgatttttttaatagtaaatgaagtcattcagttcttggatattttggttgactgtacatattccaaaggcatggattcaggttaagtgctcaccacttcagaaggtgcagctgacattttaaccccaaattgttaatacttaactctttcttacccccaagggaagccctttgacccatggtgatagagcctttccagaaagaaggaaaaactccatttgatatggccacagaatctggcaggaggattcacttttagatttcaaagacaagtagagaatatggaagtaacatgagttgaatttcaaaacaaatcgtgacttcaggtttaatgcatttcaacaccaattctagtgtctcttctgaatacagctgacctgcttggcatcagtttatatacctgttattctgcttatatgttttgtagaaatatagactgacaaactactgccgacttagaattctgcttgagaccagctcaagaagttaagcagtagctggtatgcttcattagaggatttaattggccttaaaatgcaatgagttgtgtgtgtgtgtgtttactctctttactccgagtgcttcttttcaatgttcttaaatatacagtaatatatatttcaaagttattattgcacttatgttccctctttgaggccacttatttgcttcagaccttttttctgcctttttgattttggtttcaaactatttttttttttgcatttttattatccctctacaaaggtaattgaaattggtttggagagccttttaaagaccacttttttcaagctcagaatttacctccctgtgattgaaaaccacagtagagtaatggagggaaagtaaacaccttggcttatatagtaataattaccactgcaaaaatgtaaaaattattaattcaaaaaacttcaaatgctctctggtcacacagtgtaaaattttaggactgcaggagagttcctatggtcatttggtacttcctgagccttctggaaatttaatagcctctgagcttttctttagcctgaggtgcaaaaggatcctgctgcttgcttcattgggcttgaaaatagtgggcagaaaaaaatcttgtgcaaacacagtatgcatagtctttcatatacagattactttgcagacttcctttcagtagaaagtgttagataactttcagtggttggataacttacactgaatcaatggcaccgtcttgtttgctgtccctttagaccacatatttttaagatgggtgacaggttcagagatacaggctagactggagagctaagtgaagaaatccaagcctaagcaggaagcaagcagacagctttggtctcattaatgcctattttcaagcagaaaacaacctcacctaaccaaagggaaagtgcgtggttcctgggttagggggtgttctatattgataaccagaatgcaggatgctgaatgagtgaaagtgtttgctgtacacaaagggatgggtggctgggtggagatggtgtcaggaggtaggaaagggtcagacactggtaaatatggatggaaaaaatgtggactgaatgtattttgaacaaatttgatcattttggggggagaaaataataaggataaccgcacttcaggagggaagaatattatgaactgtggattttgaatgcatttaaatatttatgaaaatattttctttagactttttttcaatattctggatagcaaagaaatgttctcaaactttatttcatttatttttgcaaatttctgctggaaggatttggcaatacaggcagcactgtactaggcttctcaaaacatagtaggttaattctcctgtgtgactttcatcaagtaacttatctttttgtgttttcaaccatgaatgtacttattattcaggctagctgtgagattaaacagtatatgctatttattcatttgtttagtcacttattcactcaacaaatatttatagagaggctaacgtgtgccagacacttcatagcacaatttattaattcagtgaatgtttattaagcacctactctatactgttagagcagtgaatataaatatattatagaggtctctctttttcaaatttctcattctctctgtgtcttttaaaactttacttttgatttctttatctagattttattataattaatttaaaaatctccttgaaagtaggcaagttatcagttatatataaataaataagacaatatatgtggaatcaatttaaaaagtgtaaatcagtgtatatatgtggagtggtgttactattatttatagtcacttatcacccttgatggggcaatgataaacagctcatagagaagcatagaatgactagatccccaccccctcccatagaaagtggcatagcaatagctggatggatcagaaagaatgtgacaaatagaaaaaaaaaagtttttcttccctctagtctgtcattccattttaccaaagctggtgtactttgggatagtgtgattgttaagcctccctgtgggttgcaagtatgcttttaactgtgactattgatgctgctgctacagaccccctctgattttcctttacgtgctttatgctgtgaagaggttttttaaaaagaaagatccatctctagctctctcccctttaatagggtagatcagattggttttgtagggctgagttttcaccagtactatagttgtactggagtcacatgcctgcagggagcccctgctgaattgtaaatgtgccaatccccagagtgtagctcagtgtacctctgcaagcagtcagtagtttttcattaagcagtgatttgattagataaaaataaaagttgcttgagcattcatttttgcagcagtgcataacaaatttatgcaaattcctgtgtcagtaatctgcattcaaaatataaaagtgtgattaccaagccatgtgcacctgtattgaagtttaatcaggtacaaatattaatggaaagaataaagcgtttaacaaaagtcacagctgttcgaggtttgtaaaatattgcaatgagagcgttagtacattaatgataattttagcattttcagattaagcaaaattttattttaaaggaaatcccaaataaggcaattctttagtggcacttgggaaatgcagagaaataagattgggctaaatgactcagctgtttaatagtgaaggtgtgatcaaactgtttgaaatatatattagagaacaggtatttattaagaattttaatgtattctcaaggacaactagaatgattctaggaagtaaatggatattttacacctagcatggtgtctagcatgtaatagatgctcaatataaatgtttgtaaaactttttccttcattcatgctgattcattgcgtaaatcatttaagatattgtaaaaggagtaatgtatcgacttccaagtttgtaaatgaaaggctgtgttttatattttacaatggtaagaaaacaaaacaataatatttattgaatgctaggaactgtgccggacacattacatacattcttttagttcattctcttaacaacttatatagtaatagcttacttttagagatggaggaactgagcctgaaataaatcaaatccatggccacaaatcatagctagtctgactccaaggtcctggtttttcctctgtatcacagaatacatattatcccataattatctcagataatgcatggttacttctaggagagcactggtgtaacttttggctacttgtataaaattcatctgataacctaagaatctaaatcagaacgccacaaaacttaaagcatgaatttccaaatgtagcaaaaatactatggtgaaggattgacctctgcaaatgtgatttttaaaataatattaattttttctcatctttagaatagtgatctgagtgacactggacaagagagaggctaaattgtgattttctacgtctctgtctcttacaatttgtagttgtatgggatgagtcagaactttttttctgaatattgttctttaaaattgaacataatcccatcttcattcatagcaggactaaaaactaaaaggtataatttaatgcttcaagttttccatcctgttcgtttttgggaatgaaagccccattcctgtttattttcaggggaaggacagagtgagaaagggggtcatttctgggcttaagtcagatgtggctttcgtgccttgatagaaataattcattcaattggagaaaaagtgatagccccaggattaagttattctgtaggccatagtggttcacagaatttggaagacctatatcaatccttagctcagaaatacagttttccagtccttagatctaacattttatccaggcatgcaaagctcaaatgatctggcttcaatttaccccttcagggatatctctggttagtctttacaacaaactgacactagccagactagtgtacttatcctttactgaaactttccttcttttctcatgtcttttttctccttttctgtcatgttttccctctacttgtctccattcctcactccacccagatatgaatcttttctttcaaggtccaactcaaatctcatctgctccatggagactttcttgaaacttcagctcaaagcaatcttcctttatgtgtattcctgtaacattctctgtctgtttcattgcctatgccttttcccttcctccttccctcctcccttcccttgcttgctttcctctttccttcaacaattactgagacagtgtctgccaaccagaacatatttgcttctgggaatacaatggtgcctcaggaagatacaggccctactcttacggaggtcacacttaaatgaagcagacaaccactgatcaaagaaacaatcaattgcttcctggaagtaaaagaatatggttcgaggagagtggatgacaaaggggccatatagactaagaaaactgacttagggaagggggacaggaaatgcctcctgaggaagtaataattaagctgtggtctaaagtttgagtagtcgttaaccaggctatggggtagagcctgcaaagagcattggaggcatgggaatggcatatggaaaggccctgtggaaagaggatgagtgtacttacatgactctttttttgttgttcatgttctctctcctcaaacatactgtacaatgcttttggatgtgaacgatgtgttgtatttatttttaccaaattcttttgaaaggactttaattatcattgagtgcaaacttcagcaggccctgagaaaagttcagtggtttactgaaggtcacacacatagagacatgggtctcctgtacaccccctcctcatgcccagtgttctttcattgaaatgattctttataattttgtgtaaatttagccaacatacatctggaataagtctctgcatgtggaagatggttcatttacaattggtaactgtgcggtcatgtatagaatagaggagagcaggaaggtacagaatcaaaaggtgtttcattacatggaaagttttataggacaaagaggtacatgttagggaggaaatttacatttgtaaaggaccatgctaactaagctttggaatgcatagggtaaggattcaatctttgaagaaaatctgtgtgaaataagatatgaaaaacattatgatgattagaattcagagagccttggatttaatcctgttccaaatacatttcttgaaactgaaagaaaaaaatgataataatttggtagtgctatatttgtgtgacaattctaaaatttggcctacaattttttgacatttccaaccactgacaggtatgggcttatgtcccttccacttgaatctagttgaccaaatagaatacagtgaaagtgacactgccagtttctgaacctaggtttcaagaatatggaagcttccacttcttcttttaggaagcttgctcttacaccctagccaacatgctgtgaaaaagccaaacttcccatgggaaggcctatatggggaacaacaatggcctcttgcccacagccctgggtgggattccagaacctaattatattcaatgtgaatgaaccatcttcagagtagatcctataatctttagttgagccaccccagcttagaattcagagagcagagaaaagctgtttctgccaagacttgccaaaaattgcagatttgtgaataaagtaaatcattgttctttgaagcaactaagttgtggagtggcttattcagcagtgattgataattaatagatttggggagatcattcagatctgctgagcactggaaagttagaaagatctcagttcttatatagggcccttcaattttagaaggagaaggcaaattgaggaaatcaagaacaatctgataaatggaaacaacaccaaaataaattcatcaatcagagggagcaattatggagtcccagggaaatataacagtaaggattttatttagagtgtgtgggtagaagatatagagaaactagataccaatgttaggattccaggagaataaagttaggaaatgtatgagaaggcataatttatttaagaacttagggaaaataggatagggccaaagaccaggtcaccagcagagatataagtactgaggtccttgaatatctggctgcacctggtagtgtctcttcctcaacctgactctggcttgaagtttagcccctgcatgcctagcccatctgcttccctacagggtcttgacacatactatgccaagcaccttgggggcactgagggtttcagtttatagtccatgtatctaaatttgaaaattaatgagaagatggtgaatagagtcaatatatttcaaaattgcatgtcagatatggaaataaagtttgaacttgtagtttaattatacatgtaattatctttcatttacatgcaatgtcaatttttccatgacctacttataggatgaagatgaactcatgtaatttagagttagagttgaccataaaacaagtctggagaagaatattcttagcttagaaagggtggaatatatgttcctttgagcttttgggtgaaattgtcatgactgaaattataaattaggtaagaaattatgccatgtctggtaccaagtagttcctgcctttgatgagcctatttatttcaatgggtgaatatatgtaatagattaagacaattgagaaatggataatgtataaatgcgttactgtaaacaaaatggtttcatgtttgatggctactttcatgtttgattaagttgggccttgggacatacaaccatttcatttctcataggtttaggaaagtttagtgttagcctgataggcaaaatggctgactgactaggaaaaaggcaatggaagatataatttttgagagtattttggaagaattgattcttctgagaactggatgatatttatacttttctgaggcttgctcgctagtgcaagtgctattctaaatggagtgctttgcagattccagacatatgccacattcatgttgtctagatgatgaatgacttattgatagtccaggctttgtactatttgagatggtagttcttttaatagccatgatgtcattgagataaaacttagtgggatagatgttattaatggtcaccattcagccttttatttgcaatgaagccaaagggcagttggagggggatgaggtcagcctgaatcactgattcccttgaagtcttctgtgtgttcccattttgggatcctgtgaaaaaacagaagccaaattgaacaccaccacattttggatgagtttccatttgaggagctccaaaaactcccacaagtcagattcagaagagttttcaggagattgccaaagactgtgcagtattgctggcaggaatagaaacaacaagcagatgttttagcagagtggagcccattctgagagactattcccgggcattcaatgaaagagactggagaggaggttagttcagaacaaagatgagagagcctgacttgggcgtgcacttgcctaaaaatagacttacaaatttaagagttccaaagcccctaaagtaacttcagatggatatagttgctaattaatctcttgaacttcacatgaaaactccatctggcactgtaatcttgtgacaacttgctattgttgtggtattggtttaatttggtttggctttcttcttttttggaaacacacttctccctgtgcttatcacagtttttaaaaacccaaattaaaaaaaaacccaaatagttaaaaattcatagctgctttcatcaccagctggttgcatgacctttgataagtcgccagattcactttcttcatatataagaggaagaaagtaaactagatggtattttaggtctattccaactctacaatcagttaatttatttgaacacaagctacaagattatgagcccgtaaaaccaatatttataaattttctcttcatttctgaccactgatgaaaatgggaagaatatagaattcctctacaaatggcagattaatcactttaacagtaagacagagctctgagggtgaaatttgcatgtatatcataactcagagatgtatttgttcagcaaatatttattgggcacaaactatatgataggtgctgtgctaggtgctggaaattccacagtgagaaaaacatatggttcctgccctcagggagtttaaaatctagttcagaaaaaacaaatattaaatactgtaatcatataattataagtgggactaagtgctaaggaaatgaataatagtgaacctggcctagtagggaataggggttagaatgaggtcatggaagatttgtctgaagaacatattccaaagtattacagtacccagtaccaaagaagtccacatggcagacttcattattgaaccagttgtttttgctctgttctatgactctaactccaggcagcgaaatcaaaatcctcactattagtccaaaatggacttgggctagaacaagtagatggatcagggaaaaccactgtttatgaacagaaacaaaattcagagaccacattatgtcatagcattggagggaccttttgtatgccagggttaatatgaatgcatacttattttacattttccacaaggagcataagatatattataatcttatggatgcttgtgaactgaccccaggagttatgatctgtgttcaaatctcgttatttaacctttctggaaaatatgagaagtaaatgaggtaatccatgggaagggtttagcacagtgcctgaacctagtaaaactcaataaatttttctattgttgttcctgttagtatttaacaaaacagcaatcacccccatctctctctttctgagtaatacataagaaagttaccagtttccaaataaccattcttccttatacttcctatcctgaataatgtaagttagcttgatcaaggaaaaacaggggttgaagcttctagggcttcctggaaaatttctatgggatgggggcaattcttgctatggttttgtgcagaaagaggctgaaggtaattcagagggaggttataaactaactttaaaggcactggagttgcttaccatttaaaataatgttgttttggtggtggtggtaatgttggcgtgagagtgtgtgtgtgtgtgtgtgtgagagagagagaggctctaattgattttgaaaaattataaaatgtatattcaattatcatttcttggattttgaaaaattacaaaatatatatttgattataatttcttggagttcataataaatagggttcacttattgtgacaagggccccactatccttctttgaaattatggctataatttagtttcctagtacaagctttgctcatgttaccttctcagtatgtaatcactcatgatggcaatcatctatttgagtcatgtcacatggtttagtggtgattgttactgtctgagaaaatatttagcatttagctaagtatagttctttctaggtatactatgggcctttgttaggtatactatggagcaagtaaatgtaacttaattgagttttctccctcaaagcaggtgtgggtgcgttttcttggtgtaggctcatgatcaccttcgttatctgcagctttgctaccaaatacttctctttagttcttggttgaacatggttctgtattccattgtgaaacaggggatctttttttgtggggggaatgcttgtgttctagcccttcagaattgtgtttctcctgcacagaccccttgaccaggtcatggtcttttcacatggattatggttataactttgctcatgtgccctgtatacataaaatgatttcccacccaaactcttctagcctagatacattcatcctagatgcttttactctatcattcaagttcccttcctggccagagtccttatcaataattcttaggctatactgggcttgtctacttgagtgtaagtttctaaaaaggaggccccacaatatcttttttttttttttggagagcccccattctccagtcctagcacatagctgagctctaagaagatgctcaacaagtacttaatgacttaaatcctatcctctgagacatttcaacataactcaatgaaagatcagaagaaacaatctacacgaggatttgtatcataatctcttcacagttatatatatatttggggagaggaagaagagcacattatagatccttatcagccatatccagagaaagctgttactttcttctgatcaccaaaccaagtatgggacctcagacagagctgggtttgaggtactctaaggtaatggaatcagtgtaaacactatctaaaacatccgagtatttttctttggtcctcacacctcaggattcctgaataacttatgtactaaaaatcagaaggccagaaaaattgatttgaatttattgtccagtgaacttgctttttgttaatttaagggcagtagtttgaagggtaagttttcctgaagactctgcattccttgacctaaagtctccattaggaacataaacaatacgactgtatgtactgtgttttgaaaccactataaatggctctaatgtgtgaatcaggttatagtttaatttttctttgctggatcagaggcacttgagaataaaacatatgcagctgcaggatattgaaatatttcatatgcatatatatgcagcatattttctagggaattttaccccttagcaaatctagccaattctttttcaattctatgacttaacattaccttttctttttgtttttattagcgttcaggttttagactatttgtttccacaaattgtattttattttggcttaataaataaagaaattgagttacttcaaagtacgttgtggatgtcatttggtagcagtggataaatggaaagttaaatgacttgctcaaggtccaaaagaaagtcagcagcagggcagagacaaaatttctgtcctttttgccaattgcctgtcagattcactctgctaatgaaactttttgcaacagaacagtcttccaatgtttccaaggagccagttaattaaccaaataaagagaatgatcatagcgatttttaaaatgtccatctctctcacatttttcccccaaatttcattttgagtgtggatcaaggaggtggtttttacaatttaaatatgattggcaccattgctgttaaatgaaaatgtggctactgggtattgaaatatattttttaaaattggtaatcaaaaaccttgttagcatttgtgcccatctcatgagaagttcatagtgctttaaaattaacattgattaaataatgaactgactggagagagaccatttataaaattggagatagggattagaggcagttgtggcaatttctctgccaggctaggaacgctcattaatgagctaagagggctggagaattcatgaagggcagtatcacagatgattactcccattacgatgaaattggtaggccaatggatatgacaatatgatatttatgattatatctggttatattattgtagaagttaaatctttctgtatggaaacagtttagcacttataatgtgtttttaataaaatactcgtgtgcaatggcattttataggaattgtaaatgttaaccagtagactgaattggataagaaatgcaaaggcagattactttcaaataaaaaggggtagagtgtcaaatatgagtttcattagctaattggtaatataacatgcttgtttcccttgagcacctgaaggccagaccaagctgcagaaatgttgaggtttaaacaagcattgagcatactatgctttacagcctgagtgatcacaagggttaggaaaccaggacacaatctatagtctcaacaaatcatttaaagtatcattgcttaaaagctcacctaatgtttgatttttccttcccacaatttatgtgtttattccaaatctaaccaaatctctgaaatgatcaacaatatcatactcacggtatcttgtaatagatgcaatattctgggcagagagtatcacaataatctcttctatctggaattacaagggaaagttatggactgctttcccagaggttgcttttttcactgatcttgtggcaaccctatgatacaggcaagggctattatcaccattttgtaggctaggacactgaggctccaagaggtgggaagtaaatgacagagtcaaaatgtgaacctatcataaaaacaaaaaaaaatccccaaactcgtcaggtactatgcttagtacctgagtgacgagataatctgtacaccaaatccacgagtcctgagtttacctatataacaaacatgcacatgtacccctgaacctaaaattaagaagttaaagtttttgagaaatgtgaacctagatgctctgcccccaagttcagtgtccattctatgatccatgaatgacacaaataacagaattgtagttaaaattctcaagtgaaagttgtgtcagaacttcaatttagagtccttttagatttttgttttcaaatgtttgaaaaaggcacggtctgaaaaataatattggtccccctaagtccccccaaaactgccccagtaggactattataaggccagattactagactagaatttactgggattactttgtattaaacccagagcaggtagaacttgatttaagtaaatgcaatgtaacaaaacccaaatttacaacctagataatataccaaagatttgctttaagtgacaatttcacttgtatgttttaatcagtttacaaaaatggataatccatctctggggactttgagggaaacacacatgttatgtaaagcggaattaacctatactatgcaagagtcatgtgaaagtgacaggttgttgttcaaactaaatcttacctcctgcttgtgtgattttttttggtatatctagagtaatatagcactcttccctaatattcatccactggcatttggcatctagttaattacaaatgattgtagatttttattattgaaacagcatctaacagatttacttgtgtgtgtttgtattgggatgtacaaggaaatgtgttgtttcgaaggaatgtaatgtgaggtgtcaggtgacaaagatgctttctagggcttttcacccaacttgttccttgttcaagataacttttatttaacttgcctccaaatcaagccctgaatatcatgcaacacaacagagagatcttctcataaagtagttgtcttttagactcatcttgaagtgtatggagtcattttaatagccatagggagttgggcctagtcccagcaaatgcccagttgaaaattttatggaagatggagtaagtctttttttgttcattgtactaatatttactgagcactcatatcagacactgttctaggtattgggcacataaaagtttaaaagcttggaaaaaaaattctgccctcatgtcacttacattttagtggaagaaacagaccattaccaagataaatatgtagaatatataaaacctgtacagagtgggaatgatcaaaagaaaaaagtgaaggaaggagattgaagtgtatggataaagttttagttaaaggggccagggaagacttcactgaggaggactcacatgaaggaagtgaaggaactagccatgtggatatttgggggaagaatatttcaagcagtggaagcatcaagtgcaaaggccctgagacgagagcatgcctggggtattagaggagaagcaatgaggccagtgtattcagaggggaatgaatgtaaacaagaagaaaagatgaggtcagagaggtaatcgggtaactgggtaggtcctggtaaaaatcttggtcttctatccaagagaaagagagagagagagagtgaagctctgacttatgttttaacaagagcattcacattgcaatgattgcaatagactaaagaggacaagagaagaagcagagagaacagttaggaggctactgcagtaatgctagtgaaagaagatgatggttctagatggtaataatcagagtagagctcttaagattttctgacagactgaatgtgggatatgagagaacaaaaggaatcaaagttttggggctgaatgcctacaaggatggcatttatgtgttagtgaaatggggaaagctgcaggaggagatttgggatgtgacaaacatcagagctctgtttggagtatgtttggtttgagttgcctattaaacgtctaagagaattgttgtataggctttaaatgtatgagtctggattcaagggagacattctgggtggatatgtaaattggagacataatcacatagatggtatttaaagccataagattgggtgaattcacctagaaattactacatatagacaaaaggaagatgtctggtgacatgagaaaaagattttaaagtagtatgcatataatgttctcttttcttgggaaaaagtgcttatagaaagaagaatggaaatatgtttaccaaaatcatctctgggtactaggaatattggtgattttcattttattattttatgtttttccatatttcccatattttctttaatgaaaatggattgcctttataaccagaaagcagaataaaacaataaataccattaagaaaagaagatttttatctagagttgttctccaatgtctaaaataaaacatttgtttgtgtacagtcccttccacatgcttacatcctcagatacccacagtgaacatgctgaaaaaaaggttatttgaatcaaattacacatgacatgattgggacttgccatcaaggactgacaatacagatgtttctgtccttacatggagttgaattaatagaactagataaaatgtgcctggacggtaaagaatatgaagacctggggacagttaaacccaacaggactacatccagccagaatagattgggacccttggggctgagtcaaaaatcacatcctttgggaaaagagaattaattgaatgcttgttctactctcttgtgacattcttttccctgaaggccttttgccttctttttctagtagctcccattcagggaacagggtatctgctagttcagcaagctactcttaaatgttaataacttattcttggccaatttttcacacataggaaagtgtatcatcttatcatgttgagttttaaagatcatataatttttttcttttgaacatagaagctctaacacttctctttgcattctcttcatctccccatttgattataataaggattaccctcccccttctctggtggtgactcagacatagctaaagggggcttttctcaaacttcttttggaaaagagaaaaccgtcagtgtttggcttgaggacaaaccgagaatattttagctaagatgtaggacggttgatacagttatgagtgactgaaaagggaattgtagtggaaaagccatttgcgttttgagctatggcatttgctactgtgttagcactttgttaaaagtgtgtaaatgcatggtaagttttttaagcagaaacttggaaaattggtacagaaatttatttttgcatatgcttgcctttccattaagcagtaagtgtaatcctctccctgatgatctgatgatctactttactttttccttttcttcctaagaatgccgtgacccaattccaaatgttttgttgcacaaatgagctatgttactccctcttctggactccaaatgtcagaccaggctccctccaatattctatgaattttggcgatttttgaaatcaaagttagaacagtagatataatctatattcacccccagcctcctgctgagacatacataccacatacacacgtgtgtacacacagaacacatgttgaaagaaagaaacttctacctttgtcttctactcttaatagcaaagattgagtcctaagacggcccacacttatatatgaatttagatcaacaatgtaatcaaaggcatcaaattgtaaacattctgcctagaactggacttgagatcttacagaatgaatacaggtcttggagttctgagatctgagtgtaaatcttgcatctgctacttgctagcagagcaaccactgacaaactacttaagcatttatttaattctaaggccttacatacttgttctgatggcaaccagtatcatgggggttgaagttagacctgattcaaatctactacttggacaatttgggttaagtgatttattgctttagactctgtttcattgcctatggaattaggataatacctgctttttcagggcttttgtgaggattaaacaagaaaatgtatacaatatgtctaggagcagcatttgggacatatggtatattaaaaattctctcattattattgttgttgttatttctcttcttagtagcacaaatattttcttacctgtgaaaaccagaggctttcactaagtcaagccaatagcaggagaaaaaaggtagaatttctcatttttcaatttttgtggatacatagtagatgtatatatttatggaatacatgagatgttgtgatacaggcatgcagtgtgaaatactcaactcatggaaaatggggtatccatcctgccaagcatttttccattgagtaacaaacaattcagttacactctttattttaaaatgtacagttattgttattgactatagtaatactgttgtgctatcaaatagcaggtcttactcaatctttctaactttttttgtgcccattaaccatctccacctccctcctatcccccacaacacttccttgcttctggtaaccacctttctatgtccatgaggacaatggttttgatttttagatcccacaaataagtgagaacctgctaagtttgtctttctgtgcctgcttatttcatttaacataatgatctccggttccatccatgttgttgcaaatgatggaatctcattctttttatattccattgtgtatatgtgccatatattctttatccattcatctgttgatggatacagatcccttccaaatattagctattgtaaacagtgctgcaacaaacatggaggtgtagatacttcttggatatacttatttcatttcatgtaggtatatacccagcagtgggattgctggatcatatggtagctcaatttttagttttttgaggaatcttcaaactgttctccataatggttgtactaatttacattcccactaacagtgcagaagggttcccttttctccacatcttcaccagcatttgttattgcctgtcttttgggtataagccattttaactggggtgaggtgatatctcattgcagttttgatttgcatttctctgattatcagtaatgttgagcacatttttatgtccctacttgccatttgtacgtcttcttttgagaaatgtctattcaaatattttacccatcttttgattggatttttagatttttttcctatagcatagtttgaactccttctattttctggttattaattgcttgtcagatggatagtttgaaaatattttctctcatgatgcgggtcgtatctttgttgattgtatcctttgttgtgctgaagctttttactgcaatgtgatcccatttgtccctatttgatttggttgcctatgcttgtggggtattactccagaaatttttgcccataccaatgtcctggagagttttccctaagttttcttgtagtagtttcatcgtttgaaggcttagatttaagtctttaatccattttgatttgatttttgtatacagtgagagatggggtctactttcattcttctccatatggatatccagttttcccagcagaatttatcgaagagattgccttttccccagtatgtgttcttggcatctttgtcaaaaatgagtttgctgtaggtgtgtggatttgtttctgggtgtattagtctgttctcacactgctaataaagacatacctgagactaggtaatttataaaagaaagagatttgattgactcacatttccacagggctggggaggcctcaggaaacttacagtcatggtggaaggggaagcaaacatatccttcttcacatggtggcaggaaggagaagtgcaaagcaaagagggaaatgccccttacaaaaccatcagtctcagaagaactcattcactatcacaagaacagcagcatgggggtaacagcccccatgatttaattacctccccccaggtccctcccatgacacatggggattatgggagataaaattcaaggtgagatttgggtggggacagagccaaaccatatcattctcctccggcccctcccaaatctcatgtcctttcatttcaaaacacaatcatgcctgcccaacagtcccccaaagtcttaactcattccaggattaacccaaaagtccatgtccaaagtctcatctgacacaaggcaagtcccttccacctatgagcctgtaaaatcaaaggcaaagttaattacttcgtagatacaatgggggtacaggcgttagataaatatacccattccaaatgggagaaattttggccaaaatgaaaggggctataggccccatgcaagtccaaaatccagcagggcagtcaaatcatctccttctctttctcctccttctccttcttctccttctccttcttctccttctccttctccttctccttctccttctccttctccttctccttctccttctccttctccttctccttctccttcttcttcttcttcttcttcttcttcttcttcttcttcttcttcttcttcttcttcttcctcctcctcctcttcttcttcttctttttttgagacagagtctcactctgtcacccaggctggagtgcaatggtgcaatctcagctcactgcaacctctgcctcctgggttcaagcaattgtcctgcctgagcctcccaagtagctgggattacaggtgcccaccaccacgcctggccaattttttgtatttttagtggtgacagggttttgctgtgttggccaggctggtctcaaactcctgacctcaggtgatccacctgcctcggcctcccaaagtgctaggattacaggcatgagccatcacacctggccagggaggtcaaatcctaaagctccaaaatgatctcctttgattccatgtctcaccttcatgtcatgatgatgcaagaggtgggctcccatggccttggacagctcctgtggctttgcagggtacagcccctctcctggctgccttcatgggctggcattgagtgtctgtggcttttccagacctacggtgcaagctgtcagtggatctaccattctggtgcctggaggacagtggccctcttctcacagctccactaggcagtaccccagtgggaactctgtggcagctctgaccccacatttcccttctgcacttccctagcagaggttctctatgggggctccacccctgaagaaaacttctgtctggccatctaggcatttccatacatcctctgaaatttagccagaggttcccaaacccttcctgatttctggtcaagaaggtttgagacttgcaccctctgaagcaacagcctgagctctgcattggccccttttagtcttggtgggatgcaggacaccaagtcctgagactacacaaagcagcaaggccctgggcctagcccaggaaaccattttttcctcctaggcctctgggcctgtgatgggagcagctgccatgaagacctctaacatgccctggaggcatcttccccattgttttggcaattagcatttggcttcttgttacttatgcaaatttctgcatctggcttgaatttctccccagaaaattgggttttcttttctcctgcattatcaggcctgcagatcttccaaactattctctgtcaccttttgaatgcttttctgcttagagatttcttccaccagataccctaaatcatctctctcaagttcaaagttccacagatctctagggcaggggcaaaaagccaccagtctctttactaaagcatagcaagggctacttttgctccagttcccaataagttcctcatctccatgtgagaccacctcagcctggacttcaatgtccatatcactatcaacattttgttcgaaaccattcaacaagtctctaggaagttccaaactttcccacatctgttttctgagacctccaagtctctaggaagttcaaactttcccacatttttctgtcttcttcttagctcttcaaattgttccaacctctgcctgttacccagttctaaagtcgcttccacatttgagggtatctttacagcagcaccccactctctgcaataccaaattactgtattaatctgttcttgcattgctaataaagacatgtcccagattgggtaatttataaaagaggaggcctcaggcaacttacaaacatggtagaagaggaagcaaacatgctcttcttcacatggcagcaggaaggagaagtgccaagcaaagagggaaaagccacttataaaaccatcatatctcaggagaactcactcactatcataagaaaagcagcatgggggtaactgcccccatgattcaattacctccccctgggtccctcctcccatgacacgtggggattatgagaactacaattcaagatgagatttgagtggggacacagtcaaaccatatcactgggttctctcttctgttccattggtctatgtatgtatgtttatgccagtatcatgctgttttggttactattgctctgtagtataatttgaagtcaggtaatatgattcctccagttttgttctttttgcttagaatagctttggctattatgggtcttctctggttccatataaattttaggatttttttttctatttctgtgaagaatgtcattggtattttgatagggatggcattgaatctgtagattgctttgggctgtatggacattttgacactactgatttttccaatctatgaacatggaattttttttcattttttggtgtcttctgcaatttctttcattagtgttttataattttcattatagagattttttacttctttggttaatttctaggtatttaattttatgtgtggttattgtaaatgggactacatttttatttctttttcacattgttcactgttggcatacagaaatgctactgatttttgtatattgattttgtatcctgaaattttacttaatttgtttataagttctaataattttcttgtggagtctttaggtttttccaaatgtaagatgatatcatctgcaaacaaggataatttgacttcttcctttccaatttggatgccctttatatcttcctcttgtctgattgctctatcatggacttccagtactatgttgaataacagtggtgatagtgggcatccttgtcatgttccagatcttagaggaaaggctttcagctttttctcattcagtatgatactagctgtgggtctgtcatatataacttttattatgttgaggtatgttccttctatccccatttttttgggggtttttatcatgaagcaatgtttaattttatcaaatgcttttacatcatcaattgaaatgatcactaggtttttatccttcattctgtcgatatgttgtatcacattcattcatttgcatatgttgaaccatccttgcatcccagggataaatcccacttggtcaggatgattaatttttctaatgtattgttgaattcagtttgatagtattctgttgaggatttttgcataaatgttcatcagagatattggtctgtagtttttttatatgtttttgtctggttttggtatcagggtaataatggtctcatagaatgaatttggaagtattccctcttcctgtattttttgtaatagtttgagtagaattggtattagttctttaaatgtttgatagaatttagcagtgaagccatcaggtcctgagctttttttgttttgttttgttttttactgggagactttttattatggattcaatcttgttacttgttattggtgtgttgatgttttgggtttcttcctggttcaatcttggtaggttgtatgtatctagggatttgtccatttcttctagattttccaatttatccaaaaaacgtttgaatcttctatattggtctgaattttaaaagaaatatcctgctgagcttttgtctaaataagaattaatatgttagtatttctaaaatgttccactttgtgcttttcttggtatggattcaagtttatagtggtaaacacatataaataaaggctgctgcctcctactctcctttatagagccattgtgaatggttaataagggtgattaacccttaaagacacacacaatgccccagcattttaaaaataacttgtattttagatttatctctggtctttgtgggagaaccctatgactctctcatgaaatacattttgggagtgaccatttacttgcactagtgagaattagagaccatactttgttttgtggaccttttcagctgtagtcaaagtaaaatgactgcagtgtcttgagtagaactgaaaattgaaagtacctgcatcagtggtattgatcctggaggacttcattcctcatacttccctaaaatatttgtcctctgtttctgaatgacagtcagggataccccctgaaaaatgctgcccattgagcatgggatatcatcttgatgaattatttcaaaactctatcaaagtgttttccaaatatctagtgatctaatgaggccattcaggtcctgattttcatccaggccttgtttttagatattagctgggaaaagtacagagtgaagactgactgtctgcattggcacagtcagagggatcttgtggctcagcagttattggctacctaactggaaatcaaaccaatatagcactttatcaagtatatgtagtagtaaccacaaataagtcaacattttattaagaggaaaggggttggggaaacaattggctcaatttgccttactgagatatagaaagcctgtcatagaggacctcttctaaaatatcaaggattcaaagccatcacttcaaagcttaaaagatttaagggaaaagataaaaatcctatgacttcccattggaataattcctggctggcctgcctgcctgcctgcctgcctgcctgcctgcctgcctttcttccctccttccctccttcctccctccctctcttcttcctttccttcctatttatatcagatatagaaattttccttgcaggttctatcttcattgatttctgtacacttttcccatagtatgacaccatcatcatgattaacatcattggatacttattatgtcctagacactgttctaagtaatttgcacatattgactgacttattcttagaaacctaaggaaggtactattcttgtggaggcacagagacacaatgtgcccaaagcttcccagctagtaaatggtgtagccaagattcaaagataaggaatctggtttcagactctgtgatgataactactgtgctattaactaccaacctcaaaagtacacatgaaaagatgatgcaaataagccgttattgttaggccaaggttcgtttctatttttgctttgttttttagtagtgcactgaacaatcaacagtctctcagatggcatttagctgtcccagtttacacatttgcagggtggctggccagtgcttaaggtgtgacttggaactgatgtggctggatgtcaaatcagtgaccttggcagatatttggatggagaatatttgcttgtcaggtgtaccctgtttgcttttcctccacagggttcatgtagaagtttccatagtgtaagacacattctccacttttttcctgaaaacctagtacatttcaggaaattagaaccagtgagtttctgggggccatccatcaggtgcaatatcaggtgctgatttgtcactgactggcaggctctttcccaattcaaagcatgagaggactccaaacttctttttgtggttggagtgcccctggaagttgattcatgttctcattgcaatttattttacattgcatcttggcataatgactttgactaaaagggatattttctgatgtctctgctttaatttagaaataaccaaactgatttttccaacatatctccaaaactgaagacacatgtgcctaggaaaacaggggtttctaatgaaaatgctgacacaatctcatgaatgctgaggtttttaacagtctgccattcagtaaactagtatttttgtgtcctatgaaaataccaaacatctgcttgcaatgagcgtacttaacaccttttgggtttctttttagctaagctgaatgcacttgggaatgagtgaaacttcagataacaccggcaaaaagtttgaaataaggaatttttatttgaaaaccattttgtaagcataatggtacccatagtacaaattacaaacaccattcaaaacaacatggtagcaagatgttttcaaatggtgcaaagtccctgctcacaggtgtgaacgccagcaatgggcctgtcagctaaggctggttagtagaataagtggcaagaaggtaaaatataattgaaactaagaggcaaaactttatattccagggttcaaaataaaggacaggaatcagaagctaaagtgaatgtcaaagcctaggtagacacagtgggacagttggcaaaagaaaacttaaagtatgtattttttaattttaaaattctttatttttaattgacataaaattgtattttacatgtcaattaaacaattttatatgtcaattaaaagtaacacgtacaacatgatgttttgaaataggtatacatcatggaatgtctcaatttagctaattaatacatgcatcacctcacatattattttttgtggtgagaacacttaaaatccactcagtgattttcaagatacaatatattgttataaagtatacatacctggttgtacaatatatctcttgaatgctttcctcctatctaattgagaaaagcatgtgtgattattagagttgcctaactagtcttcctgcctcaaccctttcccccaccctaattattttctacattgctaccagaatctttcctgaagaacatatcaaatgatgcctctcccctatagtaatcacctggaaacattcagtgattccctatagtatactgaaaaaggtttaaacttctttaagggttttcatgattgggacccaaactattctttcagccttctcaaacactgtttatatccctggacatctgatacttatgctcagtggttctaaattgggactggtggcatttggaattccgttgaggtgttttgggttgccaaaacaggtgaagaataatatgggtatttagtgatctggagcaagggatgtcaagcatcttgtgttgagcaaaacagacccttaccattttagacttgcccgatcaaaatgacaatagcactcttgttgagaagctgcaagtttctagctaaactggattgttttcagatcttcagagatagtgcatgctttcctagtaatgtacctttgcttctgctcttccttctccttgctatgcttgcctctttattcattgttacctgttgcattcccatcgatcctcagggtctagctttcccgaggaattcattcttctttcctaccagagttgctgagcatactgtggtatagtagaaaaagtagtaacatgagaatcaagacacccaaatctttgccctggtactgccactcaccaattgtgtgacattggcaagtggtttttcttctctgagccttagtttattcatccataaaatgagcaggttaaaaaaattaggggattgaactagatattccctaacattccttccaggactagttttctatgggccccttatcacctatctcattttattttaatcacagtctaggatgtctttagatctctcaacatagcgtcttgtacattgtgtacctcaaatagttgacctgattggttcagagggctttatattccttgccttttgttgaagatgacactggccattgatgttgtaacattgttgtgctcaatccagtaaatatatatgtatgggctaaaagaatggcagggaccagttttctaaggtcacttaataagacaaggaagagccatgttgggtaattaatttgttgggaaattactaacattacctaacctctacagaaaagatcatacacatttaatgaatgtaaaagaatatagtaaattttaggtttttgttacatgtagaaaagtcttctctgacaaagtagcagtaattatgaaatatatatcatgtaggtttatattcctgtggcctgcaacaggctatttgtcttaaaattagaagttttgtaggcttcaaacgtgttcaactggcacttgccttgatataatagttcccttagagattggttggaatcacatttatgttgtccagttgtgtattcacaactgtgagtctgcattatgatgtatgggcacaatgctcagtacctagtttgcataatctttcccagatgcggggtttttcttaagccttcttaaagggctgtcactaaacctaagcatcatggcttggtttctatttgaatctgagaactgcctcagctgttaacttggtgaagccaatcatgttttcagctggtatttctctagtgttaccactttcacagaaaggtttggacacatgctgtgtcattaatgcccagttttttcctttctttttagtaagtcacataaatgtattacctgattgtcatgacatctaggatttttttttgtcctaggcctatctaccttgaagcaaaaaaggtgaattaggctttgatcacctcctcctccagcctaggtttaattagtgacctttgaattcacggggcccctgttttctccattgctgcctgctcccagaataatcttagcccttttttccacattccaagccatgttttagaaagttaataatagcacaacaaacatttccatagcatggtatgattctgtgtacaggttgctacatattatattcagtgaatgataagtgctaagtaagaataactcaaaagaatgagagatgtaagtcatcctatgttctagtttgcaacataaatccccaggaagcttgatgtaatgttcatcaccaccaccacaaccaccacccccatcatcatcatagcaactacaatttattaagtatttgctctttgtcaggcaacatctataatataatttaaatatcaaggcaactatattagttagattctattatgatctccattttatggatacggaaactgagatttagagaacttaactaatttgtctaaagtaatacaactagtaagtgtcagagccatgatttaaagcgagagtctgactccaaaacctgtgccttaactattatgctggactgcattctgttatagagaggaattcgttgaagagactcacttattttttaacttttatgttaagttcaggtgtatatgtgcaggtttgttgcataggtaaacttgtgtcatgggggtttcttgtacagattatttcatcacccaagtatgaagcctagtacccattagttatttttcctgatcttctccttcctcccaccttccaccttccaataggccccagtggagattcacttattttgatgaccatccaagggagtgaatacttctaaaatgcccagataactcattcaaagatggtctatttcccataaattccaaggaaaatgttctgaaaaggatcatgtgtattttgagcttctttttaaaacctagggagaaaatacaatatccccatgatccctgcttctttctactctgtctttaggttttttcatatcaaaaatgctgcaacctgaaggaactctgggctgtcggatctcctaaatttaacttttaaacctaagttgtaatcagcatagctttactcccacataccttctattttaccagccatatctcccctccagcagagtatcagcaccagggatgttgggcagaagcccagtagggggtggccccagtgttatttattgttttataggctgcagaataaagtatatgtgataattgatttactcttcgtcagcctttgaggctgataactcaattagcctgtcagatactgactgtgtatctttttcaaaaaaatcctcaaaggtgattttgtattttgtattagataaggtgtgagaggtattttttgcttatattgtattaaaagttcttattttctctgacgatcagcagcagaacaagcagtgttaccataatagttgggtttttttcttctttttaatctgtgtgcttcaagagagaatgatgatattttgaagcaggcacataaggaaataaaaatttaacaatctcaggtgaaataattttgatttccagtccccagctgagagagagagaatatgtattcagctgattggcagggctgcttgtgctcagtagcacaaattgctggattagagaaagggccagaagggtggtgagggaaagtctggtccatggctgagttatgattttaagacagtagattttgattgggcataatgatcagaaaaaaacttttgagtgcacaaacctctgcatacatattatgtacataataaaacacaaaaatgttatggacactaaatattttctttctatactctatggatgtccttttataaccacagggtacatatatccccattttgaagactactgacctaggagttatactttgtgtgaccctagaagagtctattagatggtctggacctcagtttcccatatataatataagagggatgggctaaaatacagtttcaagtttcattttatgcacgggtattcctatggactttagcctttctttcaggatgaggttttaactgctgttttggaggcattatgagccagattattactgaagaataaggataatattaattgttgcaattagtagccctcctattgcatttgtacattcacatttatatgcatgattatttcaatgtggcaaaaatacaatttactaagttaaggcagtatcacaatttgttttccctatgtgctttacgtatttccaccctatcttttaacaagtgatgttttgttaaaccactcagatatattcattgatacagtggttttaacaatggaaatttatttggctcagacctaaagcctttatataaaagttagtaccaaaattcaataaataaagctatcggttatttggttgtttattggatagagatcaatattgccttgttaaaggtaatctgagtgttagaccagtttgtatgatccatctttgctacaatttccacatgtttaaagcacagagatgtataattgttagtttgtctataaaatcctatgtatatattaaattgtctaaagtcatataaaatcataccctctagaccatagacaaatgggaaatcttctgtgtattttgatatttaagccaagttcattccacttgtgttattgggtaagttaatagatcatttcttattagagtttttgagttagggagacttaaccctgcctttcacacatccattatgaagacattgtaaaaatacttcagggtaccacaggaagtacaattttttctttttctttttttttgagacaaggtcttgctctgttgcccaggctggagttcagtggcacacacacagctcactgcagcctcaacttcctgggctccagtgatcctcccacctcagcctcccaagtagctggggctacaggtatgtgtcaccacacctggttgacttttaaatttttgtagagacagggtctcactgtgttgcccaggctaatcttgaactcttgggctcaagtagtccttctgcctcagcttcccaaagtgctgggattacaggcatgagtcaccacacctggctaaagtacaactttttagtctttgaaaagtaaaacatatttggatctatgaaatcaagaaaacaacttaatgtgtgtacctctccccttctatatctatataataatattgttatagtgtagttccattcagttattttagtttggaatcatgctttttattgaaattgttggtaattttatttgtatgtattaactgaacattgattattttgctacccagaatctattcacctttctttttgaaaccacacttttatttcctttgtagatcacccctccccacacccagcccacgtgcttaccataggcatatgaggtaggcctaagccaattagagccttacatttccataggcttcaatgattaatttaagggtgggcacattacccagttagagcaaaagagatacaatgaaacttcagtggacacacctgggaaagaagttcgtgctgttgtcaataaacttggagttatgtaaatataacttctggagttgctacagccatcatgtgaccatgaaagacaaatctgaaatggatgagagcagaggttaaattgaaagaatgagggatgagatctttagccatccaatcagacctatttaactggaatttttcattatgtgatccaataacttatcgttttgcttaagccacttaagggttctgttttctgtcacttggaactggaagaatccatttgatcatccctgtgcaatcttaggggaaggcatgggctttgtataactacccgtagtgccaaatctttcaacatggaaggagagaaagagacagagtgaacaaacatattcaggcgctttggcctgaattaacggaatgggtagaagtgaggcatattttttctctttaaatggtagtttatttcacgtttgtttagtgatgcattatgccacgctctgtgccagacacgacattcagaggtgaatgataattcaactctgaagttcacaatgaagtgggagattattccaatacaaggaacactttccagggtaacgggaacatatccaagagacatctaactaggatatgagacttgaactctgctctattgtgtcaatagtaggcagcgaagtggagaaggccattgcaggcaaaggaaataacatgagatatattctttaagagtccctgagttttgagtgccttatgtagctactggcaattgtagtagggatttatagtggaagaaagttttgtgcatgactaagtagtagtacttgggtcactgagacagcaattaaagggctgatactcctatttataaatgataccagtgcctagatctatgtctgaatgatagaatgtggatttagcttctccctagaatccaaaccatattatctgaatgcatgtttgtgcctcctgcagagtgccagtgcagcacaaatgatataccagagacgtgatctctatcctcaaggagggcaaaatctgaaatgcgccactttgataggaagcagaagagtggtgggatcgaggctgcaaaatttacatattcattgatatgtgactgggtatttacttcatttgcaaataataggtaagtgcattgtgcagaatagaaggcacatgaaattatgtaatttgaatgggaaatggggaaaatatctgtaaattactaagatgtgtggtgtagtaatcagctttctcttctgacaaaatatggcacatcaaccctctcatttattatgctctattacgttcttttaccagtcacgctacaagtttcacacactcccaccatgaaactgccagtcttcctactccatcactgcattgctagtgaaatgacttttaatgtgcaccgagtgtcagcagtcttctaggtgccctggaggaagaagacctctgcctgggcattcattctaaattaagcataaaagttagtgctcaattgtgaagatgtgcaaattataatttcaaaataccttaccatcttaaagctacgttccaacagctgggtattaatactacccagatacttgtttacttcagttatcttacaagctgtctacaatcagggtggatggtgttttagaatagaaaaagagcttatagctgtagatgatcaaataatcagtggccattaaaacacacaggggagttgcgttttggaattttaaaatgtttgaatcaaagggaacataaaaatagtaatagggaaatacagtctgttatggttcgcagactatagatgtgcctacattttgaaaaatcggccatttaaaatccaaatttaataaaacaaatggggtgattagttgcatttctgaagggttttgttgagggagatttgttaaaatatgtattgcatctgctgcttttaaatgttggctttaatagattatgaactctctggtgagatgaatagcaaggaaacaaaggtcaagtatttaatgtcaattgaaaaatgaagatgaaccatctctgcaattataatgtgttaatggggaaaaaattcaatttacaattagcaaagcactgcattcgaagaagcacttgtgttttgaaggccatacaagggaatcctggcatgtgtaatagcaaaaacataacatgtttaaacagctcatatagttagttaagccacgttttccaagacatgccataagtaaaagggtttatgaaaaaaaaaagagagggagagggtaagtggggtgggaaggcaagaagtggggagagataatgcttagaaaataatttggttgatcacagtaatgggtatatgagggaggattgggatcctgagagaagaggtattctaccatttgtctggctgtcatgtggacttgggagcaagagtcattcccagtggagtccattgatgtccctttcccttgacaacttactaatttatttattcttacatatacatattcccttattcatttgatggacacattttgtgagcaattatgatatataggaacataataactggggaacaaagaatgttgggggtaggcaaaatatcagggcacaaatttggaggatccttgcagtagtgcatagaaggagcaattgcatcttcactatttacagagatatagctaagcttgggccacattactgaagtcttgaagacatccaattgtacttgcgcatcatgaaagtctcattagggaaaaaatgcctttggatgctaagctggaaaatgaagacaatgttgctctcttggctttgacactaagttagatgtttgaccttggaccaacacttaagctttctgtgcctcagtctccttgtctaaaaaagaggataattctgtaatgctgcttgccatggcctcacatggatgaactcaggattaattagattaaagaagtgatcagtgaagcacatgaaagctcctcagaggtactaagtgagcaggacgaataacaattggaatgttagctatagagctgtaattggagtttgttttaaataggtcacttcctgaaaaccagggcaaatggtacttaaaaaaataaactttgttttacaatagttttagatttatagaacgattaagatagtacagagttcccatataccctacacccactttttcctgttgttaatatcttacataatatggtatatttgtagaatatattaatgaaccaatatttatgcattatcattgagcaaattctgcatatcatttagatttccttagtttttacctaacgctctttttctgttccaggattacatccaggataatacatttcatttaaccatcgtgtctatgtaggatcctcttgctgtgctgacttctcagacttttcttatttttttatgaccttgacattttaaagattatggtaaaatacacataacataaaatgtaccatcttaactgtttttaaggatacagttcattggcagtaagtacattcacactgttgtacaaccatcaccgccatccatctccagaactcttttaatcttgctaaactgaaactctatatccactaagcaataagtcactatccaccctccccctacccactggtagctaccattctactgtttctataaatatgactactctaggtacgtcatataagtgggatcatacaatatttatccttttgtgactaacttatttcacttaacaccatcaaggtttatcaatattgtaccaggtgtccaaatttcttcctttttaaagctaagtaatatttcgttgcatttatataccacattttgttcattcattcatctgtggatgaacacttgggttgcttccactccttggttattgtgaacagtactgctatgaatatgggtgtacaaatatctctttgagactctgctttcaattattattattattattattattattattattattattattattattattttgagacagagtctccctctgtcacccaggctggaatgcagtagtgtaatctcacctcactgcaacctcggcctccccggttcaagcaattcttgtgcctcagcctcctgagtagctgggattacaggctcccgccaccatgcccagctaattttttttttgtatttttagtagagacggcgtttcaccatgttggccaggctggcctcaaactcgtggcctcaagtgatccgtgtaccttggcctcccaacttactggtctgctttcaattcttttggagctataccaagaagtggagttgctgcatcatatggtaattctacttttaatattttgagaaaccaccatactattttctatagcagctgtaccattttacattcttaccaacaatgcacaaggttgtacatattgttgccaacacttgttttttttttatttttgatagtaactatcctaatgggtatgaggtattatatcactagcatttccctaatgattagtaatattaagcatcttttcatgtgcattttggccatttgtatatcttctttggagatatgtttatttaagttgtttgcccattttataatcaagttgtttgatttttgttgttgagttagatgagttctttacacattctaggtgttagcccctcggagatctttaattcagaaaagaatttctatgcaatgaaaagagagaaaagtaaagagtaagtaaatgaatgaattcatattggcttcccatcgagcagatctctgattcataagaattatctccaatatacttcctaaatatttaattttttcttttttaaaatataaaactttgcacacacctgtagtcccagctactagggaggttgaggcaggaggatcgcttgagtctgggatgtcaaggctgcagtgagctgtgatcctgccactgcattccagcctggatgacagagtgagactccgtctcaaataatatatatatatatatataaatatatatgttattgtgaacagtagtgctatgaatatgggtgtacagatatctctttgagactctgctttcaattattatttattattatttatatatataaaatttgagatatatagattattatttgagatatatatataatttttaccagccaattaaaatggatttttacttactaagcaggtagactggggctaccttggatttttacttactaagcaggtagactggggctacctttcctaaaaatcacttccttatccatgaactcaagtgaccagatgccttcaaaccaagtttcaaattgcccaaatgtcttctcaggagagaaaaatttgtccctgtgaagcaggcaggcagctcaggggacagatggatgccagggagtgtccctagagatgataattgtaacccatcctaacataacccttctcttcctttatgccctctctcaaaccacttatcttctaatttccattgacttcttctccctttttaaaggatgaaaccacccaactgatgcatctaaagtactagtggcagaactgggcttaggcatatagctcataacttgttattaggaagatataatagatagaaatgtgttttttgacagaatttgaagatgaggaagaaaattatagggaggctttaagtgttcctagctttcagcttcccttctaggaaccatctgatggtctgggttcatgtgcttggaagcactaagtgcagcatctccacactgagcaggctgatgtttgcatcgtcttccaggtacaaacagtctcctcaccactgaggggcactatcagatgtaattgggtctagcaggaataagacctaggaagaaagaacagatagaaaagaggtacacaagatgaaacatagcattctaccactaatggggattaggggtttgaatagtgcctagggcatcctgctttttcagaatatttacaaagaatggaatgtctagaataatgaagcctgacatagtgcttggtgctgtatacataatgtctcacttaatactctcaacccaatgaagtatgtactgttattatcatctccattttaaaaaggaaggaactaggcacaaggaagttacatagcttgtccaagataatacaggaaaaattagggaccaggtcacatttgtcttattccataactcttgcttctaacccaaccatttgtttggcttaatgagtggtgagttaaaaatgtgagcaatgatgtgaaggcagaaaaatgtggtctgcaacatgggaggtacaaagtgggggtggggaagtatagtaccagaaaaaaaaataactaaagttggttcagagagagaagagttagatggttattaaggaaacccctggaagaaaatatttggcccctgatgtctcagtaactcctatatcttcaatgtgaaagaagactaaatgaaattgataaaaatgattttttcatttcaaaatgagcataaaggtgttcttctccctctaattagtacagattaattagatgtaaactatagtccacaggccaagaaacaaattcaggtagggatatataggtggattaaaaaaacaccaaaatatgaatatcaaacaaatcctaagaaaaacagtacttacacattgcagaattgcttaccttatgttatttctggggatacctaagccatatctgtttattcagccactgatagcctctgaaaagtaaaagccacttttacaaatccggggtaacactggtgtctctgtaatcacaggacacagatcaagctagagtttgttactctgatatctctctgtcacagaaatatggccccatatgcaaggactgagtaagctagttgccagaatggctaggaagggggtgtcagtttcagccatggtattcttgtagtattatttaggctctgtgggctgccacgttccaacaggtctcactaggcagtggttgtgtatttttgttgcaggattacttgtaacaccatttcatttctaagacttgatgttctccctctctatttctatagagcattggaaattggcaaaaataaaaaataataatatagccaattcgatccaagctgacaacatgttcctatttttctccatctgccatgaattttatattctgacaagggcttgacctttggagaagcagacctctgttgggttacttctttggtacatttttatcttccaggtattttggaaactatttacctgtgctaataatttgccatccaaataggtcagtgcttcactgacttattattatttgtgtattctaaggaagcctatttggtatgaacagactcattcttacttttagagtttcttattctatcagaattcaaattaacagaacttctatatcatttgcaatgtgtcaaaatgaaatggagtcccttgagaagtttcccaaaaatggtatagtaggaaacctcaaagcaaagctttctactttacttagttttatttttttttttgttagtcagagagactcctatttactgctttaattgacttttttcatttttttaaacctcattgagccacaccttatagagctacaggtaacattattaaacacttaatgtgagacagacattgtattccagtgttttgcatgcactatctttataatatccctagtatatttttagctccactttacagatgaggaaattggggttcacggtacttaagaaactctcctgaaggcctgcagctagtgatatggaagctaagattcaaaacctgtccatctgactttgaagcagatgtttttaaacagttgactgatattagctagtgtattggctaagttactgtaacttggagaccccaaaatatagtggtttaaataatatagaaatttctttctctttgatttcacagtctgtatagagtagctctgatctatgagatcatttaggggcccagatgccttccatcttatgactccaccatgatttaggaatgcccctcatctgcatagttaaaactggatcactgttgcatctgcattccagcccatgggaaggaaagaagaaagagaggttatggaggtcaagtattttcatttctaagaatgtgaagcagaagatgctcacatcaattctgcttatatccttttggctagtcacatagtcacacctagctgcaagaaaagctggcaaatgtagtctctaaataggcaggcgtgtgtctagccagaatgctgtggtccaaatgttggttttcccccgaaattcacatgttggaacctaataccaaataagatagtattaagaagtgggggcatttgagaattgattaagtcatgagggctccaacctcacaagtgggattagtgcccttataaaagaggttcaagggagcacccttgccccttctgccatgtgaggatacagcaagaaggctccatctctgaagcggagagcaagccctcaccagacactgaatctgctggcaccttgatcttggatttctcagccttcagaactgtgagcaataaatttcgactgtgtatacattaccctgtctgtggtattttgttatggcagctcggatgaatgaagacacagaacttgggaggggcttctattactaaaaggaaggaggagagaacaaattttaaggggcaactggtagtccaccataccaccatagtgtctggtgttatttatcatcatccccttccagaatacaaaaagtcaagtagagggcatcagtaggagactatcttctgtagaaaagagaatgatctggtgtcagatactctggacattgcaggtaatgttataaaggttcagggatggaagctttaaatagcacctgtgttgacttaaatattcatgctaatattcacttagttttatatcccttcctgagaagttaggtttaggggacatttattattttagtatttatacagtagtcaaacttttgttctgtctacagccattttttcagttgttaccattataatattgataacctgaaccatcaagttaatccttttctttaggcttttattcttgtaaatattcatcagctcagcattttctttgctgagcaccttattcaactagaaaggagaatgttgccccctggaaatatcagcaatgatttagatgtgatcgttctcagatttcctcatgtctgtgtctcagtgtgcataaatatacaggctaactgttgctgaggcaaagggttggagatagattccatggtttatagcaaccctatttgagttgcaaatataaatgttgtatagatgctctcccatagtggtgttagagtctgtggatttacagaagagagttcttgacctcacaggagaatatgcggtaaagagtgttctaggagtagttagtagtagcttttctgggctttctttaggaaaatttaatgctgggatttgggcattaaaagttcctccacagtttggtgcaagtgcaaatacttctttaagggaatttttaaaagccacccaaagaattggattgtggaggaaatcaaagaatgttaacatagaagcagtagaaaatgtttctctatgtgagttctcatttgaatgtagatgtgagtgggtgggcaggtaggtactttatgtaatctgataggaggagaaatttagaggtggtagacttgacaagtatccctctggttctccagaactttaggatgacatgttagacattttcttgaaagttagtgagaggtgtttcctctgcaaacagatcgctgaaagtgaccagtttctagatgtagaaaccatcccagttgcccaggtttatctctataaaccagaatcaacaccaaccgactcttgtcttagcccaagggaacaagaaggtattctgcttacctgtttcccaccacaagaccaattttagaattcatttttatttatctcaatacagctgcctttttaattggcaatgatctctattgaatttctaacttatgctgaaacggtggctgctggtggctgtttgtatgaggtatttggtattttattttggcttaaatctgtttttattgctcaaatattgtcagcagatgcattatttctaccggaatttccactgctcagtgtacaggttatctccactttgacagctctgtatcttcaatgtcaggtacactgctcccaagtcatactagatttacacattctattatacttctattgaacagctcttaatctgctcagaagaaaacatgctacaaccagcaaattttatcctcttgcatttaatgggaacctttcttggcaaggatggacagttgtatttgaaccgttccaacaatatctggccagttttggaaagattttgaaggagttaaccctgtaacagccaaactctggttgatactttaatattgcctgaacacccaagttctaaccctgctctatttactgagttactccctcccccagctgccaataattcctaggaaccttgcctaatataatccctgttttagtcactataagttaggtttgatttacaatggaatttcatgctgaaattgggtggcaagatgcacatgtatttcttgggataactttactgcataatcttatattgattgtatttcaaaggaagtgttttcaattgtgctactcttagcttcatgcagcagtgggttgtgttataatggggttattccacatttattggctgagtttgtctctggagagatgtgtttgaaattaagaggaggtggggcagagttttcttctacagtttgcattctgaggtaggtaatatctgatattcaggccagttcatttttcttattgtttcttctctcctaagacactgtgaatataaagtaacaagagacaggacagaggctattgctagtctcctcatttgtatgatgggaataataatgcttaccttgcagagatgtgatgatgataaaatgaatataaagattgtaaacatgttcaatatatagttaatgctggtggaagcttctgagtagaaggtagactctaggattatccacacataacccttcatgtattttctgatctcctccactgagatctgtcctttgaatactatctctttaagtatgtatgctggggtattaagtctttttctttactgtagagttatctagtgtgtctttttatatcttctttgacatctttatctactgaaaaatctctaaacatctgtaactgtgctcagaaacctcttatccctgaagacccccagaagggctaagcggtaaccagagcagaggcaggagaagaagttgtaagaaagaggaagaggacaaaaaaaggaaactcaatgtttatgttgacaaatcagcttatttatcaagcatcttttttatgtccagcactatgctagaggtggaggaggtgctctggacttcaaggattatcgctctttcttttgtttttttgaaacagtctgactctgttgcccaggctggagtcagtggtgcaatcacagctcactgcaacctcaacctcccgggctcaagtgatcctcccacctcagcctcccaagtagctgggaccacaggcgtgcactaccacacctgggtaattaaaaaaaaaatttggtagagacacgggatttctctattttgcccagactggtctcaaactcctggactcaagcaatccttgtgccttggcctcccaaagtgctgggattataggcttgagttgccatgccgtgcctggcctctcttttttgaagtgttaagtattttagacttgaaaataatcagataatagccatcaagtaatataaaaacaagtcctaaggcaggccatttttgcttcaattataatttccaggtataacacccccatgttaatttagcctatgttggtgttttctctggtgtgggaaggttatttcaagtattgtaagatagttgggcactgtctatcttctccctccttattcagagtcttccttctgccctcagttttctgaccttgcatctgccttcagttttgcagtcctaactccttttttccccttatcaacccccactgctagcattttaaatgccattgactttataaggtgtcccttcctatagctcagcagttctaccttgttgcagctgctatatagcactgacctcttatctctttcaaaaggaaagatgaatctaagaagcgactgtggcaaagcaaactattcagaaactggcttgatgctatctctgagagaggtttgcttagtttgcagaagcaaatgtcgtgcatgcttccatgttgcttagtgtgatttgtcacttgggattctcaagcatttgatatgaggccctgactggcttagctcctcatcagaatgcactacaatttgttcacttcaaacccaccaggaatagagggcattcactttgacatctgctcttcagaagcagcccattaatactgtacttgatgtgtcaggttcttaaagaaatacttttagttcttttatccacaatcagatgacctggttcaaggtcagtgccaaccctaagctgtttttctttttgcttttcccttttgacagtcattatatgcctttgcctgtttgtaatcctcagagcctctcagctcaggcactggtaagtgtggtgcaaagattgaggtgggaccaacattattggcatccccggattttggccactctcagaggtacctcagtaagctacccagtgatctcatatcctctcttccttcctcaatctgtatctgttccaaactgcttcattcccactgctgtacatggcttctaatatagaaattatcatatagttaaaacctatcatatgccaggtgctaagccaaatattgtgcatgtattatatgtacatatattatctcattgaattcctgtagaacctctgcgaggaaggtggaaactcaggctctgagagactaagcaacctgcccaaggtcatatagctgggcaatgtagaatgcagggctgctaatagcttaacaacttaaccccttctggactagtactctttataaagataatcacttgtttattattttcaggcaacaaacacttattgcacattattttgtgactgccactatgctaggcattttggatatattaatagattaaaaatacagtagctactctcataggtatcaaataagctaggggaacgagacaaacagacaaatgaaatgccataaaaatataagatttgaggtgctaaggaaaccagaggggaacttaacccagaccatgaaggttatgtaccctatgttgcctcgcaggatgagtaagaattccctctctcattctcattctcattcatattctctctctctctctctctctctctctctctctctctctctctctctctctctctctctctctcgtatccctatgttggataggtccttctccttcctttgtacttttttgtgtatctcagtaatagcacttatttattcttttcattcacttaacaatagtttgagtacccactttgtgccaggcaacgttttcagcactgggaacagagcagtgaacaaaacaaagttctgcccctcttggattttactttctagtatggagatagacaggaaactaatagataaatggatatggaataaaatgtcaggttgttaaaagtaacatgaaggaaaatagattgagaagctggagaatgacagaaggtgctatcttatagggaagacttctttgagaggtgacgcttcccatgcagtactgtgattatgtgtttacatttctggctcgcccttgatactccgtacctctggaggtaatgggctaagtctttactttgtagccccagacaagagaatgtaggagtttgggggtatcagccaaggcatagttgaaatgatgagtcagtgagtctacagatgtcaagaatgaagaacagatgatgggggaggtaagggagtgagggagctagaatgctgggagattattgtcagagaagaggagatttacatttcagatttaaaagattgaacaattcctgatgattctgtggtacacttacatgtgggaatgactgggtacagtaaggggaagcccactgagtcatgtagctcaagaacctgtgaggctagcacagttgttcttaaacttgggcatacattaaaatcaactagagagctttcaaaattgcagcatgagatcttgccttaggagattctgattcaggagctctgaataggtttcagaaaagggatatatatatatttttaaataagttccaaaggagttttagatgcacagagccaaggttcagaatcactggacaaggatgttagaagtttgattcatgtgggttttaaagccatgaaagattatgtcaggactgagtggaaaggaggcctataagccaggtgtaatggtcctcaatgcatcttggaactgaccagaaatcagtagatggctgtgacaaggagggagagagtgtggtggaacacaggggatgattttggaaaaagaagagttttacacaaggatggagaagtgattaaaggctttcaccaattcagggctatgtagaaatttagggcatcagtatgcagtttggggtactttgcatggaagaaaagttctggcattagtctgcttagcagatctgacatcataacagttaggcatgatctgctccacctagatgtgctgtcagccttgggcttaggagacaaagtcctcagctgcatttatgaatttcagagagacactggacaagtaacttgagcaaacttctctaaagtgggcctgcctttagggaagaatatataggtaaagcctagagcatttctctgagagtttttggaactagtactatacataacaactaactagaatcattggttcagcgtcaattatatgcaaagtattaatcaactatatgcaaagtactcatcaactatatgcaaagtactgagaaagaagttactttctcctgaaagcaggttgtggggcaaatagcggctatttgataataatactggttcattgggttctgaatatttgaagtttctgatatatcgaatcattttggttttgaagtaaagattaccaagagctttcactcagcctgtgattttccctaggcaggtgagacttccaatcttaatagggcttacttaaatgatgcaaaaggcatgcacatgaaccagtaatttttattaataacattatcatcattgtaattacttgcaatcttggaaagatcctggggttataatgtaagaaaagcctgtatttgatttctggctcttgattcttagtgttgtgccccattaggcagcatagggaatgcctctgagttctaatcccctcctctgttaaactgaaaataataataatagtttctttatgctattgtgagaagtaaattagataatatatgtaaatgcatgaagcatatattaagtggctcaataaaagccgcctttcttctcagcttttctttagacaccttttccaatctcactgtagcaagtaaaaattattaaaattggaaccacaaatctttttaaaaaatcatttcaacttttaagattcagggggtacatgtacaggtttgttacttggggcgtattgcatgatgctgaagtttggaatacaaatgatcccattaccattgtagtgagcatagtatccaatagttagtttttcaactcttgccctcatccctccctcttccttcaagtagtctccagtgtctattttgccatctttatgcccatgagcacccaatatttagttcccacttataaatgagaacatgaggtagttggttttctgtggaaatataaatctgactctgcttgatgtgtttagaaattgttatcccctgtcaatgggataagttagtctctagcttatacagtatatgcatttgttacttgcctgcagtggaatatatttgaaaatggatcaccaattgatagttagactgttgacttctggaatgaaatgtgagaaaatataaccactcaagctacattcttctattatttgctaaatatccaaattgttaccataagggagaaatatgcctcatgaattgccatgtgactttggcatatgactgtggtaatctcatttttaagaactgcatgtaaatttgaagtaagaaattctagtttcaattaaaaacaaactgagctgaaatatccaaaattcactggctatgagcttatctttaacagttactaatttatatggccaagaggggttgtatttgcaaggccatccccttaagagctgaggttaaacaagtgagtggcatgggctataaatgaattgaaaattgccttctgttccagcccagtgcaatggtttgtgttttgtaataagccctagttggtgaggtaactcatgtcaccaggaggagctgtccacagactgcttgatttgtcactgctgtctgaaggacacaacaggctggggaagctggcactctgcagaatttttatggtgctgcatgcatgcattggtctcccttatcaagctgtaattcaataataaatacaaaaaaatttttgtttaaataaatctagggttgtgacacaacctgaccaaagctaggagagttaatgctgatgctgggatattaacttagccagggagcagtttgggtgaggggaagaaaaagatggatgctgggagagagtctctatttgtgatagagtattcatctgcatggctgtttttctggaatgctttggtctgtgccattggctcaatgtagtcatttttcaacttggtgtctttttgttcttcacgccctcaccctcctttttaaagagagaccaaagagcatgaagggtgacgagaaccactacaagaattttgttgcgataagcagaagccagccttatagagtgggttctgccattttctcccagaatggtgaatggttacaagaaaattactgggacaggtaatttggggaatggatggatttgtgaaacatttttttttttcacaaagaaaactgctttttattttttgttattataaaagtaatatgtgttcactcaaaaaaaaccttcaagcagtacagaaaagtataaagaaaccataaaaatcacctattataattttccccctcatatcagagataacatctgttaacattttggtatatctccttttgtctcttcctgttacctttttcacagtggtttattaggagaaatttctagaaatgtaattcacattttaggaacttgtgattcctatataaaagtgatcctccacaagacagtgctgatttccactccagcaccactgtgtgaaagtacagaaggaagcccatggtcacaatttattgcataatgaccacgtgccagtcactgctctaagtactttgtaaatattaactcatatcatcctcataacaaccctatgagatgggtactactagcattcccattttacagtcagggaaactgaggtttagaaaggctacacagctagtcatgagactgaaccagaaggttgatcaggctttggtataggagaaagaaatagcttctctctctctccctctgccttgcctgccctgccttgccctgcccttcccttccctgcccttcccttccctctccctcctctctccacccccacccctcccccatctgtttacctcaaggcccagggagaaacaaccaatgaaggaagaagtagcagcctagtggataagcagagagccagaggagtcccaagcagctgtgaatctttaaatttaggagttctgggcaaagatgtccttgcattattttcgttcctaaatgagcagaacagaacttcctctccagtgctgggctttgtgagctgaatttgaaccaacaatgagagggaaaatagcaacagatatagatacacttatgtttgtgtgcaaacacacacatatacccatggcaaggagtgtccctctgtggctctgatttctactcagaatcagaacaccaggagaaatgatgatctttgtcaaatgaggtgctcccttagtttcccagcattaaactagagtgggtatagataaatgttcataaatgcagtgatggagagagaattgaaagtctcttattatattccagaataattttgtatgaagtagcagaacatgtgaataactttctgtgtgaccttaggctactcccttcctcttactgaacctcagtttcctcccctctaaaagagaccatagaactaatgtatttgagtgttaagaaccctatctctactttaaacagttcctaactgatttgactttgggttttcttctcctggaccactcttattttttatttttttatgccttttcggggctacttgatctgttattggtctgctgttgctagaaattgttctgtggatgctaagaaggtgagttgcttcatatagtctatcaagtgagaacaattaggaaggcccctatggtcctagaagacagcttatcatagtatctttgagattttactcaaacctttactttagaactattgcctcttttagaggggaggaaactgaggttcagaaagaggaagggactagcctaacagaaagttattcacatgctctgctacttcataagtagcagatcttactctagtaagatgattcaagtgtctcatttttataaaaatgattggggcacaacgatattatgtgatttttccccaaagtaacatatctaattagtagcaagggcaggatagaccccagatcgcttcactgtctagtaaggtttcccaaagtgtattccacttaacacaagtccctcaatatactctgggtggagatcggggcatgaggaagaggattctgaggtcaaataagtttgggaaatgccgccctgtctaaggaagccacaatgtgcattgaagactctgagaaatatagagtaagggaacatatcactaatattgttatagcatttatggctttcagagcactttcatagccatttttagttgtgtactagaagagacaaagcaaaaatgcatataaagtagatcatgggattgaaaaggggataagtgtagccatataaacaaagggtggctgacagttgtggaggttcagcaaagagtcctgcagttattagaataaaactgatgattttgggcctggtcacagtaatcagattgctgaatcttcattttatttgaatttatttaaaggataactccaaaatcctgcaaagagaaaggaaaaaaaattcttaagatatttatagtattaggggcttttaaaatggatttccatccattgataaagaaataaatacccaaaagaagcaagaccagaaagtaactattactaagctgtcttgtattatttctcttggtcaaaatttattaaaagtttgaaagctcattgtcccattaaatgttggtgttaagacttcagttctttattcagaatgattggaggttatattttacacttaacattttccagctggggaactgaggtcacgacaagaatggccactcaagaattctgttggtccagcagttaaggtcatatatgggcttcttttgtggctcaggcagtagactgccattgttttcatatttcaatttgattttcttgttcataattcaagttgggagtgaactaagtggtatattttctccataagcccattgagaggctgagaatctgcttttctgcctctagattctaagttaagaagaacaagggcagggtgcatgtcattcctcttcaccattatatcaccagtggatagcatgggacctggaacaccatatatgtttaggatataattattgaataaataagtgttctgtagagaaaggaaagtggatcaaggtggaaatcatgtacctatttgtagtctactcaaagtatacaagcaatgtttgttgttgatgatgtgtttttctcatgataattgggttgtatttgcaagacctcacttatggaagcaaattaattgctatttaggttctctgactgctatttgggtaggtggcacagttggatgatagaaattatagtttttctaaccagaatctcttagtgacaacgtatattagatcagtgggtttctagtgaattggagtagaggtaaagtaatatcctatatttggattttcgaaacaacacctattaattatcctcctgcaccatcaccattataaagatgtggaaactcagtgtcagtaacttaccatgagcaccttactggttaatggtaccaccgtaactctgaggtaaatctactgttttacagtttggtgttcttggccacccctcctgctaccactaatcaacaacatggggatttgtcttggagctgctacttggtttcagtactgaaaaatatttcagggactctgtaaaattcttgatgggtcatcagccattgactaactcacctgaattccaactgtgtctggtaaagttctaccaaggatgaatgtattaacttctttacaagctcaaaaagtattagaggaggaatatgatattaccaagtgtttactgcccacttctcatgtagcataggggatatgtgaaagcatacagaaacattctgtacttttcaggagtttgcagctctgtacaggaggtcacatggaagtgcctggtatcttcagagaataacgcactatgatacagacatgttgcaagtatggcaagcatttaagtggtgctggaggtcggaggagggagggatcaagaagtaaacttcttgtgatgacaagatagtggcttttgggagcagacttcagtattctctttttgctctaactctccctttctgattcattttttttttctaccagtttggtggttaattagataagcagtgcccctacatctaccactaactcactttgttgatttcctattccacagtgactcctcagggaggaagataggtggtggagttcataataatggtaaatatgtagatgcctacaccttggggatacagattttggtacatgatattatggaaataggtgaacttagttggagaacagttttcaaaagaacaagctatgttttgatacgtgtggagggatttatgctgtccttgatatcaaaattttatgtttccataaatatgtgcctatttgtaagtagtatttcatgagggaattaggtggatggaagcgttgatagtacaaaagattttcccagtagtaacagttaatgcatgctttcccttatagcttaaaacaggtgaagggacttgaagtgagatgcttttacttgcattagagtagtttctctgtaaccatgttccccttcctctttattcaggttttcagcatatacaatatgtgtattaattattaggctttgctgtggggccattttttatgaacctccaaatgttgctgagtgtggaatagctctggggcttgataaaaacatggcctttattttcccaccagtctttccaaataaacctacctcataggaaagtataaagtggtttacagaagaagatttggaagccaagttcccatctttggagtcaaatggttcagcattctggcctggagaatggtgggtagaggggaaaatatgctcctttgtgcctttatgccttctcagactggctaacatcagagctgcatagcacatattctgagctgatggaattgggtaaaagcaggtttaatttgatctcagcactagatttaggagcaagtcaactctgaggaaagattcagtttcagcagagtggagctgagaagaaaccatttgttttcatgaaggaaaaataatctttgaagcaagacttctatccctctctcccttccttttttttttttaacttcagcttcattttcttgatctgcaaatctcaattcctcaaaatctcaagctatttttatgtgtctttttttcctttcataatgtataaacattagcaataaaaagtgatggatcaagttgttagaaaagggggcaactgtagctttttaggaccccaccttgaggaaatattctgttatttgaatccctcctggagtgtaaattccctccttaggtgatgaggtatgtataagtttgccgtaaaattatttttgttacactggggactcagatacacttctactcctactgctgggacttggtctgcatgaataatttgtgtgaacaagttgctcctgtctgtaaggaaactgttaaatccttgactttccagacacaaggatgtcatcttcaggatcctcactgacttatatggacaaatagtattgaaacagatgacaatctgaagttcctacagtaggttcaaaatccaggcagatatccccaacaaaagactaatgaaaaagtctactccgtatgagaaccatgccagggaaggtctttgaattcctacttctctctgttatgctaagctcagctatagatctcacttccatgagaacaaggctagtccttgtggcatttgcaaggaattaggctgggaatttgtggactatggttctaatttcatccctgacattaactgactaaccttgagaaacttgtttcacttttttgttttattttctctgtctataaaatgagggtgtaactacatctgccctagctgtttcacagagatattgtaagaatgcaacataaaaatggggtgttttaaaacctgttgaaagatgtaaacaaaagagacatacaaactaaaggtattgtcaggtatcattattgttaaatatttttggagctcttcaggagcaagttctttggcattgtctccctaaggagacaatggatatgagacgctatgaggaaaaagtaggtaataatacaaaacaggagggttggcggtggtagagagactctggacctttctggaagggctcaagtggctgaagggaaaacaaacattcatgggctggcccaaagggtaaagaaagttcctgcacccctaatctatgcattgtgcggtgatggggaaaatggtactcccattctttcagtaaaaatggttgatatctgaacccagctttggtgactcctttgccagtcctaagctagcactgctatgcaaaaagagacaacaaggggaagaagtcctcacaaagaaattcctgggttagggtaaagccaggaatgcaaaagcctaagggaaaagagtgttttttggttctttttttgtttgtttgtttgtttgttttgagatggagtttcgctcttgttgcccaggctagagtgcaatggcatgatctcagctcactgcaacctccacctcccaggttcaagtgattctcctacctcagccccctgagtagctgagagtacaggcacctgccaccacccccagctaaattttgtattttttgtaaagatggggtttcaccattttggtcaagttggtcttgaactcctgacctcaggtgatcccgcccgcctcggcctcccaaagtgctgggattaataggtgtgagccaccacgtctggcattgttcttcccatttcttctctcccctacagataacttaaaatcctttatctctccaaaagaccaagtaccatttagcaaatcctgctacctaagttgtaatgatctcttcagccccccccccccccccgcaaagtaatgtttgctatgacagaattacagtatgtctggaagagtttgtacttctctgtgatttggtacgaggcaatttaatctacgtgacaaagggagatatctgatttgtgggagcgctgcctcttttgatttccctctgtgctactgaaagaatggttggaatgataagaacagtatttttaaagtgtgttctgggcaatactaatctctaggtgttttttgtttgttttcagaaaagggcttctatggtcaaataaattgggaaatgattcatgctatgattccctctaggaaatgtgttgtgcatgttaggataccaaaagctttgagcagtttaacagtaaaggaatctgtttaactttgtttaatctagcatttcataaacttatttccttttggaagcccccttttcatataataccaatcactattaccctttaaggcctttaagaggtagattcattctcaaatacctgcatagttcagattgctatgccagacaacaaagcctcaagttagagaattcagtattgctggttagccttctccaaaattaaaattgctgtgctaagacaaagatagaatcagggcggtgatgttttctgtccaaaaaactattaaaatgttacagtgattcaacaacatcttcattatgagataggcaaacaatgaaagcggtccacacttattgcacgctcagtatgggccagccactgtgctaagcgctttctcttgttacttctaggcataaaaatgacccagcaagatagattgaatgagtcttcattttagagcccagggaactgagagctagagattatgtaaatcacccaaggccgcagacctagtaagaggcagatctgggatatgaatttcggtctgttcaactccagagtcgatgatttagatttaaaatatttaaagtcagactctgttttctaagtggaaaatggcatttcaagaaatctcaaaattctgtatctgaataatgtatcagctaagactctaaggcattcaggaggctgtcttttggttaaggggggctccacctgcatcgccagagtcagtctaagtataattataggtatcagcaacctagagaacagctggttcaatttaaagtgccctaaggatcacaagcatggtcctgtttacatttacaagctgataggccagttgctgtggctcatgcctgtaatcccagcactttgggaggccgaggcgggcggatcacaaggtcaggagatggagaccatcctggctaacacagtgaaaccctgtctctactaaaaataaaaaaaaaaaaaaaattagccaggcgtggtggcaggtgcctgtagtcccagctactcgggaggctgaggcaggagaatggtgtgaacccgggaggcggagcttgcagtgagccgagatcgtgccactgcactccagcctgggtgacagagagagactccgtctcaaaaaaaaatttacaagctcatttttttgcccacttactaagtttcaagcccatttccatcttctttcactgctgttccttgaggccacctctttaagccacttgcttgggtgcttataaatacaatgtccctcagatgggtacctttaattgtccctcctaatatcactaggtccctatccattcctttttcattgctctggaggggtggcttaaagccttattttgtggacataatgaaaacatgtccacatgcctctagactaagctgtctacaactgaagaaatatgacatccaactaattataacttaattttatcatacatttattattatatatatgttctaagtattttacatggatcaacttatttaatcctcatggcaactctatgaaggaggtactgttgttatcctcattttacagatgagagaactgaggttcggagaagttaagttactcgcctaagattacacagctagcaagctaagtctcaaacccaggtctatatgacctggtttgatgaataattaatggtattatgtgctattacttattttattatactagtcttgctgcgcctggattagccttcctccaaccagaatcttgcctttattgttagtatgctcattgcctcctcccggctctgccactttggtaaatagctgtctagtttgatggttctccaatgagcatcaatgtgtatcagaattacctggaggccttgtgaaaacctggattgctgggacccatccctagaacttctgacttaggaggttatggagcttggcagggggaggagcagtgaatttgtattcctgacaaattcccaggtgatggtccagagaccacatttcgagaaccattgatctcctgttaccactcaattaaccaactcttcttagaaactggttttctcttgagcaactcactgtttattaaaacagaactaaatgtttccattttgacttatttaaaacatcacctaaacatgtatatctccaagtgatttttaaattatttttaattgacaataattgtgtatatttatggggtacaatgtgatgttttgatctatctatacactgaagaaagattcagtcaagctaattaacatatccatcacctcaccaacttatcattttttcagggcaaggatgttaaaaatctattctttcagctatttggaaatatatattattattaactgtggtcaccatgaagtgcaatagatcacttaacttatccaagtgattttttaagagcagtttcactgtactgtgtcttgatcgtattcttgaacctaagtagtttggcatgcaaatgtgatttcagggatttacctccaattaattcccccaatggcttatagccacccccaccaccattcacatcatacctgaaagactttatgtgctatttaacttgattaaggaaatggtaaattgaagcttatttactacaagaatacttagtgacaggcaatatggcttggggattaagtacagggacattgtaattagacttgggtttgaatctcaactttgcctaataactagctgtgtaactgtgctcaagtgaagtaacttctctgagctctatttcttgtacagtgggagatgataatgaaatcaccctcatgaggctataaataagattatatatgtatagcataccctatcatgccaggtatttaaaaaaaaaactaaagaaatagctggtttatgttagtgattgcaaacctctaatcttcaggcctgtgatattccaaaaattgttgcaagagatcagtgacactgtgtgcataccaaaataaaatctcaaagatagaattaataagaagtagcatgtatagatgtacaattcatttccaatctaatctatgtagatgctgatttaattagtaaaatacaaattcacttagaggtatgactaatgatatgataactttctgtcattatgtagtacattttcatcaacagatattaaaagaccaacttttttgatatttaagaaaaatcttcacactttaaaaagttgtgaagcactggtttatctgaatagtctgttaatgcactatcccccagcagagagcaggcctctgaaagaggggaggccaggtcagctttgatgagcaaaggagacagaggacattctagagcatggggtgttgcttaaggagagcatgatgtggagggctggctgctgtagtgggggcaatctgagaaacccagggccagtgggaggatattagtcagggaagagcaggggcaataatgccaagatgtccagggaatctaccaaccagctaatctgttcctaggtgactaaggatttcaagtgaacaaccagccacaccaatagtgtatctagctttagagaaggactatgcgaattcattaggatagcagagtgtgtcttcctgaaggacttgggtgcctaaagtggaaaaatgcattgttgctttattctaattgcattattcagtcaaatcccttcaaaatgatcagcaaacagcccctgaaataggaaagtattggtggcaggagtgaaatttagagttgttttgatagaataattttcttcaggggtttgggctctgattgctacttagactgagtaaaagtattgctgaataaggtgctgagtaaatgcaagttgtcattaagaggaccgtggctagtctcttaaattatatccactattcagataaatgttgcatgccttcctaatagtctgcttccttatcgacttgagcatttagttgttgttgttttttttttgtttgttttgcttttttatttgtatttatgtaagagaaaaagggcaagtggtactcataacatcttgccagagcttcatagatgacatgagtatttgtaaatagggttggagttatatatattttcctagtctagaagtgcaagcttaagtttgcattcattatttgacacagtttggttatggtaatagtatatggtttggtagcagtttaggcttgatttagatgagaaaggaacaattgtgtttcatgtttttatttctaggaatagctgaattcagtttcatgtaattggtactcagaacacagctatccaagcctttctttatagtttctcttccatgtttccatttttatttccacccactcctatatagggcattaaaaaatgtatctctataaccatttaaaaacatgtctgtaaattttccacccagtagattttacaacaaatattttttctcaaaatagcttcgccctgcaacccaaaacactcctgaattattttgcactcatatctacccttcctaccatcccttaataagggctcagagaatgcagactcattaacatcagcctaaggaaaacagcatcacaaaaatcagtccaaggccaggcgcggtggttcacccctgtaatcccagcactttgggaggctgaggcaggcggatcacctgaggtcaggagttcgagaccagcctggccaacttggtgaaaccctgtctctactaaaaatacaaaatttagccgggcatggtagcacatgactgtaatctcagctactcaggaagctgaggcaggagaattgcttgaacctaggaggcagaggttgcagtgagctgagattgcgccactgcactccagcctgggtgacagaacaagactacatttcaaaaaaaaaaaaaaacaaaacaaataaaaaaaaaagaagaaagaaaatcagtccactttcaaagaaaagttaaaatatgcattgtaaaactggatagaactgatttgtacgctttttttgtagttaatacttctatgaaataatatatttaataaattttatatgactatcaccatttcacataattgttttcattggtgtgacggcccgcacaattttaaatcatttcagccgctgtatgcacagttttgtattttgctttttcaactaacacagcagtatttttctatgtttgttcatagtacaattttctaatttttaatgtttgatattccatcttgtttattcagcataagttacttagccattcccattatctgttgtattttaataatttgtgaggttattcatttattttctattaaagcagctaggcaaaagtttgactttacagtcactgtcctctagaatatcaatccctaagtgtttctgcttgactgttctaactctcccatttctacctgggtcaatctgaattctgccacgtaaaacatggttacccagtgaaagatctttacacacagtatattaggttgctaggggaaacttacagtagcaagctttctgtttgcttatttcacatacattctctcattaattcttctcaatgtgtctataagaaggtattgaattatttacaaacacttgggataaagaaggaggataggaagagttgcctgctgttggggaggaagaaaggaaagaataatcgaggtgatggattcattaagttcataacaagctgtccttgcaggaggtaagtctgttaggatatcttcttttcctttcctaccctaactctaaaatttcgtctggaccaactcttctgcctgaactataaacctccaccctgtgaacaatgtattaattttcaaatatttcttgtgtaggtgaatacaaccaccttcatatccacacatgtctgtgctcagtttggcaatgaatcaccttctaaacatccagaacaatcagtcagataaggatcacctttgattaagatcttctctgccaggctctattggaataggtgccagcttctcactacttagagcttacgattgtgcacaatgacagctaagatttgtctgggcaggaacatatttttcccactcttaaagtcaacatttgaggtgtttctaagtggaagaaattccctttgctcattctgacttttcattcagttcaagctctccatcttttgtaagaaatgttgttctccatcgtgctgaagcattaggttgctgtttccccaggccaatcagtctgaagataactttatgatgctgctagagcatgacaccatagtttatccattcttccgatttcatcagggtgcctgacgcttgttagacaactttggggatgcagactgtttggtccagccttgttgcaatcagcagtttttagcaaggattacctagacttatctttgagatccttgataatttaatcagtaaaaacacgacatggccttttgtaggctgcagtgagtgcagatagagtgccacaaaggcctctggcacgctgcaagagtaaaaggtggcagggcactacctgcccactcccaaatgctacatgcttcccctctaccacatgcaaatctttgcacttaatcatgtcattgccaagtcccgcttctggtactttgtatctcagctaaagaagatgaagaagtctttgggggaaattgtcttgtgtgggtaggtatttgagcaattctgcctgcaggtgaagaacttcagcttgtggctgcaccacaactcatgcagtggcacccacaacatgtaccaggaatacctggactcagccactgggggtgctgtcacccagtactacagagaaatgggtgcccagcaatgtggttgggcccactggatccagattgtgaaggtagaagggatcttggccagcaggtgccagcaatcaaacagttccacaactccaagatcaagtttgtgctgtcccaccgcatcctgcattgtcaacacaagccacacttcaccaccaagatgcccagcccaacaccttcttttaggtgcagggccctctcactcctggtctgcccaaataagcccaaaaactcccaggcgctaaagaaaatgcccaggacatggtgttgaaatatgcaaagagttgataccatgtgggacatctgataacgttagtataccacaatagtctttattgttgtggacacagagaaggaactcaaagactctttttgatgatcctgacataatcaggaggagacagtgaacaaactttatttcacaggaggctctgatgatgagtggtaaatttaggatatgttcaagattattctgctttcctccctttacaataagtcaagtattcattaagcaaccactctatttaagaccttgtgcaaagcactgtgggagacatgatgatctattaaattgggttttcttctttcaaacttaaattctagttggagtgacaagatctgaaaaattaggtaacacaggagataaatagttcaaggcaataatagaagaggtgtcatgagacaaaacattattatttgacaaatgaatggcacagacaagtgttctagaggttgcaagaagatagagctgagaggcatgctaatatagtgcctttttctcctgctgttttctctgcctaaaacgtccagtgtatacatccctctccacctgtaaaattcctatttctcttttgagatacagtcattgcctattcagtgcaatcgtcatcagcccacccagagttaatcacattacctctcataagcccatagaatcttagactcactgagagtataaaagcacatgttaatgcctagtgttccattattggaacgctaagcatgtgggaattatttatatcctactgctcaaggtcatcaccacggtctgattgaaaaattaaattgcaacctcaggtataaatgggtttattattcactgtaattattcacttacacattggattcctctaccagactgagaccttcaagggtaggggcaatttgatagtaatttatctttctgtcccaagaacctaccttagaattggacacatagtgttcagtacatttattgaaatgaaatgagtgtagtggaaagagtactggacttggaatcagaattaaaactgtcctgggcttggtaaatgtttgtttttctgaaatgtgtgtcatgtcacctctctgcactgaataaaatgatctctaaagttcttatagcactgaaaactgtgcaatcctagcctgggagtagttatcaaaggttttccataattgctgttgataataaataataatcacaacagttaacatttactgcatacttactatgtgctaggcatagaacatgaattatgtccttcaaccctcaaaataaccctatgtggtaggtactattacactcattttccagatgaagccaagactccaagaggttaatttactagaagtcacacagctagaaactgttgaaacagagactctagttcaaatctttttgaacctagaggcctttgctcttaatagccacactagtcattctcaaccctggctgcatatgagaatcaccagggagtttttaaaaaatagtgatagccaggcccaactctgcagagattctggttcaattgatctgggatgaggactaaacattggcagcttttaaaagctccccaggagattctaatatgccaccaggtttgagaactatttcattacatttttcagcctttgagagtacacctgggccttgtaaaagtttgcagtttagatggacaagagaaagaaggacattctgggtgggaattctgtttaagctttaaggtgatacacaactatctgaatgtgtcttatttctctgaagcaggtgccctttgttgtatcaaagctacttacagctgagtatatataggccagacttagttcctgatgcaattgcatttggaaacagtttcaagagtttcctcagttcagaaagggatggcttctgcactggctgctattaggtcatctgccactcttctgacagaggtcaacgggaaaaactacttccttgtgtagggacagcaggttggttctctttgccccatacagtagactgaaaacctgtcagtttctaagcaaccgtttaaatctggaattcatgaatcagattaccttactgagaaagctggaatgaagagaattttgaaaaagtcatggaatggcttccccctcctttgtggtacaacacttgccatggggctggctttacagcattcttgaagacattgttctctggtcactgcagtaaaagaagcagcttatttggggttttgttggctgctgctgctgaggttggggatagtttcctgagaatggtatacctgagaggatcgagaacagcaaagaagttggtagtaaaatgatattaccttctgcatgtggccattgagaggatttactgagataatccacgtaaaggggttagcatagtgcctggtccgggggtagtcctctgtaaatgctgttggctgcttgtatttctgtgtatttgtcaaaacaggatagtgataagatggcagaaagatgccaacagatacagtttgaggtgatgtttcttttatgacaaaggattagaaactagagggatggtatgaatagcagcagatagggcaccatgcttcctggtgaaagcatggtgctcaggtttctgcaaatttccttgggggtatgcagctgtgggtgacaccacttgcttgaaataaggattttgtcaggatctagaaggtccttttgccatttttactatattttattttaatcctttcctgttacttcccgactattttgcagactctgactacaaatctacctactcaccaaggtcaaataaatgaccacaactctttcacattcttaagtatttacgggaataataggtgaggggaagctcactttgcaggaaacatcatttagtgggataggcctgtttgaggtctacccctgcagggctctggtgatgctttggaatagggtttatctttatttggaagtagtaagaccttggcttcaaatgagaacaaaacatctcttaggagagttttttcctttgaaaatgctcaatatacaataatgcaaacttgtaaaaattttaattagtacagcaatgtataagaattaaaaatccatgttctattttccacaagcccaccatcagtctcaaccccccagacgatcacggttaactcttcatcatgcatccttccagatctttacccatccatctataaataaatatatgtacaaaaataggattccactatagtatatagtatccgttttccctctcacataacaatatgtcttggagattttttctatgttaatacattggtctctgtatctttttttttaaagcaactatgtaatataaatggacttttcattttgttccatttttttctttatgaacaaaacatttttaaataaaaacagcacttatgtgttaattcaattatctaacttcatacagccaataagtggggaagtcaagatttggaccaatgttggccgattccagaactcatggtattaactgctaggcattgctgtcatttccacaaattattttcactctagttttctaatgtaagcagtagttatgaggcaacaattaaatctcagagttgaaaggaacctttaagacaggttatttagtttaacatctcactctgcaagcaaattattagatgtttacttattaggaaaaatcattcctgaaactttattttggccaaataaaactccattaatttatttgcatttgcagtggtagaaactgtgggttgcttaaacaatagtttgtcttgcctcctttatattttatatcaccattttttcatattatcataaccctctgacataggtagagtaagctattattatgcccatttcataaatggggacactaaacatcagggaaattaagagacttagatttatacagtcagttgtggaaggccacttgaatggcaggcaaaggaccttagactttcccctgaagggagtgaggagttattgaagacttttgagcaggattgaggttatgggtttaggtggatggaggtcagtaggtggtaacatgacaactggaaaacattaggaataggagtcgcaagagccaagttagcaagccaagtcagccattcaagtgcaagtagataaggagcatgattaatcttgatagttatcaggcttgaaaggagaggatagatataagaaaaagtaagaagacaatcttgcgggagatgggggactggagagagaaaagaggtaaagatgattccagagatattggccagaagaaaatcaatgttggagggaagagtagtttggattagttgttgaacgctggcagttagatatttaagtagaaatgcgaagcaatctttggaaaatgtaggactgggacttgggtgagagcagttctgaggttcagcatcaagagtggtctaccttcacagagcttttcacacactcagcacattaagtctgaaaagggatcttaaaagtcgtgtacttgaggtccctcattttacagataagaccaatagatgatataaattgcctagggcttcacacagttcctgagaggtgatgataaatcagatcttttgagtcttagttgtttacttttacctgaaaacgagaagttgcaaactggtaatggaccactgatagttatgtttggccagtagggttatattactgttcacaaacacttgatgcctctctctgctccgccttccccttaacatcaaccttagccacatggcttactttggtcaatgaaatgtgagctgggtcaaatggtatttctagttctagatccctgaggaattgccacactgacttccacaagggttgaactagtttacagtcccaccaacagtgtaaaagtgttcctatttctccacatcctctccagcacctgttgtttcctgagtttttaatgattgccattctaactggtgtgagatggtatctcactgtggttttgatttgcatttctctgatggccagtgatggtgagcattttttcatgtgttttttggctgcataaatgtcttcttttgagaagtgtctgttcatgtccttcacccactttttgatggggttgtttgttttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttagttagatcccatttgtcaattttgtcttttgttgctattgcttttggtgttttagacgtgaagtccttgcccatgcctatgtcctgaatggtaatgcctaggttttcttctagggtttttatggcgattcctcagggatctagaactagaaataccatttgacccagccatcccattactgggtatatacccaaaggactataaatcatgctgctataaagacacatgcacacatatgtttattgcagcactattcacaatagcaaagacttggaaccaacacaaatgtccaacaatgatagactggattaagaaaatgtggcatatatacaccttggaatactatgcagccataaaaaatgatgagttcatgtcctttgtagggacatggatgaaattggaaatcatcattctcagtaaactatcacaagaacaaaaaaccaaacaccgcatattctcactcataggtgggaattgaacaatgagagcacatggacacaggaaggggaacatcacactctggggactgttgtggggtgaggggaagggggagggatagctttaggagacatacctaatgctaaatgacaagttaatgggtgcagcacaccagcatgtcacatgtatacatatgtaactaacctgcacattgtgcacatgtaccctaaaacttaaagtataataataataaaagaaaagaaaagaaatgtgagcagaaataatatgcattatttttgagatgagcattaaggcaaaatttaagtgtataatccaccagattttcttttccttctatcatgaggtcatcaatattctagatagaagtagctctgtcagcttgaacatgatatggaacagagacacaacttacctatgatgggagatgatatgcgtaacaaaaaaaacttgttgtaagctaagatctcagggtcatgtgtcaatgcagcataacctagcctgtcctaactgatacagcctacaacattctgaaaaactgaatcagtggctaacattaaaaaatttggagagttaacagaaaaatccagacttcgggtttctgatgagaaattggaagaggtggcaacatttagccaacttacatacacatggcatgatttgtctgaggctgcatagcagttcttcccttagaaatttgtgttgagtgtagttatacccagtatccactattcctaattgtatcttatacccacccattttttctttatttacatttacatatttacatattacatttatttacattatctgcctgggccttgcaagcatttgaatctgccactctggctttattatagctttccactcctcagggagaaaatgctagagacaaaaacaacagaggactggagacagaaatttagatagtacctacctgtaagtgtgagaaaaagaatcagtagagagacaaataataactgcctagaaaagtaacagaaaaaaaaccctgaattgcatagtgaccaaaacaaacaaaaaaacaaggaagagtcaggaaagaggggatgatcaacatcaggtaaaactacagagttcaagaataaagacagtgaaaaaaaagcaggtcacatgtaacccattaaggaataattgcagtgctttggtgattacggaagccagaggataagagattaaggggaaagtgctgctgagaggatggaggcattgagataatttcttttttaatgtttgctattgaatggaaggagaaaagtaattggtctctaaaatggcagcagaatcaagccaaagaggatttttccccctctttttttttctgtttttgaaagagggacaaatttttgcaaagcagagtaaggaggaaccaggtgattgagggagcaaagtgtgggagatgtctgggaggtgtggatggagaacacatctgatgcagttattttagaaataagggataatagactttcatctaagtctgctgacatagtgtatggggtcttagcgaatcatcagaagtgactcaaaagaagcagtgtctgggtcccacaatgggtattgggtaagggaagaatgatgaccttgtctagaagttcattgaaggtctgctgtctctggttacagttttgaatgaagagcagacaggcagtgaaggatctgatcactgagagactgaacgctgtttgtggcaggaacctgagccctgtgctcagatatattcttggtgctattctggccctcttttctgtcagttctgcaattgtactaataagaaatgtctcttgtctcccataggttaatgagtttggggaggaaaaatgcagagtttactatgatggcaggaagggcaatgcaaatggcctgctgagaaacttgaaatgcaccgcagggctttgaatttcatttcaaccgacaaacattctgctcatcaaacagcaccccctgaagaagcaatacagaattactaaatatactatcagtagtttccagcctgtgatcctagacccctggaaaccctgctgatggtctgcatacagagtcctacactattagtgcttacaatatgatagtgtctatatttctgtcaatgacataaaatggggacttactaatgctatattaccatctcatgattatgcttgggtttggaaaaaaatgcaactgacccatagaccttccctgtaatgcaacaaaaagagagccactctgtgtcatgatgtttatggagaccatgctgtcattcctactatgaccacaatgagagtattaccagggacttcctgatggggtcttagtgaagaatgaagacaagattgttctgtttttttttctgccttaacaagagcagcagcacttatctcactacatccagtaaagtctgttttgtggaggcatacaggtggagaggggacttggagatgaaagctggtaataggtggcccataggatcatttgcctatggaagggattgaagaatagaaacaaaattatagtcactatttaagtgttatggggtttgagttatgtgtccattctgtcagcagattcatttttctgagtgttgaatggggccacaatatagaagaggagggtagtgtggtggtgggaaatgtcctgcctcgggagggagggaaggatgtgtagagaaggaggggcctgatttttggactgtagagtaaaagcaaagagagaatgactggttttcaactgtgtttgactttattgttcttatgtcactggactatgctaggcacaaaaattaagaattagcaaaatgagcaaggcccatgttctcttcagcttattcactcaactataacagtgacacttggtgatattctattagcgaactagattacttctcagaatagcaactgttttccttgattacgtgaatgttgtaagtgacgtactgattcatacttttatggctggcctcatatgggagattgaaaaatcctttctgaggaagtggtatttatacagggacctcaaggatgagtaggagctagtcagcagtggtgggatggggagaagggattgctttaggaaacagtatgcatgtacaattgccttgggaagggaaagagcaaggaatgcctaaggatttcagagaagatcagtggagcatggtgaacaaataggagagtggtatcagatggggctgaaaaggtagacaaacaccagaagcataaagatttttttttgtgggactcagctttgagcattcattgaaagcaagtttatgaatattgttagatacattgtactagaaaatcttcatattctcgggcttgtgttgtatgtacagtcactcatttgatcattcattccaacaagcttatgttaaatatctgctatatgccgagttttttgtgccacagagttgtatacctcccagatctgtgtaaatttcagctgccaccaacaatgtggtcactttttcagtcctttccttaggatagcatcagactcagcttcttttcattattattatcttaggtataacattgctggtttgaagaacagggcccaatgccagtgacctctgctgccagctatccagaaaatgttttccaagactctcctggtaggcaagagcaggagagagaaaggaaactgcagctgtgtcttcatgccagtaaagcagcatttggggagttattaggcttagttcttacagctcttttcaactatgagctttgacaaagagtctgtaattgtcattttgaaggtcggtggatgtcacttccttcctccttggtctttctagtttttctttatttagactctgtttttttccctgctgcctttttaaatttgttccatctcttttattcagttatcctagccatctctctgagcatgggtaccaggggtaaggaccctgttctcagtaacagggaaagaggagctgtactcagataggctagcactgacccaggaatgcacctctgcagacatctttatcctccttcacaaatagtatttgtgctgaaggaatcaagtcaatggcaaagaaaaactggctttcttacctggatacctatttaagaagttttctccacttactctggccattactaatctgacctttctctgaactgtatcgtacatccccactgtgaataataaccatatgatttgcctcttgatgatttattgcattgaattagtttctgaatatttagtatttattgattttgtttccctaacaggatttgaaactcccttgggaaagggactataaccatacttatattttatcatcttagagatgagcaaaattgcaggcatgcagtttagccactcaatggatatttgactgatttaacgagacctgccaccttattgtacaaagcaatctaacatagaggaagacctttagattcccactaccatttctttgattattaaaagacagtagaatttttgacaatgattctattgtcaacctccctcagttgtctttctactggtagacctgtatggaggcatggatttagatgaaacatctatttctttgtgtcaaattctgctcctttgtgtggcagtctgcattatacaagaatgcgcttgccttatttctacatcaaagaaagtgagagccaagaaatgttcttaatgagttctttttggttcttatgccctctgaagcagcccaggaggaagagaggacaataataggggaggacagcaatataggaaagtaggaagatggtataaatgaaagggacagatgtcacttgaggcctcaaattaacttcatcagatctttgaattgctgcaaataaatggcaagtgcggagcaaggagcagtatgtgaagaagacattctttggtcttggcagcctgtgcttgtataacaaagatgagagatggagttgctagtattctctgttgaagatgtaggagttcaatagtggagaaaaaagaaaaatctaagaaagcaaataattgggatagggaaaggggattatgtttgtttcctattgctgctgtaacaaattacaacaatcttggtggttaacacaacacacatttattattttacagcactggaaaccaggagtccaaaatgggtatcactgagaaaaaaacaagatgtgggcagggctgcattcttttctggaaactctaggggagaattagtttctttgtctttttcaccttcttgagggtgcctgaattccttggactgtggtacccttccatcttcaaagaaccaactaactctggacaaactctggtgaagagtatgtagatgacataggagatacagggcaggaaacactgagtgaaagccaatgaccttctgaagatataaaataatttgtaaattttatgagagacaaatggcttgagagcctagtcatgctgctttaaaataattttatgttttttaatgcatatgaatacatttatacatgtaatgtgtgtctgttagagtgaaagttgatactgtttagttctgtgatttaagacatagtataagataaagtccatggacacaattttgtgaataatcttaaacttacccttcttttcccagagctaattgtttaatgctttcttcaccctctgctttatagccttctgtttcattctgggacacattccacccccctcatttttttttttttttttggttcctagccttttccctttgttcctctgctgacatcatacgtgtttttgataatttaataaaatacatagagtcaatcacagcatatgtacatttttggggcaaaaattctgtttaggaagacttctaaaatatttcattccatgctagttaaaatttaagtttaaagataatatttttacagtccctgtagccaattccctagaacctctttaatttatattctgtttctaattctacttctgatgcttcagtgctctgacatgtggcctgcttagaaaaaaaataactttgttgaggatactatatgacttgtgacttttccctaacttgctttggtcagagccatggatttaatttttatgtgggctacagtgtaattctaattcatgactatagtctgtactccttatcctgggttattttacaaaaggagtttagattaaccaccccaaagtgactagatatatgcaaggtttctatttctattattggagaaagaactcctgagtttctgccctactgatagtgagtcaatactccaataattgtacatagaggaaggcacgcagtgagcccttcagacaaaatgctttcatcagtctccttagtctttgattagtccttccttccttcctagaatgacctcatctctctcagaatgacttaaaaagaagcatggctttaaaaaatgagaataactgctaatgactttatgatcctgaggcaaagttttctttgcacaataaatgcttagttatgatttgatagtcaaatgtcgtgatggaaaaatgtatgataggcagtttgaatcagtgtagaaaactcagaaaagaggaggtatagcccaatggttaaatttgggggctctggaatcattaagagttggtttgggttctaagctcaacacttaatggctttatgaccctaaacagttacttaacctttctcaacttaactttcaatatgtgtagtattgcctatcttagagggttaattgcatcacagggagattttcattgaaggttgtttccctaagtaacttggtagctgctttgaagtttcactaagaaatcaacttgcaaaaggcagataataggagaaaagacatatacatttatttaacgtatgtacatgggatcctttagaatgaagaccaaaagatacagggggaactcttaatttttatgcttaggttcaacaaagtatggacagctatgtagaaacatgattggacaaaaagtgtatgatctaatgaataggttgagtggggaaacccagcaagtcctgtctgtctagattcttcttggcctctctgagcacacagttcttccttctgggcatggggcaggaccctctctggaatggaagggtcttatgagctacagccaaacaaggtaggccagataatttctttatggctggttttgccacagaaagtcagagggaaagttaaagtaatatttttaggttttatggctggcttgggggaacatgggttctggtttccatgacctgccttgaagaagggtgattctagtttctatggcaagcctcgagggagaatggaactgtgagaaaggaggatagcagaaggttaaagaaaaacttgtatctgaggctgatcctgaggccttaattttggggcattgttctctgagccccaacactgcccatccaagaaatttaagtgcagagacacactagaaatgaaacagaaataaggcagcctaatgtagttgctcagtggatgggctctggagctggattcaaccccatgctttaccatttagtagatgtatgacttcaggcaagttactttaccttctgtacttcaattttcttatctataaaatgggaacaataatagtgcctacctcaaagccttggtatgaagattaaatgaatacagataaaataataagcacagtgtctgacatttaattgatgtttaagaaagactatctcttcttattactgaaactaatgctgttagtactattaataaaaagatgatatatatagagatacaaggaaggatcaaggatgactcctatttttcaagcttgagcaactggtcctgtggtagtgccattcattgagatggggaaaagtgaaggaggaatagattcgggcgtgtgtttagtgaataacaagttttgttttttgacatgttgagtgtgagatgcctgtggaatatcagtatatagttagtcagttttggccgtgcgcggtggctcacagctgtaatcccagcactttgggaggccgaggcgggaggatcatgaggtcaggagatcgagaccacggtgaaaccccgtctctactaaaaatacaaaaaattagccgggcacagtggcgggtgcctatagtcccagctactcgggaggctgaggcaggagaatggagtgaacccgggaggcagagcttgcagtgagccaagatcgcgccactgcactccagcctgggcgacagagagagactccgtctcaaaaaaaaaaaaaaaaaaaaaggtcagtttttctgtgtctggagatcacagaattgtgatccaggaatgtaatcttgggagaagtaggtattctgatttttaagattatgatagtggatgacataaccaagaaacataatttagaaagagaagggaggagagcccaggatcaatctcggggccatagagggtgaggaatcagtaaagaaaatgaatagatatggaaagaaggtaggaaggaaatctacctttcatgacagttgagacagaagagtgtttcaagaagagagtaatcaactgtgtaaaatcaggacatagaaacatcaattgaatttgactcctttgagaagcttggttatgaagatgcatagaaaaattgaatggtggcctggatgagtcatcaaggaaggatctattttttataatatagaaagttatagtggatgtttatattgcaatagagacatacactagaaaaggagaaattaaagaagagaaaacaggagggaatgggatccagagtacaatagaggggcagggatacttcctatatttctatgagataaagtacatagcacaatgcctggcatatagtaagtgttcaatgaatagtatctgtcatgtttattgttgttgttgttactgtattaactcaagagcccaagctggcttgcatgtggaaaagacagttggagcatgcacagagccaatagccttcatggaatgaaaggccttggtgagcagatagcatttagagtgccgtatcctaaacaaaggcaaaaaaatgtggttccaacatacacagatgcttctcaatttacaataggattacgtccagataaaccaatcgtaaattgaaaatataaagtcaaaaatgtgtttaatactacaacacagcagatagttcccaacttatgatggttcaatttatgactttttcactttatgatggtgggaaagcaatacacattcagtagaagctgtaaccccatcctaagtcataaggagctccttgacttatgatgggtttacatcctaatatactcattgtaatgtcaaacaattgttaagacaaactatcctgaatcagaaactgtccggaaaagcatttggttaggttggcctatctaccctaaccaattttttttatatcatgggaggatgggaggtttctttgattatcatatggatgaaaagataaggtacttttattttagcaactgtacttcaaagaaatgactctaagaaatgggtagatctagttctgttgagattcactgatcagcacatccctggagaggtagccaacactctcctagtacacgttgtccctataacatgtgtgcttaaaggagaaatgaagtgtacccattgattatatttaccttagcaaaatgtgcttccatatgataacattatgcggtaaaaatgctttgtgatttacactgtttgtgtgatgttatgttctcaatacaatgagctgaaggcttttggctattattcctttagaaacaagcacctcttgttgagggctgattttgtccatattatcttgaaatgctttttgcctattcatctctaagtataaatatgagggtttttttttaatcctgcaaaatttcccataaacgtgtgtttttaaatctttcctaaagtggtctttatgcaaccaatagaaatcttaaatatatgatcagttttccaccctgtgttctctagataaagaaaagtttgactggtattagatatgaaaaatggaatgtgctttaaaattttcaatctgtcatttgagatcaatatcagagacagatacctattagactctttccacaactgtctcttatcgttgttaaagtttataagaagttacctggccaggaaatgggtttcactggttttaaacatccgttgttattggtatcatgtatctgctctcctgagtactgagcccagccatttggtttatgtgagtttctagactcctgtgtatttgccttactctctaggatttaggcttttttggttcccatattttgcttggtctagcctgtcacactttgttctttgtacctttagacctgtgtgtgcttgcttgatttaatttattatcttgtctcaactgctgattcagctttgccttctgactcttgagccctgggctaattctcatcctaaagcagcaggttttgagccttgcctccatgctacattgtgacctcagcaccagcattgagagctggtctaactcataggtctaactcagtacaacatttctgattttcatagcagttgcggtagaataaaaagaatactgtgcttaatgtttgaatctctgggtttaagctgtagcactgccagaaactcactaaatgcctatagacaaatatcttagcgtctctgaatttcagttttctcctttgtaagataggaataatattctccttactcatttttgtgattaaataagatatcttatgtaaaaatgcctaatgtgataactggcaaatgtttgtaaaatatttaatctcagttttggacactgtgatactctcatatgtttctttgtttccattattagcctgtttctttttataagcaattacttaatttatttccatgacaaataatcataagtaaaatgtatcagtccaaaagttttctggtaaaaaatcaaagtgaaattacaacacaaacttattttaacaaggtcccaagtttcccaattaacttgtctccaattcttatgtattctgttcaccaattgcattatatctcttctgaaaacaattaatatgacaacttgtaaatttctggcaaagaaactgagtatctagaactgagcagaaatatcacagtgattacaacaaattatttttgtctatttgcttgtaaatctgttttttttttaattttttattataccttaagttccgcgatacatgcgcagaacatgcaggtttgttacagaggtatacgtgtgccatggtggtttgctgaacccatcaacctgtcatctacgttaggtatttctcctaatgctgtccctccccttgccccccacctgttgacaggccctgatgtgtgatgtttccttccctgtgcccatatgttgtcattgttcaactcccacttatgagtgagaaaatgtggtgtttggttttctattcctgtgttagtttgttgagaatgatagtttccagcttcatccatgtctctgcaaaggacatgaactcattctttatcatgggtgaatagtattccatggtgtatatgtaccacattttctttatccggtctatcattgatgagcatttgggttggttccaagtctgtgctattgtgaatagtgttacaacaaaaatacatgtgcatgtgtctttgtagtagaatgatttacaatctttggttatatacccagtaatgggattgctgggtcaaatggtatttctagttctagatccttgaggaatcaccacactgtcttccacaatggttgaactaatttgcactcccaccaacagtgtaaaagcattcctatttctccacaccctctccagcatctgttgtttcctgactttttaatgatcaccattctatctcgcgtgagatggtatctcattgtggctttgatttgcatttctctaatgaccagtgatgatgagcttcttttcatatatttgttggacacttatatgtcttcttttaaaaagtgtttgttcatatcctttgcccagtttctgatggggtgtttttttgttgttgttgttgttgtaaatttaagttccttgtagattctggatattagccctttgtcagatggatagattgtaaaaattttctcccattctgtaggttgcctgttcactctgatgctagtttcttttgctgtgcagaagctctttagtttaattagatcccatttgtcaattttgacttttgttgcaattgcttttggtattttagtcatgaagtctttgcccatgcctatgtcctgaatggtattgcctaggttttcttctagggtttttatggttttaggtcttacagttaaatcttcaatccatcttgagttgatttttgtataaggtgtaaggaagggatccactttcagttttctgcatatggctagccagttttcccaacaccatttaataaatagggaatcctctccccattgcttgtttttgtcaggtttgtcaaagatcaggtggttgtagatgtgtggtgttatttctgaggactcagttctgtttcatttggtctatatatctgttttggtacaagtaccagtaccatgctgtttttgttaatgtagcctggtagtatagtttgaagtcagttagtgttatgcctccagctttgttctttttgcttagaattgtcttgtctatatgggatcttttttggttccatgtgaaatttaaagtcgtttttttcaaattttgtgcagaaagtcagtgttagcttgatggggatagcactgaatctataaattactttgggcagtatggccattttcacaatattgatttttcctatccatgagcatggaatgtttttccatttgtttgtgtcctctcttatttccttgagcagtggtttgcagttctccttgaagagttccatcacattccttgtaatttgtattcctaggtattttattctctttgtagcgattttgaatgggagttcattcatgatttcactctctgtttgtctattactggtgtatagggatgcttgtgatttttgcacattgattttttttttattatactttaagttttagggtacatgtgcacattgtgcaggttagttacatatgtatacatgtgccatgctggtgcactgcacccactaactcgtcatctagcattaggtatatctcccagtgctatcccttccccctcaacccaccccacaacagtccccagtgtgatattccccttcctgtgtccatgtgttctcattgttcagttcccacctatgagtgacaatatgcggtgtttggttttttgttcttgtgatagtttactgagaatgatgttttccaatttcatccatgtccatacaaaggacatgaactcatcattttttatggctgcatagtattccatggtgtatatgtgccacattttcttaatccagtctatcatcgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagtataaaagtgttcctatttctccacgagactttgctgaagttgctagtcagcttaaggattttttgggctgagacaatggtgttttctaaatatacaatcatgtcatctgcaaacagggataatttgaattcctctcttcctatttgcataccgtttatttctttctcttgcctgattgccctagccagaacttccaatactatgttgaataggagtggtgagagaggtcatcctttccttgtgctatttttcaaagggaatgcttccagtttttgcccattcagtatgatattggcggtgggtttgtcataaatagctcttattattttgagatatgttccatcaatacctagtttattgatagtttttagcgggaagggatttgaattttatcaaaggccttttctgcatcaattgagataatcatgtggtttttgtcattgtttctgtttatgtgatggattacatttattgatttgcatatgttgaatcagccttgcatcccagggatgaagctgacttgattgtggtggataagctttttgatctgctgctggattcagtttgccagtattttactgaggatttttgcatcgatgttcatcagggatattggcctgaaattttgttttgttttgttgtgtctctgccaggttttggtaacaatatgatgctgacctcataaaatgagttaaggaggagtccctctttttcaattgtttggaatactttcaaggaatagtaccagctcctctttgtacctctggtagaattgggctctgaattagtctggtcctgggcttttttggttggtaggctattaattactgcctgaatttcagaacttgttattggtctattcagggttttgacttcttcctggtttagtcttgggagggtgtatgtttccaggaatttatccatttcttctagattttctagtttatttgcacagaggtgtttatagtattttctgatggtagtttatatttctgtggaatcagtggtgatctcccctttatacttttttattgtgtctatttgattcttctctcttttcttctttattagtctggctagtggtctattttgttaatattttcacaaaaccagctcctggattaatttattttttgaagggtttttcatatctctacctcattcagttctgctttgatcttagttatttctttttttcaaatcacactatttattgccatacagtttgtttctcttttcttttggttcacaatgcttaaatggggaggataatgaaaacaaatctcatagggaatataccctatagacgaaatacattaactacatagtgagttccgaaattattaaagtctagttgctcagttaggatggaagcaggcctctgtggaaagtatagtctaattaaagtttgaggtgtgccttataccaggggttctcaggggagatgatctgacctgacacagcagaggttcctagatgctaaagggttgttctggtgttggtgggcaaagctttgggggttagctcaaaggcaaataaggtatggccctgatagcatgagctctccctctttgagaggccgctaacagtgcagccctgctagggcctaagttctcaaactgtctgtgaaacttttaggattatatgtattttggattccagtagttgaggtcaatagctcagatatggggcctgataaggtatggcctaacattcttgaggggagagggcttatcacagcaaaacatgtcactcatttagcaaatcatataagtgcttggaattattttaaggctacaaaacaataacacaacatgaatttctccaagtgctctggaatatatcattgttagatgcaccataatttgatcataatttaagctgatcacataatgtttttaaatttagttggtcaaatgaaagtcattcaataaacataactggtgaagtggaggtcatattcgttagttttagtaatttcctattacaaaatatattatcagttgcagatatcagttgctccagtaatcctgcataacaaaccacctgaaacccaaaggcttaaaacaatgatcatttaatattgctcatgaaagtagagtttaggtaggtcattcttatggtcttggctaaactcatctgtctgcaatcaactgcaaattgaggaggctgctttgttgatcttgtctgagttctttgacatgtttatgcatgcttgagggttgaatggattttgtctaacctaaaatggtccttgactgaaacagctgggatgactgaaaataaggaagcctcaactctcctccatatctcttacagccttttatatattacccagttttagtttaatgaggaaaatgtctttggaatatttctgaggatactatttagaatttgtttttatgtttttttattagttatttcttgtcttctgctagcttttgaatttgtttgctcttgcttctctagttcttttgtgatgttagggtgtcgattttagatctttcctgctttctcctgtaggaatttagtgctatgaattttcctctaaacactactttagctatgtcccaaagattctggtacattgtgtctttgttctcattggtttcaaagaacttatttatttctgcctttatttcattatttacccggtagtcattcaggagcaggttgttcagtttccaactagttgtgtggtgttgagtgagttttttaatcctgagttctaatttgattgcactgtggtctcagagactgtttgttatgatttccattcttttgcatttgcgaggagtgttttacttctaattatatggtcaattttagaataagtgctatgtggtgctgagaagaatgtatattctgttgatttggggtggagagtactgtagatgtctattaggtcggcttggtccagagctgagttcaattcctgaatatccttgttaattttgtttcattgatctgtctaatattgacagtggggtgttaaattctcccactattattgtgtgggagtctaagtctctttgtaggtcttgaagaacttgctttatgaatttggctgctcctgtactgggtgcatatatatttaggatggttagctcttcttgttgcattgatccctttaccattatggaatgcctttctttgtcttttttgatctttgttggttgaaagtctgttttatcagagactagaattgcaacccctgctttttttttttttttttttttttgctttccatttgcttggtaaatcttcctccatccctttattttgagcctatgtgtgtctttgcacatgagatgggtctcctgagtacagcacaccgattggtcttgactctttatccaatttgccagtctttgacttttaattggggcatttagcctgtttccatttaaggttaatattgttatgtgtgaatttgatcctgtcattatgatgctagctgattatttcacccaatagttgatgcagtttcttcatagtactgatggtctttacattttggtttgttttgcagtggctggtagtgatttttcctttccatatttagtggttccttcaggagttcttctaaggcaggcctggtggtgacaaaatccctcagcaattgcttgtctgtaaaggagtttatttctccttcccttatgaagcttagtttggcttcatatgaaattcgtggttgaaaatacttttctttaagaatattaaatattgtcccccactctcttctggcttgtagcatttccacagagagatccactgttagtctgatggccttccctttgtgggtaaccatacctttctctctggctgctcttaacattttttccttcatttcgaccttggtgaatctgacaattatgtgtcttggagttgctcttctcgaggagtatctttgtggtgttctctgtatttcctgaatttgaatattggcctgtcttgttaggttggggaagttctccaggataatatcctgaagtgtgttttccaacttggttgcattctccctgtcactttcaagtataccaatcaaacgtaggtttggtcttttcacatagtcccttatttgttggaggctttgttcattccatttcattatttttcctctaatcttgtcttcaaactttatttcattaagttgatcttcaatctctggtaccttttttccacttgatcagtttggctattgatacttgtgtatgcttcacgaagttctcgtgctgtgtttttcagctccactgggtcatttatgttcttctctaaactgtttattctagttagcaattcctctaaccttttttcaaggttcttagctttcttgcattgggttagaacatgctcctttacctcagaggagtttgttattacccaccttctgaagcgtacttctgtcaatttgtcaaactaatttttcctccagttttgttcccttgctggcaaggagttgtgatcctttggaggacaagaggcattttggttttttgaattttcagcctttttgtgctggcttttcctcttcttcgtggatttatctacctttcatctttgctgttggtgaccttcggatggattttttgcatggttgtcttttttattaatattgatggtattgctttctgtttattagttttcttctaacagttaggctcctcttctgcaagtctgctggagtttgctgggggtccactccagaccctgtttgcctggatatcaccagcggaggctgcagaacagcaaaggttgctgcctcctccttcctctggaagctttgtcccagaggggcacctgccagatgtcaactagaactctcctgcatgaggtgtctgtcgacccctgttgggaagtgtctcaccatctggagacaaggggtcagggacccacttgaggaggcagtctgtcccttagcagagctcgagcgttgtgctgggagatctgctgttctcttcagagccagcaggcaggaatgtttaagtctgctgaagctgtgcccacagccgccccctcccccaggtgctctgtctcagggagatgggagttttatctataagcccctgactggggctgttgcctttctttcagagatgccctgcccagagaggaggaatctagagaggtagtctgactacagcggctttgcagcactgcagtgagctctgcctagtccgaacttcctggcggctttgtttaccctgttaggggagaacggcctactcaagtctcagtaatggcagacgcccctcccccaaccaagcttgagcatccagagtcaacttcagactgctgtgctggcagtgagaatttcaagccagtggatcttaccttgctgggctctgtggggttgggatctgctgagcaagaccacttggctccctggcttcagccccctttccaggggagtgaacgtttctgtcttgctgatgttccaggtgcaactggggtatgaaaaaaaaactcttgcagctagctcagtgtctgcccaaatggctgcccaattttgtgcttgaaacccagggctcttgtggtataggcacccaagggaatctcctgttctgtgggttgcaaagaccatgggaaaagcatagtatctgggctggatagcagcatccctcactgcagggtcacccacggcttcccttggctaggggagggagttccaccaccccttgcaaatcccagtttaggtgacaccccaccctgcttctgctcgctctccatgggctgcactcactgtctaaccagtcccaatgaaatgaactgggtactttagttggaaatgcagaaatcacccaccttctgtgttggtctcactgagagctgcagccagagctgttcgtattcggccatcttggtaaatctgtttttatccaagaaataatctgattcaacctttgtccatttataaaatgtgattgtttcttccattcaatggattcataagaacagcatcataacacgacgcgacgttttaatgtatagcattttggatatgcaatgggtgaagtcatgttcttgaaatacagctctatatgattaaaagtacctgttgtcacatggtctaatcataaagaagatgaaagagtgaatcagttcttattgacacttagtgcatggacaggtactctgtacatagcgttctgttaaatgcttaggacaacccagtgaggcaaacatagttattactgatttagagatggaaaaactgaacctcacacaggttaaggaatctgcctatagtcatgcagctggttaagagtagagctgggattcaaactctggtcttccttattctagctccctgtgctgtttttactacatgaagcaaactaggcctgtctcctgataacagaatgatagaggagatcctctacatttacaggctgttaaagtggtttatccaactcttggcagtaaacagatgtaaccaagtgtgaaaggacagggtaatcaggggacacagaacgggcaaagactgagtaggacatattcagaggtatgttttattcagctaattcatggctactgaatcttagacctgaaggtaggtacaactcaactctttttgccttcctcaaaaaagaggaagaaaaaagagaaagatcagtgttgaggaaatatatcactatggtatgtagaatggtatctgttaattattttggtgttgtgtcactcctgtcactatcttactaggtgacagcagcagtgtttttattcaagatatatgtgtgtaatattgttttcactggaaaataaataatggatgctatagtcttatgtccccaagaaaattttataagtttttaatgcatttatcatgcatccctacagataactttccccaggaaaattcagccatcagttttgtccatgttgttaatatatatgacatccataatgttacagtgtagagtcagaaagagttcatatttaagctcttccatttattatttaggtgaccatcgtcaatttacttaatctctctgaatttcaactccttctgtcaaatggatcctaagaatattttatgggtctataataaagaggaaattaggaaaaatacatgtacagattcttttatgtcctgttacagtgtcacatggcaattaataaaagctaattccattgctgataatgacaacactcctatagtaacttaagttacattagttctgcactgctcatatccagtttggcagggcagctattattgtgtatgcatgtgtgtattgttttcacatctagaatgtttatctcttgaggatgggaagtgtcagaaactgtttttgtatctctagggccttctcattgctttatttactagcatagttacttgtaatgactatcacaggaaagttatgtagcactttgaactaattttcaagataattattaaacaataactatgtttcttcttaggtattttgtctgtaagtagtgaaagctataggtaggagtgtttatttcattatgccatttggtttgattaatagcctttttctgcaagagtatttcttcaaagatttttttcaaatatgggactatttaaatcactaaatttaaagattttaaggaaatataatattttaaaactagctagcaaacatttactgagtgctaataatttgtcagattctattctaagtcctttggacatattaaataatttaatccttacaaacactgtatgaggtagaatatcattatgatttccattttacagataaagaaactaaagcacagggaggttaagtaacttgcccatggtcacacagctaacatgtagcagggcagggagtcacacatagttaatccaactctagaatctcctatgagtttcagcattatattgcctcttagtgtatgttggtgctaaatttttaagtaaaatgaactttggctacagctatcattattactgattcttaaatattatgcatttattctgataactgatctctttcacacaccctgattaggattttccaactgtgatttgtcctgcttctcttagttgggagtccatatagtttttaccaacttttcatcaaaagccattgcgggtagctttcttcatgtatcatctaattaaaatatcactctgagactgttcctacatttaaaaaacctttacttttatctctccacattttccgatctcttcttactattctgcttacatgtaactgaagcccgcaggagtctattagccttgtgtaagcataccgttggcttgtaattagatatgcagttgaaacaaagcagtttttaatttttttttcaagagtatctcttttcctttgtctgcctatgtaggaatccatctactctgttcagggttacttgaaatttctatatcatgcattagcaagtgaacctcagcttttatactcttggatacatactgctttagaaatgtttttgtcatactaatgtaaaaatcaacagatatgtattcctgccaggcaaaaaaggttttgaggataaatgtaaagtattttcgctacagccatttaatttttttgtttttgctttatttttattttattttttgataaataatcatatataattatggggcacacagtgattgtgatgtttcagaaatattattaaaagtagctaatatctgatatttcaaactccagttgttcattgtgggagatttcattctatctgctttcacattggttttccttacaaacttgaggctctgttcttgcctgtatctttctgagaaggaagattgaaaaaaaatggaagtatttcctgaggaggtggcataatttcttttgagaatatgatgtatagaatggacagctttcttctctctaccttagacagattttcatgaagcaaattgcttatttcccgggaataggttagaatttccgttccttaggtgttctgactatagtgcaacttcaaactggaacatttgagtttgaaattaattcttagggaagaatttcttcttgaggttcaccagaaaaaaggacagttttccctttcctttaaaaacatagaaacaatgcattttcttattacctcagtctaatttctgttttgctaatttggttctgctttggatttcattgctttaaaggtatatctatttatatacatgggctcaacatcagttgaaaaaaagttgattttggctcccctgacagtttcatcttactccgtttttgttcttttgaatttcataaatttacacttaggatattttaatatataaaatgaaaattataagaatgataatttgtgtagaaaatatacatcagatattctttatgagtagaagactacttctgcacatttttttctgtcatttctatgaattgttcatcgtcatctgcattaaaatacactcacttgcattttaatatacagtgtaagtgttgtttgtttgtttgtttgtttttgaaacagagtctcattctgctgcccagactggagtgcagtgatgtgatcacagctcattgcagcctcaatctcctgggctcaagtgatcctcccacctcagcctcccatgtaggtgggactagagtcatgcaccactctgcctggctaattttgacaatttttttgtagaaacggggtcttactatgttgccaaaggtattgctgtttatttttgaatgctgaaactaattttcagggagatcacaaagaaatcttttcatatttaaattataatcattttatgaaattgcttaactgtattaaatctgaatttgtctcgtgtaaagtcatttggttattttttttaaagcgagccttctgaatcatccactcagagccagactggctgggttaattagaagcagctggtgtgcatatggttctaccagaaacctgtaagaggtccacagaagaggtttgccctaggagactcatgagcagtggctagttgtgccaagagtgtagcaagaattggttgaggacaattcagggaagttattaaatagttggagcataaagacttctgttactaaaaaagattgtaagtcaggttttcacacactgggttttggcttatctactgaggataagtgactattgggagagccaaatcaatgtaaaaaggagaagaaatctatgaagttaagaatcaacattgctatgttttctttgaaatattttcctctttgttctttagactctttaatattatacaaatatattcattatgttttgttggttggttggttggttttggtaatccatttggttttctttattcataatctacaactctttttattggaatctcagtttgctaacccaaacaaaggaaccactaatcttttggtgacaacaactaaaccaaagtcactatctctggaactaaatagttcatttaaggcacagcctgaccactccctaatgctaatcccaactcctaagtaattactgaagtattgaaaagtgttctgattctatcttggtgtataaaaactttctattttcttctgcttatttgtgatgccactcctccttgttattcaatacattgctgaaacttacttctgtaaaatttttgtgatttgattgaatgaggactcccatgttactcagtcccttttctattctattcagactccttgtccacgccgcaccctttctggtcatttatctctgggacagttttaatattctattatctagcttgtcctttggctctttgtctacattattattggcttgataaagtcaatttgcattccctgaacacccactacaaaacttcagagaaaaatggtcccaaaactgtgtgggaaagacaagaggaaatcagttataaatattttacacacaaacaaatgattcacttgcagtcactgagagttgctattctcattcatagcctctgatataaacattcacaaagacttgttgatgaataaacatataaagaatgcaaagagttggtagaatttcttattgattattgatttccattttgctcttggatctacaacatggagggtaatgcaacctgtactcttcttgagcaccacgactatgtcactgtgcctagtcaggcattaaattaagtctgtgtagtcaagggtggttattgctgcaactcccttccctcacccaacaagaaaaagcaagctgcttctttgggtgtttcccctcactccttttgaaacatttatcctctggtccttttctcatcttttaattccatgaaaacttacctgtcttcagtctcattctgacaaggctctagtatttgctgttgaaaatgggaaattaagtcgaaaatcaatccctgtcaatgtttgccttctttgaaaacagaaaaaaaatgttgttagattgatcattgatcacattagctttatcttactcctactccttcattctataaatatacttttcctaaaccctaagaatcactttttaacaaatctattgttttcattactgaggcattgaattagagtatgactttgggctttgattgaatactgactctcaaaaacctgtgtaataacactaaattggagacacagagagggtcagtgattctctgtgttacctgttttatataacaactatgtttgagcattgtgattttctttgtaaaacatatctccaggctaactaaatggattttaaaaactgatactatcaggaaaaaaaaaaaacatttaactttggtgtttaagtctctacaacttggctccgccctatgtggccaagtttatgtcttcactatatgtcctacattggtcttattcattacttcctaattgcttgatgtatttttgtaatgacatttcatttagatttgaatttttttgactatgtgttacatttttcctaatactcccagttcctcaaaactttgtacagagctaagcatactaacaaaattaaataaaaagttcaatatcccccacttagatgtaatagaaatttatgccactaatactggcaccactgatacaaaggtattattaaaactgtttattttcttctctccctcacctgtcccagttgaagccttacctaaaatgttaacagtgcattagaaaaagttcttctgtgggtaaaattttagccacgttttcaaaacaaaataactttcttaagttccactgactttgatctcgtcttctacagccagacataacattgtagttgcagtcatgcttggcctgcttgtgatggtgattaaattggatctatgttactgtttatcaagatgtgacattaaagggtcagctgaaaggggctaatgggatgatccattctgtttgatagtgtttattatccacatcaagaaacaaccacattctacatgtgcacaatggagtgctattcagccataaaaataaagtaattctgtcatttgcaacaacatagatggaactggaggtcattacgttaagtgaaataagccaggcacagaaagacaaacacagcatgttctcactcatctgtgggagctaaaaattgaaacaattaaactcatggagacagagagtagaatgatggttaccagaggctgggtaggatagtggggggctgtggaggagatggggatgtttaatgggtaaaaaaaaacccagaaagagtgaataatatctagtatttgatagcataacagggtgactatagtcgataataatataattatacattttaaagtaacaaagaatataattggattgtttgaaacacaaaggataaatgcttgaggtgatggacaccccatttaccctgatgttattattacacattgtatgcctacatcaaaatatctcatgtaccccataaatatacatacctactatgtacccacaaaaattaaaaattaaaaaagaaaacaaccacattgacctatgggctatgtttaaacagaaataatgtatcctatatatgctggctatgaatattattgattctattattatttatatacaagtgaattaaaataactttttcaaatatacacaattctttattttttatttatttatttttttactttaagttctgggatacacgtgcaaagtgtgcaggtttgctacataggtatacgtgttccatggtgatttgctgcacatatcaacccatcatgtaggttttaagccccacatgcattaggtatttgtcctaatgctctccatcctcttaccccctatccctaataatggccccagtatgtgatgttcccctccctgtgtccatgtgttctaattgttcatctgccacttatgagtgagaacatgcggtgtttggttttctgttcctgtgggattatggcttccagtttcattcatgtccctgcaaaggacattatctcattcttttttatgggtgcatagtattccatggtgtatatgtaccacattttctttatccagtctatcattgatgggcatttgggttggtttcatgtctttgctattgtaaataatgctgcaataaacacatgtgtacatgtgactttatactagaatgatttatattcctttgggtacatagccagtaatgggatttctgggttgagtggtatttctggttctagatccttgaggaatcaccacactgtcttccacaatggttgaactaatttacactcccactagcagtgtaaaagcattcctatttttccacagcctcaccagcatctattgtttcctgatttttaatgatcaccattctgactggggtgagatggtatctcactgtggttttgatttgcatttctctaatgatcactgatgatgagctttcttcatatgtttgttggctgcataaatgtcttcttttgagaagtgtctgttcatatcctttgcccactttttgatggggttgtttgtttttttcttgtaaacttgtttaagtttcttatagattctggatattagacctttgtccaatgggtagattgcaaaaattttctcccattctgtaggttgcttgttcaccctgatgctagtttcttttgctgtgcagaagctctttagtttaattagatcccatttgtcaattttggcttttgttgccattgcttttggtgttttagttatgatgtctttgcccatacctatgtcctgaatggtattgcctaggttttcttctagggtttttatggttttgggttttacattcaagtccttaacccatcttgagttaatttttgtataaggtgtaaggaaggggtccagttttagttttctacatatggctaaccagttttcccaggaccatttattaaataggcagtcatttaaccattgcttgtttttgtcaggtttgttgaagaccagttggttgtaagtgtatcatgttatttctgaggtctctgttctgttccattggtctagatgtctgttttggtaccactacttgctgttttggttactgtagccttgtagtatagcttgaagtcaggtagtgtgatgcctccagctttgttctttttgcttagaattttcttggctatacaagctctttttttgttccatattaaatttaaagtagtttttcttattctgagaagaaagtcagtggtagtttgatgggaatagcattgaatctataaattactttgggcagtatggtcattttcacgatattgatttttcctatccatgagcatggaatgtttttccatttgtttgtgtcctcctttatttccttgagcagcagtttgtagttcttgatgaggtccttcatttcccttgtaagctgtatgcctatgtatttcattctctttgtaacaattgtgaatgggagttcattcatgatttggctctccacttgtttattgttggtgtgtaggaatgcttgtgatttttgcatattgattttgtatcctgagactttgctgaagttgcttatcagcttatggtgttttggggctgagacgatggggttttctaaatatacaatcatgtcatcagtaaacagagacaatttgatttcccctcttcctattcgcataccctttatttctttctgttgcttgattgtcctggccagaacttccaatactatgttgaataggagtagtgagagagggcatccttgtcttctgcctcttttctcttttcttttcttctttctttctttctttctttctttcttttttttttttttttttttgaggcagagtctctctctgtggcccaggctggagtgcagtggcgtgatcttgactcactgcaatctctgcctcctaggttcaagtgattctcctgcctctgcctcctgagtggctggaattacaggtgcccaccaccacacctggctcattttttatttttattagagatgggctttcatcatcttggccaggctaatctcgaactcctgatctcaggtgatccacctgcctcagcctcccaaagtgctgggattacaagcatgagccactgtgcccggccctcttgtgcctgaaagggaatgctactagattttgttcattcagtatgatattggctatggatttatcataaatagctcttattattttgagatatgttccatcaatacctagtttattgagagtttttagtatgaagggatttgaatttgaatggatttttattgaaggccttttctgcatctattgagataatcacgtgtttttgtcattggttctgtttatatgatggattacgtttattgatttgcgtatattgaaccagccttgcatcccagggatgaagttgacttgattgtggtggataagctttttgatatgctgctggactcagtttgccagtattttttattgaggatatttgcgtcaatgttcatcatggacatttgcctgaaattttctttttttgttgtgtctctgccaggttttggtatcaggatgatgctggcctcataaaatgagttagggaggagtccctctttttcaattgtttggagtagttttagaagaaatggcactagttcgtctttgtacgtctggtagaattcaactgtgaacctatctggtcctgggctttttttgtttcgtaggctactaattactacctcaatttccgaacttgttattggtctattcagggatttgacttcttcctggtttagttttgggagggtgtatgtgtctgggaatttatccatttcttctggattttctatagtattctctgatggtactttgtatttctgtgagatcagtggtgatatgtcctttatcattttttattgtgtctctttattcttctctcttttcttctttattagtctagctagcagtgtatctattttgttaattttttctaacaagcagctcctggattcgttgattttttggaatactttttgtgtctctgtccccttcacttctgctctaatgttagttattttttgttttctgctagcttttgaatttgtttgctcttgcttctctagttcttttaattgtgatgttatggtgttgatttgtgatcttttcaagtttctgatgtgggtatttagtgctataaatttccctcttaaaactgctttagctgtgtcccagagattctgctatattgtctctttgttctcattggtttcaaattacttcttgatttctgccttaattttgttatttacctcagagtcattcaggagcaggttgttcaatttccatgtagtcgtgtggttttgggtgagtttcttaatcctgtgttctaatttgattgcactgtggtctgagagactgtttgttatgatttcagttcttttgcatttgctgaggagtgttttacttccaataatgtggtcagttttacaataagtgccatgcaacactgagaagaatgtgtattctgtcaatttggggtggacagttgtgtagatgtctactaggcccacttgatccacacctgagttcaagtactgaatatccttgttgattatctgtctcattgatctaatattgacagtgggatgttaaagtctctcacttttttttttttttttgagacagagtttcactcttgttgcccaggctggagtgcaatggtgtgatcttggctcactgcaacctccacctcctgggttcaagcgattttcctgcctcagcctcccgagtagctgggattaccggcacatgctaccacacccagttattatttatttattttttttttgtatttttagtagagatagtgtttttccatgttggtcaggctggtcttgaactcctgacatctggtgatctgcccacctcagcctcccaaagtgctgggattacaggcatgagccaccacgcccagcctaaagtctcccactgttattgtgtgagagtctaagtctctttgtaggtctctaagaacttgttttatgaatctgggtgctccagtattgagtgcatatatatttaggatagttagctctttttgttgcattgatgcctttacaattatggaatgcccttctttgtcttttttgatctttgttggtttaaagtctgttttatcagagacggagattgcaacccctgcttctttttgctttccatttgcttggtaaatattcccccacccctttattttgagcctatgtgtgtctttgcacgtgagatgtgtctcctgaatacagaacactgatgggtcttgactctttatataatttgccagtctgtgtcttttaattggggcttttagcccatttacatttaaggttaatattgttatgtatgaatttgatcctgtcatcatgatgctagctggttattttgcacattagctgatgcagtttcttcgtagtgtcattggtctttatattttggtgtgtttttgcagtggctgttattggttttttcctgtccatatttagtgcttccttcaggagctcttgaaaggcaggcctggtggtgacaaaatccctcagcatttgcttgtctgtaaaggattttatttctccttcccttatgaagcttagtttggctggatgtgaaattctgggttgaaaattctgttatttaagtatgttgaatattgtcccccactctcttctggcttgtaggttttctgctgagagacccactgttagtctgatggacttgcctttgtgggtgacctgacctttctctctggctgcccttaacattttttccttcatttcaaacttggagaatctaatgattatgtgtcttgggcttgatcttctcatgagtatcttggtggtgttctctgtgtttcctgaatttgaatgttggcctgtcttgctaggttggggaaggtctcctggataatatcctgaagcatgttttccaacttgcttcaattcccccccttaatttcaggtacatctgtcaatcgcaggtttggttttttcacatagtcccatatttgttggaggctttgttcattccttttcattttttttctttaatcttgtctacatgccttatttcagcaaggtggtcttcaatctctgatatcttttcttctgcttgatcgattcagctattgatacctgtgtatgcttcacgaagttctcgtgctgtgttttacagcttcatcaggtcatttatgttcctctctaaactggttattctagttagtagttcctatcactttttatgaaggttcttagcttccttgcattgggttagaacatgctcctttagctcagaggagtttattattacccaccatctgaagcctacttctgtcaattcgtcaatctcattctccttccagttttgagctcttgcttgagaggtgttgcaatcatttggaggagaagcagcattctcgcttttggaattttcagcatttttgcactgtttttccctcatcttcgtggatttatctacatttgatcttgaggctgatgacctttggatgcggtatttgtgggagggtcttttcttttgatgtcgttgttgttgtcattgctttctgtttgtttttcttctaacagtcaggcccctcttctgtaggtctattgcagtgctggaggtccattccagacccttttcacctggatatcaccagtggaggctgtagaacagcaaagattgctgcctgctccttcccctggaagctccctcccagaggggcactggcctgatgccagctggagctctcctgtatgaggtgtctgtccacccctgttgggaggtctctcccagtcaggaggcacgggggtcaggtacacactcgaggaggcagtctgtcccttagcggagctggtgcactgtgctggtagaatctccttgtcaggatcagctgctgtcttcagtgctggcaggcagaaacaattaaatccactgaagctgccacagcagtcggccttccccctaggtgctctgtcccagggagatgagagttttatctataagcacctgactggggctgctgcatttcctatagagatgccctgcccagtgaggaggaatctagagaagcagtctggccacagctgctttgctgtgctatggtgaattctgcccagtccaaacctcccagtctccttagcactgtccggggaaaaccacttactaaagtctcagtaatggtggatgcccttcaccctaccaaactcaatcatcccaggtcgactccagacttctgcactggctgtgagaatttcaagccagtggttcttagcttgctgggctctgtgggagcgggacccactgagcaacactgcttggctccctggcttcagccccctttccaggggagtggatggttctcctgtctcgctggagttccaggtgccactggagtatgaaaaaactcctgtggctacctcggtgcctgctcaaacagccacccagttttgtgcttgaaacccagggccctggttgtatatgctcacaagggactctgctgatctgcagattgcaaaaatccatgggaaaagcgtagtactcagggctggcagcacagtccctcactgtttcccttgcctgggggagggaggtaccccagctccttgcgcttcctgggtgaagtgacaccccatcctgcttctgcttgctctccatgagttgcacccactgcctaaccagtcccattgagatgaactgggtacctcagttggaaatgtagaaattacctaccttctgtgttggttttgctgggagctgcagaccagagctgtttctattcggccatcttggctccttccaaacatacacaattcataaacatacttatgagttagagctccttctgatcttggtctatctgagagaatgtgtgagatttaatttctctgtttagatttcttaagctataatctggctttgaccatgtggaactgagcaacatttctgtatagcttttattcccactataaatgttcttgaggcttttaacttctgatgatctagtctttacaaagtttctgtagtgcccaagtgttgctgttttttttttaatgattaagatgaagtgattggcaaacttttataatccttcctatttcttcttaattcctttcttttctggaagttaaaccaatgtgctacacttttctgtccttctttaaacattaaaaatagaataattgcaccaagtggtacagatcaatgttcgtagtaccaagcagcaacctaggataatcaattaggtcaaccttttccaagtaagtaccatgggtcattagttctgagggaggttgggtaataggtgctgcatggaaaaagaggaagtagctatgattaaatgatatttgaaaactgatattttactgcatttttctcagagcctttaatatactgatgtttcatgtgaatttccaggaaagaaatatagtaggcagtatttacagggttatccaatttttttgcttccctggaccacattggaagaagaaggattatcttgggccacacatataagacactaataggaacaatagatcatgagctaaaacaaacaaacaaaaacagaaaacaaaaacacaaaaacatctcataatgttttaagagagtttatgaatttgtgatgagcttcattcataaccatcttgggctgcatgtggtccacgggtcgcaagttggacaaccttgatttaaaactttttccaaatgaaatgtctcagagagctagtgacaagtattccacatagcatattttgtgaaatgctacattagatgaatcctgcaccaagtgtgtggagacatgtgtcctgattcctcttctgccacagagtagttctgcgactttggagaagttgcctttatggcttttgcatttcctatttgtaaaaaaataggaagttgaattagaacagagctaggggtaggggatcacttctcagaaaaaactctgagactttttcagcccttccaacaaagttttgacataatcttctaatctcttcaaactttaaagctactgttgctttgggagcacagagtgtcccttatctgtgttgagatggagagtagaagttgagaaccactgggctgaaatcctctttgagctcacttccatctcatacttatcatgtgtattacagatagccagtcaaacccaaagtttgttttggctacctgaaaaaatgttaatgtttttgttgatgtgatatttcctcataacagtttgtcaaaaatattctgctacttagaagcagttataaccattccctttcatctgtttcaggaatacttatgtcatcagtggtatcaaactaaataacagagagagaggatctctaagaaaaaatgtttatttgggaatagaaattgcagtgggaatacaagtgccatagtaaactattcaggaaggtaaaagaagataaagatttttaaagaaaaaatgaggattacataaatattttgagataattatcttggctacaaggatcaataacaagggtggcacaatgtgtgaagttggacaggcagcttctgggcagattgtctcatggaaaattgaaatggtctttgtgtaaggttgtggctttcgcagtcttttgtgataattattgttattggggatttatgcctgagaaccctcccttcatggccttccttgactctatttgtcatggtttttagcacaaatgactccattttgattatgacaattttcacatttttcccttttgatgaagatatttttctgaaagacttactcattgattatcctatagttaggttttcattgtccctccatgccaagatggatctgtcctgatttcctctagtctggtctggtctccagtgtgaaggaagtgattgatgactaagagtcagtgtcaaaactcttttagccatatttgagcaacaagagagactggggtgagttgctcttgagctaaatctacctagagtccattattaagttcaaatttgtctgtttagtagatatttgttattatctcaaagtattgggccgatatcattttgttaggagttatacttttgtagaaatgtaacaactagctagctggtacaaagtttaaaaaggaaactatgaagtaaaattaatagtaatataataatcatagtttgtaggatagtttttttttaattatcctttaagttctagggtacatgtgcacaacacacaggtttgttacatatgtatacatgtgccatgttggtgtgccgcacccattaactcatcatttacattaggcatatctcctaatgctatccctcccccctctccccaccccacgacaggccccggtgtgtgatgttccccttcctgtgtccaggtgttttcattgttcaattcccacctatgagtgagaacatggggtgtttggttttttgtccttgtgctagtttgctgagaatgctggtttccagcttcatccatgtccctacaaaggacatgaactcatccttttttatggctgcatagtaatccatggtgtatatgtgccacattttcttaatccagtctatcattgatggacattcgggttggttccaagtctttgctattgtgaatggtgcctcagtaaacatacgtgtgcatgtgtctttatagaagcatgatttataatcctttgggtatatacccagtaatgggatggctgggtcaaatggtatttgtagttctggatccttgaggattcaccacactgtcttccacaatggttgaactagtttacagtcccaccaacagtgtaaaagtgttcctatttctccacaacctctccagcacctgttgtttcctgactttttaatagtcgccattctaactggtgtgagatggtatctcattgtgtttttgatttgcatttctctgatggccagtgatgatgagcgttttttcacatgtctgttggctgcataaatgtcttcttttgagaagtgtctgttcatatcctttgcccactttttgatggggttgtttttttcttgtaaatttgtttgagttctttgtagattctggatattagccttttgtcagatgagtatattgcaaaaattttctcccattctgtaggttgcctgttcactctgatgatagttccttttgctttgcagaagctctttagtttaattagatcccatttgttaattttggcttttgttgccattgcttttggtgttttaatcatgaagtccttgcccatgcctatgtcctgaatggtaatgcctaggttttctctagggtttttatggttttaggtctaacatttaagtctttaatccatcttgaattaatttttgtataaggtgtaaggaagggatccagtttcagctttctacatatggctagccagttttcccagcaccatttgttaaatagggaatcctttccccatttcttgtttttgtcaggtttgtcaaagatcagatggttgtagatgtgtggtattatttctgaggggtctgttctgttccactcgtctatatctctgttttggtaccagtaccatgctgttttggttactgtagccttgtagtatagcttgaagtcaggtagcttgacgcctccagctttattcttttggcttaggattgtcttggaaatgcgggttcttttttggtttcatatgaactttaaagtagttttttccaattctgtgaagaaagtcattggtagcttgatggggatggcattgaatctataaattagcttgggcagtattgccattttcacgatgttgattcttcctatccatgagcatggaatgttcttccatttgtttgtatcctcttttatttcattgagcattggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgcacattgattttgtatcctgagactttgctgaagttgcttatcagcttaaggagattttgggctgaggcgatggggttttctaaatatacaatcatgtcatctgcaaacagggaccatttgacttcctcttttcctaattgaataccctttatttctttctcctgcctgattgccctggccagaacttccaacgctatgttgaatagtagttttaaaaataaattaatcctttataaaactgttaagaccgtcacagacatttacaatatgtttaaacttttagttttgtcctatatttaaaaaatagtcatcttattttaggacaaaaatttagcatataagttttttatacaaatttttaaaaagatttttatctgtatatatatatatatatatatatatatatatatatatatataacttaaacaatctctctttggtttctttaaatcttgtttttattgttctaaacctatatttaaaaacaaactttaaataacctgaatttagacaaaattactttctaaataaataacccattttcaatgcactttcaataattggttttgttagaaatacatcttttgtggttcactttgtatataaaattatacatattaattagaatttttaacttttagtaaccttaatttttagtgataatctaggaagaacttttgagctgtctatcatatatcagtattttatagatgagaactattttataatttttaaaaacatgttttctcctaacataattttatgtatattaatagatgtaaattatttagttttttaaataaaatttaagtattcaagaacaaacttatggttagtaatttatgttttagtattttatcttatttgaaaatgaaccagataattaatgagtgtttaatatttaagataactttagatttttcaattatatgaaaagtttatttataaatgttaatcccatttatatttaactgttttattatttatttatttgagacagggtctcagtctgttacccaggctggagtgcagtggcacaatcacagggaatttaactgagtaattgttttgaggtcagcctccatctcctgggctcaggtgatgctcccacctcagactcctgagtagctagaagtacaggttcccgccaccacacccagtcaatttttgtattttttgtagagatgggatttctctacatgttgcccaggctggccacgttgcccaggctggtctcaaactcccaggctcaagtgatctgcctgcctcagcctcccaaagtgctggtattacaggtgtgagccaccatgcttgaactatataatatatatatatggattacttacggaaactaagatattagacaaagctggttgtcattttgagttattttcttgttaaccactttttttccttatgaacttcatttgtaaattgttaatcatttttatagcctgtgaatatctgggtgtttacctaagtaatagccttaaatatatgagcgttttgtcaataacacagaaaagatagctgtttttactaaagtagcaatattaaattagtcttatcaatgagttttacaaacaaagattattatgtttttaggttggatttatagttttattacctcaaatcatctagtagagataagtataatcttgtctaaaaagtaaacccaaaaataatatgttgacaattttgaatatattttaatttttattttattaacaaatgtaaaactgattatttatcaaagatttacttaagtcatgtgaactaaaaagcatttgggttaattactatattttaacaatttttatgagtgctcatttacctaagccaatctaaacagaatttttaaaagggaattctggttaactctgccaggtttttccaactagatacaatacatgtacctacatgtaaatatacctagacatgtgtgtatatatacacaaaagatcctataggttttattttaaaattttaattatgaaacagtaaaacatgataatacaaacttaccagtttataaaatgatagttgcttttaaattatgtttttgacaaaatgggactagtttacatgggtaaattttatttgtcccagtaggtaatctaatgaaggctatagacctaaattttggataaagaatttttaatgtggtagttggattttttttttaaaaaaacctctttttatttttatttgttttaagtgagtttaagtatttaaatgttgacattttaactaggactggctgaattgtataaggaaaacaaaatttccagatgaccttgaattttagtaacaaatttattttttgttagtctggtttgactagttaacgtgggaagggaacattttagaaaatgttattatttcttttcagctctttttcatcccttttgggcacagaaagcaatttttatgtcagacagagatatattatggttttgaactgaagattttgatctatttgatctgagtctttcataaacatttatctaggttttaagactattaatcctttaattaactatttcattgccctttgtaattattagttaggcaaacctaagttcacattttaaaagttgtctaggttggttgttgccatggagctgttgtaatttgtagtatcattaatttgaaagtcctttgagactctttttaaaaaatcttggctgaaatctcataagaaatgagtatattttaatactagcagaaaagtcagcagatttaaagtgggtagaaaaaatagagagacaaagaacttagaaggctctccatgttaactctatagttggttgtagttttttttaataagcttagagagtttgaataattgccatttaagttctgagttttttatatggtttgcctaccagttgaaaaatgtgtatgagaatagactataaattttgaatgtatagttgtctagaattccagagggcttggcatgctttagaattttgagaatcctgttcttttttttcttgagaccagagaaaatcttatcagtactgtcagggaatgtcaggagtttggactggtattttcgatggcgtcgactaccctactagcttttaattggctgtcttgcactcaccatttagaatggttatttttgctcttggaagatgtttagaaacaaataaggtaaaaaagagccaaatcatttacagacacatgtaaccaaaccaaaatgacaccaaaatcagaatattcacaaaaatttttagccaggtttatacatcaaacaaaatattaaaacaggcacaaagaaacaaaagtgaatttaccagaaaataaatgtctcacagacagaatataaactagagttctcaaaccagaaggatccttgtctttatatcagaaagtgcttgtcaaaaaagacttatggtcccagaagggatgtaagattctttatttaaagtggtcttttaactaaatcagatctggaataaagtaaaaaaggactcaccaaagggagggagtctgagaatctgagagaagattcgccagggcagaaaaggaactcacgaaaatagagagtacaaaggactcagtcattgctgcattcaattccagaggtcaagatttgtctgaggtgagttcattttgaactcatttctaacactgtcttggtctgttgtgttgctgtaacagaatacctgagactgggtaatttacaagaaaacagacttatttagttcacagttctgcaggctggcttctgttgagagctttcatgttgtatcacaacatgacagagaaggtcaaacaggattctgatgcatgcaaagaaggaaccaaacaggaggaggaacctcactttatgacaacctgctctcatgggaattaatccagtcttttgagaatgaaaattctcttaatactccaagaatggcaccaaggtatttatgaggaatttgcccccatgacccaaacacctcccactaggccccactttccaacactgccacattggggatcaaatttcaacctgagttttggtggagaaaaatggaacacatccaaaccatagcaacaccattaaataacagaaagggagactctctaaaaagaaaaccaaataatgaactgggagactcttcaaaataaaatgatttcatatttaggaataggcattgtaatgggaataagtgggccatagtaaacaatatgcatattcaggaaggtgtaaaggaaggcaaaggttttaaaagacagaatgaggaggattacataattgtctttaagataattatctttggctacaaggatcaataacaaaggtggcaccagtctgaagttggacaggcagtttctgggcagatgtcctcacagaagtattttttgtgtatgtaaggtctttgtccgaggttttggtttttgcagtcttttgtaatagttctcattatcagatgtttttgcatgagaatcctccctttatagcctcctccagttctatttgtcatggtttttaacacaagcaactccattttgattctaacaactttcacaatagtgtttcctacaagctatgcctgagattaggatgcttgtgtaaatggtttattaagggagtgacctgaagaaaaacttgtaatgaagcaaaggaagcaggagaaggcaagataagaagctaagtaaggacatggcatcaggagaagcatagcctgatcccgtgggggccattaaaacacgaattacatcactgattgtcttgctcagtggtaaggaggatggacttttgtgctactgcatctgccatttattgatgaattgcttctgggatgagggacataaccttcctgacttatgaaggtgaggcagctcctatcagcttctgagaaggatgcagctgtgaatcattagaagccaaccctcagaaaacctggatgatgggtgcattggcccagaaaaaggggtatgagcagggtacaaacatcatctgctacaaccaacttacttgtgggaaatcaaaatcccctttggtttaaagtctgcctgtaagcatttaacagatacattcctaaagacagtagttaaatgtaatttaagtcaaatattaaagtgcctactgttagccaagctgcacaatgctaggtactgtggagaatattaagggaattgatcattatattcactcttgaaaagcttaacgtttggttggtgtgaagaataatatgtacataatattgtgaaatatcaacgataaggatgtaatcatatgttatagaaatggtacccaatggaatcagtggcagcatgcttaggtgatcagagatggacaactttgggctaggatacaaggatacaaagccctaggcaatctttaatattagtaaggatggtgagtctttatggtgggcaagtgtaaagaaaagcatcatggaggaaagtgggacttgagtttagccgataaggaatgatgaaggggaatgtgggaggtttatggtggagcaggaggttacaggatgaaaaacctgagtaaactttggagcattacacaatgcatgtgttgtgagggagcaatgaagagcatgacttagtttgtccagaggatttgtgttgcagggtagtggaaagagtatagccagtactgtaatcccagcactttgggaggccgaggcgggcggatcacgaggtcaggagatcgagaccatcctggctaacacggtgaaaccccgtctctactaaaaatacaaaacattagccaggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaagagtatagcagtataggatggtactggagtgtgtgaaaaaagtatagaaccaggcagaagaatatgaattcatgtcttagatagtgacaagctcctgaatgtttttgagcatgagaatgatctgatgaaatgatgctttaggaagggttgtctgggcaaaacaaagaagttgttggagctgtctttatgcacaacttttaaaatggattaattgactttaagatgtcagaaacttgtttatttaaatctttcatgttagtgacttgtatttggaatgcagttacttaactcaggtcttatgcttgactacattcagcttttcagaaacagctgtattaggtcatccagaaaccctgattttttttttaaaggtatcattaagtggtgagaaagaaaagactcattcaaaactttcaatttacctttcaaaccaaagcccagggataattattcataatcatttctaagtctgaaatgtgacattgttccatgagtcatcatctaggttttaaccacacatgcacaaaaaagcacaacataataccacacaggctatttgagaaagcattcagagaaatgttctgcctttttatgttgacttcctgtgtataaatctggaatcataaaagtccaaggacactcttcagtaggagtacattcagtaaacagcatgtgtggagcaacaactgtatgcagaactggagtagaagctggttacaagagaaagaatttttttttttttttgcctttggagatgctatagtagaaatagaatacaatgtttgaaaaatagaatgtttgaaaaatgtatgagaacatgtgtaaagcaatatctaaaaggggacacatgagatataaactgagaattaatgccaaagggctaggagaagtcacaaaagaggactcagacatgagggagtcacaaaactaattttctgacctgggccaatttttccttaaattggcgtggtttaccagaagaagagaacattgtgtttcccttcctggcaagtacttttggttgccgaagactatattatcagatggtgaaaatgttcattctattgatgtggttcctcagtggaaagtcatcacatctttctagaagagccaaaatcttttgtgaatgagctgtgttttatggcaagcttttataaatgattctagaattacagagtttctcatgccagaatatctatttgctctgggctagctagctaaaggactgacctctgccctggactatatagtaaatacctatcttcttaactcacaaatgaaggttcttagactaaagtttggacatgggtccagagaatatgacaggaatcaggattccagggcgatagatgaggcagcaaagtttggagctactgagtcagactcagctggagttggctactactaattcaaatgagctagggatcaagaacatggaatctaaaaggaaggaatggggtaagggaatggcaatctggaccagaatgggccagaagccaaggccaatatacagtgggaaaatggttattcaaactgggggaagctaggtcagtatagcaaaggtgaagccaaggctaaggacaacagtccagattcttcctagcaaagtgtctcacagaaatagagagcctgaatccttgagtatacaattaacagcacaggttttgaaatcagtctaaatacaaatctcaactctgccacctaccactatggtaccttgagtaaaagttccttaactgtgctaaggatctggatccgtttttttttttttttttactgtatctctctctgttgcccaggctagagtgcaatgacactgtagcctcgacctgctggacccaagcgatcctcctgcctcagccttccaaatagctggaactgcaggcatgcaccaccacacctggctaattttttatttttatttttagcacagaggacgtctcaccatgttgcccatgctgatctcaaactcctgggctcaagtgatcctcctgctttggcctcccaaagtgctgggattataggcatgagtaactgctgctggcctaagacctaattattgataatgaggacagtatagcatcttaccacataaatttgtggtgtgagttaaatgaggtaacacatgttaaatatctgatcaagtgccttccatgtagtaagcactcagcatggtaatgtaattagtgttagtattgctgctgcttctgttcctccaccacatcatcattcacacgattttggaatagcaaaacaacagtatgtggtattccaagaagactgaagcaaataatttgagaaatcttttttcttatggaaaagttctctaaggattgtgaaatatttgaaacagaaaatttcagttaccttgtattcaaatatttattatcttaaagcccaaagccttctaaatgctaaaactctactgtgtatcagatatgtcagcaagacaatattcacattaacaacaggaaaatgaatcgggacaaaatctgcagaagtgcacatgaaaaatggatgacagaaattagtttctaaccaaaagggaatggcttgatatgaaattggtaagaaattgttttccccatgaccttgaaaggtcatgaataattaaaatgccattaaaggtctacatttgttgtgaattcatgcatgtttagagcatatgtatacttaatcctggaacaatttcttatacctctttaactactcccactcctgccatacttagtaccagtgtcttatacataatgataatggacactcatacactgattgattcagcttatggagattggtagcttttattggcctttgcaaaacttaccttcaaaaactaaattaatatatgcattttgtagcttatcaagaataaaacattttaatagctttgattcatagataaaatttatagaggaaatgatttctgtaatatgcataaagacataatctgtgatttaatttattctaatcagaaagtgagatttcctaataaatctgcttttaactattctggttatttctaaacaattctgccaatttgttacctttgccctcaaactttactttctctgtttgaatgaagttggctgccttttatggtttacaaagcaattgaagacattcccacaatgccatattacttattagaatttttatgtgtgacaagccactctttcttcactttagcacttctcaaaacttacaggaataatattggttatcttatgggtcacagaacaaatacctattggactctggaggccagaacccctactttcaacttgactgctaagtatcttaatggtaagacaggcaggttgaggcttataggtttaggacataagatgttaaagctgcaggtggcagagtgttgagaaatgacattattctctttgtgtgtacatttatttgtcctttcttaatgctccaagggctgtagggtgaagcattgtaaagatgtaccagatcccagaaggttagcagttaaacatttttcagtttgcaaatgcaacaaaccatctcccatagtgtatttactatttcaaaaattgaccctctaaaaagaacatgcaatccctggaattcatggaaagactgggaccactttaatgagattcccataaagtgaaaactgtttattaaatgttgctaggatgttttcttgctggaaagtagtattgtgtgttcatattataaacattaaatttaagggccaagatggattgcctatggaagactcttgtagtctatcagcagtcctcaggtcacattttaagaactgagaataagtggagaatggctcacttgtacaacactattgcctgtgtagcacctctgaaagtcctcctactactcagattaatcagcgctgccatatggaatgtcattgccttcctttccctccaacctgttttttgtccctatagtacctgctgccaatagaatcatagattcatacatactaaaaaaaatcttcactttttaaagctaattgttagaatcctgcagttttaggggaaaatcaggtacactatatttagaataccctcaccttgatattgcaggaagcaaaattctcaattttttttcagtccgccagtactcagtcttccctcacttgggtcctaagactgaaagaggagaatctagattttaatacagttaataataatgataacaaggccatgtgttggtatgatgatgaaaatataaatcaaaatggtctttgatttaagtgataaatactacagtgtccaagatttgagattcctttgttccttgaagatagaaactattcattcttggtaccctaatatttagcagagagttttaaacatgatgactgctcagaggaagtttaaaaatgattgtaacttataggaattaaacattttatctacagtaaagagtttacaggattttcagaaatcagagaagggcttgacctcaaatgtaaacctgctattggtatgaacttcactaatttcctaattcagacccaaatgttaattttcttagagaatcataaaccacaccaaagttaaaaacaaacaaacttgtaaacaaattctaaacaaaatccaacttctttcattaaaactagtaattaaaggagaataaaattgatatgcatttactcaaagttttaggagcatttacctcttcaaaagaattcatggatcaactgaaacttaaacttttaaagattttaaaccactatctgtgtcacttgcttatctgtttggtcttggtttagtatgaaacatgtctctggtctgaaataaaagacgattgcatttcaaaaaagaccaatttataacaaaaaactcaaatcaggataatatgaatgaagtggtattacacataaagacaagagcagaagtcaagtttttccccaaaggatctgaaaatatcatcaagagtcaatgacctctcatttagcctttgaataagaagagtcattctttagctagacagctggctggaaataaataaaaatgggattgcaagtaagatcagatattaatctctttcccatattgctgagactctgaaacagtaatatggtactaaatttatacagataatggcttgattgacctaccctattcagctcttcttccattgaggttttgttcaaatagcttttaaatttatttctgatgaggctactagggtgtatgctatattgctaatatgttttttcaccaccttgaatactacatcaaccctaaagagttcattgttctagctgttctactcaaatatccatgggtctctctactcatggccatttatctacctatgaattttctgggtacaggaagaccaagagtaaaaggagacgatgaagatttttagtttgctgaaagggacataaaacaacctgaaaatgacacagaaacacctttaatagagtgctaaattgtgtgctaaagcaaggtcagagtggaacaacaaggtacagtgggaagagcaaaggctttgtaatcttaccgacttagttcacacccatgcccatcacataatgtctctgagtctcacagtctcctcatctgcagaaagcacttaatataatgagacttacctgacaggatttttgtgtatccaatgtgaaacatactaaagtacttagtacaatccctggatcccaattaatggtaggtgctatgattatcacagacagatatgagagaattggccatgaagctgtaatttagggaaaacataaattatttgatctgggtgagaaagtaattttttctaactggtataaatgtagccaccttttctataatgaacataatggacttcagaaaaccatatcctattacttgcctgtttggcacaacatatgtaatatagtttaatgactgtaacttcaggcatgaacctaaaactacttggaggtaatattgctttgcgttgcagtttcagtgaagtggacaggcagaatagagttcaattttacagtctgacctcttagtcattacttaaagccaccacagagccatttttaatctttgcattttcctctttgcaagtagtttctaagacagacagcgtgtcatactctaactaaatttcagattttaaaaaggcatttagctctgtaacttcagatgataaaaatccatttaatggagaatgttcttttgctgtctgcttggtcgataaattaaacagattaattaagtcaggctgtcaggaccaaggactgtcactaatgttagcctatggagctgacccatttatcagagactgaggctgaataaaggcagtctttgtcctgtaattctgtaatgaatacaaagaaatagcttatggagagaaaattctgtcacctgactgtatctcaaggcagagtagatgtggtgggaagaaaccctatcattgttattttcacttacttaattgatttgctttttccctatgtttctctgtatctacctttgtcctttgcatgtcataggaggctccttctcaatttgaaacataatcaataatgatttcctttgcttatctgaattggagctatgtgtgacacagtacacaccaaagatgtataaaacatcatccttaccttcgtagaacatgcacagaaataatacaggttaaagtatcccttatctgaagtgcttgaggtcagaagtgtagatttttttttattttggaatatttgtatatacataaccagttgagcatccctaattcaaaaatctaactccaaaatactccaatgagtatttccttttagactcatgtcagcactgaaaaaaatttttggaatttggagcattttagatttagaattttaggattagggatgctcaacttgtatatgactacgaaataaagaatcttggtggggaaccagaccagcaaagtggaaaaaagttaggttaaattggaatccaggattgtaataatgtgataccattaccaacttcatcaagcacttaagacttccaggtagtctttccagaggtcctgattcttggaccctagctatcttactccttttctttacccctcctttgactttgtccttggtgcatatgatctggcaaatatgaacttgacttctgcctagtattttccgccattactcccagagccttcctattaactgtattacctgaatttctaaatttagaaaaacttgctaaccactaccccttgatagaatgccaatgcagatcagatcagtggtctgtatgcccagcattctgactggaaaaggttccaaaaatgctttataaaaattgtttttgttgtcctttttagcatcagtctcataaggctaaggggtgaccctttaaaaagtctacttttctttaacaatccaattatttatctgcttactaacaaatgtttattaaatgcccactatgtggccaggcacatgcgagcactggggacattaaatatgtaaataaaatacattcagtgccctcaaagaactccctttatagtggaagacagacatactgaaaaataaaatatagactatcctcaacttatgagggttcaaattagtatttttcaactttatgatagtgtgaaagcaatacacgcctctacttatactcctctacttactatggagtcaagccataaccccattgtaaattgaggagtatctgtgtatatggtgtggtaggttctataaaacatatgtatagtcatcctttgatatccatgagggattgattgatttggtaccctcgagagtaccaaaatccaccgatgctcaggtcccttatgtaaaattgcatagtatttgcatataacccatgtatatctccctgtgtactttaagtcatcttgagattactttcaatacctaataaaatataaatgctatgtaaatggctgttatactgtgtttattcacgttttaaaattgttgtattgttattttttctaaatattttttatctgaggttgattgaatctgtggatgcagaatccacaaatacagagggtcaactgtaaaaggtaaagggtagtcagagaaaggttttaaaaagagaagtttgagctgggtctaaaggataaataggagtttgttaggcagacaaacggaagggggaggcattctaggcatagagcagcctacataaacacccagtagcatgaaatgacaaggtacaatttgaaagtagtttgatgaggctgaaaaggagtctaagaaggagaagtcttaggagaagtaaaagatgtccctgaaaaggctgacataggcttgaacatgggggtccttttatgtcacattaaagatctgaacttcattttgaagtatattgctgagctgcagtttatgagcttcttgccttaaataagtcattggttactgttatgtgctgaattgtgtcccatccccatcttcctccctcccctgccccccattcatatgttgaagtcctcatacccagtaactcagaatgtgactgtatttctagatcaagccttcaaagaagtgattaaggtaaaatgtggtcattagtgtgggccctaatctagttggcctggtgtccttataagaagagaagattaggacacaaacgcagaagaccatgtgaaaacataggaaaaagacttctaccaacaaaccaaaaaaagaagcccctagaagaaaccaatcctgtggacacactgatctcagatttctatcctccagagctatgagaaaataattttctgttgattaagccactcagttatcagtacttcgttatggtgaccctaacaaattagtacgattactaataatatagttccaaactttataaatgttaccttttaaaataaataaataaaaacattcaagtttattcctaaaataataacagggtgttcatttacttagagtttaatatgcttctttgagtataagagaaatcggtgatgccaccttaatattttggttaatgaagagacaagttcagatgtatgttaggaagattattctaggagcattgtggagggagtatcagaggacactgtgactagaaacaggaagaccagttaggaaagtgttgggggtctttatggggcttaataaatatcatagtgcccctcttctctgcctaagttctaaaccaattgagaaataaaacacaatgttggcagtttgagatggaaataacacctttaattctatgaaggctagacagttggaggatgtagctgagcatgaggaccaaatacacttattaattttctgtaccccagactggaacttggaacagcccagtcaagaaaaatttgaatctgagtatacttgctcagaccactgccatccactgggctgggtagagagggagaaagacactaaagcccagatccagccagttgataaatgtggatcatttaatcactcatacatttatgtaaaagcttttttctcttgtggcaggttggagagggatatagtcattcagatttattatagtaccccaaggtataacaaattccattatgttatatctgctatgtaacataagacctttcatatgaaaagctaaattaaaaagttgctactaccaatgccctttccctttttctccacctcagaagcttccaatgacagattatagaactaaattttgggaataagttaagaaccagggtaaattccttgcagacaacggtggccaagtgttctgtgaaattgtttcactgtctcaaacagctttgctgtagtcaaaagctcatggaacagctgttaattcctaaagtattcttctaagctgtaaagaatggttgacttttgccacctggcccagctaatcagaagctgatttcaaggactaagacatagcttctatcaccgtatttatgatgaaaatggtgtaagactaaatactatttcatgagctcctttggtccttcaatagtttaactcctcagttgaagagaagcacagttcatattttgagttgaatgatgatgtcacttcaattccaactctgaaatgtgaaatgattattgtcttcagccattttctcatcctgggaggcagagcttgtctaaatattgaaagccattgttcatgaatagtataagacttcctttagctttagggtccctaaaggctcccacacttgggggaagcttgttgtggaactgacactgagaactcttgtcataatacagagggcatgtgagccaaataaccaactttcttgaattctggatgttgccttgcaaactggcattcacttaacctataggctgtgttataaagagcccttggattcccacattgcatcttttcctttcaattttatagattgatcaacaaacttcagaggccaagcaaaaagtaaaagagcccctcaggctaaagatagtccttatttgggaacaattattaggtatcacattcattgtttctgagctctgaaaacttcaaggaaactcactatgtttctcgaacatatcctaagatagcaaggcaggaggaaagtggcagagaaactgtttaagttgggaaaagatacaaagtcaaaacattccaagtggcatatttgagcacttactcagagtacttctggactgtttactcagttggattcggaacatgtcgtgatggttaatattgagtgtcaacttgattggattgaaaactgcaaagtattgttcctgggtgtgtctgtgagggtgttgccaaaggagatttacatttgagttggtggactgggagaggcagatcctcccccaatctgggtgggcaccatctaaatcagttgccagcgtggctagaataaagcaggcagaagaaagtggaatgcaaagacttgctgagttttctggcatgcatctttctcccatccttccccaggaagacctctggccttttaccaggatagatgtgcagtggggaaaggagaatgatcagaccttttgtggactactggacactggctctgagctgacattgattccagagggacccagaatgtcactgtggtcctccagttaaagtaagggcttatggaggtcaggtaattaatttagctcaggtccgacttacagtgggcccaatggatgcctagactcatcctgtggtcatctccccagtgccagaatgcataattggcatagacatacttagcagcttaagacatacttacccccacattggctccctgactggtagggtgacagttattatggtgggaaaggccaaatagaagccattagagctgcctctacctagaaaaataggaaatcaaaaacaatatcgcatccctggagggactgcagaggttagtgccaccaacaaggacttgaaagatgcaagtcttgatacctttatcatatgacataagatttatttacttcagatcagcatttaagtgttattaactttatgtgatagcttttaggttaaagattagtgtgcttctggttgtgtgaaggatagctatattatgttaggcataattatgaccttattgttgttatttgaagattatgtatgattttgggagatgtgtatgggttcaagttgacaaggggtgaacttgggatggttaatattgagtgtcaacttaattggactaaaggatgcaaagtattgttcctgggtgtgtctgtgagggtgttgccaaaggagattaacatttgagtcagtggactggaagaagcagacacaccctcagtctgggtgggcaccatccaatcagctgccagcatggctggaataaagcaggcagaagaaaatggaatgagaagacttgctgagtgttccgcacttcatctttcttttgtgctggatgcttcctaccctcaaacatcaaactccaagttcttcagcttttggactcctggacttaacaccagtgatttgtcaggtgctctcaggccttcggccacagactgaaggctgcactgtcagcttccctactcttgaggttttgggactcagactggcttccttgctcctcttgcagatggcctattgtgggatttcaccttgtgatcctgtcagtcaattctcctaataaactccccttcatatatacatatatcctattagttctgtccctttagagaaccctgagtaatatacatgtactggcagttgctttccttctatagtgaccacacaatctgtctgttatttataatggtacctttccagtggctattgaatggattaattaattaagagatgagtattcaaatgctagttatgcaaatataaagtcacttctgacctatggttcagacaatgaataaaacagtgaaatccatgggaacactgttttgcaagttttgggtcacaactcatagtgtgttgtagagtcaattcagtaggttacaactagcatttaaaagagataggattgaaggaaatagaaagtattggagtacgttgctcatatgaaggataattttttctttgttaaattttaaaattctatacatgtaagtatatgctagatcaagagtaaagtactttttttatatgagccacagtcaaaatagtttgagattggcaaactctggcccacaagtcaaatttggcataccacctctttttgtaaataaagttttattgaaacatatttatgctcatttattcaagtattcctagggcttcttttgaaatacagtggcaaaggagagtagttgccacaggaccttacagtctggaaagcctaaaatattttctctctgacttttcatgggaaaagtttgtggatgccggtattagaaaatactggagacctttaggcatagagagactagttttggtgatttagaaacaaatgaaagtgaatataatcgatttctatgtagttgggagttcatcttatttcttttggctcatagcaagcattgttagggttttaacacttcaaaatgcatttgaattgagctaatgacagataatttaaaaattggggccaaaaatgaatgtgtgtttcttgaacacagtcatgttcttaagtagtgggttgaggctatctatcctagtatatagcaaagattcctcactttttgtaaactttgtaaacactacccaagaagattctagaagccaacatgactggcttaaaacctttatatatgctttcaaaattgtatagccatgcatcctggctaacatggtgaaaccccgtctttactaaaaatacaaaaaaaattagccgggcacagtggtgggcgcctgtagtcccagctactcgggaggctgaggcaggagaatggcatgaacccgggaggcggagcttgcagtgagccgagatagcaccactgcagtctggcctgggcaaaagagcaagtctctgtctcaaaaaaaaaaaaaaaaaaaaaaaattgtatagccatgtaacaacaacaacaaaaacaaagacaggattggggaactaaaaatggtatcacaaggcggtagatacgatgcaagctatgtacaagaaataaagcagaatgagtagcatctaattgcctcttctctttccctactaaatattggctgcttaagttacttaccagcaagaaggattgcttcttatactcatctgcattagtttaaaccatgcttattgagccatacatacaagaactgcgacggatgctgatgactgtaacaatccacatggctacagagggtatgtggatgtgacagtgaggggttgagtctggagatattggtaatgcccaaatactgtgtgagagggaccctctgaaccaagctaaagagaaactggcctttatcctgaaggaaatggggagccatgggaggtttttaaccagggaggtagataatcaactatgtgtttcagatacactctttgcagtatgactgatggattggagggagtagaaactggaggaaggaaaaccaggtagaagattattttagcaatccaattgagaaataatgagggcctgcagtgagtgcagtgacctgtggactgtttccatgggtatagatgtgaaatgtgtttaggaataagaagcacaaaatttgtggagaggaatgttaacagattaatctggaagttaagtagggacctcttaatggaaggccttttacaccatatcaagggattcagtctttattgtaaaggcactaggtagggggtactgatggaaaatcactttgctgcagtgtaaaaaatggattgaaaatagacaagctcagaggtagagagatctcttaggagactatttccagaagacttgcttggaaagtagttttaagtgagactatgagcatattaagttcctcctattgcctctcagacacaagtagaacaatggaacaatgcagtcacaaaagtatacaatttagctatattgcaagattgagaatatattcttgatatgctagtagcaagatattggactgctccctcatgcaaagctctgaagttctatatgtagacatgtgtttgtgagatattaactcttctgatgggataggttattctttagggccactctccctctttagggtattaaattacctgtatctgctctgaaaaataccgacgaaaacaacggacccattccttcgttttcatttttgtttgaaatccagtgccaaggatatttgcaacaacagtagatgactgcagaaaagaacttgataacttgtccccaatggggcgtctgacatcatgacatcatctcacatatgtaattgttatttatttgatccccaaagaaacataagtgctgcttctgtggcagtagaaatttgcataaatccaagatctcctgtgaagctgtacccttccaattaatctttgcaaggggaagggattatagtcttctgtgaattacactgctaattaatttctacacaaatcaattttattttgccaaatacacaagtcaaccttgcacagctctgaatactacatatatccatcgtcttaaaaagactccagtcaaatcatcattccattctttctcaggaaggaaagcaaacacactggattgagacattttcttcccctttcgtgttaactttgatgtttgaaggtgccttgaataatcgtttctttttttctgagcatatgttaatgtcaaatattcatttgttttaatatcaatgattctgccttgtaaaacactgttgcctgggatgaaaatgtcaacttttcttgggcctcggtataactttctggccaattcttgaagttcttttaatgcaagttttttgtttttgtaaggggaaaagtatcttgtgtatccttagtgttattcactcaaggctctgagaaactgctgtaaataccttttacttttattttttattttttattattttaatggacaaattatacttgtatacatttatagtatacaatgtgatgtttgatatatgtatacaatgtagaatgattaagtcaagctagtgataacatatccatcaccttacttatcattttttgtagtgaaatatttgacttactcccatagctattttgacatataaaatgtattattgttaactatagtcatcttcctgtcttaatatatattttaataaaaacttcttccttttaaaataattttttccccaaaattcatatgccacttcatggttccctgtataattctttttttgctttgtctcttcctagagtgggaaagactatttcttttttttcattattatactttaagttttagggcacatgtgcacaacgtgcaggtttgttacatatgtatgcatatgccatgttggtgtgctgtacccattaactcatcatttaacattaggtatatctcctatttctaacagaactatatccatgaacagttttatccagaaggagctatagccaagctgtattacaaaagctataagaatgtcagtcacatgcagatattcaaacatagaaaaggggagaggctgtgtttgtgaggcccagttcccactcttctgatttcatttcttctttaggatcttttcaccaccaccaccacgctggtgcacatttctggtaattgttggaaaaacatctgggtggatgtagtgtgactactattttttatttatctctgtttagatggaattattccaaaagatctcttatatgtatcccctggagaccccatgctaacacatgcctctgggatgttgtggtttttccactatcactacaataaaaatattaccattgcaaccattttacaatagcttatctgaagaacattacaaattaaatgagcttagagacagaagtcagtgctatgtataagaatagtagctatttatttagtgcttacagtgtgccaggttctgggctaagcaaaatctatgtattttctcattttatcctcacaacaactctatgaggagattactaagaaagcttgctgtgttgaaaaacataataagcttgtgattactcttgcttttgaagaaaagtggtagtagggtcactctattgctttgaaacatattcctatatttaactatgaatagcagtaatgactaacatgtattgagtgcttactatgtgccaggcactatactaagcactttatctggattgctccaaagtagatactaggaatttatggatgaggcaaccaagaatcagagatgttaagtaactggctcaaatccgcagcataaatcaggcaagtgggatctaattcaggttttgggtgactctgaagtttgtgttctcaactcatacctcctattactagttgtcctatttgtctccccaccataccctgcattctttgtaactttctcttacactattatggaaaattgtcagggtggcattatattttctatctccgtgatttttctcaggataccttgtcttactggctcttctggaactgttctattctgtcctcctaaaagaaaattgtcttcaggaaaacataagtttcttttattttgttttttgttatttctaaattgttagttgtgagtaagggagctatttgtatatcttatggaatgctttctgtctgtcacttatctcttattggtaagtgacaccagggtcctgagttctctgtgaaaatgttctaactgtaaaaattaccccaattatgtaaccagcttctttgtaaactttcccctgagactctgaaagcattttcagatctccccaaaagacaaacatataaagaaaaagtcaaattaaataacgacttatataagttcttaaatgtctataatggaaataaatatgattttttaaagttccagagtatgaaaagatcccctgaaaaagtatgtttctattcatataaatctcaccaaatcggactaattggtcaaaaagtcagtttgtttaaaaatattttatattcgagttgtctactaaaggaaattttcttttataataaagtttcctttacaactgttttaaaatgtagaaagaaacctgcagaaagcctttccattgttccaaatgacatatttttctattgtcacatgataatacaaatctgggacaccacagtagaaatatagaacaaggtgctgctattgaatctccctggtccttaatttattcatttatccaataaaggaattatcttgttgatgtttaagttcctttccaactctgacattgtttttttccttaccatgggttctgaattacctttccattgttctaaaattctaagaaatgatagttatcctgtattttttttctgaattcttttcataccttgtagtaatgtaatgtacctaattctaaaatcccctgggtaagagggacaggaagatcttggaaggattcaaatatgacacacaaaggggattagaatgcaaactgagatatcttcaatattaacaaaatattgatgtggatgattccttctctcctaattaatccccattatacatcaaaacttcctgaacacttatgaaaatcagcatcttgaaggaacactttcatacatttgattaaattattttaaaagtggaggttagatttataatctcaattaagttataagttccttaagtgcagagatcatggttttgtcttactatccacagtgcctagcatcctaaaggactcatggtagtcattcagatttattgttaaattgtatctgttgttgagaagccttgtatagtgttgtgtataaattctggccaagatgatggacaaagcagaagggaaatattataccacaacagatgcataaaatgctaaagaaaataaattttaacatgcatagccaagcctgaaagtatgaaaggggtatctccagatgttggaaatgaagaagaaaataatagctaaagtggcggataataattgaagctttacaaaatgtgaaggacctggactctaaacacaacttatcttaggtgatgaggatctaatgcctcgtatgttgggagcatgagcagtttcaacctttctgggacctgaaagtcatacaatttggaaagctctccttaaaaattatcttacttttcaatttcactaaaacccatgaacatgtgcacacatatgtagggccattccttgggccatgaagggagcccatggacatgaggccctgaaacctaagcttcattagctacatggtaaatctgcctctgacttttgtcaaggtcacaagcttggtaaaaaccaaggagcttgacttaggttacctatgtggaagccagaaccagaaaagcaatgcatcatgtttgaatagctaccagaaaacctctgctagctggcttagggtcttgtaggtaattcactgctggacccaggctttaggtcacctgagagtgactagaacctttgagttgtagaaactacagccaattaatagatataaaatctagtttgaatatggtgactcgtctaatattcaggcaaaggcatctgtgaaaccactccagaggaggccatcacaacccatgacctatttatatcttctacagaaaatattctcatatatccatggaagatgaacccataaataaaaagtataaaatacatgagaaaccttaacaccaagaaatatacttcacagaacctagagatgagagaattcacatccaagcaaccagagatagcagagcaataaaaggtgacttcaaattaagaaatttataattgcgtatgtgtatatagacacacacacatagaagtgcatatatgatttttaataaagtctcattcctttgtattagtcagtttgggctgctttaacaaagtaccatagatagggcagtttataaataacagaaatccaagatcagtgtactggcatagttgggttctggtgagggctctcttctgggttgcagaaaagtgcaagagagctctgtgaggtaactattattaatacaatggcatttatctcatttttgaggactccacattcgtcactgagttacctccaaaaaagccctaccacaaaatactgtcacattgggattagaatttcaacataagaatttttgagggacacaaacattcagtccattgtaatcttcaagtgtatatatcattttgcttcatgtaagttatattagctttggttaagttatgttgcagtaataaacaaccccatgatctcaccggcttaccaatagaaggttgatttctcacttttgttaggagttttctggaggttgactgcagctctgctccatgttttcttcactaacagggaagcctctatctgggaccttgacactttcaattcagaggaggaagagcaaggcggtaaatcactcgatggctcttaaaagttctaggaagcagcacatatcacttccacccatgttgcattggtcaaggcaagtcacatatccagacatgatgaaaaagaggtagaagtatataatcctcctgtaggaagggacagtgaatattttgaacaaaggatacaaaatttgatttgacaaataagaaatatttgatattagcaaatgagtccttctgatatgtatatagaggcttgaaaatcattattttatgtattaatagtttttccttgtaattctacaggctcttagcaattcttcattgatatgataaggattatcataatctgatattcattaaccttgctatgaatgccagaacaggttagttccaatggcaacactcatcttctacccacaaatcacgtccacttcttggactgatctttgatgctgccaggatacaggaaagtgaatagccgtgttaatcttgacactcatatgataaggattatcatcattatcatatcactttcaaattagctggatccaaatatacagacatgaatgtttttcccccaactctgcttctaaatcaaagttctttcccaatctttatcttgtctatttacagacctctaaagtatgatttgattatttttaactgtctgtattcctctctctctctctctctctctctctctctctctctctgaaacttaggatatgcatagataggatcatgggcagggtagatggggtggaacatgtttttctttcctcaccagggaaatttgatattcactaaccttgctatgaatggcagaagagattagttccaatggcaatgctcgtcctctacccacaatcaggtctacttcttggactgattattgatgctgccaggatacaggaaagtgaataaaaagaaaagccatgttaatttcaagctccatttagaaacacactagaaaaatcaatggctggtaagtagaaatcggcaaaattggcaggaagaatttttacattcaagcatagaaggggctggaatataaatctgcacactgaccagataataaccagataaaatgatgatgatactagaaaggcacttgacaaggctttttcctaatgttttagtgcactgaggaatgttcacctcttagattcactgaaccaagattctgtcatttaaaatttggggattaaagtttgtcattagttttctcaagccttactgatttcacagaactgaagtaggcagatactggctcctggaaggagtgattaaccagcaactttagtgctaaaggaatttaggaaatctggattttagtggggtatacttatgggaggccctcttcttcaggtttaaagatcattttctatggtgaatttaatctcactcagtgttacatctgaaaaatgggatattattctgagatcttcctcacttattataaaagaagaggttttctaactttgtgatgctgagagaattacttctctcatccccatgtttaccaattctcagcaccaacctgaagtacatttttctccatgaagcctgccctggcaattccagccttcacttctttttgtttcttcttgtgaacttctagggaaatgtatggcttagagacactacaatcctatggtcttcagtattgttccttaaattgactcatacttattggtttattgagtatctattctgttgggtattgtacttaacactgaggataccaaaaatagatatggcccctacctcaagatgcttacagtctagtgggaagaagagagagaagtaactgggataattaaaatacaatatgaaaaagaaaccatgtgaaaagcaccaagacataagcacagggtgctgtgggagtgctcagttgtgtatgttgttgttctatccaaccagagattaagtttctctaggacaagatccacatcttccacttttctcccattccccgtagtgcctgacttatactatccttggtctggaactcttttccccccacagatatatgcattccttgatcactgtattcttttaagtctttgctcaaagatcaacttctcagagacagttgagctatgttattcaaaattgtttctctctcccatccaccttacacacatacagtcacattctagaagcacatattttcttctttccttgctttatttttctacttagcacatatcaccatctgacataccatatcatctacctatttaattttgtttattatctatcttgcctgctagaatataagctctatgagaacagggattatatctgtcttgttactatttttttttttctctagagaggcctgtaacagtacataacagttacttacagtaactttaaagatattggcttaagttatggatgggtggtaacagtgcaagttggctcgcaattagtaattctttagtgggttgaatgatttctcttttaatcatttaatagagaaactaccactactgcctctactactacctctacttttaatttggcttgataatgaagggcctgttctgcaattcttagaccctgagaagttgctcttctggatacatgtcagatcccccataactatgtagcaacagtcacacttgctgccttaagcctctttcaccctctgaaggcatttagcacatggaccatgctttgagaattacagacacagttcatgaaatctctcttcttaaatttatatttaacagttaccatatgttcatgaccatgataattttgccccatacatttgtttttatttggggtcttgcatggtaggaagactttaagaagtcaaagattattttttcgtcttttcccacttaacaaaatcaaaatgtttcttaatgctgacgtagttactaaaacctatctatacaaaatagtttgctacttctaaggtaaagattgaaaaaatagtgtcaatttctgtttagaagatttctattattgttcctagtggaggtacaaaaactggttcacacacacaaccaaatcactgttatatagctttctttttttttttttttttcaagggacatgctgaattttattttatttttttctctgtaacaatttcttttattattattattattattattattatactttaagttttagggtacatgtgcacaatgtgcaggttagttacatatgtatacatgtgccatgctggtgcgctgcacccactaactcgtcatctagcattaggtatatctcccaatgctatccctccccgctccgcccaccccacaacagtccccagagtgtaatgttccccttcctgtgtccatgtgttctcattgttcaattcccaccgatgagtgagaacatccagtgtttggttttttgttcttgcgatagtttgctgagaatgatggtttccagtttcatacatgtccctacaaaggacatgaactcatcattttttatggctgcacagtattccatggtgtatatgtgccacattttcttaatccagtctatcattgttggacatttgggttggttccaagtctttgctattgtgaataatgctgcaataaacatacgggtgcatgtgtctttatagcagcatgatttacagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctaccattccttctgaaactattccaatcaatagaaaaagagggaatcctccctaactcattttatgaggccagcatcatcctgataccaaagccgggcagagacacaatcaaaaaagagaattttatatctttcttttgctttttatagcatctaacttcaggtaaagtttttgttaagatttttgcatgtcactttttggaaaacatttaaaatcagcattagtgtagaacttacacatgtaactattcaagagaatgcaagatgaatttaggaataatttctgagtcagatttacaatgcaaacatcaaacatgagcaatagagctattaaccttgaatcaattgagctgtctgtacatacagggcattttttttttcttgagacatacccaggggtaaaggagataacgtaaactcagtctgtgaataaacaatattgtttactggaagagatggcaaacaagctcatagagaagtaatggacatgcagaagatctggaaaaactgaagtaaggcttcaaataaatttgggaaagatttagtaaaaatctaagcctccacacagtagcacattattggctagtgttggagatggcttataggaatctttatggactaagattcttctggcttttattccacagatatctctctgccaagtggctttatacttcccttactgatacttcacatatctttgtgtacattgttagactgcatggactaagtgtggtaccttgcgtctgtaccatgataccagttagcatggaccccggcacattggatcattcagaaatgtagtttcaccacactctgtgccaggtcataatgatcttccctttgatctggctttccactaatattataccatccctgatgtgacaattcaatggttatctgaatttcttatatatgagtaaaataataataacaatgatgatttgtcaagcactttatatccagcaggcactgtgctctgtgctttatatattactgtctgttttaatcctcacaacaacccaataaggtatgtattcttattctacacatttcaaagatacagaaactgaggcacaggaaagttaaatagattgctcaacctcacttatgcatttgtctactctattagctttgctgtgatttccacaaaggtagatatcagaaggtgtgaattctcttttgaagttggttctaaacacagtgttatgtatatttagatggctaatcatagttaaacttataagtgtgtcaagtaattttagggcctcctgggaggtctctttgttctcccagatatctttcctactgaattgctgatgcctaaaatcttgcaattcagaaataccttatgttggcttgaagcttcttgttccctgtttaaagggcagatatttctggaaggataattctaaaaaatattactgggcattcatgtaagtatattttattagcttcctttttttttgaatgaacaaattttgatgggagcaagtttcgaaaacgtgaggacccaggatacctgaagttggcaagaaaaatatagtatcaagggaaatatggaagaggaagacattaaaggtacaaaaagttcaacttcatcttgatttccaaccgagccaacctcagttaataaacagttttcaatgactcttttggtaggaattattacaaagttatataaaatattttatcatagggaaagaatcggattctttgtaaatcaggctctggtttgattttagacttttatatttttattaatttgtgcatatttaatgtaaatgactaaataattatgtagcgatccattgctagttgaaatttagaatggggcattgccctaaggcaatatctccagatcagtgaaaattctccttagtcctaacctttctttttatgtttttaattgcaaaactaaaaagcaagcaaacaaacaaaaaacccaaacacgttaatttgtaaaagagaccaagcaaaactagtaaaaaaaaaaaaaaaaaaagagtgcagaaaacatagccttgctctatgaaattgacagcactttggtgtctgcattttcttgcaatattaatgagaaagtcaagcatcatgtttgtgccaaatggcaacttgtttgacacacaacagtttcattttcaagtgtaatatgttgattctttattggattatttcaggttttctttttgagtaaactttatatttcctttgctgtagtatatacaacattaaattcttgccctaaaccaattccttccagatatgtcaagctctccaagtctggtgcaaattatcacagtagtttctgctggaattttatgttgtattttgtaaatgtagcaaattgacttcatcctctacataggtatgaggttagctatcatgagttgtttcaggacaggatctcatattttctggttcacagtcatatgatttgtttgggtccttttcagtgagatgggaggaaagtggagacttacagtgagaagtactctaaattacaagagattatcaagacagactaagtctggactgaggattgattttcaggtagccaagtaggatggccaacttgacaattaattagggtaatgtgaaaagtgggggagtgtgtagagtgagttgattgcttggtaatcaaatgatagtacttctcattttctcctgctgagtacgctaaatctgttttgcaatttttttttatctgctactctttacttctcctttaagtaattgcagtaagtcacaattacgctagtcatctcctctgacaattatcaagtttcacctcaaagaatgcctggaacaaattatgaaggaaaaatcttagaattggggacatatggccttagcagagtaagctagtaaaattctcccatggcaaactactgagtaaagcttctataagacagccctgccagagattggcacccttcctaacccccaagatgttagtagaggatagtacttcttcagagaaaaagcgtacagtagtcccataagcatatagcctctgcagtggtctaccataccatagaccttccaggaatcagataacatttatttttccactaacttttcacaagaacatagaatacattttcttgtagaagatttagacaagtaaggctgtttcttacatccattattttccaggaggatggcctgtcccccagatccttacttgtttatttccatcatccaagttcatcacttagaaccctctcctaagcaaggacacagcttcatgattcattttgcatataataaactaattaacaagtacatcacaaaaatcaaaatttgctacagttcaaataggtctatgtgattcttatcacgcaaactgttcgaagtaatgcattttgatagaattgtagtatcttacaaattaaaatttctgtcacaaaactatacctttctgttttccaaaatcaaaggtgcaatagaataagcaatccttcaacacgccatcaacttttgagtcccatgattgatttttgtaggctattaatgatttatgtttcacagcattaggtgacatagattgattttgagtcctaaatgtttcaataacgacctcattttgcggagtggttattaatgtggtagtatagtttaacagcactacacccttttaaaagcagtttaatatttttttaagcaaaactaagattttacacaaggtcattctaggctctcaaactttattttacataacgtaaaatttttataaaaatgtaagattatcatctcattttaagatggcattttattaattaagagtgaaaatgttaattttgtagatatttttcatgcacctagagaatattttaaacacataaaaaatgagatatacctttctttacaattacgttctttgctagtgaacatgggagtcttcatttcccttcttacaaatattgctgaatttaattcagtaaaagtggtcatttttcatatttatctgtaaattgcactgaattttgttgtagtcacattaggaagtaatgatttatatgctttctaattatttatctgcttatataagcatagtctcattttagaaatgttattgaattaatgttgtaatacctggaacaaagaaaaataatttccatagactaagctctgcttttcagaaatctgatcttgttttgcatgctgtactctgtaatataggtaaatgcaggtgccaatcaggcaatttattataaaatttaaatagacgctgggaaaagtgcatagaaaatgcttatctactgaaaagtggctgttttcctgaatataaactctaagaggctgaaaccaaatagttaaagtatctgtcctattgcagaactagggacacaatacaacctgaggagttactggttgctctcttttattcccatgtgaggatattggaatgagaaggtgcatggcagttgtatgttctggaaagcttgtaatatagacaagagaaggtggtgagaattttttgagaacttttccctaagtcttctgttaaactgaagcttagagtaactcacaaataagtgaactaaaaaaaggagataaaataaatgtttagtttttaaaaatgctacttttatgaaaaatccaagcttaccactaaagaaaaaatattctaccatgttcaaagtcatatttggtcaacaggcatatatgcttctctttatggaatacttgtttcctgaaacaacatgaaaatctcattttataatagactggaaattattgtttacaacatgtaaatatgcttacagaaatgtgcagatatgatatacaaatgctgaaaaaacacggaagaataacaaaaagttggggcctggcttcaggtatatttttaaagccttttaagaagaattcaaatgatggaaggggcataagttggtgtggggactatgagcaaaagaaattcatgaggtgatatttttctttctaaataagtacccattttcaatgattaatgtagaaaattagttgccttgttggaagctgttatttattgctgaataacataccatcccaaagcctatgccttttaacaataactttcaacatccatggtaatgagaggtgaagccggctgggcttctgggtcgggtggggacttggagaacttttctgtctagctaaaggattgtaaacacaccaatcagtgctctgtctagctaaaggtttgtaaatgcaccaatcagcactctgtaaaatggaccaatcagcactctgtaaaagtggaccaatcagcactctgtaaaatggaccaatcagcaggacgtggatggggccaaataagggaataaaagctggccacccaagccagcagtggcaacctgcttgggtccccttccatgctgtagaagctttgttctttcgctcttctcagtaaatcttgctgctgctcactctttgggtccgcactacctttatgagctgtaacactcactgagaaggtctgtggcttcactcctgaagtcagcaagaccacaaacccactgggaggaacaaacaactccggacgccccacctttaaaagctgtaacacacactgcgaaggtctgcggcttcactcctggtcaagcgagatcaagaacccactggaaggaagaaactccagacacatctgaagatctgaaggaacaaactccggacacaccatctttaagaactgtaacactcactgtgagggtccgcggcttcattcttgaagtcagcgagaccaagaacccaccagaaggaaccaattccagacacattttggtgaccacaaagggactatcacctatcgccaagcggtgagtaccattggaccccttttgcttgctattctgtcctatttttccttagaattcgggagctaaatactgggcacctgtcggccagttaaaagcgactagtgcggccaccagactaaagacacgggtgtcaggctttctgggaaagggctctctaacaacccccgactcttcggagttgggagcgttggtttgcctggaacaagcttctgcttttcctgtacttctgggctgagtcaaggtcaacagagaggaaagccattcagctccagggtcccgacaacaagttggttgaccctgtgaccatgagcggaactctcgaagtcatgttgcccaagcgagactcgcccatctattctatctatcttgacccttgcctcttgggtcctaatgcctgccagacaaacttcctcttgcctcttctttgaggctagtcccacttctaaaaaccactccctatctctggtgcttttctagtttctcctataagaatgatttctagtgtaaactccaggactctgttaccttctttaggcacccaggctcaccaatcagaaagacataatttttacccaaagccccatcacaggggggactgcctggaattttaggatccctcctcagactagcaggcctaacaaaagctattcctgaagctaggatatggggaacctcagaaattgtatccttcctattcatataagtgaggacaaaaaacatcactcttccaactctggagatccctcccctccctcagggtatggccctccacttcatttttggggcataacatctttataggacaggggtaaagtcccaatactaataggagaatgcttaggactctaacagattttcgagaatgcatcagtaagggccgctaaatccgatttttctcagtcctctttgtggtctaggaggacaggcaagggtgcaggtttttgagaatgcattggtaagggccactaaatctgatttttctcggtcctctttgtggtctaggaggacaggcaagggtgcaagtttttgagaatgcatcagtaagggccactaaatcagaccttcctcagtcctccttgtggtctaggaggaaaactagtgtttctgctgctgcgttgatgagtgcaactattccaatcagcagggtccagggaccgttgcgggttcttgggcaagaggtgtttctgctgctgcgtcagtgagtgcaactattctgatcagcagggtccagggactgttgcaggttcttgggcaggggaagaaacaaacaaagcaaaaccatgggcaattttgtctttcagatggaaaacactcaggcatcaacaggctcacctttgaaatgcatcctaagccattgggaccaatttgacccgcaaaccctgaaaaagaggtggctcatttttttctgcactatggcctggccccaatattctctctctgatggggaaaaatggccacctaagggaagtataaattacaatactgtcctgcagcttgaccttttctgtaagagctaaggcaaatggagtgaaataccttatatccaagctttcttttcattgaaggagaatacacaactatgcaaagcttgcaatttacatcccacaggaggacatctcagcttacccccatatcctagcctccctatagctccccttcctattaatgataagcctcctctaatctcccctgcccagaaggaaataagcaaagaaatctccaaaggaccacaaaaacccccaggctatcggttatgtccccttcaagctgtagggggaatggaatttggcccaacccaagtagatgtccccttctccctctctgatttaaagcagatcaaggagacctggggaagttttcagatgatcctgataggtacatagatgtcctacagggtctagggcaaaccttcaacctcacttggagagatgtcatgctattgtaagatcaaaccctggcctttaatgaaaagaatgtagcttcagctgcagcctgagagtttggagatacctggtatcttagtcaagtaaatgatagaatgacagccgaagaaagggacaaattccctactggtcagcaagccatccccagtatggatccccactgggaccttgactcagatcatggggactggagtcgtaaacatctattgacctgtgttctagaaggactaagaagaattaggaaaaagcccatgaattattcaatgatgtccaccataactcagggaaaggaagaaaatccttctgccttcctcgagtggctatgggaggccttaagaaaatatactcccctgtcacccaactcactagagggtcaactgattctaaaagaaaagtttattacccaatcagccgcagatatcaggagaaagctccaaaagcaagccctgggtcctgaacaaaatctggaggcattattaaacctggcaacctcggtgttctataatagggaccaagaggaacaggcccaaaaggaaaaagctagatcagagaaaggccatagccttagtcatggccctcagacaaacaaaccttggtggctcagagaggacagaaaatggagcaggccaatcacctggtagggcttgttatcaatgtggtttataaggacactttaaaaaagattgtccaatgagaaacaagccaccctctcatccatgtctgctatgctgaggcaatcactggaaggtgcactgccccagagtgcaatggttctctgggctggaagcccccaaccagatgatccaacaacaggaccgagggtgcccgggcaagcgccagctcatgtcatcaccctcactgaggcctgggtatgtttaaccattgagggccaggaaattgacttcctcctggacactggcacagccttctcagtgttaatctcctgtcccagatgactgtcctcaaggtctgttaccatctgaataatgctgggacagcctgtaaccaggtatttctcccacctcctcagttgtaattgggagactttgctcttttcacatgccttttttgttatgcctgaaagtcccacacccttattagggagggatatattagccaaagctggagctattatctacgtgaatatggggaacaagttacccatttgttgtcccctacttgaggagggaatcaaacctgaagtctgggcattggaaggacaatttggaagggcaaaaaatgcctgcccagtccaaatcaggctaaaagaccccaccacttttccttatcaaaagaaatatcccttaaggcctgaagctgataaaggattacaggatattgttaaacatttaaaagccttaggcttagtaaggaaatgcagcagtccctgcaacaccccaattctaggagtacaaaaactaaatggtcagtggagactagtgcaagatcttagactcatcagtgaggcagtaattcctgtatatccagttgtacccaacccctatactctgctctctcaaataccagaggaagcagaatggttcactgttctggacctcaaggatgccttcttctgtattcccctgcactctgactcccagtttctctttgcctttgaggatcccacagaccacacatcccaacttatgtggacggtcttgccccaaaggtttagggatagccctcatccgtttggtcaggcactggcccaggatctaggccacttctcaagtccaggcactctggcccttcagtatgtggatgaattacttttggctaccagtttggaaacctcatgcaagcaggctactctagatctgctgaactttctagctaatcaagggtacaaggtgtctaggttgaaggcccagcttttcctacagcaggtcaaatatctaggcctaatcttagccagagagaccagggccctcagcaaggaatgaatacagccataatggcttatccttgccctaagacattaaaacagttgtgggggttccttggaatcaccggcttttgccaactatggatccccagatatagtgagatgactagaccactctacactctaatcaaggagacccagagggcaaatactcatctagtagaatgggaaccagggacagaaacagccttcaaaaccttaaagcaggccttagtacaagctccagctttaagccttcccacacggcaaaacttctctttatacgtcacagagagagcagagatagctcttggagtccttacttagactcgtgggacaaccccacaaccagtggcatacctaagtagggaaattgatgtagtagcaaaaagctggcctcactgtttaagagtagttgcagcagtggccatcttagtgtcagaggctatcaaaataatacaaggaaaggatctcactgtctggactactcatgacgtaaatggcatactaggtgccaaagaaagtttatggctatcagacaccacctacttagataccaggcactactccttgagggaccagtgcttcaaatacatacttgtgtggccctcaaccctgccacttttctcccagaggatggggaaccaatcgagcatgactgccacaaattatagtccagacttatgctgcccaaaatgatttcttcaaagtccccttagctaatcctgaccttaacctatataccgatggaagttcatttgtggagaatgggatattaagggcaggttatgccatagttagtgatgtaaccatacttgaaaataagcctcttcccccagggaccagcgcccagttagcagaactagtggcacttacccgagccttagaactgcgaaagggaaaaagaataaatgtgtatacaaatagcaagtatgcttatctaatcctacatgcccatgctgcaatatggaaataaagggagttcctaacctctaggagaaagcccattaaataccacaaggaaattatggagttattgcactcagtgaaaaaacccaaggaggtggcagtcttacaccgccaaagccatcaaaaaggggaagcagaagggagaacagcagcataagtggttggcagaggcaaggaaagaccagaagaaagaaaagagagaaagagacagaaagtcagagagagagagagagagagagaggaagagacagagacaaggaaggagagagagaggagaagagacagagacaaagagggagtcagagagagagagagagagagagaaagtcagagaaaggaagagacagacaaaaagggagtcagaaagagagagacgaagaagtcaaagagaaagaaagaccttctttctatcttccttctttctgacagcaatttactcctacctttaattcagcctggataaaatgatctcatcttccagagcaccagttttaccttcctatttactctttgcctatctatccttcctgcttccttggatacctcatacaatcacccctcaccttccactagctcctaattacctctacaagactctcaacctaacccacgctctgttaaaccagtccaatccttccctggcaaatgactgttggctttgtatctctctatcaacttctgcttacgttgccactcccattcctgcaaaaaaactgggtctttaccaacttaacctactaccctagttatgaaggaaaagaccctttccaacttctaaatatgcaatcattagccaaattccccatttctgataggaccaagaataccctaacaggacatgcaatccaacttttacattcttacatttcccacctcacctattacacaagcaatgaaaagcccatacacggcactgtaactatgaataccatcttaactttctaagttcctttatgcatccagtgcaacctgttatcaggcctgcctctggggcacctactaccccatcagcgtaattacaccccacaacttcaagccccaactgatcatagtaacttccgagtcacccaaacagctccattcagatggcttgtccgcttctcagggcccccaaaagtcatcatctcctccctacttaacaaacagtccaggttctgtaatggcaaacatactccctgcatgaccattcacccctggactccctgcagcagtgcccccaccactagtgaatgcctgctcatcccctctttcaaccactctctcaaaaggttcctagtcgatacaaaacggtgttttctccaatgggaaaatagaacacagggagccactcagtttgatcccaacacccttccacccgctcaccagagctaccttggcaagtagtctaggagtatgggaaaatgaaaacaacaaactcacacacctttttaacatacacaaacagttctgtctacccagccaaggtatattcttatgtggaacatcgacctatatctgcattcctactaactggacaggcacctgcaccttagtctttctaagtcccaacattaacattgccccaggaaatcagacattatcagtacccctcaaagttaagtctgtcagcacagagccatacaactaatacccctattaatagggttaggaatggctactgctacaggaaccggaatagccagtttatctacttcattatcctactaccacacactctcaaaggatttctcagacagtttgcaataaataatgaaatctatctttattttacaatcccaaatagacttttttttattgtactttaagttctagggtacatgtgcacaaagtgcaggtttgttacataggtatacatgtgtcatgttggtgtgctgcacctattaagtcgtcatttacattaggtgtatctcctaatgctatccctcccccctacccccaacccaagacaggtcctggtgtgtgatgttccccttcctgtgtccaagtgttctcaatgttcaattcccacctatgagtgagaacatgcagtgtttggttttttgtccttgcgatagtttgctgagaatgatggtttccagcttcatccatgtccctacaaaggacatgaactcatcttttttatggctgcatagtatactgtggtgtatatgtcccacattttcttaatccagtctatcattgttggacacttgggttggtccaagtttttgctatcgtgaatagtgccgcaataaacatacgtgtgcatgtatctttatagcagcatgatttatagtcctttgggtatatacccagtaatgggatggctgggtcaaatggtatttctagttctagctctttgaggaattgccacactgtcttccacaatgatagaactagtttacagtcccaccaacagtgtaaaagtgttcctatttctccacatcctctccagcacctgttgtttcctgactttttaatagttgccattctaactggtgtgagatggtatctcattgtggttttgatttgcatttctctgatggccagtgatgatgagcatgttttcatgggtctgttggatgcataaatgtcttcttttgagaaatatctgttcatatgctttgtctgctttttgatgggattgtctgtttttttcttgtaaatttgtttgagttctttgtaaattctggatattagccctttgtcagatgagtagattgcaaaaattttattccattctataggttgcctgttcactctgatggtagtttcttttgccgtgcagaagctctttagtttaattagatcccatttgtcaattttgtcttttgttgccattgcttctggtgttttagacatgaagtccttgcccatgcctatgtcctgaatggtattgcctaagttttcttctagggtttttatggttttaggtctaacatttaattctttactccctcttgaattaatttttgtataaggtgtaaggaagggatccagtttcagctttctacatatggctaaccagttttcccagcaccgtttgttaaatagggaatcctttccccatttcttgtttttgtcaggtttgtcaaagatcagatggttgtatatgtgtggtattatttctgagggctctgttctgttccacttctctatatctctgttttggtaccagtaccatgctgttttggttactgtagacttgcagtatagtttgaagtcaggcagcatgatgcctccagctttgttcttttggcttgggattgtcttggaaatgcgggttcttttttggttccatatgaactttaaagtagttttttccaattttgtgaagaaagtcattggtagtttgatggggatcgcattgaatctataaattaccttgggcagtattgccattttcacaatattgattcttcctatccatgagcatggaatgttcttccatttgtgtcctcttttatttcactgagcagtggtttgtagctctccttgaagaggtccttcacatcccttgtaaattggattcctaggtactttattctctttgaagcaattgtaaatgggagttaactcatgatttggctcctgtttgtccattattgatgtataagaatgcttgtgatttttgcacattgattttgtatcctgagactttgctgaagttgcttatcagcttatggagattttgggctgaaatgatggagttttctaaatatacaatcatatcatctgcaaacaagaacaacttgacttcctcttttcctaattgaataccctttatttctttctcctgcctgattgtcctggccagaacttccaacactatgttgaataggagtggtgagagagggcatccctgtcttgtgcccgttttcaaagggaatgcttccagtttttgcccattcagtatgatattggctgtgggtttgtcataaatagctcttattattttgagatatatcccatcaatacctaatttattgatagtctttagtatgaagggctgttgaattttgtgacaggccttttctgcatctattgagataatcatgtggttttcgtctttggttctgtttatatggtggactacatttattgatttgcatatgttgaaccagccttgcatcccagggatgaagcccacttgatcatggtggataagctttttgatgtgctgctggattcggtttgccagtattttattgaggatttttgcatcaatgttcatcaaggatattggtctaaaattctctttttttgttgtgtctctgtcaggctttggtatcaggatgatactggcctcataaaatgagttagggaagattccctctttttctattgattggaatcatttcagaaggaatggtaccagctcctccttgtacctctagtagaattcggctgtgaatctgtctgctcctggactttttttggttggtagtctattattacctcaatttcagagactgttattggtctattcagggattcaacttcttcctggtttagtctttggagggtgtatgtgcacaggaatttatccatttcttctagattttctagtttatttgtgttagaggtgtttatagtattctctgatggtagtttgtatttctgtgggatgggttgtgatatcccctttatcattttttattgcatctatctgattcttctcccttttcttctttattagtcttgctagcggtctatcagttttgttgatcttttcaaaaaaccagctcctggattcattgattttttgaagggttttttgtatctctatctccttcagttctgctcttatcttagttatttcttgccttctgctagcttttgaatgtgtttgctcttgcttctctagttctcttaattgtgatgttaggttgtcaattttagatcttttctgctttctcttgtgggcatttagtgctataaatttccctctacatactgctttaaatgtgtcccagagattctggtatgttgtgtcttttttctcattggtttcaaataactttatttctgcctccatttcgttacgtacccagtagtcattcaggagcaggttgttcagtttccatgtagttgagtggttttgagtgagtttcttaatcctgagttctagtttgattgcactgtggtctgagagacagtttgttataatttctgttcttttacattttgctgaggagtgctttagttccaactatttggtcaattttagaataagtgtggtgtggtgctgagaataatgtgtattctgttgatttggggtggagagttctgtagatgtctattaggtccacttggtgcagagctgggttcaatttctggatatcctcattaactttctgtctcattgatctaatattgacagtggggtgttaaagtctcccattattattgtgtgggagtctaagtctctttgtaggtcactcaggacttgctttatgaatctgggtgctcctgtattaggtgcatatatatttaggatagttagctcttcttgttgaattgatccctttaccattatgtaatggtcttctttgtctcttttgatctttgttggtttaaagtctgttttatcagagactaggattgcaacccctgcctttttttgttttccatttgcttggtagatcttcctccatccctttatgttgagtctatgtgtgtttctgcacatgagatgggtctctgaatgcagcacactgatgggtcttgactctttatccaatttgccagtctgtgtcttttaatgggagcatttagcccatttacgtttaaggttaatattgttatgtgtgaatttgatcctgtcattatgatgttagctggttattttgctcattaattgatgcagtttcttcctagcctggatggtctttaaaatttggcatgtttttgcagtggctggtaccggttgttcctttccatgtttagtccctccttcaggagctcttttagggcaggtctagtggttataaaatctctcagcatttgcttgtctgtaaagtattttatttctccttcacttatgaagcttggtttggctggatatgaaattctgggttggaaattcttttcttaagtatgttggatattggccaccactctcttctggcttatagtttctgccgagacatccgctattagtttgatgggcttccctttgtgggtaacccgacctttctctctggctgcccttaacattttttccttcatttcaactttggtgaatctgacaattttgtgtcttggagttgctcttctcgaggagcatctttgtggcattctctgtatttcctgaatttgaatgttggcctgccttgctaggttggggaacttctcctggataatatcctgcggagtatttttcaacttggttccattctccttgtcactttctggtacaccaatcagatgtagatttggtcttttcacgtagtcccatatttcttggaggctttattttgtttctttttactctttttttctctaaacttctcttctcacttcatttcattcatttgatcttccatcactgatatcttttcttccagttgatcgaatcggctactgaatcttgtgcattcatcatgtagttcttgtgccatgtttttcagctccatcaggtcatttaaggacttctctacattggttattctagttagccattcatctaatcttttttccaggtttttagcttctttgcaatggtttcaaacttcctcctttagctttgagaagtttgatcatctgaagccttcttgtctcaactcatcaaagtcattctccatccagctttgttccattgctggcaaggaactgtgttcctttggagggggagaggcactctgatttttagtattttcagcttttctgctccgttttttccccatctttgtggttttatctacctttggtctttgatgatggtgatgttcagatggggattctgtgtggatgtcctttctgtttgttagttttctttctaacagtcaggaccctcagctgcaggtctgttggagttttctggaggtccactccagactgtgttttcctgggtatcagcagcggaggctgcagaacagcgaatattgctgaacagcaaatgttgctgcctgatcgttcctctggaagcttcatctcagaggggtacctggccatggaggtatcagtctgcccctactggggggtgcctcccagttagactactcgggggtcagggacccacttgaggaggcagtctgtccgttctcagttctcaaactctgtgctgggagaaccactactcactttaaagctgtcagacagggatatttaagtctgcagaggtttctgttgccttttgttcggctatgccctgcccccagaaggggagtctacagaggcaggcaggactcctttagctgtggtgggctccacccagttcaagcttcctggccactttgtttacctactcaagcctcagcaatggcgggcgccactctcccagcctcgctgctgccttgcagatcaatctcagactgctgtgctagcaatgagtgaggcttcgtgggcatgggaccctctgagccaggcatgggatataatgtccttgtgtgccatttgctaagactgttggaatagcacagtattagggtgggagtggcccgattttccaggtgctgtctgtcaccgcttcccttggctaggaaagagaattccctgaccccttgttcttcccaggtaaggcagtgcctcaccctgcttcagctcacactcaggtgactgcacccactgtcctgcccccactgtcggacaagccccagtgagatgaacctggtacctcagttggaaatgcagaaatcacctgtcttctgcgtcactcacactgggagctgtagactggagctgttcctatttggccatcttggaaccatctcccaaatagactctttggcagcagtgactctccaaaaccaccaaggcctagacctcctcattgctgagaaaggaggactctgcaccttcttaggggaggagtgttgtttttatactgaccagtcagggatggtacgagatgccacccgatgtttacaggaaaaggcttctgaaatcacacaacacctttcaaactcttataccaacctctggagttgggcaacatggcttctcccctttctcggtcccattgcagccatcttgctattactcgccttcaggctgtgtatttttaacctccttgtcaaatttgtttcctctagaattgaggccgtcaagctacagatggtcttacaaatgggaccccaaatgagctcaactaacaacttctgccaaggacccctggaccaacctgctggccctttcactggccttaagagttcccctctggagggcactacaactgcagggccccttctttgcccctatccagcaggaagtagctagagcagtcatcacccaattcccaacagcagttggggtgtcctgtttagaggggagattgagagttcaaggcagctgggcttctgggttgggtggagacttggagagcttttctgtctagctaaaggattttaaacacaccaatcagtgctctatctagctaaaggtttgtaaatgcaccaagcagcactctgtaaaatggaccaatcagcaggatgtgggtggggccagataagggaataaaagctggccacctgagccagcagcagcaacccactttggtcaccttccatgctgtggaagctttgttcttttgctcttcacaataaatcttgctgctcctcactctttgggtccacactacctttatgagctgtaacactcactgcgaaggtctgcagcttcactcctgaagtcagtgagaccacaaacccactgagaggaataaacaactccggatgccccacctttaagagctgtaacacaccctgcgaaagtctgcggcttcactcctgaaatcaagagataccatgaacccaccagaaggaagaaactggacacatctgaacatctgaaggaatgaactctggacacaccatctttaagaactgtaacactcaccatgagagtccacagcttcgttctcgaagtcagcgagaccaagaacccactggaaggaacgaattctggacacagtaatatagatgactaggctcagctggtcacttatcaggatcacaggcagttattatcagatggctgtggctagaatcatctgaaggctcaagagagctggatgtcaagatagattcttcacacatgctcctggagcctaaaataggaggaatggctggggaatagctggacatttctcttttaatgtggcctttctacatggtgacatggtctttgtcgtatcatgatggtctaagggtagactttgaagttacatgataattatttcctttagagccattgttcccagagacagaaagtgaaagctgtgatttttaaaaatttctgggctcataatctgataaagagtcacttcatattctactggtcaaaatgctcacagagtctgccaaaattcaaggagagaggatatgaaccccacctctctgtgggaaaattatcaaacaatttgtgaccatcattaatctactataaaagttatgcaggatagattagcaggatgcttcttatgtttttgttgttgaaataacagggacaaggaataaaaacctgtgcagaaatcagaagatctacttttgcatatacaaagtgaagagttgcttgtaaagcaacaccaggcattatagtgcctgtgaccttgatattagaatcaccttgccctccaaaagtgccatggacatcacttttataagtcagattctatttatatgctctagagttgctggctacttaaaggagaaccttttgtaaagtgaagaaaagtttaaaggcattgaacacacaggaggtgcaatgataaatgttactttaccctctctcattccattagtgttttcttaaaggaatattgggtcctactcaagacttaactgagatggctgatcttaagtgttgaatataagcccccgttcttggtcttggaatgtgaacattattgggtatcattgacggagagattggcaaaggaaatcctgcaagagataggagacctaaattttcaataagtgttctacttggtttccatggaaactgggttaggtagtgaatctcacttgatgtgcacttctgtgccttcttgaacagatctttaggagtcggtaaaacaatagtgggatagcattaataaaatctggaaagacaagtacaggtctggtggaacaaaaggaattgtttggggacactggtgttgattttatgctactggaagtactttgagctgcatacaactcatgtagcatgctcaatgagagacaactaagtataggtatattagtattcacagttgcaagtgacaccaagctaaattgaatttaaaataatataaaatatctaagttttctaatccttatttcaaataagaatcagaaaaacaaaaggctggggttaacctttttctgcatttctgcattgcatggctgtcctgcctaacatcagccttcactgatatctccttaacttaactcttagcaaaccagacatgtagccagaactcttattccctgccaattttgtataatgacactgtagaaatgaaaacttaaaatagccattttttcccatgaaagcttttaatagccatccacaaaacttttcttggattctttgttttaatctctgagctgaacattttcttttgtttcttttatttttcccaacaagtcctccattgatgataatcttaggaaatacagttaagaaaatgatactcttccattagcactgtagtcaaaaaatcattttgcttctatttctgctgtcaattccttttttgttgagttgtttttgtatgataaaagattaataataagaatatactttttactgcaaatattttttttccctccagtgggagtataggtataaataccaagcaatttgaattaaacagattaagtcgtagtattgctattccaattgcttgtcattacacaggaggttatggttacagctgactatacagcactacctgagccatacattttacatttgcaatcggcctattatagatgaactgtgaaaattggagagagctttttatgataattggaagatgttttccttgaagtatgtaaagcccttgagagaacttgaattacttgcttgtaattttgttataagctttaatcctatttatttaacttgaagtttattgctcctgaatatattttcctatgtctttctattgagtgacatacatgctatattttcaatatttttatttgaatatcattacaaattttattttgctttttgttttcaaactcaaaaagttgttttcccttgggcatgattcatagataaatgaagttacttctgggttttaaattaggaatatcaatggaaatacaaagacagcctctctttgattgtacttggttctttctgtgttctgagtaaacctgacctaacatttcagataccaactgggaatctgtaggtgatgtgtgcaacattttatgccacacataattgtgtgctcttttctttttctttcttccccttaacaatctttctctggtttgactggtctcttccctgtttctgaatacctcatgctcattcctactttttgatccccataaaccatttctgtgcctagaatgccctctctcctcttcagaaccatccaagtcttctcatctctccccctgacaagatactccaacttatgttttactgtgttcaagaatatttaatataactactacagcctaaattaatctatcatctatgtgctcgtagcacttatttgctagaccattatgttggtacccaaccatatgtaatgacaccttgcttctctagagatgagaagtgtgagaaagcccacctgaaatgatgatcacagagctgctgcattatgggtacagattttactaacagccataatacacaatttaattttaattattagcgaacttcattatctgttttataaatcctcaagtgataagacacagccaattcccattttcctcatctgctaggtgatatctcatcacatctaagatcccattgattgtaagacacatcactcttttacgtaccacaaagaaaagacactgcccgtaaaactgtttcacaagagtttgctatcactttgaatttgtattttgtacatatcaaaagagctctttgtcatttaaacatattgttttgtttatcacatcaatctttaatttacctggcatacgggatcagatacattaatgcatgtttaaatagtttttttaatctctggaatttcttctttaaaacattctagaccagaggttcttaacatacagtacacagattcttgaaggcggagagtctctgaatagatatagtggtcaactattactgcaacaatgctacattaaaaaccaacccccaaactcactggcttaaaacaacaattatttattttcatctgtacatttgtaggtcagctggaggttagctgacctaggctgggctctaagctggaggttgagctcaggtctaccatgcatgtctctcatctttcttggaataaaaggctacgtggagcattgttttttctcatggtgatggcaacattgcaagaagaatgagcagaaacatacaatgcctcttaaagactagagttagaaattgcattatatcacttatattggaaaaagcaaattaggtggccaaagccagcatcagtggagcaaggaaatattctctgcctctggtgggaggagctacaaagacctatggcaaaggtcatgaatttagggagagacgaaggaatgggaacaatggtgcagcctactaaaatcagtttcaaggagaccaaaaagcctctaaaattctttgctaaaatgttgtatcataaagggatatttttctagagaacatgttcttactattcaccagattctcaaggagtgaatgggattccaaccatttccaagtgagaaccacttactttaggtccttctattattcctttgtttgttcattcaatattaatatacctcagttaatgacccaggattgatttctgtgaacattttaaaattttcaggtgattgaggagttggttgctttcttttgcttctttttttttttttttttttttttttttttgagacggactctcgctctgttgctcaggctggagtgcagtggtgtgatctccgctcactgcaagctccgcctcccgggttcacaccattctcctgcctcagcctcgcgagtagctgggactacaggcgcctgccaccacgcctggctaatttttttgtatttttagtagagacggggtttcaccgtgttagccaggatggtctggatctcctgacctcgtgatccgcccgcctcagcctcccagagtgctgggattacaggggtgagccaccgcaccctaccgagttggttgctttctaccaggtcatgtattttaagagcctggcaggctctaaaatttgatttggcagggctctatcagcaccaggtaacctttctgtgcttgaagcttagctggtacccactcccatagtgatgtgttagtgaatcccatatggaagaaacatagaggggggacattgaaacaagaaagacctggtttcaaattcctgccctgccgtttactacctgtgtcatctcaggcaagtaaataaacctctatgcacctcagtttccttttctgtaaaatgagagtgacagttcttatgctacaaggtcatcgtcattgtgaggattaaatgagacaatgtgtgtatagtatttgtcacatgttaggtgctcaacaaatgctagtccctctcattcccattattgtttacattatgctgacaattttatcctcattctgtaatataaatagtatgtccctatcctgtgaaatattaatgaagaaatttctgaatgctattcctttttattttttgtttttaaaaacagttattagctgtttgtttctatcagcagattctagacccagaataaaatcatatttacacttgggcgtttctatgagctctctttagcctttctctcctggtatgaacgttatggaagtaaagtagcttctttttccctcaaaggggactgccaaggccaaaaggaaattgaactttgtcttcctagtcacctctgatctttgacataacagagactgaggaggtgaaagctaattcttaccaagtactttttgacacagtagattgagcaataatggaaaaagttctgagatgttgtttttcacaaaattaccactgttaacctccaaattacatcaaccgaaacaattttttgttctttgaactctgacacagattgaacgagccctcatcaagagtaagaaaaaaaatttctctaggttagtaggaattggcctattttgaattctattccagccagtaaacatgctgttaactttgaaaattctgtgtagatttaaaaagaaatactctaatagctaggtattttattaccttttaaaattatttcagcctcaagcctaacagattatttagtaatgagtgacatttccgttgcagaatagcaggtggataattaatgaataatgtgttctattttcctgtctatatgtatatattctagaaatataactagtgttataggtaacagttcccagcttgatcaatgtaaataaatataaggcccagttttaaaaacataaacattttaaatctgcaatgcttttatatttcattcatcaaattctagtgagaaaggcattaggcatgtaaaaaataaaagaaaaaaattataaattgtggtgttctgggggagataagctgatgataaaggatatatactatccaaaaaggctgaaaagactactctttaaaagagtatcttcaatgcattttaaaattgatgtacattaatttagctaaattaacaatgggaaattaaatactgttcagcaagcttattgtcctattagaactgtagcttttttggctgcagagggggcattaaatgttgatgatattcaatacaatagccaaaacctttttattccactatggatttgctactaacgtgaatctttaaaagggagaaagcaagctattttgagggttctaatttagacaaggctaatgaattgtgaaaaaaatacattttcatcaaatgtcatcagctgaataagcaaatgcattaagttatcattttatatatgttggtcagatattattctctctcttcttcccaacaattctggtttcacagatgagaaattattttaaaagaaaaaaactttctaaggagaatcttcattaggctttcaatagagattcaccctggacacatctagaaatgtaaacaccatagtaaaaaaaaaaatgtaaagaataaactctcttgggagctgtttgagctggcttataacaaagggaaaagaatgggtgtccattggagtttctggaccctttgaggtcagttgtagtattgctattttatttatttatttttatttttttggagacagagtctgactctgttgcccaggctggagtgcagtggcatgatcttgtctcactgcaacctctgcctcccaggttcaagtgattctcctgcctcagcctcccgagtagctgggactacaggcacgcatcaccatgcctggctaattttttgtatttttagtagaagcgggattttgccgtgttgcccaggctggtcatgaactcctgacctcaggcaatccgccagcctcagcctcccaaagtgctaggattacagatgtgagctaccacacccagcctaatattgttattttatagataacgatgataaattacagaagggataagtagtgttctgttccaggtcatacaactagcaaatgtcaaagcaggattaaaactcagatcattctggttctaaactttcacctgtagtttggattgttgagtccaaggagaggaagatttttgggtcagaagattctgcaaaactgcctgcatatgcttgccttctattcacaaatatccctctctccttatttgtatattgtagtatcaccaactaatggccatttctgatggtcactgggtaagttgttcctctcttgatagctctgctctaacatggaaagtacttatcttcttttatatatatatatatatatgcatacacacacacacatacacatatatacatatgtagttttctttttaaattattctttttttctcattattatactttaagttttagggtacatgtgcacattgtgcaggttagttacatatgtatacatgtgccatgctggtgcgctgcacccactaacttgtcatctagcattaggtatatctcccaatgctatccctcccccctccccccaccccacaacagtccccagagtgtgatattccccttcctgtgtccatgtgatctcattgttcaattcccatctatgagtgagaatatgcggtgtttggttttttgttcttgtgatagtttactgagaatgatgctttccaatttcatccatgtccctacaaaggacatgaactcatccttttttatggctgcatagtattccatggtgtatatgtgccacattttctcaatccagtctatcattgttggacatttgggttggttccaagtctttgctattgtgaataatgctgcaataaacatacatgtgcatgtgtctttatagcagcatgatttatagtcctttgggtatatacccagtaatgggatggctgtgtcaaatggtatttctagttctagatccctgaggaatcgccacactgacttccacaatggttgaactagtttacactcccaccaacagtgtaaaagtgttcctatttctccacatcctctccaacacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcccccactttttgatggggttgtttgtttttttcttgtaaatttgttggagttcattgtagattctggatattagtcctttgtcagatgagtaggttgcgaaaattttctcccattttgtaggtttcctgttcactctaatggtagtttcttttgctgtgcagaagctctttagtttaattagatcccatttgtcaattttggcttttgttgtcattgcttttggtgttttagacatgaagtccttgcccatgtctatgtcctgaatggtaatgcctaggttttcttctagggtttttatggttttaggtctaacatttaagtctttaatccatcttgagttgatttttgtataaggtgtaaagaagggatccagtttcagctttctacatatggctagccaattttcccagcactatttattaaatagggaatcctttccccattgcttgtttttctcaggtttgtcaaagatcagatagttgtagatatgtggtgttatttctgagggctctgttctgttccactgatctatatctctgttttggtaccagtaccatgctgttttggttactgtagccttgtagtatagtttgaagtcaggtagtgtgatgcctccagctttgttcttttggcttaggattgacttggcgatctgggctcttttttggttccctatgaactttaaagtagttttttccaattctgtgaagaaagtcattggtagcttgatggggatggcattgaatctataaattaccttgggcagtatggccattttcatgatattgattcttcctacccgtgaacatggaatattcttccatttgtttgtatcctcttttatttccttgagcagtggtttgtagttctccttgaagaggtccttcacatcccttgtaaattggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttgaggagattttgggctgagacaatggggttttgtagatatacaatcatgtcatctgcaaacggggacaatttgacttcctcttttcctaattgaataccctttatttccttctcctgcctaattgccctggccagaacttccaacactatgttgaataggagtggtgagagagggcatccctgtcttgtgcctgttttcaaagggaatgcttccagtttttgcccattcagtatgatattggctgtgggtttgtcatagatagctcttattattttgaaataacgtcccatcaatacctaatttcttgagagtttttagcatgaagggttgttgaattttgtcaaaggccttttctgcatctattgagataatcatgtggtttttgtctttggctctgtttatatgctggattacatttactgatttgcatatactgaaccagccttgcatcccagggatgaagcccacttgatcatggtggataagctttttgatgtgctgctggattcgttttgccagtatgttattgaagatttttgcatcaatgttcatcaaggatattggtctaaaattgtcttttttggttgtgtctctgcctggctttggtatcagaatgatgctggcctcataaaatgagttagggaggattccctctttttctattgattggaatagtttcagaaggaaactagttcctccttgtacctctcatagaattcggctgtgaatccttctggtcctggactctttttggttggtaagctattgattattgccacaatttcagctcctgttattggtctattcagagattcaacttcttcctggtttagtcttgggagagtgtatgtgttgaggaatttatccatttcttctagattttctagtttatttgcgtagaggtgtttgtagtattctctgatggtagtttgtatttctgtgggatcagtggtgatatcccctttatcattttttattgcatctatttgattcttctctctctttttctttattagtcttgctaacagtctatctattttgttgatcctttcaaaaaaccagctcctggattcattaattttttgaagggttttttgtgtctctatttccttcagttctgctttgatttcagttatttcttgccttctgctagcttttgaatgtgtttgctcttgcttttctagttcttttaattgtgatgttagggtgtcaattttggatctttcctgctttctcttgtgggcatttagtgctataaatttccctctacacactgccttgaatgtgtcccagagattctggtatgttgtgtctttgttctcgttggtttcaaagaacacctttatttctgccttcatttcgttatgtacccagtcgtcattcaggagcaggttgttcagtttccatgtagttgagtggttttgagtgagattcttaatcctgagttctagtttgtttgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggagagttctgtagatttctgttatgtctgcttggtgcagagctgacttcaattcctgggtatccttgttgactttctgtctcgttgatctgtctaatgttgacagtggggtgttaaagtctcccattattaatgtgtgggagtctaagtctctttgtaggtcactcaggacttgctttatgaatttgggtgctcctgtgttgggtgcatatatatttaggatagttagctcttcttgttgaattgatccctttaccattatgtaatggccttctttgtctcttttgatctttgttggtttaaagtctgttttatcagagactaggattgcaacccctgcctttttatgttttccatttgcttggtagattttcctccatccttttattttgagcctatgtgtgtctctgcacgtgagatgggtttcctgaatacagcacactgatagatcttgactctttatccaatttgtcagtccgtgtcttttaattggagcatttagtccatttacatttaaagttaatattgttatgtgtgaatttgatcctgtcattatgatgttagctggttattttgctcgttagttgatgcagtttcttcctagtctctatggtctttacattttggcgtgattttgcagtggctggtaccggttgttcctttccatgtttagcacttccttcaggagctcttttagggcaggcctggtggtgacaaaatctctcagcatttgctcgtctgtaaagtattttatttctccttcacttatgaagcttagtttggctggatatgaaattctgggttgaaaattcttttctttaagaatgttgaatattggcccccactgtcttctggcttgtagggtttctgctgagagatccgctgttagtctgatgggcttccctttgagggtaacccgacctttctctctggctgcccttaacattttttccttcatttcaactttggtgaatctgacaattttgtgtcttggagttgctcttctcgaggagtatctttgtggcgttcactgtatttcctgaatctgaatgttggcctgccttgctagattggggaagttctcctgaaatgttggcctgccttgctagattggggaagttctcctggataatatcctgcagagtgttttccaacttggttccattctccccgtcactttcaggtacaccaatcagacgtagatttggtcttttcacatagtcccatatttcttggaggctttgctcatttctttttattcttttttctctaaacttcccttctcgcttcatttcattcatttcgtcttccatcactgataccctttcttccagttgatcgcattggctcctgaggcttctgcattattctcgtagttctcgagccttggttttcagctccatcagctcctttaagcacttctctgtattgtttattctagttatacattcttctaaatttttttcaaagttttcaacatctttgcctttggtttgaatgtcctcccgtagctcagagtaatttgatcgtctgaagccttcttctctcagctcgtcaaagtcattctctgtccagctttgttccgttgctggtgaggaattgcgttcctttggaggaggagaggtgctctgctttttagagtttccagtttttctgttctgttttttccccatctttgtggttttatctacttttggtcttctatgatggtgatgtacagatgggtttttggtgtggatgtcctttctgtttgttagttttccttctaacagacaggaccctcagctgcaggtctgttggagtccccttgccgtgtgaggtgtcagtgtgctcctgttggggggtgcctcccagttaggctgctcgggggtcaggggtcaggcacccacttgaggaggcagtctgccccttctcagatctccagctgcttactgggagaaccactgctctcttcaaagctgtcagacagggacatttaagtctgcagaggttactgctgtctttttgtttgtctgtgccctgcccctagaggtggagcctacagaggcaggcaggcaggcaggcctccttgagctgtggtgggctccacccagttcgagcttcctggctgctttgtttacctaagcaagcctgggtaatggtgggcgcccctccgccagcctcgctgacgccttgcagtttgatctcagactgctgtgctagcaatcagcgagactccgtggttgtaggaccctccgagccaggtggggaatataatctcatgctgcaccattttttaagcctgtcggaaaagcgcagtattcggttgggagtggcctgattttccaggtgccgtccgtcacccctgtctttgactaggaaagggaactccctgaccccttgcgcttcccgagtgaggcaatgcctcgccatgcttcggctcgctcacggtgcgcgcacccactgacctgcgcccactgtctggcactctcttgtgagacgaacccggtgcctaggatggaaatgcagaaatcacctgtcttctgcgttgctcgtgctgggaactgtagactggagctgttcctattcgtccatcttggctcctctctaaattattctttaagttctgtggtacatgtgcagaatgtgcaggtttattacataggtatacacatggcatggtggcttgctgcacccatcaacctatcatctacattaggtatttcttctaatgctatccctcccctagccccctgtcccctgacaggcaccagtgtgtgatgttcccctccctgtgtccatgtgttctcttcctaatgtattttaaatacctgagtttcctttttgtgtatggtcagtacagcaaacttgaatttctagaacctgatatagtggtgtcttgaggtttttgtttctcttttgttcctaatagtttttaaaaattttgtagctctcttcactcccacagcactctacatattcacgtgcacacctaattcatgagctctctatacagaaagaaataatgggaatgactgggaacatgctattaaatggatatattttcagatcttccttaaatcattttctttgcagccttctacttctaagaccgtatcatgaggcttattgacacaagggagaaaaagacacatgcaagtaatattaggaatgaaaaggtaatatgatagatataacagagatttgaataaatcagaagagattaatatgaagcaaccaactttatgccaataaaatagaaaacaaatgatatggacatattaatagaatgtataattgatcaacattatctcaagaaaaattagaaaaccttcataaaccaataagcttaagcatattgaattggtaataaaaattatcaacctcccatctcccgcccaaagactccaggcttatgtgattagatgattttattggaaaattttctctaactgtcaagaattaaatgttccaaattacattaacaatttcagaaaagggaaaaaagctacttaatttactttatgagactagcataaccatcataaaaccaggaaaaggcagaatctgaaaagtataggccaatcctatttataacataggtgaaaatgtctgaaacaagaaccattagacaattattactcaggtacaagccccaagagtcatctttctttcctgttttcctgcttatactcaatatctagtgagtgaggtcctgttgactctgcctcttaaacatatctcaaatctgttcaatcttctttgtcttcactaccaccataggcaagtgaacaaatatctcttcctgcagtggtctctgttcactctccactcttgctcttactgcagtacttttaaaatgtaaatcagatgatgtcgttcctgcatcaaaattctctaaatattttccatgatgtatagaatagaatccaaacctctcaccctggtctacaagtccctgcactatctgacatacagcttcatcaccatctcttgctactctgctccttgctcactgcactgtagacatactgatcttcttcctgttatttgaagagaccaagcttgttgccacctcagagaatttatattttctgttccttctgtctgaattactctcctgtaagtgtttgcaaataaatcttctccgtattcaggccttcactcaaatatcgctttctcagagaggccttccctagtacatctccctgtttcttcatttactcttcttcctaccttttactctgtatcccattaaccttcttattttgcttcatagtgcttatcagtatcctccaataatcattttcagatattttagaaatgcattgtccttctatcttttatcagctgcaggtggacagggatttttttttttctttttttcctttgttttgttttgttttgttttgttttgttttgctgtatttctaacacctagaaggctggggaggcactaaatatatattgcatgaataaatctaatgtaaacttccttaagtcacagatgagaaaactgaagcccagggaaggaatgtgacttgatcaagattacttgcccacctgggaatagaatcctttctcctgagttacagtatggtgccctttctgctataccacatgtttttatgtgcctctagccccataattctagtttcaaaaggcaatcccatcctctccctggtggactagtataagtattaatttatagagatgtttatgaagcatactgcaggcaaatcaatatgataatgagagttagatattgatactatattattttgtagctttccaatagtgactgtttcatttcaggattgctttcctttcagaggtaggaaaaatacttatttttaatgtgtgtgtctatcagcaaatatggtaaagcatgttaaggccaagcatgctgagctgatgacattaacttatcctaaataagtctcacatgagccaactggttcagattaaagccccttattcaccatgatgcaaagtacttttacaataaaacaaaaacaaaacaagagatcacatagcaagggtgtgtgtgcatacatgcctatgtgctgcaagttaataagtacattgtgtaagtaccatgagactgtgactgtgccagtggagatacaaaagaagtagcaggcataatccttatcatcaaggatcttacaaaatatagtcttgaaattactagaaaatagttctgatgcattatataagcaaggcaggatagtaagagtaagactgtatctaccagggccagtgagatacagaataagagaaaaatcactatgaggtagagttaatctgaacaaacaacacagagactatgcaatcaaaactatgggtggcctgcctttttactttttgtggcaagactcagtatatattgatatatcattaaaaatcattcattttgtttgtatgcaggctgttaccatcgaccacaggagacagagttttctaagactttaaaataattcttggaaggtaataaggtctggtagttgctttcgattttctaagcagaaacacagtgttcaagtaccctttgtctacattcagaattgggagtagggatgtttcctgacactgtggaatatttcacaaggtttcatcaaaatttcaaaatatcagtttcttcatggtatatcacttcaggtccctgagcaaactggaaggggtatgttctgttttgtttgctctgggtagcctatatctctggaatgtctgtttcctgtcaactgccactagagggaggctgattaagtgcatttcatttgtgaatggaattttaagcaacagtaaaggattctcaccaaacacacacagccctttcaggcctaatcctacaaacccaattaaaggtaatggacactctatttgatgaggcagttcagctaagccagcactctctgatggtagctagagaggttattcagaattttgcaaatgccatccatgtctgcaggaatttatgcctttatatcagctgcatagtagagccttctatttgcaacatgcaaaacagtaaccacatttcttctttaaaaatgtattagggaagaaattatgtactagaatattaggtttcttataataagagctatagggactttaaaaataggttttggttgctgggagtagaaatttggttgggagtgataaattttctgcatttatttatttctgaacatttccttaagcagtgtgtgcaggtaaatgaaaatattatcaaatttattttaaaataggacataagaaccagagcagcgtttctctaaatagggactgcctgcaataagatcactttgtagggggagttgtttaaaaattcagatccctagcttcacactagacctgctgaatcactctctgaagttagggcctgtggatctttactaaaaacaaacaaacaaacaaaactgaccaggtgtttctgatatactctaaggtttgacaacattggaaatcgaaattgtggagtaattacttaggagcaggtttggttagaaagggttacgcagaagggtaatgtgggtttggagtgctggtcaaatttctgacagctttttacctcatttgcatctcaatgttgtttctaaaaaaggaaatgctaaaaaaggaaagtgtctcataaaagagaagactaaaacattgtggcatacccacataatactatacaaccatttaaaataattttataaaatgatatataaatgcatctggaaagatattcttctattgttaattgagaaaagcaagtcacaaaacacacatgttgtgattgctttctttttttattattattatattttaagttttagggtacatgtgcacaatgtgcaggttagttacatatgtatacatgtgccatgctggtgtgctgcacccattaagtcgtcatttagcattaggtatatctcctaaagctatccctcccccatcccccaccccacaacagtccccagagtgtgatgttccccttcctgtgtccatgtgttctcatcgttcaattcccatctatgagtgagaacatgcggtgtttggttttttgtccttgccgtagttaactgagaatgatgatttccaatttcatccatgtccctacaaaggacatgaactcatccttttttatggctgcatagtattccatggtgtatatgtgccacattttcttaatccagtctatcatagttggacatttgggttggttccaagtctttgctattgtgaatagtgccgcgataaacatacatgtgcatgtgtctttatagtagcatgatttatagtcctttgggtatatacccagtaatgggatggctgtgtcaaatggtatttctagttctagatccccgaggaatcgccacactgacttccacaatggttgaactagtttacagtcccaccaacagtgtaaaagtgttcctatttctccacatcctctccagcacctgttgtttcctgactttttaatgatcgccattctaactggtatgagatggtatctcattgtggttttgatttgcatttctctgatggccagtgatgatgagcattttttcatgtgttttttggctgcataaatgtcttcttttgagaagtgtctgttcatatcctttgcccactttttgatggggttgtttgtttttttcttgtaaatttgttggagttcattgtagattctagatattagccctttgtcagatgagtagattgcaaaaattttttttcccattctgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctcacgtttaagtgtttaatccatcttgagttaatttttgtataaggtgtaaggaagggatccagtttcagctttctacatatggctagcccgttttcccagcaccatttattaaatagggaatccttcccccattgcttgtttttctcaggtttgtcaaagatcagatagttgtagatatgtggcattatttctgagggctctgttctgttccattgatctatatctctgttttcttaccagtaccatgctcttttggttactgtagccttgtagtatagtttgaagtcaggtagcgtgatgcctccagctttgttcttttggcttaggattgacttggccatgtgggctcttttttgtttccatatgaactttaaagtagttttttccaattctgtgaagaaagtcattggtagcttgatggggatggcattgaatctataaattaccttgggcagtgaggccattttcacgatattgattcttcctacccatgagcatggaatattcttccatttgtttgtatcctcttttatttcattgagcagtggtttgtagttctccttgaagaggtccttcccatcccttgtaagttggattcctagatattttattctctttgaagcaattgtgaatgggagttcactcatgatttggctctctgtttgtctgttattggtgtataagaatgcttgtgatttttgtacattgattttgtatcctgagatttgctgaagttgcttatcagcttgaggagattttgggctgagacgatggggttttctagatatacaatcatgtcatctgcaaacagggacaatttgacttcctcttttcctaattgaataccctttatttccttctcctgcctgattgccctggccagaccttccaacactatgttgaattggagtggtgagagagggcatccctgtcttgtgcctgttttcaaagggaatgcttccagtttttgcccattcagtatgatattggctgtgggtttgtcacagatagctcttattatgttgagttatgtcccatcagtacgtaatttcttgagagtttttagcatgaagggttgttgaattttgtcaaaggccttttctgcatctattgagataatcaggtggtttttgtctttggttctgtttatatgctggattacatttattgatttgcgtatattgaaccagccttgcatcccagggatgaagcccacttgatcatggtggataagctttttgatgtgctgctggattcggtttgccagtattttattgaggatttttgcattgatgttcatcaaagatattggtctaaaattctcttttttggttgtgtctctaccaggttttggtatcaggatgatgctggcctcataaaatgagttagggaggattccctctttttctattgattggaatagtttcagaaggaatggtaccagctcctctttgtacctctggtagagttcggctgtgaatccatctggtcctggactttttttggttggtaagctattgattattgcctcaatttcagagcctgttagtagttgttttctagtttattgaaagtgaaagaaaagaatctgaaaggctcaaagtctctcacattcttcagatggcagagaaaacaattcctcattagatttctgatgttataatgttcaaaaagagcaaactaactttgcaaaagaagattccttaggtcaaatgtggtcctgggtacaaatgaaactaggagtttctctatttgatttttatccacagatttgatttaaaaaaaaccttggggaagctcccaaattgattgtgggttctaaagggagggctttgccaaataaagtcactaacatgcaggaatggaattcttcaccaaatggaccaggcaaaaacaacctctgccctaattcccaaacctagaatgggttatcttattggccctggtagaaatgcctaattgccctttggagtagtctaaccctattttccaggtaagaatttaaacaccagggtttataaatgagtgttcccagctgaggtgagccatcagctgaaaagtgcttgagtggaaaactggcttaaaacgttgcctagaaacaattaatagaaacctggatattaagagtttcggactgaattctatacaagatgaagctgcttctcatgccagaagagacagaaaagacatggctctttggaaagtctcttctctttctataatctgtgctgatctgcagtagtggtgacttgtgattttactttaccagatatactaattactgccctaggtaataataccagagaagattttaggactccaaaaaaaatttatgtaacgtttgttaaaagtccaataattaggaaattagcaagttaggcattaactatagaattttccatggtctgtcgctaccagtgtttctcaactgaacgtttgcaattatctaacacatgctaactctgtcaatattttaccttttatttctggttggtaaccttaggaaaatagagcatgttcttaatcaaaccagagttccaggtttggtttcctactatagtaaccttggctctgtctcatgaccagagatcacaccctagccacatataaaggccataaggggaactgaaagactatgtgtatactttaggtatcctcattcatcaacaagtgatcatgtacttgtcataatcatggcatgttaactggaaaaaaaacaaaaaagtagaggaggagctgaaaaactatattctggttatgatggaccaatggggttacattaacacactatatttaatacatttatttaacatttggagaggtgcagggcaaagggggtttgcatctattccatgccttagcattttacttccacaacctatggtcttaacttctgttgctaacttagttatcactattcaaaatgtaagaaagagaacttgtttgctgatacctcagggatcataagattgtggattctgactagtaattctcaatatgaaataaaattaatagaggacaaaatggagtaaaattaacggaggcaaaatcttagttgagtatcctgttgtgttacaaagctcattggaccatggtctggaagcccgtatactattcttgatggtattaatttttattgtttctcaaatttatttttaaagccttgatgtcctttgaacaagatagcctatggagctcctctgtggtccctaagccacctttacaaaactttagggatttaatgaatatggtttgaaaagaaccaaactactggaaagaagctcaatggccatccataggaaaattcatagatgataatctcttcataagaggacgaacattaagaattaactagatctacgtatgtaacatgaatatgtttcaagcatgacatttaatgaaaaaataagttacaaaggatacacagcataggatactacattagacaactcttatgctacacttcaggtcctcttggcctcacaagactctggggactcttgggcactttttctttcttttttttttttttttttaagatggtgtttcgctgttgtcgcccaggctggagtgcaatggcgtgatctcggctcactgcaacctctgcctactgggttcaagcgattctcctgcctcagcctctcaagtagctgggattacaggcatgtgcgaccacacctggctaattttgtatttttagtagagacagggtttcaccatgttggtcaggctggtctcaaactcctgacctcaggtgatctgcctgccttggcctcccaaagtgctgggattacaggtgtaagccaccacgcctggcttttttttttttttcttttttctgagacagagtctcttactctgtcgcccaggctagagtgcagtggtgcgatcttggctcactgcaacctccccctcctgggttcaagtgattctcctgcccttagcctcccgagtagctgggatcacagacatctgcaaccacacccacttttttttttttttttttgtatttttagtagagatggggtttcattgtgttggccaggctggtctcaaactcctgacctcaagcgatccaccttcctcgacctcccaatgtgctgggattacagatgtgagccactgcgcccagcccaggtgctttttctgcccaagccaattttgtagggactaattctgtttgggctcagactgactttacaagggtacaatcttgcttcatgtctgttttgtgtgacttgtatgtcctgcatggaggcctctctattgccactgaggcataagaggccattggactggctcagcacccttgtctacacaactcagaagtgtgagggatgtaatgctccatggggagactctgaccaatggagactattgctggcagatcatttcttctcctcctcttccccaatatttactttactgagttatagtagtaaatacagtctcgaagcaactggtccctagaaatcaagcaatcaattgtgcttgataccaagcaatggccaactcaggatcatactttcctattaacactttttcccctgattcaccttttctttccccttacttctacaacactgggattacactaccaaatagtagtagcaacacataagattttgcctcaggctgtgctttttttaatgtcccctctaataaatctcatgttgaattatgatccccagtgttagaggtggggcctggtgggaggtgatcatgtcataggggcagatcctgtatcacttggtgatgtccttgtgatactgagtgagttatcgtgagatatggttatttaaaagtgtgtggcccctcccctcccctcccctctcttgctcctgctttcatcatgtgacgtgcctgcttctgcttggccttccaccatgagtaaaagctcccaaaggcctccctagatgcctagcagatgccagtgccatgcttgtacaccctgcggaaccatgagccaattaaaactcttttctttaaaaattacccagtcttaggtattcctttatagcaatgtaagaatggcctaacatgctagattaagacagagtccatttacatacattttaaaaacactaaaaaaggagagattaaagatgctgattagatacagctgggaggtgccttttctgtggaaaagaaccaaaatattgagtatacctgcacactctgaccagatcttttgagacaaaacactgaaattcaatagagaagtgacagaagacaccctggttgaagagggatgaagtgaggctgcctgcttggtattgtgagataccaggactggcccccagaccggtgccattcccaaggaagtgttgagggaagaaaccccgggacaccatattcccactgtggatctctgagttcctagctacaggaattcctccagactccttcagacctttggactggcagagggagctgcctggagataacacagacacattgcttgaaccctagtagagcccaaaagtcttcagtgtgctaggcagcgacagcaaaagctgactctgagctcccccacccccaccccagagctttgcatcctgccctaagttgttacaggtcctgctgtctgctaggcttggagagaacagggccagggaatgctcacatgcccaagacaggtcccactgccattgccatggggctgaggtacagccaaagcatgaaatcccacatctgctaaaccctcctaagactgccggtctggccattcccacaggggaggggccaacaacatagcctccattgtcccgcctaggtggtttgttgatggcctaggtgcagttcacccccctgtcacatgtggtccttgaccttgaggggccagtgaacaaatccgctggccttgtcccagtttcccaggacttgagcacaccatccaggtggatgaaaatgagattcgtagcctgatctctagcaggggaggagccctcactgtcagaataagagaagagcacagctcgggttcatgtaatggcatgggaactcccttcaggagaccgggccaggaagggtgtggcctgatagccatggtttctgcctcagggagtatcatgaatgcctggaatggcttggcaatctgggtacagattgcttgggactagtctagtcagttgggcctgttgccagcattgaatactggagggagatctcccaagtccagggtgcagcagctgggtggggtcccatggctgcctgctgggctgataacccctggcatccttcttaccctgagcgtgctctgtggcacaggagaggcgccgccaccccccactggagggttgtcccagtagcccgagagcagcccctagacccctgcgaaggtaagtgtttacgactgccttggagagcctggctgtgggcttgcccaacccagccctgcccagttttgccccctccagccaccttggtggtagagtgtggagcaggacccctgggagccccataccctgcccatttcaggaacaccctagtacttcccccatcaacaaaggccaagtaaaaagtccactgccatcagcgcaaatgctgtcctcggcaatcgccatctactggctgggacagcaaactgcatgacccatcacaactgcaaatatcactgtacagtgctcagctggttcttgcctgctatcgccacctactggccactagggtgaactgcgtaatctaatgtaatcgctgctgaaagaagcacacagtgctgggaaatgagataagcttcccaaggcctccacctctccatctctgttggtgtggcacagcacaccactacaacaacctacaaacaactagcatcttagaaaaccactacagtaaggctatctataatcaatgaattaatacagagtgttggtgccctaaaagcacaaagaagcaaagccgaaggactctacccaacatacacaacagtaacacactcaagcggggaagaaaaaaatcccaccgaaatgaaagtaagtttaaaaatagaaagtgacagcttctacacatgaaaagggaccagtacaagaactccagcaacatgaaaaaacataacgttttgacacccctaaaggaccacactagctatctagcaatggatcctaaccaaaatgaaaacttggaaatgccagataaagaattcaaggtatggattttaaggaagctcagtgaaatacaaaggaaagtggagaaccaacacaaagaaatcagaaaaataattgaggagataaaagattagatacatatatttaaagaaaacaaacagaacttctgaaaatgaaaaactcactgaagaaattttaaaacacagttggaggctctaacaatagactaaaccaagcagaagaaagaatttcaagcttgaagcccagtcttttgaattaacccagtcaaaaacaaaggaaaaagaatttttaaaaatgaacaaagccttcgagaaaagtatgattatgtaaagtgaccaaacctacaacttataggcattcctgaagtagaagaagaaaataataagaagtttggaaaacgtattttagggaataattcaggaaaaattccctgatcttcctagagatgcaaacacccagatttaagaaattcatagaacacctgacagacactatacaagagaaacattgccaaggcatatagtcaacagactatccaacatcaatgtgaaagaacaaatcttaaaagcagctaaagagaaatacaaatcacctataaaggaaatcccatcagactaacagtggacttatcagcagaaaccttacaagccagaagcgatcaggggcctattattagcctccttaaatgaaaaatatgccagataagaattttaaatcctgccaaactaaggttcataaatgaaggagaaagtattttccagacaagcaaatgctaagggaatttgtcaccactagactggtcctacaagaaatgctcaaaggtgtgataaacatggaaacaaaaggatgatacttaccgtcataaaagcacatgtaagtagaaagctcacagatcctataaagcagttacacagttgagacttaaggtaactaggaaacaaaaccatgacaggtacaaaacttcgcatgtcaatattaactttgaacataaatggcctaaatgtaccaattaaaagatatagacgggcaagttggatttaaaaaaaaaaataagatccaaccacctgctacctataagagacccaccaaatgtctaaagacacctacatgctcaaagtaaagagatggaaaaaatatatattatgcaaatggaaaacaaatgagagaaggggtagccattcttatatctgattaaaacacactataacaatagtaaaaaaaaaaaagacaaagaagggcattaaataatgataaagggttcaatacagcaagaagatgtaagtatcctaaaaatatgtgcacccaacactagagtatcgagactcacaaaactaatactactagacccaaagaaaaaacactgataacaatacaataatagtgggagacttgaacattccagtgacaacacaagacaagccatcaaggtagttggttttctgccttgatgacctgtctagcattgtcaggaaagtcaacaaagaaactctggacttaaactggactcttgaccaaatggacctaacagacatttacagaacattctacccaacaactgcaggatatacatttttctcacctgtgcatggaacactctcgaaaattgaccatatgcttggccataaagtaagtctcaataaatcaaaaacattgcaaccatatcaagtatcatcttggacaacagtagaataaaattagaaattattaccaagcataactctcaaagctacacaagtacatggaaactaaataatttgcttctgaataacttttgggtaaacaacaaatgaagggagaaataaaaaattttgggaaatgaataaaaatcgaaacaaaacataccaaatctctggaatacaataaaaacagtgctaagaggaaagtttatagtattaaatgcctacgtcaaaaaggtagaaagatctcaaattaagaacctaatgtcacacttcaaggaactagaaaagcaggaacaaaccaaacccaaagctagcagaagcaaataaataacaaagatcagagcagaactaaatgagattgagaccaattaaatgatacaaggaatcaacaaaattaaaagttggttttttaaaagaaaaaacaaaattgatccaccactagctagtttaaccaagattcaaacaagcacaatcagaaatgataaaggtgacatttaatgttaaaggtgtagttctgatatcacagaactacaaggaatcatcagatatcactatgaatatctctatgtgcacaaactagaaaacctagaggaaatcaataaattcctgaaaaaaagacaaccctccaagaatgaaccagtgagaaataaaaatcctaaacataccaatgagtaatgaaattgaatcagtaataaaatgtctcccaccaaaaaaaaaaaaaaaaagcccaggaccagatagattcacagccaaattctaccaaatatacaggtaagagtcagtaccatctctactgaaactattccaaaaaaatcgaggagggaatccttcccaactcattctatgaggccagcatcattctgataccaagacctggcagagacacacacaagaaaactttaggccaatatccttaatgaacatcaatgcaaaaatccttaatgaaataccagcaaaccaaatccagcaacacatcaaaaaagctaatccaccacgatcaactaggctttatccctggaatgcaatgttggttcaacatatgaaatcaataaatgtgattcatcacataaacagaactaaagacaaaaatcacatgattatctcaataggtgcaaaaaagtctttcaataaaattcaacatcctttcatgttaaaaactctcaataaactaggtattgaaggaacataccttaatataacagcaacctatgacaaacccatagccaacatcctactgaatgggcaaaagctggaaacattccccttgaaaatcagcacaaggcaaggatgccctctgtcaccactcctattcagcataatattgacattcgtggccagagaaatcaggcagcagaaagaaataaagagcatgcaaataggaagaaaggaagtcaaactatccctttttgcagataacatgattctgtatctagaaaaatagcttcagcccaaaaactcctttagctgataaataacttcagcagtttcgagatacaaaatcaaagtacaaaaatcactagcattcctatacaccaacaacagcaaagctgagggtgatcattatcaatcctctgaaaacaaatgagcaacaaatattttctggcagtgtacttagctccatcaaaggagtgctgggtgaaataaaaatgttatgctctggtcactaccctgatagaaatctttagaatcctgttagaaaatcatttccaatgtctgaagcaaacctgcaaacattacaagaattaattgctgaactgcttgagatgtactagatatgttattcaaatttaggtgtatttcgtggcacatttctgacatgggtatttctaaattttcaaaatatatcgagagaaagagattaactctctgaaaatgtctttttgttcatgatttcctagacaaaaatcctttcttgtcattgcttttgaaaaacataatctaggcccctatttgtatcatcacggttatcaaactttaatgcagtgtcagtgtttgatgtgaagattagattgtcctgaatttggccagtctgggccatatgtgggaggcattataatttgattctgttcacttaagaagtatatcttttaaaatcatttgagtgcaacactatattgaaatgattgttagtgttctctcttgcatcacagttgatgtatcccatcatataaggatgttttcagacctgtaagccctcatattaatagtaaatctttgctcatctttgaactctggattgacacactgttctctcatttccttttgaattgttccactgctcagggttctttgtggcaagtaagcaccactgtttagaactaacaaataccaatcaactcaggcttagggattcaacttgattaaggaccagtgagatttgtatatctgtgtctttagagtctacctgtttaccaagctgtactggaccgggagtcagctttagctttacattgaactagctgtgtgactttgggaaaattactctctggatctatttgggaaaataatttatctggatcttggtttccttatctataaatgaaaacatttacactaggttgtcttaactttaagattctgtaactccaatgcaaagtaaacaaagaccaggtgaaaccatttggcaaacttaatgcaagctaatttctcctattgaagataagactaaactatcaccattccgaagcccactcctcttcctacctctcttacaatttaaatctaacctacctttgaaagtcaactacatctccatcacttccatgaagtctttcctgataacacaacaacctccagtggtatctttttttcaattataggattaattatcatcactacacttagtcttctctatcaccttgtattgttgtttaattttagtgcttttgaggtcaggaatgatgagttatgaacatttatattgcccaaagcacattgtccagtatttcatatgcataataggttctagatttgttgaattaatgttgaaggaatgaatggagtttaaaaatcattctgaaccattttcccaaattcacaatgcaaaagtgattgaatttttcccacctttctttcccaaaaaagatgcataattttgacaatattatacgaaatctaaagtacactttggaatttaccttaaatataaatccctttccttctagtctcctaattttcctctttaaaaagattgagaatacttcctttttagagtggcctgccgtagaaacatttgtattttccttctatattccttagaatacaatgcattttgatcagccagtgtatgaatggcgttttgttttctattacctttttaggaaacatgacaaatggcattgttactcctcaagggagtgtttggttacttgcgctcaccagagccagttctctaggatttgatggaaacagatgctagcattcccatcacaaggtgtatctccagtgtataagtgttgacagaagcaaagtcaaacaatattcaggtcaacatttaatttttttatttttaattattgtaggttcatagcaggtatatgtatttatggggtatgtgagatgttttgatacaggcatgcaatgcatattaatcacatcatggagaatggggtatccatcccctcaagcatttatcctttgtgttacaaacaatccagtgtaactggattgtttagttattttaaaatatacaattaagttattgactatagtatctctgttgtgctatcaaattgtagatcttattaattttttctatttgttttgtatcaggtcaacatttgattagattcattatagatattagtccagcttattccggttccttgagaatttgccaccgagtgtcttatcagtccctcattatccttcttagtctgcattgagaatgtgttagaacaagtgcttagcaactcaaaattcatctagcctgggagacttggaagaaacattttagctttggcctcatgctgtgggagccatgttgtttctctgtcaggttgaggctgtgccgcacttacggaaattagcccaaaaaaattgttttctctctccttttctgtaccagaatgagactccagggtataagcaaaattgatgttgcttgaagaaatttcaaaggttcccaactcccagagctcaagtagccacggaaataagcactggccaaaaaatgtacttagacttgatggtaattgggaaccatttgagggaagggaactaaacatgtactacgtgatgttacttcgtagaataagaaaggcttgtgttgaattggtattttaaagaataatggggaaaaattgggcttctttgtgtgggtttgtaaggtggtgtgagggcagcgtgttggcaatacctaggcaggattgaaggtgataatataaattgaatatatttctggtaaaggatttttgaaaataaaataaactaatgttttcttagattcactcctactttattttcttaaagaaatagtaacccttcctattggtatgtcaggaaaagataatttgttcttaaaattttactagaaagaaaagtatatcatgttcccaagttgacttgtatgcaaaatcaaggttatactttccaaaattaatgcaccttgttcctctgaccccttaggcataattaggggttttgtgctcttacaaatggacttagcaaatgtggcactgacataatcatggaattcatggtatttttcccttgtgattataacaatttggaccccatcaagaaactccttattcagcctttcgtttgttcataagctgacttcttttgacttaagagaagtcagcttatattagtgctaagcccaaaagaaccttctgcaatcacactgcgggggaccactttctatgccctctgctcacatttgtgttccaaatcatcagtgttcactggcccaattaggccctctctagcaacattagccctcagagctttgcttgccaatgtcaacatacattctcagttccagaattccactgtcttacctcaagtgtcacttgagcagcccaggctttcttattatagtgtttatttctgtcactgattcatcattttttatttgtctgactcaaatccaggtagttttgctcaatcgatggcaggctgttaaacagcatgtgtgtttagggcagcaattcattcatccattttgacatgcacacctgacatcttcattaatgcccagcacaaatttctcagattccagatctgcttggtatctccatattccttctgcatccacctctttgccacaaaagacacttcatgtaaatgtcacttttttcaagtttttcacatgttccacagtggaaccatatgcttatagaaatgatgcccttttaggtctgtatccaaacatagcttgtcaatgactgctcacaaattctaagtcagcttataagcttttacactttttctgaaatgttttctttagggcttgtaaacttcttcccatgttattgcttacttgttgtacccctgtgttctttttcgacattaactccaaccaccttaccacctttttattgccctttcaattcatcacattcagctgaactgctgcctcaggcaagtgcttcctctctatgtctgtttattgagtttggggcaatctctgtaacagaaattctgctacaatggtctttcttctatcctatgaccatttgctaagctcttgaaacatcagtcatgttcagttcttagaaaacctacattgaagaaaaaatagtactgataattttatggaattaatttaatatttatagtcagatagtatgagttgcttacctgaagatgtgcagggaacctctggagagccatactgacaagtaagttgtggcttagtctgtatgacttgagagctattggtttttcttgttcacatagttgtcaccattattgcaatattataaacatttcctgagtgctcactatgtgataggcactgtgtcaagaactttacatgaagtaactattcaatactcacagtagcccttcaaagtaggttgtattattatctctgttttacagacgaggaagcagagaaaatcaggagggtaaatgacttatttagggacatacaacaaataagtgttagaataggcatttgaatttaggcagtataacctcagagttcacaaaactcttacccttcgtattatactgtcttcttataatgatagataacatttattgagaacttacgatgagccagtcacttatgatgagctagtatagttagccatattgcattcattaacttattaaatcatttcttcagcccttgaagacaggtgacattatttttcttttacagatgaagaaactgagtgaggcttagagaaaataaacagtctttaaagtgattaaagtgattcccctagtaagtagtagagacaggattttaactcctatcctcaaccattatgccatactgtaccaataaaggactaaaaaccgacaaacagaaaagttgatccatgggttcctacagccacaagcaaaaatcatacctttattcctgctgcttgcaggacctattagctggaagatgttgggctgtatcatcaatatccataatttatgtatacttattcctgggattaaaaatggtgggaattcctaagaagcagggaagcaatactttttttcaagagagttggtttacccaaaaatgacagactatcttgccagaagtagcactaagatagggtggaatagaagctggtataccccaacgaaaagtgaatataaataaatatgtattacagtggaaacagaaacatggcaaaagaaaatgtgaagcacgggattgcactgttataatgccacttctcccccacctcccctaaaaaaaaaaaaaaaagccagtgaactgctaagatctagctgtacctgtctatttataatggagagattggtgcattgaaaaaacaagatttttgattggagaaggttagaaagatgatttaggaatatgagctgctacccaagcaagacaggccaggttggatttccacagtgggaggcatgaagaccctgggtagtagcgaaagctgtggtattatttgtgagaaggccaatgaaaagatagaaaaatactctgagacatattttatctacttctgaaatttaattatgactgactttaatttcaggcattatttatttctacttttgaaaatgtttaaattattgaaaataaattaaaagaacttttttattattggtagaactttattaaaataatatagacatgctttcattggtctagcagtcctatgctaaattaaaataaggatcaagaagctttaactttacttaaacagtggcatgctgctctcagtgactttgttaatactgtgaaaagactttaaaatctcaaatacacacagactcacagatatgtgggaaactatgagtgtgtgtgtgtgtgtgtgtgtgtgtgtttgtatatatatatatatatatttttttttttttgagacagagtttcactcttgtcacccagctggagtgcaatggcgtgatctcggctcactgcaacccctgcctcccaggttcaagtggttctcctccctcagcctccctagtagctgggattacaggcacctgtcacctgtcaccacgcccagctaatttttctctttttagtagagatggcttttcaccatgttggccaggctggtctcgaactgctgacctcaggagatccatccccctcagcctcccaaagtgctgggattacaggcgtgagccaccgcgctcggccactatgagtatatattaaatgtaaattgatattaaatcccaggaggatagggtcagaaacctatgctgtagggtggcatcaaatactacaattttacaggtaaaaaatcacacatacacacacacacacatgatgaaagatctttcaagttcattatttgaagcagtcatgtggatattacttgctgccaaatcaatctataattccagtttctctagaaaagtgggttttctattatataaaagactacaacaatggaaatagtctgattcattcacagtctcacacacacacacaatcatttatgggctgaggatgtacatgtaccatggccttcacatgcccttcaggagaaaatgaattttgggggagaaacagatgttttctattaagtcaagttctgtatggtcggagtttaaggcaaagagttaagctgaatatggaaattaaagccaatttatcaaagcatattttaaaagactttcttgttaatactagagtttgggctgggaaatttctgcttcttaacataccgatgttagtagggatttaaagtttgctgccaggcttctcttggaatattcttccattggcacagccctagagatgctaactctgaaaaacgggatttggctggtagcacctgacacagccaatcttgaatttccactaaagtatctatgaagacatagaaaaatgatgagagctcacaacaatgctgataatttggattgacagtcaaattattgccagaaccagagagaaatttccactagctaaaaatcaggaagaagtagattgaaaagtacaatcagcgaaccactcataccatgctgctagaaatttggtaagccaatatatcttaatgtaaatgacgagttgatgggtacagcaaaccaacatggcacatgtatacctatgtaacaaacctgcatgttgtgcgcatgtaccctagaacttaaaatataataagaaaaagaagaaaaaaaggaataggtccaaaaaaatctcatctttccccccatgcagtctaaatcctggttccaaaacacacattctatacccagcaaaacaaggagtacttgtcttattgcatggaaagtacttttttagatagctagaaggctggacaccaaaccctaaaatattgcttttttctctatatatgcttgagcactactacttccagcaaataattagaggagaagacatgaatgtggatttgggatttctaatatgaagtagtggtaaattatcttcaaggtccattccccagaaacataatgctataagtgggagcaaagaaccttggtaggaaggtattctgggtattctagtttttcatgtattccatcagttctgattatcaataaatcagtcagttgggtcaggagaggatccaatcttagtccaaagaaggtgtattaatgaaatcaagttagacaccaagaacagacagttgaaaatatgagatatatacatcaacctattgtcccgttgcatactcgagaaggggatttatctaaaacccagtttgagcttaacctaggacaattgttgtctcctaagtattggcaagcatgggatcaagatagattggaactcctttgaaaataagcaatgaaagaaaaaacaatgtggaacatatggaaaatttgcaaatgggctaaaggcaaattattttggagatttcaagaaagaacacatttataaaaatgggtttttaaaggaatcagaaaaaatattagaaattgatgattttagctaaaatgcaagataacatagctcttatgaaaaagcagactgtaaaatgtaggtgttcacaatcttttgttaggtcatgtgacacttataaaattttcttttttgaggaaattctggactctttcctcatataaaacaaatttgtaaatacactcacaactttttttttttttgcattccgtttctggggttttacatatcctctgaagcctatgaacttcagtttaaaacatctgccatcaaggaacaaatcaagacacaatgaagataatcaaggaactaataaaaattaggcaacaaaatgagactattaaaaatgtgagataatcaagataaggaaaaattacaagaaattaaaactcaaccacagatgattattatcagtggaggctgcagagaacagaattgacaatgctgaaaatcagatcagtgagaatgtcaaatatacttgaaaaatcatctcagaaagcagtgaaaaagacgaagatatgactcatgagggagaagatgataaatctgaagaatggatatccagtttaataattttaagtattcctaagaaagaaataaaaacaactaaagccataatgaagcatatatttaaaaaaacaaagtttcctgagttgtcaaacagcttgaataggctcatcgtagtctaggtaaaattagtgaaaagggagaagaaagccacatgctctaaagtttcttttaaagtcatagatgctactgcaaatggcatcttcatgcataatcacatatttgtttggcatacaaatatagatagccaacagggattgtaaataatacgaaataacagcagaaaaatatatagtgcctaaaaccttgtgctgcggagtcaggccagttttaccacttagtagttgtgtggatttcaatgagatcagtaactcttctgaatctgtttccacagctacctcatagggccctttgaaaattaaatgaggtagtttatataaaatgcttaataaaaggtctagcacttaggggacactgtgcctaataatattgttgctattatattcaacaatccacaattgtgatatacctagattgttcataattttttgttatgtttgatgctccaacaaatataccagtctcagcagtctctcagtaacattattttacattcaattctgtattaatttcattagtaaaaattccagttgttttaaattccattactttgcacatcaatttgaacatttatttcaaatatttattggggccaattgtagttctttctctatgaattgcccatgtgtgacttttgacattttttttggttttataatctcagtcatttcattaagacttggaaaatcctatataatctaaaggtatttgcatattaaaaacaaaaggaaaactttgttataaagtgtgccaaagtttacaatatttttggccagtgaaaccagagagcataatttttatggcagcaagaaaattgaaagaaagcttcatagaacaatatatgtattcctcttgggagaatttgtgacttctagccgaggctttccttcaaacatgtgaaaattaacatatcatctgctttatccataaatatactcttcggtgatcattttcacttgtaaagtgtgccatacttgcagagccaaaatgtttttttcatttattctgttctactttcttagtaggcacagagtggactggatactttccaagactgaaattcagtatgatcttacaggatctcagttcttggaaactttgttaatgtgcatgtaactattgtgacagggcaagaatgcagtctactaagagcagaaaattctaaatttaggtgtccttggctctgttttctcaagttttgtcaacatcttccatgcatatattcagaactaaaacctctgtcattgctcttactggggcaacgtgtatctgttcttctacagatgagctgccttaacctctgtggtttctaccgagctcaaacttgtccattgaaagcatattctacaccgggcatagctaatgttgtgttgtacattcattgatactatgcttttccctcccctttcaaaagcaccattacctgtcttctcccatttcattccctgtcaaatttatttcccttctcctgttccaaaagacaaagccatataccaggcagtagcgtccatccaagagtatttttcaaactgtggattatgacccattcctggattatgaactcaatttagtgttttgcaaccagcactttaaaaatgacacagaatatatcagggtgtatcacatataggaaggcaagtacgttttcatgaaacaaacataggagtgtactgggtccaacctaaagtgtattttgttctatgggttaaggtcaaaaatgcttgagaaacagtgctataaagcacacttcaggatgcaagacatagatttagagctaatttaagggacctgtcagctgggcagctgccctgggtaccaatctatagaagcaaaaatatttcacaggtactaaaatatcactggagatataagcagatggagaaaattgcatttaccagactctttttttttttttttttttgagatggagtctcgctcagttgcccaggctagagtgcaatggcgcgatctcggctcactgcaagctctgcctctcaggttcacgctattctcctacctcagcctacaggcacccgccaccacggtggctaattttttttgtatttttagtagagatggggtttcaccgtgttagccagaatggtctcgatctcctgacctcgtgatccacccgcctcggcctcccaaagtgctgggattacaggcatgagccaccgcacccaaccttaccagactcttaagtaggaaagtagtacatgtgataaggtagatgaattggtagatagagttgtattgcttagagcagagagactgggctctgcctccagtgatctttcttttctccatgtgctttctccatctccacacagggctcagcctgcttcttcaatagatgttgaacaaatacttttaaacatttggtttgaagagctaccaaattattagcctgctgagtttgctcatatgtcttgactcaagtctgtatagacctttaattgagaggggaaaatgctattgtaagaaatgtatttattaggatagtaatagctgctgtaacaagtaaatcctcaaatttcagtgactttgcacaatacaagattacttcttattcaagtaatggtccattatccattacaggtgtcagcaagtaagtgagtagctttcctccaaaagatgattcaggaagctagatatcttccacgctgtgaccttcccacagagctttcagagtcttctgtatctagcccaaggatggaaaaggagagagtggagaagacatacccagttactacaaactcccatttgaaagtgatacccatcacttctgttcacattccattggcaagaattgtttacttggccacacctggatccaaggattggctgggaattgcagtatctgactaggcaactgccttccagcaacatcactacattaaggcatggggagtgggtggcaggcatgaatttttgatgaacatctggctgttgcagtcacaataagttataataccaatcaaggtgtctctagaaattgtcaacacagaatttggaaacatattgctcctcccattaccatctttaagctcttttgcagtgtgacagggttatgttgatcattaatgcatttatacatttttgtataaaagtaagccatttcattttctatcttactaaagtagtgatttggacatctttacatttagctgcatattgcttttagtttaaaatgaatgtagttggcaagcatgaagtgtataagatagtaaatcctaaattacaggcagccacctcatttattcagctgctgatttccatttggttgtccagacagagcactttgcattatttgatttgtgatatctggatgcaaatggctttaagttttgattaaacacaaagcttgaaaaggtttaaacagtaagccagtaatattgaaaacattacaatctggtttagataaacaatcatctgaatgaattggatataaacatatttattttgggcaggaagcacttgttcagaaatttctcttatgatgtgacttatttaagcttctggacatcaaaatagttcataattatggatgaaaattgttggcaaagacgttactgctttattagaattcttgtccaatatcaatatggtgctattatttgattattgctttatcttttattctctgataatcaggacaaaatattgaaatttggaatattctaatagcaattagagttttcttcaagatacctgtcaacagtgtgtgacaatggaaccctgtgttgcctgtgtctgaaatgcaatgtacaaatatcttcaatattatgaatgcagatttgttaaattacgggtgataaaaatgactttgcttcagtgaaatgattctaattctaaatttatataatgaattattcactcttctttcccttttgttttctgctctagtttagtgagcaggttcattaagtgctaatattaaattcactagagtatacaaaaaaaaaaaacccagtaatagcatccacatggttgattaaatggcaaggtaggaggctggccgtggcgtttaattggaggcatgggagctgttggtttctttgtgtaatctgaccctctgaatgttgattcttctaacaagtgaccaaggaaaaaaggaaagtggtgtcatgggaaaatagcatttgcacatttcacaaataattgataaataaccattatgaatgtagtcattactttacatcagtgtttgcaatgtgtaattcattgaaatatttgtcttgtacaacactccacaagaaagggttctagaagcaaataagttagggaaatgctggattgtctctcagagataatcaacaatgcatgctagcttttttttttttttttttttttttgagatggagtcttactctgttgcccaggctggagcgcagtggtgcgatcttggctcattgcaaactctgcctcctggattcaagcaatcctcctgcctcagcctcccaaatagctgggactccaggcatgcaccaccatgcccagctaatttttgtatggttagtagagacggggtttcgccatgttggccagggtggtctcgaactcctgacctcagatgatccacccacctcagcctcccaaagtgctgggattacaggcatgagccaccacgctgggccacatgttagcattttatgggatttcataaatcctttagttgggaagcctatttgacttttttaaacctagagatctcgatttattttaagcagccttttttttggttgtttagtaaatattaaacctaatccctgaatctgcccaactttttattttcttataagaaagaggtgaaaaataatgcttataatttttaaagggcagaaatatttttgttttgaaaaccaaagttgaggtatataccaaaaataattcaaaacaggttttgaaacaaaaaattccatgggaatgttcatggtggcactattcacagtaatcaaaaggtggaaacaatccaagtgtctatcaacagatgaatggataaagaaaatatggtaggtctgtataatggaatattattggtccattcaaagcaataaagttgtgatacatgctacaacatgaatgaaccttaaaaacatgttaagtaaaagaagccagtaacctacaccgtatattatctgatttcattggtatgaaaagtctggaatagacaaacctatagagaaaggaagtaaattcatagtcttttaggtctggggaggtgggagggtagggctatgacagctaaagggtaaaggatatatcttttttgtgatgaaaattttggaaaattggctgtagtgatagttgcatgtatctgtgaatatactaaaaacattgaattgcatgtttaaaatgtattagttgtatagtatgtatagtatgtgaattatatctcaataaagctgataaaaatgataatcaccatttggttaatacacaaatatccgtaagttcctcttcttaaatatgaagcatatttttaaaaggcagggattatcctgttaaagcttctcagtattttatgatttttcagtttaaatcatcaatagcaatattgtacacctcaaaattggtacatcatataataatatgggctatatgtggatggatatttgttcatatgtagatatacatattttcaagtgacctgttttggagaaatatgtaaaggtatttaaaattatattaccagcatactttcaaaaagttctaggggaaatataaagcaatattagtattatccctgacttgtggcaattaaagtaaatgccccactagaagatacttgggagaagttaggtctcaagattttgttgtgaatgttaaggaaatgcagactaatttcttatttgggggtttattgtggctctcgtctcactggacctttaatcttggtttccttctctagttcgtatacttttcttggatctctgaacattggagtgcttcagggctagttgttggacccattctcacttctttttttttttacattgattttttattttattttattttattatactttaagttctagggtatatgtgcacaacgtgcaggtttcttatgtatgtatacatgtgccatgttggtgtgctgcacccattaactcatcatttacattaggtatatctcctaatgctatccctccccctccccccaccccacaacatgccctggtgtgtgacgttccccaccctgtgtccaagtgttctcattgttcaattcccacctatgagtgagaacatgtggtgtttggttttctgtccttgcaatagtttgctccatgtccctacaaaggacatgaacttatccttttttatggctgcatagtaatccatggtgtatatgtgccacattttcttaatccagtctatcattgatggacatttgggttggttccaagtctttgctattgtgaatagtgccgcaataaacatatgtgtgcacgtgtctttatagcagcatgatttataatcctttgggtatatacccagtaatggaatggctgggtcaaatggtatttctagttctagatccttggggaatcgccacactgtcttccacaatggttgaactagtttacagtgccaccaacagtataaaagtgttcctatttctccacatcctctccagcacctgttttttcctgactttttaatgatcgccattctaactgatgtgagaaggtatctcattgtggttttgatttgtatttctctgatggtcagtgatgaggagcattttttcatgtgtctgttggctgcataaatgtcttttgagaagtgtctgttcatgcccttcgcccactttttgatgggttttttgattttttcttgtaaatttgtttaagttctttgtagattctggatattagccctttgtcagacgggtagattgtaaaaattttctcccattctgtagatcgcctgttcactctgatggtggtttcttttcctgtgcagaagctctttagtttaattagatcccatttgtcaattttgacttttgttgccattgcttttggtgttttagtcaagaagtccttgcccatgcccatgtcctgaatggtattgcctaggttttcttctagggtttttatggttttaggtctaacatttaagtctttaatccatcttgaattaattgttgtataaggcataaggaagggatccagattcagctttctacatatggctagccagttttcccagcaccatttattaaatagggaatcctttccccatttcttgtttttgtcaggtttgtcaaagatcagatggttgtagatgtgtggtattatttctgaggtctctgttctgttccattggtctgtatctttgttttggtaccagtaccatgctgttttggttactgtagccttgtagtatagtttgaagtcaggtagcatgatgcctccagctttgttcttttggcttaggatcatcttggaaatgcgggttcttttttggttccatatgaactttaaagtagttttttccaattctgtgaagaaagtcattggtagcttgatggggatggcattgaatctgtaaattagcttaggcattattgccattttcacaatattgattcttcctatccatgagcatggaatgttcttccatttgtttgtgtcctcttttatttccttgatcagtggtttgtagttcttcttgaagaggtccttcacatcctttgtaagttggattcctaggtattttattctctttgaagcaattgtgaatgggagttcactcatgatttggctctctgtctgttattggtgtataggaatgcttgtgatttttgcacattgattttttatcctgagactgctgaagttgcttatcagcttcaggagattttgggcttaaatgatggggttttctaaatatacaatcatgtcgtctgcaaaaagggacaatttgacttcctcttttcctaattgaataccctttatttccttctcctgcctgattgccctggccagaacttccaacactatgttgaataggagtggtgagaaagggcatccctgtcttgtggcagttttcaaagggaatgcttccagtttgtgcctattcagtatgatattggctgtgggtttgtcataaatagctcttattattttgagatacgtcccatcaatacctagtttattgagagtttttagcatgaagggtgttgaattttatcgaaggccttttctgcatctattgagataatcatgtggtttttgtctttggttctgtttatatggtggattacatttattgatttgcgtatattgaaccagccttgcatcccagggatgaagccaacttgttcgtggtggataagctttttgatgtgctgctggattcggtttgccagtattttattgaggatttttcatcgatgttcatcagggatattggtctcaaattctctttttttaattgtgtctctgccaggctttggtaacaggatgatgctggcctcataccattctcatttctatctgcagattccctttgtgatcttacccagtttcatggttttaagcatgtttatgttgatgactccataatttgtgtctctagaccagacttctctccagagctccagacttgtataaccaacttgactacaccttgtttccatttggatgtctaatagatatctcaacagttaatgtttcccaaactaaacttatcttgcttccaaattctgatttatcccatcttttcttctcagttaatgactaatctgtcttttctgtttctccagttgaaatctttgagtcaccttgattaatcttctttcatatttcaggcatgctaaccccgttagggcttttatattgtttcccctacctggaatgttcatcccctgatatgcatatgattgcccccacctcctccttctagtctttgttcataagtcttcttccttcttagtgacagccacatcaaccacaccacttaaaattgcaactactcagaaccacagatctcctgcctactcttttgtttctgtaaaaccactagctaacatactataaaatttacttacctatcatgttcattttaaactgtctttccccattataatgcaagtttcatgagggcagagatttctgactagtttgttctctttatgtattcactgtgccggaaattaagaccagcacatagcacaggattagcactcaataaatatttgttcaataaacaaataatactatgtcaggaaatagtttctattatttttggtgaccctaaaagtggctcctcatgtgtggaagtagctgatgtggatttaccaaaacaaacaaacgaaacacatccttttataggatgtgtggtgtgtgttttctgactagactaatgtacaatttatgacaatcaccaagtagctgttctttaacaatatgcccgctatccacaaacatttccaactctaaataccaaggagtactctttatcactttctaaaaacattttgaatatttatacctcctctagtagaaaagcaaggactttcatttccggatttttctcttctttcttttctaaacatctcctctagagtaaaatcaaggacattttatatgaaagtttggattatgataacatttaattatcactcatatttcacagagtgtatttttaaaaatttcttatgactttgttctcttctcaggattaacttgtctctgaaaatagatcttttacagcctagcaaagaaagcaaaataatatatgtgcacaattagcacaaattgatcttgctatgtgaactttaatttcagaatttgagatttaaatgactcttctatttaaattgtcaacctcagagtctcattagtctaaattttacatttaatttatgaggacaatgctgcctccttagaactggcacttatactctaagttatatgatgtctagtgggaaacgctggtttaggatttcttttcctaggccttattttcagctatttcattaacttattatatgatcttagactaattatttaatttctgtgcctcgggattttttaatctaataattcagagaaatattcctcttctgtatatatcttagaggagacattaatgtgtgctggacgaagcacaggtttctgggtcataaagacctgggttgaaattctgctcagctactaactaactttgtggctttagggaagtcagtgtcactgatccttatttctgttaactgtaaaatggtgataagacctactttaaaagttgtaaggaatagataaataatttgaaaagtaattagcatatggccagaaccaatcttggtcctctgcctgctctttctcttccacctgcctctatcctggctgtaaaatgtgtttggagcattacattttacatatgcataaagtgcctgtcatttagtgggtgcttaataaatgctagttcaattggctgtgacataaggtaattgaggttactaaataaggaagggtgaatagtataatggtgggaaagaaaatgaggaaaatgacaaaataaagtttaaagaaaaacataagaacttagtaaatataataaatattactatttaacataataatgtactgttggtttgagagtgttcacgttcacaaatgcctaaaatatttagtaaagtctctacaccatggataagactattatcctactgagccctacatttttgcaaaggtttcataagatagaataatatatactcataactaagaaaatgtttaaatgatcaaatccagtactttgcccaacaggtttagcaatcaccgcattatctgctgctaattagaatcaagtgtatgatatacagggctcattaatttctttggaaataagaatcatagggcaatgcgtgtctttacaaatgggtaccagttaattttaataacttaatgtatgccttcttttacatgcacccaaagtgaaatgtatagtgtatacgaataatataaatgtttgttaatgctcagcaagacaaaattttagaatacgccaatgagcagtttcattaattactgtcctattgcaataagtacatattattaacacatctttctttgatgtgattcagtattagtcatgggtgagtgttaatgtgctccaaactatatagaccttttttgaacttcatacaacccactttctttttttttgttgttgccttaggttggaatcagatggatacatgatttttttttctttttcaggattataaaagtagtcccatttttaaagaaaaaatcataaatatggtttcataagatggatggtgatttaatatttttttacaaagtccaaattatcatttattatttttttatattccatgcttgtgcatcttcacaacgattttttttaatgtaaaaacttttttcccagcactttgggaggccgaggcgggtggatcatgaggtcaggagatcgagaccatcctggctaacaaggtgaaaccccgtctctactaaaaatacaaaaaaattagccaggcgcggtggcgggcgcctgtagtcccagctactcgggaggctgaggcaggagaatggcgtgaacccgggaagcggagcttgcagtgagccgagattgcgccactgcagtccgcagtctggcctgggcgacagagcaagactccgtctcaaaaaaaaaaaaaaaaaaaaaaaaaaaaaactttttaaaaaaattattattatactttaagttttagggtacatgtgcacaatgtgcaggttagttacatatgtatacatatgccatgctggtgtgctgcacccactaactcatcatctagcattaagtatatctcccaatgctatccctcccccctccccccaccccacaacagtccccagagtgtgatggtccccttcctgtgtccatgtgttctcattgttcaattcccacctatgagtgagaatatgcggtgtttggtttttagttcttgcaatagtttactgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacttcttgtttcctgactttttaatgatcaccattctaactggtgtgagatggtatctcattgtggttttgatttgtatttctctgatggccagtgatgatgagcatgttttcatgtgttttttggctgcataaaggtcttcttttgagaagtgtctgttcctgtccttcgcccactttttgatggggttgtttgtttttttcttgtaaatttgttggagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacatttaagtctttaatccatcttgaattgatttttgtataaggtgtaaggaagggatccagtttcagctttctacatatggctagcctgttttcccagcaccatttattaaatagggaatcctttccccatttcttgtttttgtcaggtttgtcaaagatcagacagttgtagatatgcggtgttatttctcagggttctgttctgttccattggtctatatctctgttttgataccagtaccatgctgttttggttactgtagccttgtagtatagtttgaagtcaggtagtgtgatgcctccggctttcttcttttggcttaggatttacttggtgatgtgggctcttttttggttccatatgaactttaaagtagttttttccaattctgtgaagaaagtcattggtagcttgatggggatggcattgaatctataaattaccttgggcagtatggcaattttcacaatattgattcttcctacccatgagcatggaatattcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgcacattgattttatatactgagactttgctgaatttgcttatcagcttgaggagattttgggctgagacaatggggttttctagatatacaatcatgacatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttcttgagagtttttagcatgaagcattgttgaattttgtcaaaggccttttctgcatctattgagataatcatgtggtttttgtctttggttctgtttatatgctggattacgtttattgatttgtgtatgttgaaccagccttgcatcccagggatgaagcccacttgagcatggtggataagctttttgatgtgctgctggattcggtttgccagtattttattgaggatttttgcatcaatgttcatcaaggatattggtctcaaattctcttttttggttgtgtctctgcctggctttggtatcaggatgatgctggcctcataaaatgagttagggaggattccctctttttctattgattggaatagtttcagaaggaatggtaccagttcctccttgtacctctggtagaattcagctgtgaatccatctcgtcctggactctttttggttggtaagctattgattattgccacaatttcagctcctgttattggtctattcagagattcatcttcttcctggtttagtcttgggagagtgtatgtgtcgaggaatttatccatttcttctagattttctagtttatttgcgtagaggtgtttgtagtattctctgatggtagtttgtatttctgtgggatcggtggtgatatcccctttatcattttttattgcatgtctttgattcttctctctctttttctttattagtcttgctagcagtctatctattttgttgatcctttcaaaaaaccagctcctggattcactcattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcatcccagagattctggtatgttgtgtctttgttctcgttggtttcaaagaacatctttatttctgccttcatttcgttatgtagccagtagtcattcaggagcaggttgttcagtttccatgtagttgagcagttttgagtgactttcttaatcctgagttctagtttgattgcactgtggtctgagagacagtttgttataatttctgttcttttacatttgctgaggagagctttacttccaagtatgtggtcagttttggaataggtgtggtgtggtgctgaaaaaaatgtatattctgtttttttggggtggagagttctgtagatgtctattaggtctgcttggtgcagagctgagttcaattcctgggtatccttgttgactttctgtctcgttgatctgtctaatgttgacagtggggtgttaacgtctccctttattaatgtgtgggagtctaagtctctttgtaggtcactcaaggacttgctttatgaatctgggtgctcctgtattgggtgcgtatatatttaggatagttagctcttcttgttgaattgatccctttaccattatgtaatggccttctttgtctcttttgatctttgttggtttaaagtctgttttatcagagactaggattgcaacccctgcctttttttgttttccatttccttggtagatcttcctccatcctcagggacccacttgaggaggcagtctgcccgttctcagatctccagctgcgtgctgggagaaccactgctctcttcaaagctgtcagacagggacgtttaagtctacagaggttactgctgtctttttgtttgtctgtgccctgcccctagaggtggagcctacagaggcaggcaggcaggcctccttgagctgtggtgggctccacccatttcgagcttcggggctgctttgtttacctaagcaagcctgggcagtgacgggcgcccctcccccagcctggctgccgccttgcagtttgatctcagactgctgtgctagcaatgagcgatactccgtgggcgtaggaccctccgagctaggtgcaggatgtaatctcctggtgagctgttttttgtttgtttgtttgtttgtttttgtttttgtttttttttttgagacggagtctcgctgtcgcccaggctggagtgcagtggcacaatctcggctcactgcaggctccgccccctggggttcacgtcattctcctgcctcagcctcccgagtagctgggactacaggcgcccgccacctcgcccggctaattctggtgcgctgttttttaagcccgtttgaaaagcgcagtatttgggtgggagtgacctgattttccaggtgccgtctgtcacccctttctttgactaggaaagggaactccctgaccccttgcgcttcccgagtgaggcaatgcctcgccctgcttcggctcgctcagggtgcgtgcacccactgacctgcgcccactgtctggcactccctagtgagatgaacccgggacctcagatggaaatgcagaaatcacccgtcttctgcgtcactcacgctgggagctgtagaccggagctgttcctatttggccatcttggctcctcaaccaatatttttaactaaatttaaaattacaataaacagttatataacatttgctacagttccagatctgagattcaggagatctctatttgtgaaaataaattgatatgacatgtgataaagccccattaccaaaagggaaatgaataggcaagaaaatagctaaacctaatagtcaggaaatgtaagacctaaaattttgagattctattttttcttttgtaaattgaatgcacaactcacttaaagtaaatgtaaaatcattcatattcaactttctgagctgacgttaccaaaaaagtgaaagttaaaaatacttggcttctattgtaaaattgcaaataaaacccatttcatgaaagtggctttaatattttgatgtttggcttaacagttcaattcaacaaacatttactctgggcaatctaccatggtgtttaagagcattggctttgcaatggaatagacatgggtttggtttcccataccacaatttactgtctttgagtgaattactcaacaactaattgtcttaatttcttcaactgcgtagttgggctttcagagcctactttgcaaggatgtagtaaggattcaataggaaagtgcatgtgcctggctatggtaagcactcagtaaatggtaactgctaatgtcaactatgtgccagactctatatgctggttatacaaagatttaaaaaagacgttatctggcattgatctttgagtgagctacaaaaaggctatgtattgagacaggactgtaatgcagctgccttgacaacatgttccaatcagccacattactgagttgtctgtattgcacatataaaaatatataatatcaaattaatgctaaatgaactctgtatgtgtaaatgttgaagaatgtatgagttttccagccctgatgcaaaattattggtggggcatatattggctgtggtttttcagcacaaaatacccttataaaatgtattttgaggaaattcattataccattaacatttttagagtgagatcaacattttttaaaaagtaaactttgctttactctgaagtgactcactttaaaataaagttggcattttggaaaataggcacaatttttgttgctcatgagctttgcatgaaaaacttgcacgaggccaaaatagcatgcctcaagcatctataggtttattgggcagtctctgtgtatttcttgatagataaaagagagagccctccagaatgcagtcaaatgtgtaatgaatcacaagaacacaacatgatttattttaatgcaaagagtgaatttactttaacaaaagaaacattaacacacaaaataatgttgttatcttattaagagttatgtattatttcccagaagagaagaacttttggggtacaccctaggccctaatcagttaaaggatattacctatatactagattatatggtagatgggcaaaagataggtgtttttcatatcatctgatcccctcatgcattcatcagctgataaagctacaaaaataccattaaaaagaaagatgctaagtccttcttatgcacaacttacaaaatttagttttccaattaatttagcattttattcagaaagagctgtcaactagcaatatatgcttaccaaattctgttcagaactcataatggtgtctcccaaggcttagcagtgttcttctgaatcagaaattcatttatgtctagtgtcatgtttaagtgtggactatgttttgatctgttctttgccaatttgtcattcttggatagtgtattaggtgtgattatcaataatgcatttgttcttcttgggtagcttgtaaagggattctgaaggaaattgcaaaaggaaagttttttttttcttttagtcttcaacaactccaacattgcaggaacatgtgcttacctcccatggctaccacgttgaaaggttactttcatcatttactttgttcatggcagagaggttacagaattgaggaagtcttagccctctcctcaaggatgttgtagtctatttgagaagattaacaagtcaagaagtacatatttacagtgtgctgagtactcttatagaagaaaacacagttgctgtggaaactcagaggaaaataacataactaagttagagaatcctttataaatttggattctctataaacatatatttggatagataagttctgagacatacatgccacatatcctacagtatctatgtttacaagtcatattttggcatcctcttgagtggattaacccttaactaaacattccagatgttaaaacaatatgaaattgttttgtttattccaagaaattcatgcacccaggctcagaaagaaggttgagcaactttatttggcttctctcttataattccctgaagccaagctaactggcttagtatacaatgaacaatgaatcaagaaaataggggtaagtttctagatggaacaaaggtattcattattatgagtataaatattttttctcttatcaactattatcaacataatacatgttctaatatgttcctgatttttctggtgatgtgaatcataaatttagtcaccctaatcaacaagcctggcaacttggacactggcacatctaatatatatttttgtagcaaaactcaaaatcccactttctttttccttagccatttctcttttttgcactttctttgggatgactattcttcttggacagtgaattgaacagtagtgaggaggatagaagttagactgtgttccagactcacaaaattaggctatagaaatcaaaagtgtccagggacagttatgctgaagacagattgaagggatattctttctttctgccctgggccaataggtccaatggaattaattcagctggccagctattttaaaaaatgtcatgtaagtaaaatggttgcaaagaaaaactgcgttaccttgaaagcactccatagataaagcatatgttttacagagcagacattgactctagagaagaggaaaaccacagtgatttttaatcattaattgtaatgactcttcaaataatacataagcaacatggggaagtaatttttcccttcttgccatcattacctaaaaaaccatagctgttttgaattatatgatcaattcaattcattacaagtttcttgaaggtctgttgggtgctatgtgctagaaatatagtgacacacaagacagacatagtttctctcctcatggagcttcaagtctgatgggcaagacagatattacactaatagttagagatttccctcttttcttttattttctttttcctttctttcttttctttttttcttttttctttttggagacagggtctagctctgtagcccaggctggagtgcagtggtgcagtcatagcttactgcagtcttgaggggctcaaatgatcctcctgcttcagcctcgcaagtagctaggactacaggcactgaccgccacacctgagtaatttcaggtttggtgactgctagagtatgaaagtgtaagacgggtggcctaatttaaccttggagcaagtagatgtggccatattgcaaggcaggcaaccccctaaattggggcctagccccagaagttttttggcttcacttaggaaagaattcaaaaatgagcctgtggtggaagaaaacagttttattgaggcagcagtgttacagctcagtgactgctcctgcagagcggggctaccccataggcagtatgttgagaatagtagctcaggggcagttctgcagtcatatttacagccagttttaattatatgcaaattagagggcagggtttactcagaaattcctagaaaaagggtggtaacttctgggtgttgccatggtaatggtaaactgtcatggtattggtaggcatgtcttgtagagaggtgctttctgtgcctctttcctgttgtagccaatcttcaatctggtctggagtggagtcctgcctcttagccagagattcacttaagttgtggcttagagatgggaaaggcagaggagagaatagccagcctctattcttagtaattgttagtatagctgaaatattcctcaaggtcactgggacactttcttcaggggatataagggaagaacagtccctagctgtttaacatgctttctatgtagatagtcctttctaagctgcagagtctgctgttctttacacccctctgtccggacaacagaaatttatttcagctcaccattatatatgttatactcccagatatatatatatatattatactcccatatatatgtattatactcccatatatatattatactcatatatatatattatactcatatatatatttatataaaatactccccattctcagtatccttttctagaatcgtttaactttctaaaaggattagcccttacttattacttgtgaactcttttattatgttctccaagaattctatagcattctcagacccagtacaatgtcttcatccttcttccatttggttttaaaagcttctgtcccagcaggaaacacaaagagttaaacttggattcaaccgcttctatagctcatccactgagagtcttccatgccaaacagcgcatcatcaataggagttagatttccctattagttaaaaatgaccagagaacatgaaaataatttggggaaaaaaataggggttggaactgtgaaatcaacagtatttgttttgaaatgtacccaaaatgatccaatgttgctttctggggtgaagggaagtgtataacaaagagtgggagatcagtacttttttatttgctccacaagtattctgtagaaaacatggtaaactgtctctcaggatacatttgagtgcttgccacaattcaaaagagcctgatctcttctgttgtggcccagctaaagggtgtagaggagagtcctccttttccttcactcacagctttcactgacttggcagataaagggcatccctggaatatgctgaattgaggagggagatctggcttctaacagtcccagcagcactactgactgacactaatcctggttaactcacttcccttctctgggcctcaatttcaccatctgtaaaaacaagaggggccaggtgtggtggctcaggcctgtaatcccagcactttgggaggccaaggcaggtggatcacttgaggtcaggagtttgagaccagcctggccaacatggcaaaaccctgtctctactaagtgtgtgtgtgtgtgtgtgtgtgtgtgtgtgtgttatgccgggcgtggtggcgcatatctcagctactggagaggctgagtcaagagaattgcttgaacctgcgaggtggagattgcagtgaaccgagatgctccactgcactccagcctgggcgacagagtgagactccatctcgaaaagaaaaacaaaacaaaacaaaacaaacccaagagggttcaactgtaattctgtggctttcttcatagcagtaggcattctatggaggcaccattaggagaaattctggtggccaagggtttgccactgacgtacatactctgtccttttttctcactaagagcagttctggttttctctgcttttgttttcaccttcacatacaatatcatttgaccaaagaggttcatatcttaaaaaaaattgtaaaccattgtattggatgatttttaagaactatgactcttttgctggctttaggtatcctactctaaggggctcctatgctgctggatagttgagaatatcagttaataggggtggaggtggcttagctagaaggtgctaaaaacatccctgaagccctaaagggttataatttccccttcttgcatgtatatttgctgctgctgagttaagatatgacaatagtaaaaactggacagtccttttgggtatacccagaggggtttccccatgaatgaagtgggcagagctaacagtctaagcctgaaatggtgtatgctaaagagtagaggcaccaagggtgtcaaacactggtgctgtccacttctgcagtgagcttggaaatcctcaggccaggtgttcttcagaatgcaaagtccctggaattaaaggaggaaacagccttggaaagctttgagtttgcaggggagttgccctcttgtctttggatgggatcagggcagggacacccatgctgaagaactatcaaggaaggatagcacctgagggccaaaggattaagaggccagctgggggttcagagggagggaggcagataatgcctttatgaacccattccacctgattatagtgtaattggattttgagggacttcaagatccatggaaacatcccacttgcttttatttgggattttgactatcagaaactggcaatttgggaacttgactttatattagttttatcattgcaacattttctttggtttcctcttcattttgctaaagtttattttgaaaatgtcatatcctttgttattttccaagggatatgaatttctttaggaatatccaaggcaggtctatcgtcattggtgtgtggcctgtgttattggttggtttaaatactcttctgggctgggcacagtggctcatgcctataattcgagcactttgggaggccaagggaggaggagaggatctcttgagctcaagagttagagacagcctgggcaacacagcgagacctcatctctactaaaaataaaaattaaaaattatctgggtgtgctggtgcatgcctgtagtctcatctactcaggaggctgagactggaagatcgcttgagtccagaaggttaaggctgcagtgagctatgattgcatcactgcatcccagcctgaggtgacagagtgggaccctgtctcaaagtaaataaatgaatgaatgaatgctcttctgtcactatcttgaaattcttaataagttttgaagaaaggatcttggcttttcatttttgtaccaggctccacaaattatatagccagtccttgcccttggtatccattttatcctaattttactaggttatatggttcatgagtggtactagggagaataatagacagaaagggagagatgtgttttgttctaggccccaggtatccagagtgtcattgaacctgactaccaggtcagactgcctggaaattgatagtcctggtgttcaggactgggggtggaatattaagctccagaggcctaggtatagtcatttctgggttgctgcttaggtaattcatgtatatcacgtgtgaattatttttaaggtgcctcatgtgatctcttttgtaaacctgaccacagaagcagggcagatagagtgctggctaaagaggatctattgctgcaactagataagaaaaaagaacccctctagtagcttcctaccactctggaatgctacacacagtacaggttggtaagtgaatgctgccatgtgccttggattccttcttaggagaggtactaatgcattatcaaaattatttaatttttattatttataggcttcttatcaagccttcaggatgaggactaatatgatttcagtgctgtgggtttcagagagaagaaatctatcttaggcttagcaacctgggggtaagtgccaagctgataagcatggcagattaaaagcccattttacctagacatactgacaccaatagtgttgttagtaattgactcatcatcactacgatacatatcctgaggtgttcaccatgagaaatattgtgtctcctttcttttcacagggtctccgtggaattagtaacaggggatgctggttttatgggggcagtctgtggatgtagggagttttaagagaaattagcttgctagtcaataaccagggctttgcttgtacctctcctgatcagatgaagaatcatcttttttttttcttgctctgttaaaaaaaattgcaaagaaagcatgaacaccttaacttctctcatgctagggaaaaagccttaagaagggtagtacatcagactagtgatgcccattcgtgttagcctttgttatttgcagcttacatggcctcatctggaaatgggctatcaggtgtcgtcttatttctaagctggctgttacatttaatacaagtggagtttgtgtgtaggtctactgcacgtattcttggtgctcagggacttatagtggtcccttacagtttccgaaatcaatcttgctctgagatgggggcaccaagtttgcagcatctccctcctacagtcatttagagttattgatttgcattgaaagaaatgaaagttggaacactttttttaaaaatagactttttttctaagggctgtcaggaagatatgcctcttttccaatattatgtgtgcttgtttgacttagtacgtaattattgaggttctctctggcatttgagggtaccaattggggatcacatcccatgaacacagttgaccacatgtgtgccttcagttggtgaccatccacagcaaagggccttacccctctaccttaagatttcattcactctagcttgacaaaacattgggcaatcccatattataccttcccttcgcttccattgctctccccagaatgcctttctctgctttctttctttgtccaaacccatctttcaagcctctctcacatgccactatctccatgaagtcctctctaaggatttcatctcaaactatcatcctatccttgaaatgttgtatgatcattaagctcttaccataatattttacatttagttatcctgtatcttaaagttctttttctcattattattttaagtctttgtagccatatagctcctactggaaatacacttatttattttttatcctgcagagtacctgcaccacttaataaatacacatttgattattaagtcagtgaaagggttcaatcactgatggcttcattattaatgtaaatgttatatgagaagagcagcatttatatcttcactcaaattagcttgtgaggttaactctagaacagaaagctggggaagtctattgaagaatacaaggaaaggaaaactacctaaggttttgtttagaataatcatccaaaaaatgatcatccttgttttaagatgagaaaacagacatagagaggttaactgatttgtccagattgcacacctagtaaataacagaatgaaaacttgaacccaaatcctttgactaaatgctatgctctttcctattgtgagtcatggcatcctggcaaccttgggtgtgtaggtatgggctctttactttttctgtgtcattcttaaaatgtagcacccaggagagtatggggaaggggagcagggagaaaaaagaaataggtatgcattcacatagaaattcaaatactggctaattgcaatatgtgaatcacaacagtaatgttaagatctcctcatttcccccctcattcttacaactcctcccctttccccattttatttcttctcttcacattccaccttccccctcctccctccaagtatctaattatagttttgcaagaaaaattacagactacatactgcaataattcacacctggaatttacattgattttatggcatcaagctctgagtgccactttgcgttgcattcccatagcaacaccaaatcgtagactaggagaaagaaaaatctgagaactcagcatctgcagctcctgaatctcttatatttatgacttggctcttccttgacaagttgcctatttttctaactttgtttttagaaagcatacacaaattaaaatgatcccacttcatattttgattgctttgaatttgaaaaatgcttgaaagggtgttgctctacagtaacagattaaaaaaaaagataattggatgacagacagaagagtaggtgtgaaaaagtttgtaaaagcatcctgagaactcttgtctctcacacctactatagtaaaaatcaaagcaatcccggggcctctggcacatccttctgcctacagtggccctccacttgctgacctgtagactcagaagaaagaagcagccagaggtcaaacattgctgccttgaagtaggatcacatttgtgcatttcagttgaccttctggatcctgagccctttccttattttttgtgtcttgtttgaccagagatctgaattagcttttcagatttgtctgagttgctggatcctttgtttccatccactctgtgaaatgatatctgtttttctgccagccatgtcctgatactaaacgctggtactgttagcatgacttgactctccttactatgggtaatatttttcaaggttccttccaggagtcttagttcaattgtcacctcattttagagttcttccctgaccgatttatataaagtagttccctctaccccattcctccaagaactctcaattcaactactttgtttcattttccatagaatatatgattatattatacattaactgagattccctaatgtgtttactgtttcagtgtctgatcttccccactggaatgtaagagcagcagcctagtctgtcttatattcgacactttattttcagttcttagcacaatgcctggcccagaataggcactcaaaaaagtatttgttagatgaatgaatgaatgaatgagtgaatgaattccgcaagtgcttattgaatacctattatgtgcttaccgcatgattacccattttggaaaatagacaccactggcctcctggagagtttaccagcagaaataccagatattaaaagtctaatgtgtaccatctgtttcgttgctttctgtcactgtggccttcacagcagtaggaactcaggaacagtttcaggccttcacaggctaaaatgtttccaaggtgctcttcagagctggagggcttagtttgcctcacttctatgtttctacacaccttgctttctcctaattcactattgggcaatcaagttataaaaacattgacatagttaagtctgtttcctagtgtaggctcaaaatgattttgaaggtaagtaaatatacttgggaaattgacagccaagatttctgccatgtgcaaccaaaggaaaggttattaatacagtgaagctaggtatatctcttcatggtgactaagctattttagtaattttctttaggtttattgacttctttattataagaaacaatgaaaatcttaaggagagtcactcactggcaagagaaaaaaaaatcatttgccctaagtgcggagaatagaaaactaaatcatccactattactaatgacaaccactacaaaggccatttagtgcgtagcctatgctacacactaaatgtgcgtagctaaaggtgcaatgcactaaaggtgcaatgctaaatatacttactctaaggaaaaggaggacactttaaggctgaaactgggagaattttattctttatgtatgtcattaggaatttcctttcctgggagaagacacatcaacacctcagtgtagggacattggaaggtgcctttaaaaaagacattagttgtgccttttaaattgcttctctccacaattccagggtgattcttcaatctctgcctttctcttcataattcactcaccttctctgggcctctgcttcccctatttggacaatgaggctgatgctatatgctctgtctaataggagcgttggatggctgttatctcatttttttctgtctggttaatagttacacaaatgctaggcattattttggttattgttagtggtcgtcaatatttacctgggtttcttcatccctgagaggggctaatagtaaccagttcgtcccattacatgcctccgcctgacagaattaaagaactcatagtccttgggatctcagcagtcagatatcaaatagtttccctaatcaagtagtattttattagtggtaaccatggtatttcagaagtgagatctggatttaattgagctatgatagagttttccaggttttagtagggatagattgagctttccttttaaacattataaaaatatattgtctccacattattttaattaggaaaaatttgaatagtcttaaggtagtacttaatacttacatttgatcttccaaccaaggaggtttcatcataaatgtagttattcatatgtaatcacatctcacatagtaatgatatttacataacaagaaataattttcttcaggaaagttgagtatgtcctgcacacatcagtatggcattatggaaaacattctgacatctaggcatttctcattgacattaatagggtcaatatcctcacctgtcaccacaaattagaagtcacccctggatcttgttgtgccctgagggtagtaaatagatttccatgccccagacccaaataaaatatcaccagtatcttttctcttccttggctcaggtagtatacgtcctgaaacagatgacaactttaagtttggaataccaattgggtcagaagataaacaaagtgcctcattttttgactcatccatgcttcctccacctccatacaagtatttttgacaccaagtttcttttaatccttctttaagagattcttcctataagattaaaaaaataagcagagtacctttccaaataacaaaacataaaggtaagtatcttgcaagtacataggattcattttctgaatatagtataacttaataataggatgtgcgtgtgtgtgtgtgtgtgagagagagagagagagagagagagggagatagattatgcaatcagatatgaccctttatggatctatgattggtttacaggtacttttcatgacctatgagatctgatggtgagcacatgttactcaaaattcattgatcaattcaggaagcatttgaaaattgcccaataactgcttttcagaactaatatccatttatattcatttatttcaaccaattcctaaacaaaagcttcagagaaaaaaatctcctttgtctttgcctgaaaaatatgtgtaattgttgacttgtcattttatattgtgttacctgcctttatcatggtactacattgtgccagggatttatttatttatttatttatttatttatttatttattttatttattttgagatggagtctcgctctattgctcaggctggagtgcagtggtgtgatctcggctcactgcaagctccacctcctgggttcacgccattctcctgcctcagcctcccgagtagctgggactacaggcgcccgccaccacacctggctaattttttgtatttttagtagagacggggtttcaccgtgttagccaggatggtctcgatctcctgaccttgtgatccacccgcctcagcctcccaaagtgctgggattacaggcatgagccaccgtgcccagccgatttatttcttatgtacccaagaaaaataagaaatagctctctgcccctctctctatccgaattaacatcaaagacaaacagatatgatttacagatactagttggtttagacaatatggtgtactagatgtcctagaaacccttatgataaaatgcctagaaatactgggaaacatataaaaaagtttttttttctttttttttaaatcagagaaagggtcttgctctactgttgcccaggctggagtacagtggtgtaatcatagctcactgcaaccttgacttcctaggctcaagtgatcctcctgcatcagcctcccatagcactggtattacaggtgtgagtcatcatgcccagtcaagaaacattttacaaaatgcatacctgctttcataagaaattcagggaaaacagccagaggcacaccaaaagaaggatctgcaaactgaagtactaaggtaacagtaaacttgcagttgccctgggaatatttttctatctcagttatctaccaccttggattttagtgggctcataaggaacaggagatgaagccttgtttctatacatggtgttgatttgggatcgtgattgccagttgaatctcctatccacatagaaatagtggactaaaaggtatatatatggccaagaataaagagaaactagaagtatattagtttgtcttggcctgggctctgtgaggtaaaaattgtgaaatgtgaaaatgtatatatgtagtctgccttcatgtaaataaggatcttaaatctgcaacatctcatgtgatcctggaaactttgagcaaagaaattaacttaaagtaattccagatttgtatcaccacaggactcttgtatgatgcaaaagtcaactctttctgaaggattttatcctaacaggtcttgtaggattcttaaacatagagcccccatgaacataaattcacaatccaaagttataaaactgacactgaagtagtgtcagaagaaactacagaacagcgtatttgacctttaagaacttcagatactgaaattatcaaatattagatttaacatttatatttaaagtatataaataagaatcagaaacatgaatgaaggagaagatacaataaaatggtgagatatatttgcagaaatatcaaatgtattttacagaaatgaaaaattcagtagatggattaaacagaagattaggcataaagaaagaatgagctataagaaaaatctggagaaactgtcaaggtgcagttcagagaaacaaactcatgaaatatataggaagcatggaaaataaaatgaaaagatttatcatatacctagagtttcaaatgtaaagaaaaagtaagattaggagagaggtgagatccaatgagaaaatgactgagaatattctagaattaatgaaagacatagcttcagagtcaggatgcataatgtatataatgcaggaaaaataaatcatcacctaggtacagaataataaaaccacagaacagcaaaagcaagaaagaatataaatttaaataaatagcaactcaacctccatctccaaatgaagtgaaggagaagaaactaaatatagaaaaagtttggtaagtggaaaacaccaagtaaattggtgaaaaatatcagtaatcacagtaatataaatggactaatgtgacaaattgaaaaagtaattgttagattagacttttaaaacatgctacttatcagacttttctaaaatataggggcagtagaaaaattgaaagtaaaaggatggataaatatttgtcaggcaaatactaatgcaaacgttacatattttcatagctatattatatttcagataaaattgaccttaaggttaaaaaagaagcatactaggaaaaaaagaagtcttacataatgactgagaattcaattcactaggaagttctaacagttctgaatttgtatttacttaacaatacagtctcaaaatacatgaagtaaaaactgactgaataacaggaagaaacacacaaatccacaatcatgagggcagattttaatccactagtcaaagtaatggataaatttaaaagacaaaaattgttggtgagattatggaatagagatcaacacacatttacaaattttagacattgtggaccatatgatttgcagaatctcttacagctactcagttgtgccagtgtagtgtaaaatcagtcttaagacaaaacttaaatgaatgaacatatctttttccaataaaacttcatttatggacactgaaatgtgaatgtcatgtctttttcaagtgtcacaaaatctacttttgctaattttcaaccttttaaaaataagagctcttttttatctcacatgccaaaaacaggcagtaggccagtcttggcccataggctgcagtttgccaatgcctaatatccaagatttgtacaacagaattaataagtttaacttagtgaaaaatcttgcgtgtagtaattagaaaatacatattattctcaagaacatatgggatatttactaaaattgtcacgtattatgccgtaaagcaactaccaatacatttaaagaaatccatataatacagaccatgttctcttaactcaataccatcaacttaaaaataaataacaaggggattatttttaaaacacacttttagaaaaatttaaaatatacatttgaataaatattcacaagagaaaatgttcatattggacattagaaaatatttggagcaagtgaaagatgaaaaaaagtacatgtaaaaacttgtgaaattaacaaactgatatagagaaagaagttagtagcattaactatattaaaaaataaaaggttataaattaatgagctaagtttcagttctaaaagttagcaaaagaacaaaataaacacaaaaaatagaaaaaaagaaaataagaggaggacagaaattaacaaaacagaaaagacaaaccttgtagaatcaacaaagctaaaggttcgttctctgaaaagactaataaaatagacaaacccttggcaatagtaggacgtgtacatacatgagaagaagaaagagaacaccaatgatgaacaatattaggaattaaaaaggagagatatgactagatatgaagtaacaaataagaaaataccaaaagacaactttataccaatatacatgagaacttagacaaaatgcatgctttttaaaagaaaaacataacttccctagacaaactacagaagaaatagaaaaccttagtagacttataatcattaaagaaattaaatctgcaggaaaaaaaagaacaaaaaaaggaccttaagaaaaacactgaaaccacaggaaaattcaactaaacattcaaggaacagatcatttcaagttcatataaactctccccaaaagataaaaacatatattccaaatttcttttctaagaataatctttattccaaaagtagataaagacaataggaaaaatgaaaagtgtaagtaaaacttattatgaacatagatgaaaattctaattcaagtattagtagactgaatcaagcaatgtataaaactgttaataaagtagaccaagttcagtttcactggagtctaaggtttgctgaacattagagaaaatgttaatgtaaatcatcacattaatggaaagtaataaaattatatcaccatctcaatatatacagtaaaaacatttgctaaaaaccagtgcctgttcatgaaacaaaccaaagcaaacacacagttattaacaaagtaggaatagaagcaactgataaattgtgtctacaaaataatctgttgcaatcatcatgttcaatggtgaaatgttaggtaaattcctcttgaaaatcaagaacaggagaaaattgcataacattatcattcctactcaacagtgtaccagaggtcctaatcagtgcagtaagacaagaataaaaggtaattattaaaatgttaaaaatgcaatgttgtcacagtgtatagactttcatgatttgcctacatagaaaacctgagataatctataaagccttagagttaatgatagtttaacaaaaattaaatgtattcctatatgtcagaaacaaacatttggaaaactaattttaggaaaaaaaccgcgtataattgcaagaaaaacaataagatacctagaaataaatctaacaaatgtttaagaccttaatggagaaaatataagattttattgagagatagtagacttaaataaaggcagatataaagcatgttcatggaagactcactatgataaagatgacagttctctccacttaatctatatattcaatgcaattccaatcaaaatcccaacagggttttgttttttgccttttgctgtgtgtgtgtgtgtgtgtgtgtgtgtgtgtgtgtgtgtgtgtgtaagtaaaaatataagctgattccaaaataaatacagaaggaaaaagacctcaggatagccaagaaaatttttatgaagggacatggcttatcagctatcaaggcttattagtaaagctagaataaataagctaattctcttacataaaaactaggccaatagaattcaatataatatagatccaggagaaagtcctttccatatataaaaacttagtatgagtcgacattgaagattagctgggaaagaacaggctgttcaataaatggcactggaatcactggttaatacacgtttaaaagggggttatcttgacgtcacaccatagacaaatataagttccaaacatttaaaagatctaaatgtaaaaagaaaacctttaaaatgtttagaacaatataaaagagactaactttatgacagagtagaaaaatagttctttgaaaggttttataacataaaacataaaggaaaatattaattcattttactataatagaagtaaaatattctgatcatcaaaagcaccacttaaaagtaaaaaagataatgaaaaacctggggaaagatatttgcaaggcataaaattaataattagaatccattctaaaaatgttttactactaatctacaagagaaaacaactcaagagaaaattaggcaaaggttatgagcaggtgtaacctttcataacctctcacaggagaggaaacatgaatggccaataaacacaggaaaagttgtttaatttgacatgtaattagagacatctaagttacatctaaaatgatatgaaatttctccaccctccagattaatagaaatttaatgtctggctactccaagcttttgtgaaattgtgtaggaatggacactctcatacactagttttttttttctttttttccttaaagatttttcccttattatacactagttgttggtgggagtttaaattggtgcatttactgttgaaggcaatttgtcaatatctagtaaaattgaagatggaaatatcctacaaatgagcaattccactactaggtatatttcctagagaaattcttgtacatttacaccaaaatatctgtaagatatatagaactatatcctggtttgtgagaaaaaaggcaaaatttaaacaatgtacctatcattgataggggaatggataaataaattatagtgtagtcataaaatgaaacactaaatagtgaaaataaatgaacttgaggtaaatatttcaacaaattattgatataattgatacagagcaagtgagccccaaaattggaacttagcctgggagagttgttggcttcacccaggaaagaattcaagggcaagcaagtggtgttaggaacttttattgaaacagcagtgtacagcagcagcagaggtactgctccttgcagagcagggctaccccacaggcagtgtgctcagggcatgggcagttctgcagtcatatctatacccacttttaattatgtgcaaattaagattatacagatgcttctagaaaaggggtggtaacttctgggttttctggtcattgtcatggaaaggggcgctaacttctgggtgttgccatggtaatggtaaactgacatggcactggtgggcatgtctttgcagaggtgcttttgcctcttctctatttcagctattcttcaatctggtccagagtcaagtcctacttcctacctcattcccccttcaaagattaaatactcctctttaaccttaagggggatgcaaaagtgcagaggtacatctttgtaactgcatcctgctgagtttatgggcataggcccttcctaccaccagaggaataaaaatctctggatcttatctaaggggcccacaggcaagacgcttttactctctgggtcagtagatgggatgggttggaagtcttgtgccagcattgtctttacctagaactttcgtaatatagaagacacaaactttattaagaagttaagcaaacaaaggccaaagattagtaataacaagacagctattaaaggccctacgaggccgggcatggtgggtgacacctgtaatcccagcactttgggaggctgaggcgggaggatcacctgaggtcaggagttcgagaccagcttggccaacatggtgaaaccccatctctactaaaaatacaaaaattagccgggcgtggtgaggcaggccggtaatcccagctactcgggatgctgagacaagagaattgcttgaacctgggaggcagaggttgcagtgagccgagattgcaccactgcattgcagcctgggtgacagagcgagactctgtctcaaaaaataaataaaataaaataaaggtcttcggagaggtaaaaaccaagtgagacttgggaaagtacttttgttagtcaacctgatatagttgggatcagtgccctggttatatctatgtaaccaggtagcttgcttatagatcttttgaatgttaacctcaatctgtccagaggcgttaatacatgagcagcaggttttattaataactgcacagactccacctcattcagcttgtaaataatccaatcctagtctattatagagaactacatttgccaaagagtccagggactcttgaactctctttagtccctgacctgtgttggtggctaaatattttagggtttcagttaggtcgttttagggttgactcatgatagacaaaaccactccatagtgccactagtcctattgttgccctgattcctgccagagttaatcctattgcttgtttaattctggtgttcctcagtcttagggggttataggctatgaaccctggaggcacaagggtgtccaatgtacattcacccctgtcctaaatttttgatgtacaagagaaagctacttctaaaagaacaagtggctctctgggaagttgggtgtggttatggggtgtgactttttcccacttacggccacaaacaaaaatgagcccagttgaggcacacatcgaggccttacagagtatgatgtctattctttgcttccaagttgggtccatagaaatattcttcccctgttccaatgggggtggtcgaacaatctttgttttccagaagcgggcagtactcccaccttcccagattaggcagttgtttttcccttgcatgttctgatccaatagaagccaccatatatgggttcctcactctcaagtggaatcccatttaccttgctctggccttgggaacttggcagctagaattggatcacagcatcacagggaacttcctcttttatgtcattaaaacaacagtgggtgcaaaagatagaatcattagtgtactggaggtatagatacccaacttcccaggttcaggtaatagtggtgggggagtgcaggtggaatctgttaagtaggggagcatcccacctaacaagtagggagttttggatacttgaggattgctatcattagttaggagatctggagagatggctgtgagagtttatgaataggccagaagatggaactctctatcttggggatgttgataaatccagcaaccataaagatgattccctgatgctacaatttttgaaatatttactatagagttttgttcctacccacactggattagagtaattgggagatcaaacagtattaatagtgacagcatggtatccagctgggctttagaatggcctctacacccaacaagaacaaaagagatgtctccccagaggaggtagctggctaaagcaatagaaaagaaacattgtagtcaagaagagaaaaattaatgctcctatttccacccatggcatcatgttaccactgctggctgagtgttgattcttttaaataggtagtggaagtcttccaaaggtttacagaagtaggtcatggtgccctctctttgtgcctgtgactcataagaaacaggtttaatcctcgatagttgtactcaagtagttattccctgacatttaagtggtggcagtatttaacaatacccagtagggacctttcagttaggttgtaactgattctcagaggatctttctttttggtttttagtaagactaagtcttgtgagaggcaataatttatttccatattctggaagagacttgtgaatctagcctaaattttaaagggggcatagtgaggtttgtctaactccctgatacctgtcatggcctgagttagtttttaagtttctttggaatttcctttgctcaagggacttacagtcaaaagacttatagccaattaaacattctaggccagatgggaatggaggtggtcaggcactcatcagcacttaaaaaccttttaagcaatgtgagtcaaaaactaaaagccaaaaatgagattatatcaagagaaactatattgggtgaagacactgctcccacaggcctctaaaacaaaacactttagcatctggccacaataatagaaccagaagaaaaaactcacaggagccgacaaaaaagctaaaggagggagttacatgaactcactgagaagctttcaaaagaattagcttacagaattgaaaactttctggtaatttcacaaattaataccttaagaaaatttggtcttaaaatgtaggccatttttaaagagtcaattataaacaattttcttttagttacagcaagcttagtcacacacaaaaaatttattttataaattccctttcgtgaaccttatcataatttacacagatcatctataacatgcttggcctttctgacttttcctacactatctctttcttaaataaccaatcattttaatctaggacaataatttactatagagaatccttttgatgcaaaattactcctttttaaatattctttcttgcaaaaaatatattttctgtcaatagcattttttatatctctcttttttacacatttgttccctcatattttgaacctttctttcaataacttccaaattagacaaaaattattctttttttccagtaaagaatacatttctttggcacatttcatataaaactaggaagcaagaaatcctgaactacccaccatacattggcattctatatatgagaactattccacaattttaagattttaaaccacacaaaaagctcattatttaagcatctattccattcacatgtgtttaacatttttacttttaatagctatgtttagaccacctccaagaaccaagatcccatgcaaaggtagtcaccatttaaagccattttaaccattttaaaacctatgaacatcagtgatttacctagctaaaaatcttaaagttaaattttaaaagacgtaacatttctcttcaaatgaataagcctagactagccttgtttaattcatgagcactcttttatcagccaatatgatagcctgctaaacacaacacacattaaacctgtatatacacttaaacacatcaaataaaatgacatatacaaagcaactggattcaagttatttacaaaattgggacttacctatctgccaaattttgttagcaccagtaggtatagaagacaggaagaggcagggaagaagatcccatagcatcaaataaagaaggaagctgggggaactgcagtgctcagggggaaagcccagagtccccaagccaccagagagatcacccagtagtggagacattgaagaaaaatgttcaagcggctgcttgtctgccactgtgggaagctgtccattaggtcaagggtccagacccttagtaaatttacttggacaaggcagctctctgggggctagcagaagaaggttagctctggacacaatattttcctctcactggggacagttaggacatcttattgccaatggtccttttgcttgcagtagacacactgattctggcccaggggcctgcgagttgggattcctttctgggcattccagccgctgatcttgcgatgctttcttgagatgggtaaccctgcagaggcagggggattaaagcatttgctaataattgcattttttggctatttcttttttttcatctcttttgccctgtccctattgttgtagactttaaaggccatgtttaagagttggcttgcaggaatttgcggtttctttgctgctttttgtagctccttcctaatgacaggagcagattgaataataaaatgcgtacccagaagagtttgcccttctggggagtttgggtctgcatttgtatatttcctgagtgcctcaactaaatgaccctgaaacagagcaggattttcaacttttccctgagttatttctctaattttgttataattgactggcttaaccatacacttttccttccacttttttcctacagcacaagtaatagatggcaatatttgatgacatgctaaacaaaacacaagttgtaatgactgtatatacacttaaacacatcaaataaaatgacctatacaagacaactggattcaagttatttacaaaattggaatatgacaagttatttgtgagtaatgacaagttaaatcaaagaacatggtaaacttaacaaactactctataaacttttttggattctttgaaaactggccaaatttgtccttgtataaagccaaatcacacatagaaattggcatataagctccaagtgttttcttatttccattagctacctcctgcaatagatgtaggtttgcctttaggggccccagtacagggcccctctccaggtggtactggttgggcttattttcctgggcagtgtggggtatagctggggctagttggataagtgaggtggctggtgcctgatgaccttggggtgagatcctttgttagagaactggtaggactcctctcagaattgggggaccgaggagactccagggagggcataggctttctagccggagcagctaggaggggattccttaggcatatagctttctggtgcctggaaataacgagagccagtaaagggccataaaaccctgtacatagggatatcctcccattttcctcttttttttttatacagaataagtccaatcgtaaaatgtcgttataatgtataggaccatgcttaggtaaaatctgtttgctttctaatttgtattgaacccaaatggtgttgcaagagaaaatgagtttctttttctctaagctgaatttgaatttgctccaatagcttaaaagacaccctagtggtcagtcctctgggatgctcatcattgtctccatgactaataagaatatttattggacataggactttttctaagtctaatgagaaaaaaaacaactgggcctttgttatttctcccttttagatttctacttgctatctaagtataggtagtaaggtgttataaaagtggattgtaagtatttgccagtgaatgaaatatgacaaaaaagggtttttattaagcaaagtgtagaaggaaaaaataaataaagtaacaataggaaaagaaaatgttgttacagaaaatgataacttttagggcagaaaatgagaaaagacaagaccaagattcctctaggatgggcctccaacccataatactggaaggaatgccaatgccaaaaccctggaacaaccaggggtgtccaacaatactgaatgctgaaaacctggaatacctgagtatcaagccaacaagtgtttctacaccaaatgcccgaaacctcagagtttccaggggttctccaaatgccaaaaaccccagagtatctgtggggcatccaacagtgaaccccaaaggcctgattggggccacagaaaaatgtgactctggtgttcctcagtaaacacaatggggaacctctcataatcaactgccctgacttaaacaattgccaaaggagccaaagccaaaaaaaaaaaagactgcaaacaaaacatgcattttaggactgaaaataaaatggctagtggagcaataaaatagagtcagaagagaaaggacctggtgaagaagtgacaaggatgtgtctcaggacactcaattaatgagtgacttttcactgaccacttagccaaagacttttatgccctaacttatctgatattgtggggaagggttcagaggggacactcacccattcacagtagccaaaattgtgctgactgatcttccacatgggacccggatgaaggtcttccccaggttcccttaacttaggttgacttagctgtcacacatgaggtgcaagtgcagggattgtttacctgccagcctactggtaggagcagcaggtcccattcaaggtggtactactgtggacacttgcctgttcactcagctccactgcccactgggaaagatgatggatctggaaagggcctttggttagtgttatggctttgcggtgttagcagctctttattgttacagcctcagggttatagctctgcagcttttggttgccatctcaccatctcttgccaattgctgcctctccactgatcactgattgccgtcatcgccactgtctcaccatcttacctctccaccaatttccatctctgctctctcactctctctcacttgctgtctttgtccctttgttggtcaccagataacacagggcaggtgagctctaaaattggggcttagcttgggagggttcttggcttcacccaggaaagaattcaagggcaagctggtggtgttagacaacaacttttattgaagtggcagtttacagcggcagcagaggtactgctcattgcagaacagggttatcccattggcagtgtgcacagagtagtagctcaggggcagttctgcagttatatctatatccacgttttattatatgcaaattaaggggtagattatgcagaaatttctataaaagaggtgatatcttccagctcattggcttgttgccatggaaagaggtgataacttccaagtgttgctatgacagtggtaaactgacatggcactggtgggcatgtcttatggagagatcctttcactttttccctgtttcagctagtcttcagtctggtccagaacccaagccccacctctgcagtcaagtcctgcctcctacctcataatgagccaagaaaagcaaggtaccaattgaaatgtgcagagtagttccatttctacaatgtttaaggacatgtaaaacaatgttataaattgatgatacttctatgtatatatgcatctttaaaagaatgcaagagaatgatgaacatctaaatcaaaatagtggttacctcatggtgtgggagtaggaatgggaatacaagagtgtaggagcacacaaagggcttcaattgtattggtaatatttctaagttggttatgtctcatgggtgttcattatattaatagtattagtcttcttcaatgtctaaaatatttcataatatactaaaagtagcatactatgtctctgacactctacactcgcttttcctcctgaacctctgtttaattatgaaactctaagaatattctcattgatgttggaaacaaggcaatatcaccacgatcatttgacttagctctggatgtaccagctaatgcaattagatgaaagaaagaagatatgtaaaaacaaaaagaagaggcacaatcatcattatttgcaaatgtcattatatacctggaaaatccaagagtaccaactggaaattattataattgtataagtatgtatctgtagaagtgtagaaaatataacaacagatttcatgcataaaagctgctaaaacctagcaatataatcttaggaaatttatagaacctatatgaagaaaaaatgtattttttatttttttctgtctctgatgcttgaatcaagatgaaaaaccattaactctattgaggaacatgaatagatggagagaaatatcctgtttttggataggaagacaatagtgaaaagacattaaagtgtaatacaatcccaataaaaataccaagaaaactttggactaggcatagtgatttcaaagtacatacaaaacatgaaaataaacatgtgagaatagctaggataattatgaaaaagtgataaataaggattaactttacaatatatattctaagctcctgtaattaaaggtgcaggaataggaagacaggtcaaagcaacagttttttcattctagaaatagactcaaacactaacatatataattaaagggccatattaaaatagaagaaaaatatgttaaaattgactatacagtaaaaagtaaaggtaattccctctcccattataccaaaattaattccagaaagcccatatatttgaaattatatgagtgaaactctaaaagtattagaagtaaacatggtcatggggaggtagggggatgggagatcttggcatataaaatacctgagatgcaaactctagaaactctagtggaaaatattaataaatgtcactaaataaatttaaaaattctacacagaacaaatatataaaaggggaaattctgggaaatattttgcaatacatgacagataaaagtttgataatttattatgaatcagtacaagatcattcaatacaaaagagtatgaacaagcaatttactaaaggagaaatataaatggattataaacataggaaacaatcatcagttacatttatgagtaaatgcagattaaaatgagtggcaaatagtaaattttgatatttaacagtgttggtaagttaacaaataacatagaagcaaatccattgctagaaatttgtcctactgataagtggttttcaacctgaagcaatttttcccctaaagggacatttggcaatgtctggagacatttatgaggatcacaactgggacatgtgttactggaatctagtgggtagaagccagggatgctgccaaacattctgcaatgtacagtacaacccccaacaataaagaattatctgaccaaaaatgtaaattgtgccaatggtgagaaatcctgctacagatatacttgtgtatgcagacgcatgttcaagggtactcattgccactctgtttgtaaaagcaaaggactagaagcaacctaaatatctatcaatatgggtctagttaagtaaaatatgacacattcacaaagggctgttgtatagtttattttaaaaaataaagtagatagatgctgagaagaatatgtttacaagagacacaaagaaaaaaattaggattcagaccagtgtatgcaatatgtctccatttatgaaatacaaagaaaaacatgaatatatgcatgtatgcatatacgtgtgatgatctgcaagtacacacaacaaatagagaatggtcatctctgggtaatgaactttttgagtgggagactcactttttattgtgttcttttttgtattatttgaaattctactttatgaaaatattattttcacattctttaagaaacccaggctgatattttaactccaacttacctttgcaaggcttctctctattttatctctaaatagaagacacactccatgtaaagttggccaagacattatttttcctttgtgccctctgcctacaaaggcattctgccaattcccatttttgccttttaaaatcctttaagtggttgtaggtgtctggcattttatctagatttttaaacctgtttcattctctatatgtttgtttttgtaccagtaacatgctgttttggttacaaaacaaactaaccttgtagtatagtttgaagttggatagtgtaattcctctggctttgttctttttgcttaggattgctttggctatttggacctttttttgtttccatatgaattttagaatagtttttttttctgtgaaaatgtcattggtagtttcataggaatagcattgaatctataaattgctttgggcaatgtgaccattttaacaatgttgattcttcttatccatcagcatggaatgcttttccatttgtttgtgtcatctctgatttcttccagcagtgttttgtacctttctgtgtagagatctttcaccttcctggttagctgtattccaaggtattgtgtgtgtgtgtgtgtgtgtgtgtgtgtgtgtgtttgtgtgtgtgtgttattgtgtgaatgggattgttcttttttttctttccaacttttaggttcaaggggtacatgtgcagttttattatatgggtaaattctgtgttgtgggggttcagtgtacagataattttgtgacccaggtaatcagcataatatttgataggtagtttttcaatcctcactctcctcctacccttcaccctcaagtaggccctggtgtctattgcctgcttctttgtgtctgtgtgtactgaatgtttaggtttgtgttcttgatttggctctcagtttagacattgttggtatatagaaatgctaccaattttttttacattgattttgtatcctgaaactttgctgaagttatcggatctaggagtctttggccagagactatggggttttctagttataaaatcatatcatctctgaagaaagtttgatttcctctcttcttgtttggatgccttttatttcttcctcttgcctgatttatctggttaggacttctagtaatatattgaatggaaatggtgagagtgggcatctttttcttcttctgattctcaaggggaatgcttccagcttttgcccactcagtaggatgttggctgtggatttgtcatagattgctcttattattttgagttatgttccttcaatgcctaatttattgagaatttttaacatgaaaggatgttggcttttattgaaagccttttctgcatctattgaaataatcatgtagtttatgtgatgaatcatatttattggtttgtgtgtgttgaaccaaccttccaaatacagcatgttctcacttaaaaggcagagctaaacattgtttacttttacaatggatgcaaagaagggaacaatagacactggggcctacttgagggtggagggtgggaggatggtaaagataaaaaaactacctatcatcagatagtatgcttattacctgggtgacaaaataacctgtatgccaaacccctgtgacatgcaatttatacatgtaagaagcctgcacatgtaccccatgaacctaaaaggtagaaagaaaaaactgatcacgtgattcctgttcattaataccccttataatcttctgtttttctttggcatatgtgatcagtatacacattttaatgtgtataaaaaataaaatccttcaaggtaagtcccatctcaaagaccactttctataccaagtcttccctcatcctctcaaccacttggaagtacacatttatagacacataacactttgtatttttaaggcacccataccctgtgctacagtgatttatgagcatttttactttcttctttcctccatatcaaaaactcaccttacattttgagtttttttaagggaaaaatcatatcttattcatctttgaactagttttatagtatgtagcaaagtgcctgaggcataatcattggtcaataaatatttgtcaggttgaaatgaataaaagtttataatatacaggcaaatataaatgggtaaatacaaaacagaaaacaaacagaaaaaaaataacaacagaattagttcagtttgttggtaacctaaactctcttgttctttagtgcttttaaacctatacatttaactattgttaaaaatgtattgttaaacatatattgcgttttctggaacaggaaaccaactgtgtatactgtaatatacctatgtgatgtttttgtatttcttttaacacaaacttttcaattcttgtatagcaattccactgaaattgtaattgctacttttaagtgtcagtcatttttcatatgtctcactgaggaaagtgctatttgtttttattttacatgtgatgcatcaattgtacaagcacatgagacacttattttatcatctctaccctccatgtttcttgactgttacattttactactgaaatccagcatttcagatattcatgaggctgaaacatgtccataatcatcacattccccatttctttgggaacaacatatacatagtcgagaaactcactgtatcttaaggcatgctttgtcatctactaactttctactcattgggatggagttgcactgagagataaggttgcatttaagcaactgcacacacaaggaagaacagtaaccactgttgaatgagtggtcaatgtcataacactgcttcacagggaggtaaaaaacatggcccatttttattagaagctagaattgtgtccggaatagaaaatgctatatatatatatataaaatatttgctctctctatatatagaatattagatatatataatattagatacataatataatattagatacataatatataatagatacataatattatataatattagatacataatattatataatattatattagatacataatattatataatattatattagatacataatattatataatattatattatagacatattatatattatattatagacataatatataatatattatatgcataatatataatattatattatatgcataatatattatacatataatattatgtacataatatatacataatattatatacataatattaacataatattatatacataatattgtatacataatatttcatatatatatataaatatttgatactgtggaatacttttccccagttagtgaggttactttctattgataatactctggctatacagccattttacttgtttctaaatttaaaatcaaatcactttagcaagtatagatgtagaattttaggaacctctggcctttttacaggtattttccttggcaagggctccattgagttggcaatctagtaacctgcattgtgagggcacattataaaagttacaccaacatctaggactaacttttggcttctcagatggaagataaggatataataaccaggtgttgctgttattacctttagtatttgaagcagttgtaatgtttattttatttcaactttgggtaaatttaaggaagcagaggaaatataattagtctataatttaaaaacataaagccaatgtaagaaaatctgccatagttaattatagtgtccagattaagaactttcagcctcttccagaataatgtatgagcgcagagttaatcacatgtgggattttcaaaacatttaattgagaaaaaaatacaaaaaagtacttttgagaaaatatgacccacagcaatcccattatctccactgttaaacctccccactagctgctttttttctcatctgtccttatctgttatcttgctagatgccatgtgaggaggccactaaagtagaaagaaacctgttctttgccttcaaggtagctctggaggcagtaattaatatggaaataagcgctccattgtgtgattcagacaaatatgatgggagcatatagtttcaaatgaactgtggtcatcagagcaggtcatatggagtacatgggccttaaaggatggattacaccattactgtttcaaatgtaatagtgtagaattatgctaatcatgggttagggattccattttacattaaggtcaaataaattttctcaggttacagaagataattcaacctaaaaatatgtttcaaaagagtacctgaatacagatacattttaaggtgtttttattgttttgttattggaaaacagcagagagtagggatgaacgtgatctcttgctattttttacttgttaaggactaaataagaagaaaatgactaaaactgactgcaaaaaataagaataaaaataatagaaaagttacaactggtatttaagagaacatggatgaaaacttatcatattaattaaagcatggtattaaaaagcaaattcacttagctgttcttcctttatgtttataaaagattggattaaatgaccttccagcttcaaaatctgtaaatttattaaagcatagtgcttgtttatctcattttgttttatttttctttatttttttttttgagatggagtctcactgtgttgcccaggctggagtgcagtggtgtgatctcagctcactgcaacctctgcctcccgggttcaagcgattcttgtgcctcagcctcccaagtagctgggattacaggtgtgtgccaccatgcccagctaatttttgcatttttagtagacatagggtttcaccatgttggccaggctggtctcgaactcctgggtcacttgtgatctgcccgcctcagcctcccaaagtgctgggattgcaggcatgagccaccacgcctggcctgtttatctcattttaaataaatatgagtgttttcagagagtgatgatcaaatagcagaatctctcctatcaaattttttaattgacaaaaataaatattaaaaggaccccattaatgctgcatagctaaattgagtaagtacacatctggttatagaggttatacatgctggggatgagtagatggttattccaacctgttactgttctcacagatgtcagtttgtaattactacctcttgtcagaaagatgctacccacatggatttcccagaatttagtgaagagagtcagaatggagaaagtgaaggagctttgggcttggtgataaaaagacaagtaatatataacatttttccccttaaaaaacgtttctcagaataagtgaagcatttaatgaatgcctttggagctatcaaatatttgtcttttcctgagatccagacgcattacatttacaaactaccgagttatgtgtacctgtatttcattgttggcattttttgatagaaacttgtggtatgcaaaaggaaatgaaaagcttatagtagacccccaacactagtcttacaaattcaagccaatacatcaatttcatattattcagtgtcacccatttgcctttgacatctttgctcacaatattttcttgccttgctatttgtccttcagagttctgctcaaattctacctcttctctaaaagttttcctgtttatctcatattccttttccatttctctgaatgtctctgtagcactgaggcctcaattatatgtgatcttacattgttctctaaattcttactctgatttgcttcactatcctgactgctcctccaggaatgggcatttctctagcttcagttcctctctttatacaatgagggtgacaatataaccatgttaaaggcttctttggaggattaaatgagataaaccatgttaatcgtggatagcacagagtctggcacacattaagtatccaataaactttagctattgttattatgtgctctaaaggcttagtaattgatagcttgattaagttttctttcaagtctgaattttaagagaatataattttttgtctgctagaaatagcctcagagtgtgtctacaaaagtagaacaactagttaaacattgaaaatatggttaactagttgctttctctacatgccactaaaaaccaatttggctgaattatctgagtgaaataattgactgtttaggaataatggcatcagaatgtgcataatacataaattttcaccagtaatcactgctaagtaatataagttgaataaagtcatgcccatgaggcatttagatagaattgccacttaactcagtaaaacaaccattttgacaggctttaagataatttttttctgacttcatcaatttattctgtaagttgaataaattgcctgggattttgtgtatagaaacaacttcaatctctttaagtcctgtcctgatttcttttaagtaccaaatacatggaccaatacttactcttcttatactcctgctgtggggaattttccagtttcaacaaaacattaagaaatgacatgaaatgcacatgcagtgtctgcctcacaggcactaatgttaatacaatgcattttgcttgacaaatcagcaccacttgaatagaggccttgttacccatattctcctatatagtgatctctgcattcccattttctcacattttggtggtaaaaaatacattccattttgcagtggacttcactgactatccagacaataagcacaaaattgtctcagcctgtgtgcaaatatcttactcagcagtcagggctactcaggaggatggccttttagcacaggaaatagtgttccaggtttctggaaagatcaagggagagcaaagctttattgagaatgtgactcagtgtgatacaagcttctggcatatacccaaggtaatgtcagtaacttatttatttggaatttataccctgacttttttcagaaggctttgaggtagtttataagttgtgtataatgtaaaaaaaaaaaaaaaaagacaaggaacatttagggcttaaaacaataaaaaccattctgttagtacagctatgttactctcaactacggaactgttccttacttatttaatcagtgaggggttttctcgctttgtgtcctttagcaaagtaggccttaaatgaaaattttcaggcactctttattgttggcaaggtcactggtggtctctgagattttgtgcctcctgcctcccgactgcccaagaaggctgccctcctgcattgtagtttcatcccaaacagggtgcttggggacctagatgcccaccactgagttacacaaatcagcctttagctgctttgtgacagcaaatacaaatgggtatgatgtgcatatgtgcttctcagtgaatcattcatcatctgcatgatgtgtctccccaggcaagaggtatggtagcacagctccctcaagtaaagcatgtctgataaattttgtagactgttagtggaaattttcagtgtttttctttctaaatgcttagtttatcttgcccaccaaaagcatagcacaaacaactttgccaacatctatgaagctctaagaccaagctctgctcttaaaggtttgggaaagtgatttgtattctttagtcttccagagtgaagaattaaagtttccatagttttggctttactggttttcttctgaccactagctatctgctgtggtgcagagacatttcctgtagggatacatgccttagcaatttgttttcatcactgtcacatcaactcagcattttcttgtcatctttcagttctgataaactgcttctgaattgacagctgtcaccaagatgcttacatagcaatttaaggttggtctaattgacaaaggttaaattttctacttgctcactaaacactaagaaattgggggtgattatagttaggagctattgccttgttatgtgtaaatgaattatggaacactgtagtttctatgcatcttaatagaactagatgtaatatcttgtttctaaatggatcaaagattgaattcacaggaactctagaattcattttattattagcattattgataggaaggtgccaatatatagactttgccgtcttttgttagcacatgatacctactctcattccagttaaggcttgaatgcccaagaaggcactatgacaatattactgcttgaaataattttgttttactttttattgtgcttttattgaagtctgtgtttttaaatttaaaaacatgcactccacacatattaaaatgctttttaagatgttttagaaattgtgtgtcaaagaaattcactgattaagtaatgctaccctttcttttcatatgcatatgcaatttttcactgaatatggacatgtacctttctaatctacaaacatacaactatgtgatggtataggaactgctgatactatttgtactcacttaaggtaataaagaggcttatttagggctgatcacaaaatgagttttcataaagtgaattacatttctcattttattactttattatcctttttatatatggatacttcatctcagctatagtaacacagggaacaactggtggacaaagtgtgtgtatatcctcccccagaaaagcctggggtaacctttgagaagtatagtgcataagaaatgtagtgcctaagtatttgctctttcgctcattcctttgtggttaatttcaatgtaggcatactggggtgtacatcttgagcctgggcagcaaacaaggcatagggtttggccattcttattatgctcttggcactgaatactctaatatcattatgcttttccctacaatgagccatctttcttataaggctgtacttctagtcccaaagagagactgaatgagtgtggatggcccaacctaccctcataactgagagaccaactcagattgcatggtttgtacctgctgctagaaataaacgggatgtgaagaagagtaaagaatcatattgttggcaaggataattctcattaaatattttttccagtttgaatcttctttctgtgcatatgtagcatattttgctcccttggactacatcttctcaaaggacagctattattcctattgtttacattcatacagtcctcttactgcccaatatttgaaatattttaagtttacgagggaaaaaatgaacatatgactatattccttcatcaaaaaatggtttcctatttcaatatcctctctgttctctggatttatcaactccaaaattagttttaaccatgtctgtaactataaaagcacaataaaaggtaaaaaaaaattatttcccaaaccatttcagactaattattggaactcattttgtcatgactctatttctcttttattgtcttcatctctttcatttcattgtatgtatgtataacacacatatgcatgtaaaaaatcagattccactgccatacttttctattttcttgtttcttcctcctgcctttaataagctgtaagcattgcttaagttctcctattctgattcatgtttcaggtagctaatgtaccactccttgttttctgtgatgaagttaggaacaatttgactcttgactatcgtttgtgttaccctcagtcacagttgttctgtactagatgttgttgacaaggcaataataagccctattaaatcctacctcttacatcaccaaaatctatgttattggctagacaaattgggccgatgtgtatctcttcactcagaaagttttcatgacttctccatgtataaggactcataagcaaacactatacaaatctggaaaatatatttccttgtgtggtgtaaaagtcacaggaaagtattaaatttggcttgggtaatgggatattcttcctcatttgtatcatgcaaataaaactccgtaacattttacaaatcacatacccaccctctctccccttgggatggggttggaggtgtatgtttttttttaacaatggtagcattctttttgacacaaagcaaggcagttcaaaataacactgaaacaatcctacattcatgcttcttcttcttctttacaaggcatctgacaggaaaagtatcaatgtgctaatctccacagcaaatcatgagataatggacatcttgcaaaagaatataaggtgacttgaggattataaaggtaatcttgtaatgcttttgaaaactcttcgaaagcactaaaacatcaatggcctgagagagaaggaagacctttaaaatatattgcatattattattcaataaggcaaaagcattatttgatgccttctttgggatcagtagcagttgaaagacctgtgttgcaaaattatatttaaaggtcaacagctgttttattccagatggaacctactcctgaagatgtttaaacacttttttatagaaattgtgattactgtagtgatgctagtctatccctatagaatttctaggacctattggagaagaaatactttagtaaggatatttggccttattaaccctagtaaagcttgatgtaaaaaatcataaggtgactaaatgcatgagaattggcttgaaattcagcttactagtaggaggcattaggacataactttcccctgcagatttgaaggaataatgctagacagcattaagtagtgagaatgcttactactcatatacctccttactgtctctccctaagactttgaacatttttagtctttagacacactacttttggccctattcaatgtattactatttatgtacaagatagtaatacattagtacatttaagttattaagtaacccaggcaaaggaagattttatactgtacatgtctgaggctcagtgctcaagggattaggcaagttacatgagtttgtcaaagggaaattcagaggagaagtttacacagtagccagaggaaggttaagagtcttagaatcaggccccaacagaaaattgagataataagcagaatacagacaggggccagaaagcctttcaaagaatggacagaatgtcagaggtctacctgccaactggtaggagattaggagggctgtccagaggggcactgatgccaatgaattgagcctagagtgttcacactgtgttcacattaatggccaaggctgtatctattaggaactcaaaaaatgagtctataagccagaatttcaagggtttcactccctttgttgcatcttttaagccaacatttattgagtacctactttgagccaggtactgagacaggctctagggaattcagaaatttataaaatagggtccctgcctaccaggagcttacactgttgtggggaagacaactaagaaaatctacaattataaaagcatgctgtgataaaattattcagtaagagctaagggagagcaaaggaggaatacctgcattttatgtaggtgtgggttattggtcatatgtgagcaaaaccgaaaataatcttagaaggagatgccactgaagttgaattgttaaaaataaggagatttggacaggtggatgaggaagcaatggaaggcattcaaattagcaggaaaaacatgtactaaggcattgagggaggcaagtgtggcttcttgaaagagccatacataggccagttttgctaaaaatgagagtggaagggaagagattacagaagacaatgctagaaatttaaacaaggaccagatcatgaatggcctttgtagaacatagtagagaaactggatgttaccttggaaacagcaggaaactactgaaggatactaagtagagagtgacatgatcagatttgcattttagaaaaaaagcacactggcagctgtgtgataagcaggggagttaaatgagtacaggagaggtacacagaggggtatacctaagtcagttaataactgacaggttaaataagcccttacaccgggtacttgcatttgtggaatacagagtttgaactccttatctcttcagaattttttagaagagttcaagacattaccaggatgtgatggttgaaggacagtgatttcagacatagccatagattattgctgcataatgtagttggagggctaccaagatgcaggggcagtatttctaccataatgagaatgacatcaaggaagacatcggcctcccacctggccgttatggctctgtcagaggtggaatcctgacttttctcatcaccagcaatgttattagggaaaagcaagaatttgacgtttctctttgggccctatctactgaatatgagtgtttgagatttaacttttttcattcagagaatgaaaaaggccacaaaatccaaacaacctttcaattttcatttataattggtttacaattataccaacatcagggcctctcctagctcaagcagtattgttctatgatttagcttgagcaagaatagggaaaacttaattttagatttgcagtttctcttgagttagagtccacagctacattagtacccacagtttcctttggaagtgaaatgaaaactcaccattacctgttttgaattgtggtctggcagctgagcaccttgacattgtaaatcgagcagagtcacttgaaaggaaataaaagttacactgattttgcacattcatttttttttattgcctaatgctagttgaccaaaatgtattcagccgagagagttgggaaattgattttattgaaattgataagtaaaacatatataaattagtaattacaaaaccataaaatgtttcttataggttaggcatctttatgcatgagtctgatattaattgtctctaatgatggtgccgaattgatccttccattaatattttgcaagttcagctgttatttttggcaccctctgtgaatgtcaacaatttgcttgcaaagaaatgatagcatattaagcttatgtatacaagccaatattatttaacaaggaagtacaatgttgctgaagacaaagctagtttgaagagtaaaggcaaacagctaatcaatctttggttgtgcactattatttaagagggaaaatttaacttaaattttgtttactattaagctcagagtttggttttaaactgtgatttaattgcataacttctagtatgtggttgcctttcatcttgatgttatattcattgaagctttcaaagaagtgcagataggacttatttccatccccaagtcaacatttattgaatttttatgtagtgccaggcaccatactaactgctttcatagagaatatcttattgaatcctcactacacaactctatgagacaagtataatttacatataagtaatctaaactctaggatcatgaaataatatgtccaagatttcacagctattaagtaataaagccaagatgtgaacttcggctgtctgagtctagagaactcactcttaaccactatgctatactgtattacagtttatttttagccaaagctgaaattatcagctaagaagatgattactaccattatgaacaggtattctgggttcagagccaaatttttatgtatattaaaattcttaatccctcctaccctataatccaacttccacttctacataattaccaaagagaaatgaaaacatatgtctacagaaagacttgctaatgaatgttcattgctactttatttataatagccccaaattggaaacaatccagatttctatcaacaggttaatggattgtattcgtacaatagaatagcactcaacaattaaaataggtgagctgctgagatacacacaacatggatgaatttcacagacttaatgatgagggaaagaagccaggcatagccaagtacatactgtacgaatctatttatgtaaagttctagaacaggaaaaactaaactgtggtgaaaaaaatcagaacagtaattacttctggagaggaattgattaaaaagggtacagagtaactttctggggtgatggaaatatttaacttgattgtgatgtgagacacacaggtttatgcatctgtaaaaaacccattgaactatatacttaagatctgtccatttcattctttataaattgtacctcaataaaaatattaaataagcaaacagaataagggcaaagtttaacccttaaaataacttttacatagtccaaatgggtaaagcatatctagttcattatcaggccaggaatccagattcaagggtatctactctgaggaggccagtatgaggctttaaggatgtgcaatgaaattgatagaatgtgcctagccacatggttctaagagttttcacccaaaagacatgagaacaagatatcagggcctaggctgatccccaagaaaattactgtgagctccttgtgggaagacgcagagtttttcatctctgtaataccagtgcttgatacactaggagacttgcaagagtaaagtgagcagcaggacccagtcagctggctgtgatgatagatgtacaagacctgggtatttcagactctcaagtagaagagagccatggaagcaggctgggggctccaaatacgctactgccaattttgctaagacctattcaggtctttgctcaaatgacacctcctcagagaggccttccctgactacttcatctaaaataatcatccttacccccaccatcacactctgtcctcttaccatgctttattcttcttcatagcccttataatatgctacacagttatttgcttacctactctttgtttctagttactctttgtttctaggtacttttattctttgttatctatttactctttggtgtttaatataagcaccctaagagctgggactttatctgtttttctcactattgtatcttcaatacttaaaaaagtgcctggcacatagcagctgtttaataagtggctattaaaagtaacatattagtaagacttgctggctgaaattaaatagtccaggtctatccaagtgagagcagaatctatctcttacatggcataaaagtgtgattacttgtacctagagttatgatattatactcagaaacattggtctgtttcacaaaatgtgcccattgtaactaaaaaaagcaggcaatgatcaagaaaatgcaagtaaaggcctggctatcaggctgaattgagttgcctttagttgtagtttctttccatcacttgggctgtggagttcaaatagtctcaagagcaaagtcacaagctccaatttatctttatgatagaatgtgcagaaagtgctacttttctgtgtgttgacatctgtcagagctagtctcctttcattctaaaagagatcaatccttcatgtgatagaggattatcctctttgccacctataagctggctttgatccctcttatctcttttcctgaaagggtgtcaccattttaccatttctctagcaacctgcagggttccaaacaatgcactattttaatttaaatagagtcatacctactcagccactcacatatatggctattttagtggcttgagccttttcagattttctgaaatgaaatctccaaatatcagattcttaatttaggataataaaagaaggaggttatgctatcagagcaatacatagtgttatgctttttttccccctatcagagtcattccccaaacataataggtttagttttcttcacagtgggaacttgaatttgctcaacaaggaagtatatattgaggttcagccttactagcctcaatgccagtgtgagtcagttcatcttacttcagttcagcaaacatgtaatgaagtcttgctgcatgttattcaatgtgctagataaaaagattaaaaaacagatcaatgaacctttgccctcatgagaatattgtccataagtatgtaccaagcaattggagatatcatgagtaatataaatgagaacatgcagggtaccatgggtacaaacttcaaggagaaaatagtccataggttcaggaaatacttccctgcagaggcaatagttaagctgagacttgtaagataattggaaattagccatggacagactgaaaatggttatatttcccactaattgaccacatctttgattctagcatacatgctagcatacagtcatgccgaagcccattggctctttttcttaagtagataacaaagaactggatgaatagagaatattatgctttgaataagtttattcaatcatttaacaaatggttattaagtgcttactatgtgccagacactgtggtaggccctaagaataagtcagtaaggcagatgaggtgtttgagatcaaagaacttacatctaatggaaggtgaaagacaagaaaatatcaggtaccaataaatattgaaactgaagtagagaaagactgggggtttcctgttaattaggtaggaggtgacatttatgctgagacataaattataagaaggagccagacaagtgagtattcgggaaccaacatcccaggaagatgtagcatcaagggtaaaaacctaaggaagcaaacatttgtcaagctagaaggacaaataggccactatcactggagcatagtggacaagggaagagcgtagatagagatgaggtagacaggagtcagttcatgtgtagttttgtgaacttagggaagtattttggattttatgctaagtgggaagggaatcccttagaacttcactgtccaatatggtagcaactattcacatgtggacattgagcatttaatatgtggctagtcaaaattgacatgtaccaaagatttagtatggaaacaggaatgtaaaatgtctcacaaataattattttatggactacatattgaaatgacaatattttggatatactaggataaacaaaatatattagtattgggttaaccaaaattatctaattttacctgcttctctatactttaaaagtgtgggtattagaaagtttaaagttacattagtggcttatatttgtgttttacattacatttctgttggacaacactgccacagaaggtttcaagcaagtaagtgatatgatattatttctgatcttttgaagatcacaggggctgttgtacagagaaaggattggaagaggcaatactggaagcatgggaattaattaagagactttttcaacagttagaaaaagataatgctggcttgagctaaacagatagcagtgaagataataggaaaaggtacagcttatgatgtttatggtaggtagagttgattttatttccttatagtttggctctaagaagatgaggaaaaaagtttccaaagaaataaagctttggatttttagcttgaacaattgtgtatgtggtggtaccatttagtaagatgaaaaagagaggagagacagtttctgattgagggtagaaatcaagagttctgttttggagatattgagtttgagatacttgctagatatccaagttgatgagtcaagtaagaaattgaacataagactctgaaatttgggaagaggtcggagctgaagatataaatttaggattcctaagcatgtagctataaacaccatctgtgggaaaagaccatcacccagtgacagtctgtagagaaaagaagagggccaaggacagagtcctggggcatgatatcataaagagtttgaataaaaaaggagaatccaacaaaggagatagggaacatctggtgagttacaggttaaaaaggagtggtaacaaagaacacaagtatagaaagtgttactttaagaaggaagtggtcaactaacttatatggtgttgagaaatcaagtaaagtgaggacagagaatttctatttggaaacatagaggtcattggtgaccttggtgaagtatgggtggcagaaggcccattggagtgaaatgagggggaggatgtgagtgaggaagtggagacagtgaatgtgacaactttttcaagatttgccttgaaggaaagtagagaaatggggcagtagcaggagaagaatatggtaacaagggggaattttcctgtgtgtttgttttattaaaatagaacgtacaccagtctcagtggctcatgcctgtaatcttcacactttgtgaggctgaggtgggagggtcgcttgtgcccaggacttcgagaccatcctgggaaacatagtgaaacaccgtatttacaaaaaataaaaaatcaaccaggcatagtagcacacacctatagtcccagctgctcaggaggcaggagaattgcttgagcccaggaggtagaggctgcggtgagctatgattgcaccactgcactccagtctgggtgacagagtgagacccccatctcttaaaaagggttggagaaaatactagagtattttattattttatttatttttgagagagggtcttgccctcttatccaggctggagtgcagtggtgcaatcatagctcattataacctggactcctggactcaagggattttccctcttcaacctcccaagtagctgggactataggcatgtgccaccatgcctggctaacatttgtgttttgtagagacagtgggtctcactatgtgacccaggctggccccaaacctttggcttcaagtgatccttctacctcagcctcccaaagcactgggattacaggcatgaggcactgtgcccagcttagagtattttaaatgctgacagaatgatcccataggaggaggactgattacccaagagagaagggataattgcaggagtgccatcttgagaaatctagatgcagctctttaattggaacagggacacaccatccattgtaacaatagaaggcagagagtgtgccaagatactatgtgtacgtggagtgggagagtgtggggtaggagtgggaggacaggatagggagatgagctcttgcagctgacttgaagacagtggagaaggtgtgaaatattttttaaaagtgcagaagtaaacatactagggaagtgtaggaacatctctaggcaatgttgtgtgccatttgagagttgtagccatgcatttaaagcgaggccaatctgcacagttgtatggtctccaaaaactttctggaacttgaaggaggaactaaaagaagcggcttctaataaattctatagctaaggtcatcgaaggttacttattttttactttatttaggttgcctgatattcacttagtctggcctgctaaacatggacttttccagtatgcgtgggtgttacaacagaaacctttatgtttgcttacaggctcctcctttttctacacagtggtatgcatactgtgactacatgaaaaccagacatccaagtggagacggaaaaatttccccaaacttcctttagttctagtacacattctgacttgtgtatgtgataatacccaatgacattttcccctatgtacaaggcaaacctttaattttattcctggtgtttccaatttcttacttagtactttccatttaatctttcacttcaacattattacccctctcactcataacatttctttttttttttctgcataagacttttctaatttgtctgctgtttctaattcttttaagtatctttgttcctctatagctcctctgtccttcctcaacttctttttcctctttcatttccttctcaaagcctttatagattcaatccctagcaaatcatatatgggtatattttcattgtgctattcctttcatatggaatatattctctcaacaaggtacttactagtatttcttaaaactttctttttgcaaattattttcttgagctagcctaagctccagaggaaggacatctgttactactatggaattgtaattagaagtctactttccatttatagctctaaattttaaaaaatcccttgaggttagtgacttaacagaaaatagagaattgttattggggatttgggacagtataaagacaagtacaagctggagatctttcatgggtggcactgggagtttggggcctgtttgccctctgctaagatgatatggaccctacctgagattattatggcagtctaaaagtactgattgtgctgtcatccatctccagactcactgttggtaccttattttattcatgttcaaaaatggtattatgattccttcactgaccctggcttttttctaaagaaacactcatgtgctcaataattgcattgactaaagtacaaaataaaataaaatttgaattagtaaaggttttaaaacactttaaaaaggtctaatctctggtactttttaaacattctaaaaattaaaggttacattaaaatggtgcctgttgctgaaaacattacactagtcctgatgtgttatatgaagtccatagaactacaggttggttagaattaaattatagttattaaagacaagaatctattagtattgaattccagatataatgagaattttggcttgctgccttcctgccttcagcctccataaatggggcattttaacccctagcattgtccaacacccaaagatcaatctggttcctaatcagaggaaatattaatagaaaggtccactggagtccttagccttgcagtaagtcatccttcttctattctgcctcttgcttttccttgtgaccaaattcctgctttgtactgaaatttaagcaaatgggttcctatttttcgtttaccaccacttgctttccttatcttgtgcctgacaccctctggaactgccagctaaccttttggtgccaggttaccatagcatttggtcctattgaccccttaagatgtcttacgttgcctaatgttggatcttcttgatgccaactacctatctgattagacttcctaacattgcctctgctatgatttgcacagaatacctgtagtattcagaggagtatatctagtctccaggattctgaatatctcctctctggtctattctacagagagtcattctcttttggccctttgctatagttaatcaatgtaatcatttacaaaggaactgagttcttttgcttcattcagtaaaaaataagcaaatcaagatgaaaaagctggccttcaggaggctcaacctgctttatcattgaggtctgtcttccctgtatttgaagctttttaaataaaccattctaaccagaagagagaagatgaaacagttaaagctcaaatcaaacagactcaagaatatttaaataactgctttctaagggaggaaaccaaagcaaaggcattaggagagtgttgattcttagtagaataaacttcatgggtaaattgggcatcttttaaagtgaagctctgtgactatagttctaaccatgggatcttaatagatggatacaccaagcaatgtgacaaggacatggtaaagggctttcctattacacagtaggtaaactcaggggagaaaaagcagaagcaattcataggctcaggtttgcatatcaaaagaatgaaagatgatgtgaaaagtgagggtacttctgaagtgaacagaaatcaaaatctagttaggttggtaattgggaccaaagtgaaagcaaagggggtaaaaataaaagtgatgagtttctgcagaacgaatttcggaagattgcagcaagagttgtgtgaaattgaatgagtgcaagcaggaaatggcacagaatagaaatgcaaaagcattaaacctccttcaatgggatcctaagagttctgcctgttatccaccaataaaaataataggagataaagagcccttctatatctgaactgctatatacaaaaagcatggtagaacaaagggagagctattcaaggaataaaacatcaagtttacagggagacaggaaaatataacagaacaagtttgagtgtaaaataaagataagcctgacaaagaaggagaatgaaaagaagagctaacatacatatgatgccttgaaagcccatccatttcataattttggtttttgaatgataggtagaaatgaactccacctaaatagcacttttgggatctggattgtgtcctacatattttgaaatttctccttgatttggggaatgaagtcttggaatcctttttgaagtcacgaaagaattgaatgttttaaatcttataaacgatggtccatgaattctctgggaaagaaaatcttcaactttattttcataatggtggcatttatattgtttacatacaataccttccttcctagaatgaggaatgtcagtagccattatcccaacccccctaatatacccccacataccaaagtcattatgtgttaatcctataggaaatgggcaatttttctgaagagattctaaattaaggccttttaaaatagagtattcttaaggagtaaaaatggcttaaagaaaattgatctgtgacgctgtagaagattcacagtttcagtgatctaattctgtaaacaccatcataatattatgtcatgcataatttattattgaaatcctgtgtgagaattctaaggttttttcatgtaccagagagttgctgagattggtaaagaaatgggttaactgtttaagataatggtattactctggatgggaggatgcaatcaatggggtttctaaatattccttttttttcaccattgtggaggtatttatatgtaatagatttgcttttacatcagtgttgaggagggaaaccacccaggatatgcttatattatattccttcccctttagtctctcccaaatatgcaatgcacagctgtttttaaatcaccattcagcatgtcattcaatttttattactctacattattataagtatccagtaaaaataagagtgaaatctgatgtggcttctaaaatcaatgagctatcatagaattgacaaaaattttggttgaaatttagagtacttaattatcacccaaaatacagatgctgaatttcatccttgctccagatgcttcttaaaatatcaaatgtttgagatctttcatttatagatttggttttacaggtgaacacaccaaagtttagcaatttttcacatcatatttatgttatatcctctctctcacgtgcatgtgcatgcctccccctcccgaaaccgagggttatagaaagataattactttttttatcctctgtgtatttttgcataattttcttccccatgttttgatttctctggagcaagtttctattagtgctgtcagtctgtaactgggccacttagtaagagtgggagaaggagacttttttcttctgtattacatcttccatgtgattctgcaactctgttttagtcatctgtccattcacgcttgttactcatgttatttttctcttcgtttctgtcttccccattccccacctccaggccccacacactcagatccatacttgcagaggtcattcctcctctcttccatgagaaataataattgacattaaagtagctaatgtttattgcgtgcttgctatgtgccagacatcattctcagaactttgcaaatattatttcatctaatctatgtaattggcttttctccaattttatttcaaaatttcaagaaggttatagaaatgtaaggcaacaaaaagggaaaaatcagacatgtcactcctgagatttccttttccagggcttgaagaatccttacacataaaagatgtttatagttccagatcatctatccaccaccagaaagggcagcccattcactatggatgtctcgatatcctgttttcaatacacacatctctgcttgtgaggcagttttaatgctccaagtcatcagaaaaggagagtgacttggtttcaaatgatgagtgaccaagataagcagtctgaagagtgggttaaaataaagtaaaatgctttgacaggaagaggtcaaagctggcagttgtgttttgaaatcttattaaaagaggctgacatcactaatatgaaagaaacttctttcttgttttttaaaacttttacgatgcatgaggtagacttctttttcaaaaaaaattcccatcttgagtccttgcaatatacaggaaacatgcagttaatgaaatgagaacaggttgaatttgtgataaaaattggtgtctggctctctgagttcagcaatataatttcatttttattagagtcttacctatctttaacattgaaaattatgctaagaatgaaaattttgaggagtatgtaccttacaaggttaagaaatataattttatttttatcaaattatgctcacattttgtgttaaaaattcactgaacgatgaaaatgttgagagaccctgaatcctattttcacctatttttaataaggatcttgtggtacctcgatactgatgtattactacaatttgccttaaaatggtgttcaccatacccctcttttacatgttaagaagtttcatctgcacaatgtgagatgatgttatctaaattcaattcacacatttggttcaaggttaaaatatccccgtccctcagtgaggtgggggaggaaaactgctttgtttaatgttaatggaaaaatttcacctgtgaaataatcttcaaactgtgaaattaaatcccccacgtatgttctatgctcatgccttcagccttcctccctctacaccgatctaccctgtctctggattcttttaagaaagtatttgaataccatgttgcatagagggcaaatcacaaaatctgggcaagaaggattatttatatgacttttgtgaaacctattccctctaaatattgactctccaactagattgtaagtttaatgaggagaagaacaaagattttaccttcctgtagcctcctacaatgcttcgtatagggtagtgcttaataaatacttaatgatattgatctgaaatagccagtttagttggtcagtaacaacccagaccacttaataacttgattgcctataaacatagatatatctatgcaccatggaccaacaacgtgggcatcacctgggagctcataaatgcagaatctcaggcctcacgccagacttacttaaccacgatgtgcatttgaataagttctccctgtgatttgtatgcacattaatgtctgtgaagcactgctccattgcattaaggattaggcactttaccaccatgaacatttctttctttctcttatatttcttcttgtatgtacctctttccccctcttctgcttatattataggcctactagttccctctacctttttagttcaccatgtatttccaagttttgtgaagactagtcctcacaaaaattctctgaactcttcataaagaatagtcaatatctagtcatttctacttcctcagctagttttgttaaaattatacaaacttaaataacaggggagaatttttagccttctcagccttatgttccctagaaaaatgttacctatagtttcgttcagaaatcatagattacaatattattcttttaaagtaatgagcagagttttggtagggaaataaactctccaaaagtaataatttctgattctcatagctatggaatcttacgttttgtatagataaggggcaaagcaagtaagggaaattcgttctgtgatttcagacacatgggggatttttatctttacctaatgtaggtttttgctgtgttttttctctgtaaaagccatggtgcttcaaaatttaatgagattatatgatgtattatcatcatttgcaaatgcaattatcagctgcgattaatcctgctaattccgagaaagccatattgggtgttatttttcccctcctcgtgggtatttgtgttgctcttactttatgaactttgatcagaactactgcagaaaggagggggaaagcaaatgggatgtatgaaataaggctttttatgactggttttatgtagacatttatgagtgcctaggaggaaacatctcacaaaaattcacttcacctggagagaaaacaatgtaaatattagtatatagatataatatatatattactaacaacttgtagaagaaaaaataatactggatatttcttgttgaattcaaacatatgttttattaatttgaagcaacatcagctccttgtatgtaactttctcaggatattcatttaggcattacatgtcaaggaagatgcgaatgactaatcctagagttctgagctctactgaagaaatcaaatggtaagtctcaggcaattactgtatgcatttgagagtaaatttttatcccaccagattacagatgagttcatcaattattgagcacttaagctcagctggaatcctatgaactactgtttccaagaattaagcaagaacacattttgagattgtgtcactgttgggttgcagttgagacaccttgctattaccatcatctctaccaccacataggtaggataactgcactccttgttagatcctttaaggcttgagatgagtgggttagaattaggacctacaattattaaatttcaatctaccagtggttttaactcttccttggtcaattgtgagaacaatcattgcaattatagtcccctctcaaggggctggcagctgcctttcttattccccacttgtgatttacttttataactgtgtttaatgcctgccaacaacttatatccccaactcttccattagtgaaagtcttggtaaggtgctgaagcagatataaagataagtgagggggataatgaaactgaaagaaatgaagttacttgtctttgattgcaaaatataatgggagaactatgactaatgagaggtgctcagttatttattgaacaaacagttcttcagacttgggggaaatttaaaagaataattcttcatcagaaacagctttggaatgctcatatatatagtcctacattcttattttgtagatgtggaaactatgtcccaaaccatgtgatttgtccagaactaaactaaacctgggtcatctgatacaagccagtgctgtttttccagcataatatctcaataaaattccataggccagctgtatctacaactatttggctcaatatcgaagtataacttctttgggctgaagaaggaaactccatcctaatttaaatcctagtgatataaataggatttaggatttaaattgggtggcaacagagcctgacaatccttaaggcttcttccaatgctaagattctagacataaaatccaccagtgtcaaaggtaaaaatgattcatgctaagcacagtgccatacacactagagctctgcgcctaccttttaaggaagatggaacattcaattactacataatcatgtttttcttgaaatgtactttttaataagggcaattctgtaagagtcactgtgggaaagtgaactgataatgtagatatactacaaagatctagtggtgagatcagaaatgatccagaaacctggagcaagtgagaagagaaatgccaagaagagaaaagtctatagtaagaaactacaaaggcaaagtagaaaaattcagaatcgttttagcactataaacactatacattgacgtggaattggttacttactattgagaagagaattgccaagggcaatactatctgtcttagtctgttttcagctgctacaaccgtatactacagattgagtaacttataaagaaaacaagtttattttggctcacagttatggaggctgggaaatccaagagcataatgttggcatctagtgaggatcatcctatagcagaaggtggaagggtgagagggtgaaagaacataatacagaggaaaagggagccaaacttctgtgctaactacactcactcccacaataatggtattaattcatgcatgaggatgatgaagatggagccttcatggcccagtcacctcccacatcttaacattgccatgatggcaacccagctttaacatgagtttttaagtgaacattcaaactataacacaactctttcaaagtgacgagtatactttctaatcaaaaagagaatttttttttcagtttcatataccataggctatttttcaatgtatatgtcattatacaaaaacaagaaatggggaaaggatttcctatttaataaatggtgctgggaaaactggctagccatatgtagaaagctgaaactggatcccttccttacaccttatacaaaaattaattcaagatggattaaagacttacatgttagacctaaaaccataaaaaccctagaggaaaacctaggcaataccattcaggatataggcatgggcaaggacttcatgtctaaaacaccaaaagtaatggcaacaaaagccaaaatagacaaatgggatctatttaaactaaagagcttctgcacagcaaagaaactaccatcagagtgaacaggcagcctacagaatgggagaaaatgtttgcaatctacccatctgacaaagggctaatatccagaatctacaaagaactcaaacaaatttacaagaaaaaaaccaaccccatcaaaaagtgggtgaaggatattagcagacacttctcaaaagaagacatttatgcagccaacaaacacatgaaaaactgctcatcatcactggtcatcagagaaatgcaaatcaaaaccacaatgagataccatctcacaccagttagaatggcgagtattaaaaagtcaggaaacaacaggtgctggagaggatgtggagaaataggaatgcttttacactgttggtgggagtgtaaattagttcaaccattgtggaagacagtgtgacgattcctcaatgatctagaactagaaataccatttgacccagcaatcccgttactgggtatgtacccaaaggattataaatcattctgctataaagacacatgcacacatatgtttattgcagcactattcacaatagcaaagacttggaaccaacccaaatgtccaacaatgatagactggattaagaaaatgtggcacatatacaccatggaatactatgcagccataaaaaaggatgagttcatgtcctttgtagggacatggatgaagctggaaaccatcattctcagcaaactatcgcaaggacaaaaaaccaaacaccacatgttgtcactcataggtgggaattgaacaatgagaacacatggacacaggaaggggaacatcacacaccagggcctgttttggggtggggggaggggggcgagatagcattaggagatatacctaatgctaaatgacgagttaatgggtgcagcacaccaacatggcacatgtatacatatgtaactaacctgcacattgtgcacatgtaccctaaaacttaaagtataataataataaaatttaaaaaaaagaaaatagtgtttttatctctttgtaatactgttttgttaggtgtaactttctaacactgtgtgtttaatggagtattttcctctcagtatgtgtgacttcttatgattctttgcagaaatctctacctactaccttaaagaagcttagctttgagatccacaaactctctggaaaataatctgtacataactttttaattaatttttttatttttaaaatttactgtataatatttaatcatttatcttgtgtctgtaagggttttgtattatcttgtgaaatgatttttgtcatcttttatgtagagttttgtttttgtttttagtcaaaccattttaaaagcaggtagggctcaagagtaaataaacaattgcatatttgaattgctcccctgaaagttagggtatattctattaacccagaaatgccaatctgacatagtgcaaatagaagtttttcccaaaatagtgcttggcaccttggtaatgtgcacatttcctcctattttattacctactgtggtgcaagggtttcactctcattttgggatggactctgaatgtttcatttgcatgccttttatggtggtaacagacgataatttttttacagatacagttttgctttttatcatcatttgtttctcttctacaagacttttaagttggctagttacagactatctgcttcttttaatgtttatatattagaaggtttaatagaagaaatagaatgtcactgtcgtaattggccatttcccccaccttaatagcattccagagcaaagtttctttagatagcaatgctaagcaaaatgcatttgtgcagcttcatctttgattcacccattcttataccatcatgaatgtttttgaaggtctttgccaaataatcttgccaaaggctctaggcctgctgcttggtatttgctgcacggactgggcctgaggaaaggtgagctaaaaagaaattagctgaaataatgagataattctagaacactagaaaatttagaattaacaaagttttatggtgttggataagtcccagcttcaaagcaatttctgaccatagcatttaaattatttcttaaaaaaatctcaatttatttacagctccatagtagagactataggaagtagagagactctgaggataagttattctcctgctgatgtgggccattgccacaggatgggtggagaggggacaatattgaaaacttaagagtaagctcttgaatgaaagttaggggtaaaatttacttggaacttatggcctttggttaagagagtggacttgactccaaatcctggctctgtcctttactagttgtgtgactttgggcaatttacttaacttctataagcctgcttcctcatatgtaaaggtggtaccaacaattcaattatataaatatattatcaaacagtgaaatacctgctatgtattaaatgttaataaatggaaaatggcattaatatttaattctcaatatttattatgattcccccaggtttctcctttcattaaaatatctctgaaaaatgtttcagcttttcttcttgctttttagttgcttctttaaaaacaaaatttattgaggcataacttatataccataaaaaccacccattttattgtatagttaaatgatttttagtaaatttgccaagtttttcaaccataaccataaaccagttagagcattttaatcacagctagtccttggcatccactgtccactttctggccctatggatttgcatattctggtcaattcatgtaagttgaatcaaataatatttggcttatttcacttatcaagatgttagaaaggttcatcaatgtgtagcatgaatcagtacttcgttcctttttatagttgaataatattccattttgtggatataccatattttgtttatccatttattagttgatgggcatgtgggtttgtttccattttttggctaatgatgctgctatgaacatttgtgtgctagtccttgtgtggatatacatgttcttatctcttgggtatatatctaggagtggaattgtgatggtattaatattaatagtagtatttactactatttcataattcacctgacaattagacagttacatagattcctatggcaaaacaaagtaagtaacttcagatgccccttaaaggagcattcctcaaaacaacataaatcagttagctcttaaaaaaattaaaagattcctatgggaaccatctttaatcacaggatagatcatttaaagactttttgcacatcacttttgggagaattcaaaagataatgttttggttttcaaacacctcaagttttgtcttgtctacacttttgtaagatacccatctgaatgtcaataggacatatgatgcctcagaaaggcaaagatttaccagtgattaatacagggtataaataatggtgtctgaatctgtgcatcaaagcaaggaagatagatcttgtgacatccctaccttttttccctgggatgcacaaatcagtccttaatagaagggggagagaggatgaatgctttcatgcctgtcaatggaatgaaatacaattctatggcaaggaaggatacacagtggttcatgcacagcaaagacatcagggctttctaggttttcagataagggaccatattcagatggccctcactttaagcaataattgagttcttgaaaataaatcaatgcagatattgcgggcctattattaatgtgtattttagtagcaactgggtgctagtttgtagaactagtcctcaaagcacaggcaaggctaactttctctttctctctctctctctctctctctctctctctctctctctctctctctcacacacacacacacacacacacacacacagagagagagagagagaataataaaatgcaaaattatcaagttctaatttatgttacaataaaatttcaacaaagggtaagttaggttgcagcactcaggttaattggtcaatgaagtcagattttttccattttcttttattgtagtttctctgctttataatcatttccctacccacatcttttataaaaaggaaatgaggtattctgatttgatctctggtggtaaaactcatttatcagtgtgccaagtgaaaaggatttagtaaggttagatggccgttgagcagggtttctcaaagtgtggccaggtaactttcttcatccaaatatccatttttatcaggctctctaggtaactgtgatgcacactggtttgggaacactgtagtggagtcttgatattcttatatttgctttacttccaactgtttattaaatgtaacaggtgggaagtaaaccaatgggatattgtaagctataattaaagaaaagagaagagagtatatgtgtgagaggtcctatggcttccatcagagtcttggacaactctgttaccccagaaaagattaagaactgttattggaaaccttgagtgagatctctggcttgagttccattccttttgtgcttctagctatgccaacagaaccgcagcatcaaagagttgcatcctcagggtttattatcatgatggaagggagcagatatcctgatactgttccacaagtactagagagggatgtagaggaactgcattgaaagaggtagcgatactctggtaggcaggaagtataaggtcttcatactttctgcctaccagagacagaggtataatgtcaccaggatcctagagtagaaacatcctagattgtagagggcaagagagttttagtccttgcttgctggtatgggtgaggaaactaaagaggcttctggagagcagtgctccagccctttgtcctgacgattctccttctctatgaagaaatcatctaatttttaaatttccttcccttgaaatacctaatttcttgcccttctgcctactgaaaatcctccttattatccaaagcctaggtctagccttatctcctccacaaactttttcacgatgactctttttccacattgatctctttcttctattgtgttttatagcatataatcagtggctcagtacatattgccttacataaaaagtgttacatgtatttgttttatctccacaattggctcataagctactggtaaacagggcataactgccctgactcctttgatatgaatcaacaaatctagcattataagcaccaggcacatagtgcgtattcagtgacttgaactgaagtacctggaatgtggatggcttatgattcttttttatatcatgagtataagtggagagacaagtagaataaatgagaaaggatgatttcttaaggttttttttagcccttgatgttataaaaatatttttccccagggaacatagcttcactttaatttattttttattgttacataatatttgcacatatttatggagtacatgtgatgttttgtggcatgcatagaatgtgtaatgattataattctcttcttaaaactgtatatgttccaagctaaggttctctttctttcttttccttttctatatttaagttctgagatacatgtgcagaacgttgaggtttgttacataggtatacatgtgccatggtggtatgctgcacccatcgacccgtcatctacagtaggtatttctcctaatgctatccctcccctagccccacaaccccccgacaggccctggtgtatgatgttcccctctctgtgtccatgtgttctcattgttcaactcccacttatgagtgagaacatgcagtgtttggttttctgttcttgtgttagtttgctgagaatgatgttttccagcttcatccatatgcctgcaaagggcatgaactaatccttttttatggctgcatagtattccatggtgtatatgtgccacattttctttatccagtctatcattgatgggcatttgggttggttccaagtctttgctactgtgaacagtgccacaataaacatatgggtgcgtgtgtctttatagtagaatgatttataataccttgggcacatgcccagtactgcgattgctgggtcaaatggtatttctggttctagatccttgaggaattgccacactctcttccacaatggttgaactaatttacactcccaccagtagtgtaaaagccttcctatttctccacatcctctctagcatctgttgtttcctgactttttaatgattgccattctaattggcatgagatagtatctcattgtggttttgatttgcatttccctaatgaccagtgataatgagctttttttaatatgtttcttggttacataaatgtcatcttttgagaagtgtctgttcatatcttttgcctactttttgatggggttttttttttcttgtaaatttgtttaagttatttgtgggttctagatattagccctttgtcagatggatagattgcaaaaattttctcccattctgtaggttgcctgttcaatctgatgatagtatcttttgctgtgcaggagctctttagtttaattagatcccgtttgtgaattttggcttttgttgccatactgctttcggtgttttagtcatgaagtctttgcctatgcctgtgtcctgaatggtattgcctaggttttcttctagggtttttatggttttaggtcttacatttaagtcttcaatccatcttgagttaatttttgtataaggcgtaaagaagagaactagtttcagctttgtgcctatggctagccagttttcccaacaccatttattaaataaggaatcctttccccattgcttatttttgtcaggtttgtcaaagatcagatggttgtagatgtgtggtattatttctgagggctctgttctgttccatttgtctgtatatctgttttggtaccagtactatgctattttggttactatagccttgtagtattgtttgaagtcaggtagcatgatacctccagctttgttctttttgcttaggattgtcttggctatgcgggctctttttgattccatatgaaatttaaagcagttttttccaattctgtgaagaaagtcagtgttagcttgatggggatagcattgaatctataaattactttgatcagtatggccattttcatgatattgattcttcctatccatgagcatggaatgtttttccatttgtttgtgtcctctcttatgtccttgagcagtggtttgtaattctccttgaagaggtccttcacatcccttgtaagttggattcctaggtattttattctctttgtagcaattgtgaatgggagttcactcatgatctggctctctgtttgtctgttattggtgtataggaatgcttgtgatttttgcacattgatttattatcctgagagtttgctgaagttgctcatcaggttaaggagattttgggctgagacaatggggttttctaaatatgcaatcatgttatctggaaacagagacaatttgacttcctcttttcctgattgaataccctttatttctttctcttgcctgattgccctagccagaacatccaatattatgttgaataggagtggtaagagagggcatccttgccttctgccagttttcaaagggaatgcttccagtttttgcccattcagtatgacattgcctgtgggtttgtcatagatagctcttattattttgagatacattccatgaatacctagtatattgagaatttttagcatgaagggctgttgaattttgtcaaatgccttttctgcatctatcgagataatcatatattttttgtctttggttctgtttatgtgatggattatatttattgatttgtgtatgttgaactagccttacatcccagggatgaagccaacttgatcgtggtggataagcttttcgatgtgctgctggatttagtttgccagtattttattgaggatttttgcatcaatgttcatcatggatattgacctgaaattttcttcttttgttgtctctctgccaggttttggtatcaggatgatgctggcctcataaaatgagttagggaggattctctctctttctgttgtttggaatagtttcagaaggaatggtaccagctcctatttgtacctcagatagaatttggctgtgaatctgtccggtcctggacattttttggttggtaggctattagttactgcctcagtttcagaaattgttattcatctattcagggatttgacttcttccttgggagagtgtatgtgtccaggaattttttcatttcttctagattttccagtttatttgcgtagaggtgtttatagtattctctgatggtagtttgtatctctctgggatcagtggtgatatcccctttatcatttgtattgtgtctatttgattcttctttcttttcttctttattagtctgtctagtggtctatctatttgttgatctttaaaaaaaaccagctgctggatccattgatttttggaaagatttttgtgtctatctccttcagttctgctctgatcttagttatttaaggattgtaggacaaatgcttgtctatcacaagaaaacatttttattaactgaaaattaactgtagctttaataaatttgaactcggagattttaaaaaaatacttatgcaagtgagtcagattttgtttttaaggggaaggagtgattgtccctcaaaggaaaattattgaccacttctatcacacttttatgtttctgaattgttctttgagagagaatagcttttaaaaacatcaaaaactctagatcttaacaatctaaggacccaaaacctttcagtgtacaattatagtattattgaaaaatagagaagaatgcaaagaggttgcataattgagtataataaagagtaacataatagagagtggagagggagtaagagctgagtatgagcaaaatagaactagtaggtgagaggccatgggcaagtagaaacatgtctagcaataaaagtaaaaagaagaaaaaaccataaaatagaaaacaaaggtaagaggaagactgtttacggtaggaagtttggaaaaaagtgactaagagcaaaaacattgctgacaccagtgcattgcacatgttccagcaaatagtggactgcaattaacaaagctgattctcacctgttcttaggtaagctactgaatgcaacacaaagggttactaagagaggcctcttgaccaaaagtggttccccccactacgtgtgcctggaattcccacaattagactctttctttgagttaaggcttggcattttcagaagtcatctcttaaagggcaatttaaatagactggaagggttaaaatacatagagctttaatatctgctatgaactcttcatagattggtctttcagaatacttttaaatgtgccagctacccaagaggagcaaagcactgcatgatctgaactgtctagcctcatctcttcctaatccctaccttcttattacactctagccatgaatgaacacatcatggttatttgttatcctgtgactttttatgtgcattccttcgctcagtatgccttcctcctacctttctatcaactgcagctcaaaaagcatctcctctgtgaagcctcacttcagttgccttctcttgtacttccatagcaatttacatatgccttactttgagcagtattgttgatgtattataaatagtggtttcagtatttgtgttcctctctagaccacagtttcatatccataaaccaaactatgcttattccataatcacacgaatcacctagtaaggcagtactgtgtttaacatagtttaacctctctgcacctcagttttgtcatttaaaaaccagggataacaacaacgataacaaatagtattattgagagatttaaataaaataatgcatgcaagtgatattaccttagtccattagatatttcaagcctaaatatatggaaaaatacgaaagaaaggagttaggaaatttgaatactatttggggttcctgcactaactcacttttcattcccagcaaattaccaaggcccttgtttttttctatttccaacacgcactgccaagatattgatctcttacattccctatgtaactattgagtttaaatagaaagagtaacctaaaaggagattggagcctctcagagtgagatagctaagaaataccaggtgttgctatggctgagaaattgccagtcatctttatcacagttgttgccaattcttgagggcttacttataatgtgtccatgcactaggccaagtattttgtttatggttctctatttttagtcaattataaaccaaggttggtttgtcactgggcaggcatgcaatgggagtatttaagtacagaattgagtagcctgggagaatatggctgtattctttagtagcatgttttgctttcttgcagaatatattttttcttttcttcctttgtttacagaaatctgaagaaaaccataccttcaactattgtgtgaagtttatgtcatatctagaagctagttcatggaaaaagctacaaaaattgaaacactagctctataaaaatcagccataagtgccttcttactggaatgagattactaaggtataattagtagtaacacatatattagcaattagaaagtcagtagaattgaggcatgaacaaaagaccatctgttatgagagaaatatccaaccctcataatcagtaggtaatagatactctgttcttgaaacataacagttaaaggataacaaaggaatgtcttattgcttgctaaaaaatactcttgggaattccccaaaaagagctacactgtaatagtagaagttctgatttttaaaaattgagctagaaataaatctggcaacaatttttctctaaccttatcctgatgttcagggactccctcaaaagtaattatagaactcaactgttcatttttaactaaagtgatttctggttatgattaaaataaactttgaatttaaaatctctctaactcatatataaaattcatataaaggatatttggtttgcctcctgaatataggaatcataagagaccctggagatcaggggaaaggtcccagattttggagccaaagaaacctgaaacctgagtattaaagttctgccttacccatctcatgtgcaatgtgtggccctaggaactgattgtgtttttgttgttgttgtttttagatggggtttccctgttactcaggctggagtgcagtggctcaaactattgtgctcaggtgattcttctgcctcagcctcctgagcagctagaactgcaggtgtgtgccactacagccagctatttttaaaattttttgtagagattggtgggggggagggtctcaccatgtttcctaggctagtcttgaactcctggcctcaaaagattctttcatctctgcctccaaaagagctaggattataggcgtgtatcactgggcccgacctaggcagtgtcttaacctcgttaaaacttaatttccttctctgtaaaatggaagtaataatagttcctagctcagagtgttattgtaagttttaaaggaaatagtgcagtcaagcatttagcagcttctgctgctgttgttgtgacagacagaattctggacagggtggaccagggatttacattgaatgacagtctgatgtctttatttcatggagacagattggtctagcatctgtaaagtgaggattcataacattagtacttactacataaggctatgaaaatgcaaattgattatatatgtaaaacctgcatagtgcctggcatgtatgtagtaagggctcaatgaatgttagaaactattgttatgttttggcacagtgtctggcacctaggctctcaatatgtgttagctcttattgctatctctgggaatctagtaattatcaggtgacagagatgccccagcattgtctagtgttttgggaaaccccacacttctcatggacttgaacagtaactcagcaaggtggacagaggactgaaaaaataaatgacacctcttatataatgtatattagataagggagaatgaagactttatgctaaattaggtgactaggcatacgtttaaagatattccatccctgctttagcatatccatttattttcacataatttatcatggttatttgaacagtgtcagcaggtttctaagacaaagccacactgcaaaatcagttggcatctggtttctcttcagttctaatctgattaccagatctaacttaaggagatagacttgaattatttccagagaatccatgtaaacattccagaaatcccttgagatgtacttaagtgaaagttctggtttgcatccaattgtaatgcaaggtcagggtctccaacacaaatgtcatttcaatcttttagtgattattctttcagtaggagcatggatattagttctagggtgctgtggctctagggccatctgaagggctgtgtgggtcagggaaaattacactgaggaattgtcctacatatttttatctccatgaaatcaggttaaaagaagaacgaaaagagatcagtgagatggagggaaagcccattcttaggtatgctgctcggagtttatgggtggccgtggggcttatatacatataagctcaagaattatagaccgctctgctgtttgcctcactgggtcacttctcagtccatcagcagtgcaattcttcccaaaacaccagccagcactgacaacatctctgccctgagtaattatttagtgtacaggggaattctcaggatatcgattgtttcaggagactcagatatctatgatgttaacccattttcatttgccataactatgcctactctattaagtttacttgttctttaggtgtttttgattatgactaggattggactgcccaaaacaatacgtgggtatttgcctatgataagctaacttgaaccttcttatttcttccctttctttctgccttcctttttaccccatttattcaaatagtaaataatatttgagcatatgcttaccatatgacagaaaggcagaatatagagctggagatacataatggcaatcaatgcatgcatagcccttgcccttagacaatacatttagggtgtgagcattcacatcaaccatataaattgtaggaattggtaagtgtatggaggtaatgcttaatgtatacttctgaaccctctgtatattgttcttatccttcataagatttatgtcagttctcatttcccatgagaaaaattttaaaaatataaagaaaatatagaattagatgcagcatcccatacattatgtatatacatatatacacacattatatatatctatagataaatttattttttaacatacagatttgaaatatttatagactaagtttactgaaactcttgtaaagctaggcagcctagcacttagaaggatgaggggatgtaagaaatgtgactgtttccaaacaattctcttattctcattttgctctcagagaaaataaagaagaatcagattgtataatttctgaagattctgctattttatttttaagtgcctcttttctaaaggattcacagtcacacgtattaaatgacttaaagacacatccttctctcctctgtctcaatgaatagtttggtcaagaaccagaagaagtttaaaacttaacactctaggttactgaggaagtttgaagagtcttttcttggatatcccaggctccttgactttcagctctgtgatttttcatgggtgctaaccacacagatagttggcatgagactgtcttgttaaataggatgtgagagacattgaaagcttcccccaccagcctcctcagaggtagagatgccctcccctattacagtggctcctttggggcctctggaagactgtatttaaatttcaaatatctgctcttagagggctgcgttacactgttctgtctcatggaggaaatggttagtgggcaagcagattttctcttgtggagaatggctcagaaagggtccaaaacctgtgaaatgccttcaggtggatttctacagtttaagatcggaagattctaaggctgctgaatcttggtacttcttgatagcagctgtgaagcagagatgtatatacatgaaaatgaaaaacataaggcactagatgaaagagaaattggtgtagaaaggagatagaatgttagtgacctaatataacccttccctattttataattttgtcggtctgacactgccttcctgtaaagagctaatcacaatataaggattagcattctcaagttatctgctccacttgactgtgagtcctttgaaagtaggaaccccaattttagttgctttgtatcacttgctcctaggtcttgcctgatatataataaatgttcagcaaatgctgggttaaaaaaaaaaggaatgtcatttcaggggtctgaaactttcgaatcttctctcacattctttattttggccaaaggtcttatcagatgtcttccctgatcaccctatctaaaattacaccatcgtgctccagcctcttgttttattttgctatctagcagttataactatctgaagttatactatatgattaattcttattctgtttattatctgtcttctctgatataatctaatactcttaatggcagaaaccttgtgtacgtgtgtactgctgcatctccagtacctagaacagtgtccaacacaaaatagcatctcaaaaaatatttttgaagagtgtgccaagagcttgaggatgttcttccaagtggttttgctgcattaatttttgttatatttggattccaaataatatcagatatgtttggaagataatattaaacatagatgcttagggaaagaaaaatctcttttaattctaggtttaattgctccaaatagtcaataaagtggtaagaagaataaaaaagtagaatagacatttaataagaaagccttttggcaacataagtatattatattttactcttatcggggcaggtggtttttgtaagtacttgtttatttcaaaagggtggtattatttgaattaattcactagttaaaattctcagagcctaaaagtgattttttccatttcaattatctttattttctaaaatattttcaaagacagtggcttcatgctgaggatagaggatgtagttgaagaactgtatgtagctcatgattaactgaaactctgtgaaatgagcctcttcatgtatttggcaattattatacttctttaaaatatgattcaaaagatagaaataatattttacaacataaagatcatttgtcttgttttattgtatgttctgcatctaacagttcacttaacgagaatagtcccttgtgtcaaattcaaattctcatttggcacttttcctatacaaattgctttctgcccatcatacaattttgctttgaagcattctggcaatgggtgatatagggagacttagaaccaaattctgcttttaatatggaactggaaacagtcctttcatcttccaggtgatctttatatcatatgtatacaacactttctttttcaaaagtctaccctctggattcagctatgataactatcgagcacagataattaagaacttaggctcttacaatgtttaaagtagcccaagagagcatagaagttctgttcttagaggttcagaaacaggtgaggactgatggtaacaaaggttgtgaaaattcgacattgctggttttgttgtttagggcaagtggcagtctctgaaatatttactggttgagcagagaatatttgttatacttctccaatcaaaagagaaaagaggaattgttaccaataactgaaagcttttacaactctctaacttccttataaggtatagcttctgggagatgtgttgggcagacttcagtaaaagaagatagcatgtttatgttgacagagatgggtcagttacagatttgtccagggattctcattagttgttatctttctgttaacttctttccaacttctgatgtatgagtacagttgttacagtgtttttcacaattttcttttgttttcttgattaattttttttttttggatagaaatacattttctatgcctacttatagcaagtcaggctttgtctttctgaaccattttctctgtggtgacatttggaaatgaacttacaacgttttccactgtgtattgtagggggattattatagacaaaaactcttttaagatacctttttttgttcctgcttagaactattatcagtttcacaaactctttagtcttcttgtcttaggtaggatcaaggaagaaaagagggaagtttcaaaatactttttctagttctccctgcttattatcacaggagaaagctaaaactttgttacaagtaaatcctttaatataattttatttgaacacttatagcactacttattgggcaaccatgtggttagaaccagcttttttgttttttgtaaaacagaattgaagttgaaacaattacttctgccctctaaataattagactgctatactctcctcaaagtataagctgattagactttatctttgacttcagtgtgtttctggcctgccgctaaatgtcaaattaatcttaaacgcccataggattaatgttgaaaattgttacacattttttattcattcatcaatattgcaatatactccctttttcctctttttgggtatggggctgtaaagtttatttgatttcttaaagcacaaagaacctcattgatctcaacataaaacttattatgttactgcaaaataaacatgaaaataacattgaaaaactgtgttcatatattatttataagaaaaagccatttgtaaatgcctgtcagtgtttcttgtagtgcttccctttttaaggaatccattaaccatgatattgttttatatttgacaaaaactattttatggaagaaaagagtgttgtttaagtaactgcagctgtttctgcagtccaggtgggaagaataaagacatctggtttgtttgaggaaacacattaatgagtctttcagttatgaaagaaaggccctgagcatagggtagaggttgaaataaatgggaactaattgattttcccatgaagataacaacattttgaattttctaccagacagcaaaaaagacaagagttgggaccaggaatctgcggaaaagcattgatgggggaatgggctccagaaacatgatagctggccagcactggaatacaaccatgagaagaactgaagcccgatagtcaatgtctactagttgttacctgctctgtgcagcaatcttcctcagttaggctaacctttagtgaaagcctacaggtttgggtaccctttatgtgaaatgcttgggaccagaagtgttttgaattttggattttttaaaattttggaatatttgcattatatttactggttgaatccctaatctgaaaacctgaattctgaaatgctctaatgagcatttcctttgagcatcatgcaggtgctcaaaagtttcagattttggaagaagtaaaattatactgctttgcagataatataatcttatatttgaaaaaaattaaagactccaccaaaaaactattagaactgataaattcagtaaagctgcaggatacaaaatcaatattttaaaaaatcagtaacatttctatatgccaatattgaacaatctgtaaaacaaaaaagtaattctgtttacaatagccacagataaaattaaatacctaggaattaaccaaagaaatgaaagatctccataatgaaaactgtaaaacactgatgaaagaaattgaagaggacaccaaaaaatggaaagatattccatgttcatggattagaagaatcaatattgttaaaatgtttatactacccaaagcaatatacagattaaatgcaacccctataaaaataccagtgacattcttcacagaaatagaaaaaaaatcctaaaatttatatggaaccacaaaagactaagaatatcccaaagctattctaatggaagaatcacattatctgacttcaaattatataaccaagcaatagtaaccaaaacatcatggtaccggcataaacacagatacatagaataatgaaatagaatagagaacccaaaacaaaatccacatacctacagtgaactcattttcgacaaagatgccaaaagcatacactggggaaaagacagtctcttcaacaaatggtgctgggaagacgatatccatatgcagaagagagaaactaggcccctgtctctcaccatatacaaaaatcaaatcaaaatggaataaagacttaaatctaagaccacaaactatgaaactgatacaagaaaacattggagaaaatctccaggaccttggtcagggcaaaaatttcttgagcaatacctgacaagtaaatgcaaccaaagcaaaaatggacaaataggatcacatcaagttaaaaagcttctgcacactaaaggaaacaatcgtcaaagtgaagagacaacccacagaatgggagaaaataatttaaaactacccatctgagaaggattaataaccacaatataaaaggatttcaaacaactctatagggaaaaaatctaacaatatgagctaataaaaaataggcaaatgatttgaatagacatttcccaaaagaagacatacaaatgagaaacaggcatatgaaaaggtgctcaacatcattgatcatcagagaaatgcaaatcaaaactacaatgagacatcatctcaccccagttagaatggcttatatccaaaatacatgaaataacaaatgctggtgaggatgtggagaaaagggaacccttgtatactgctggtgggaatgtatattagtataaccactatgaagaacagttgggaagttcctcaaaaaactaaaaattgagctaccatatgatccagcaatctcactgctgggcacatacccaaaagaaaggaaatcagtatattgaagagatatctgcacacctgtgtttgttgcagcactgcttacaatagctaagatttggaaacaacttaagtgtccatcagcaggtgaatggataaagaaaatgtggcacatatacacaatagagcactattcagccatcaaaaagaatgagatccagtcatttgcagcaacatggatggaactggaggacattatgttaagtaaaataagccaggcacagaaagacaaatatcacgtgttctcacctatgggatctaaaaatgaaaacaactgaactcatggacatagagagtagaagtacggttaccagagactgggaagggtggtggagagctggctggaagctggggatggttaatgggtacaaaaaatagttagaaagaatgaataagacctactatttgatagcacaacagagtgactatagtcaataataacttaattgtacatataaaaataactacaagactgtaattagatttatttgtaatataaaagattaatgcttgatgggatagatatcctattctccatgatgtgcttatttcatagtacatgcctgtatcaaaacatctcatgtatcccgtaagtatatacacctactatgtacccaatcaaattgaaaattaaatttttttaaaagttttggattttggagcatttcagattttgcatttttgtattaggaacattcaacctgtacatgcaaaagcagtgtgtgagtagcaccatgaggagtcatgcatagtgggttgtattaacatctggagtgagtcagtgtagagaaagaacttatcagtaataatgatgccaagattgctgaagttgatcaaggattgactgggaagctagaattcagaaataaaggtaatgaaaatgaccaagaaatataagggcatatcaaagaaagtgctggattacctgcaattacataagaacaaggacttgagttcttttctttagatattaaaagaaagtataagtccagaacgttagagaagtaggagacattcaatttatatatatgaggggttacgagcataaatacatgctcctggagcatggtgaatttataaatacttatgtatttagattttatatatttttcattcttgtacttggtcagttgtgccgtctttaaataaagctgttcaagatctgtttgcagtacctttgtattttgcttgagtgcaccaatttttatcttagatttatgaagtctaattatcattcaacgtctttgttcaagccctagacacatttttccttgttttctcatatctcaattttcaagttaatgattataatgacatcatgattttatgttaagagtcttttttttttagttgaggtctttttattttattttttattttttatttatttatttttattttattattattatactttaagttttagggtacatgtgcacaatgtgcaggtttgttacatatgtatacatgtgccatgttggtgtgctgcacccattaactcgtcatttagcattaggtatatctccaaatgctatccctcccccctccccccaccccacaacagtccccagagtgtgatgttccccttcttgtgtccatgtgttctcattcttcaattcccacctatgagtgagaacatccagtgtttggttttttgtccttgtgatagtttgctgagaatgatggtttccagtttcatccatgtccctacaaaggacatgaactcatcattttttatggctgcatagtattccatggtgtatatatgccacattttcttaatcctgtctatcattgttggacatttgggttggttccaagtctttgctattgtgaatagtgccgcaataaacatacgtgtgcatgtatctttatagcagcatgatttataatcctttgggtatatacccagtaatgggctggctgtgtcaaatggtatttctagttctagatccctgaggaattgccacactgacttccacaatggttgaactagtttacagccccaccaacagtgtaaaagtgttcctatttctccacatcctctccagaacctgttgtttcctgactttttaatgatcgccattccaactggtgtgagatggtatctcattgtggttttgatttgcatttctctgatggtcagtgatgatgagcattttttcatgtgttttttgggggcataaatgtcttcttttgagaagtgtctgttcatatccttcgcccactttttgatgggtttgtttttttcttgtaaatttgttgttcattgtagattctagatattggccctttgacagatgagtaggttgcgaaaattttctcccatcctgtaagttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatgtaagtctttaatccatcttgaattaatttttgtataaggtttaaagaagggatccagtttcagctttctatatatggctagccagttatcccagcaccatttattaaatagggaattatttccccatttcttgtttttgtcaggtttgtcaaagatcagatggttgtagatatgcaccattatttctgagggctctgttctgttccattgatctatatctctgttttggtaccagtaccatgcttttttggttactgtagccttgtagtgtagtttgaagtcaggtagagtgatgcctccggctttgttcttttggcataggattgacttggaaatgtgggctcttttttggttccatatgaactttatagttttttccaattctgtgaagaaagtcattggtagcttgatagggatggcattgaatctataaattaccttgggcagtatggcaattttcacgatattgattcttcctacccatgagcgtggaatgttcttccatttgtttgtatcctcttttatttcactgagcagtggtttgtagttctccttgaagaggtccttcacatcccttgtaagttggattcctaggtattttattctctttgaagcaattgtgaaagggagttcactcatgatttggctctctgtttgtctgttattggtgtataagaatgcttgtgatttttgcacattgattttatatactgagactttgctgaatttgcttatcagcttgaggagattttgggctgagacgatggggttttctagatatacaatcatgacatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttactattttgagatatgttccatcaatacctaatttattgagagtttttagcatgaagggttgttgaattttgtcaaaggccttttctgcatctattgagataatcatgtggtttttgtctttggttatctttatatgctggattacatttattgatttgtgtatgttgaaccaaccttgcatcccagggatgaagcccacttgagcatggtgtataagctttttgatgtgctgctggattcggattgccagtattttattgaggatttttgcatcaatgtttatcaatgatattggtctaaaattctcttttttggttgtgtctctgccaggctttggtatcaggatgatgctgacctcataaaatgagtaagggaggattccctctttttcaattgattggaatagtttcagaaggaaactcttctggtagaattgggctttgaatccatctggtcctggactttttttggttggtaagctattgattattgccacaatttcggagcctgttattggtctcttcagagattcaacttcttcctggtttagacttgggagggtgtatgtgtcgaggaatttatccatttcttcgagattttctagtttatttgcgtagaggtgtttgtagtattctctgatggtagtttgtatttctgtgggatcgctggtgatatcccctttatcattttttattgcatctgtttgattcttctctcttttcttctttgttagtcttgctagcggtctatcaattttgttgatcttttcaaaaaaccagcccctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatttccccgtattcattccggagcaggttgttcactttccatgtagttgagcagttttgagtaagtttcttaatcctgagttctagtttaattgcactgtggtctgagagacgttttgttataatttctgttcttttacatttgctgaggagagctttacttccaactatgtgttcaattttggaataggtgtggtgtggtgctgaaaataatgtatattctgttgatttggggtggagagttctgtagatatctattaggttcgcttggtacagagatgagttcagttcctgggtatccttgttaactttctgtctcgttgatctgtctaatgttgacagtggggtgttaaagtctcccattattattgtgtgggagtctaagtctctttgtaggtcactaaggacttgctttatgaatctgggtgctccagtattgggtgcatatatatttaggatagttagttcttcttgttgaattgatccctttaccattatgtaatggccttctttgtctcttttgatctttgttggtttaaagtgttttatcagagactaggattgcaacccctgccttttttgttttccatttgcttggtagatcttcctctatccctttattttgtggctatgtgtgtctctgcacgtgagatgggtttcctgaatacagcatactgatggggcttgactctttatccaatttgccagtctgtgtctcttaattggagcatttagcccatttacctttaaagttaatattattatgtgtgaatttgatcctgtcattatgacgttagctggttattttgttcgttagttgatgcagtttcttcctagccttgatggtctttacattttggcatgtttttgcagtggctggtaccggttgttcctttccatgtttattgcttccttcaggagctcttttagggcaggcctggtggtgacaaaatctctcagcatttgcttctctgtaaagtattttatttttccttcacttatgaagcttagtttggctggatatgaaattctgggttgaaaattcttttctttaagaatgttgaatattggcccccactctcttctggcttgtagagtttctgcagtgcgatcagccgttagtctgattggcttccctttgtgtgtaacccaatctttctctctggctgcccttaacattttttccttcatttcaactttggtgaatctgacaattatatgtcttggagttgctcttctcgaggagtatgtttgtggcgttctctgtatttcctgaatctgaatgttgacctgccttgctagattggggaagttctcctggattatatcctgcagagtgttttccaacttggttccattctccccatcactttcaggtacaccaatcagacatagatttggtcttttcacatagtcccatatttcttggaggctttgttcatttctttttattcttttttctctaaacttcccttctcacttcatttcattcatttcatgttccatcacagataccctttcttccagttgattgcaatggctcctgaggcttctgcattcttcacgtagttctggagccttggctttcagctccatcagttcctttaaggacttctctgcattggttattgtaggtatccattcatctaattttttttcaaagtttttaacttctttgccattggtttgaatttcctcctgtagcttggagtagtttgatcatctgaagccttctcctctcaactcgtcaaagtcattctccatccagctttgttctgttgctggtgaggagctgcgttcctttggaggaggagaggtgctctgctttctagagtttccagattttctgctctgttttttccccatctttgtggttttacctacttttggtctttgatgatggtgatgtacagatgggtttttggtgtggatgtcctttctgtttgttagttttccttcttacagacaggaccctcagctgcaggtctgttggagtttgctagaggtccactccagaccctgtttgcctgggtatcagcagcggtggctgcagaacagcggtggctgtagaacagcggatattggtgaactgcaaatgctgctgcctgattgttcctctggaggttttgtctcagaggagtacccggtcatgtgaggtgtcagtctgcccctactggggggtgcctcccagttaggctactctggggtcagggacccacttgaggaggcagtctgcctgttctcagatctccagctgcatgctgggagaaccactactctcttcaaagctgtcagacagggacatttaagtctgcagaggttactgctgtctttttgtttgtctgtgccctgcccccagtggtggagcctacagaatcaggaaggcctccttgagctgtggtgggctccacccagttcgagcttcccagctgctttgtttacctaatcaagcctgggcaatgcgggcgcccctcccccagcctggctgccaccttgcagtttgatctcagactgctgtgctagcaatcagcgagacactgtgggcatagggaccctccaagccaggtgcaggatataatctcctggtgtgccgtttttttaagcccgttggaaaagtgaagtattagggtgggagtgacccaattttccaggtgccgtctgtcacccctttctttgactaggaaagggaactccctgaccccttgcacttcccgagtgaggcaatgccttatcctgcttcggctcacgcacggtgcactgcacccactgtcctgcacccactttctggcactccctagtgagatgaacctggtacctcagatggaaatgcaaaaatcacctgtctgctgtgtcactcacgctaggagctgtagactggagctgttcctattcggccatcttggctccaccctcttatgttaagtgtcttattaaaaactacattcaccagtgtgttctgtgacacatctaattattcacataaagggaatcactttcaaaaaattggggaaatactgtaagccagagtctacagttcacattaagaaactaatagtctctgagaggtcccacaggggaataaaaaaaattaacatggtttaatgtagctttatttgactatggaactcactttttacctaatacctatttatatcccatggaactaatgttcattaaaacaaataatccaaagtgtttttgcattatctcacttattctcacaaataaaatattaaaaaggatttactggtcaaaggagaaaaaatcacataactccaattacatttaaagcatatttatatttaaagagattacactaaaagcaatgtgtaccttttattccatgagaaattaatttaatctgactgcttgcatcttattctccacttaagtttgctgagcatcttttctttattctccttagtacagtgttaaatatctacagtcatccactgaacaaatattccacagcattgcttttttttgtataagagtcttttatgtttttaatccagtatctcccatagtctacatggttccctctaccaaccatggcctctatggaagatcatgaggtatcagtgtcattcttttggtaatgagacaaaatcaaaagtaactcctcctcccaaatttgaccaatgtctacaagaaagacactttacctgaatttatcccttcttaattctaaatttctggtcacctcattgaccctttcccactcccagcacccaagaacacagacccctgaaacaccctgggagcatagacaatcatggatccaggccatatcctgtcattaagattttagaaatgagaacacagaaagtttaatttatttaatcaagatcatacagctagttaatagcaatgtagaaacagtaatctaaatttttggccacatcttggcttctctggctcatggatcaatctctggtattttagagtttccaaggccaacgactacctcttacaacatacacagacacttacatatatacagaagccaaacatataccacatttggaaaaaggcatcagtgagatatcttacaggaccatttactaaaataaaataaaaattccagaaatatttttcttatgaaaattcaatgacagtttttgtttccacataaggtttttagagaagacttgcttgtctgtcctgcacctgctctaatgtcatggaatgcctgaaagagtctcttggtgtcaataacccacatgttcaagaattccccaaatttcacgaacgttacaaactataatacttttatggcattgaatttaaactctcaacagtgatgcacaaaaattagccatgacagtgcttttggagatattgcagcaaaacatgataataatatacaatacaaagggataaaaaccaaagctcatagatgtctacataatgagatcttctattcagaattactatatatttatcttcaccatattgacttgtctagagaaagtggagaaactctatcttagctgacaagttaactccccatatgcttccaagaaacacggaaatctagaagatgaagtcattcttctgtggatattaacatgcacaattttgcagacataaattttttgagaatctcttagaaaacaaagggagtaggaaaaattagtaagaggatcaaataaaagtgttgtctaagagggctgagtggaaacttggtgggatgatgctcattatcttgatgtcagaattggttgttgaatggaaagataaaggagaaatgatggagaagatggtgatattacctgacagaaggctacaggaaaattgaggagtagtgtgaaagtgatttttttgggaaaactgaacaatatgtattgttgggggaaaatgggcctcaacagagtgaagtattcttgtcacggaaaagatagaaaaagggttgggtagttacagggggacaacaatgccagactggggagtgtggactggatacaagagaatgagggagctcaggatgagcagaagggcggggaagcaatattcattaagcaccttctatgtgccagtcaataggccaggcttcaaattattaccttgctgaaatcttcacagcagccctctaataggtatttatccctgattccatatccatgctctgcttcccctcctattacaatggctgaagaattcaaacccctttcaaaggctagcactgtcatttgtcctctagatcccatcccctccatttttctttttattgaaacattctcaatggtattcaaacatactctgctctctcttctattaaataggcaaatgcaactcatcaagctctttttctcccttgctactgccccatttctctacttcctttcatggcagaacttctcgaaagagtttttcacaatcacttcatttccacacctctaactgacttttgaacacaactagaggaggagtaggaggggacactcattccaaagtgtccaattaagcccaatcctttaaaagtattatgttgtcatgatggctgttaagagcatggtgaaaagatattagaataagatgtggggaatcatgaccgtgagacagagaaagtagtcaaaggttttccaccttttaaaaatgtacttgatcccccactaattgcacaaactctgcccctcagacctagatccacccacagcatcaggcccacacttctggcttcaatccactctattctgtcctctatccactccaataaactgaaacagttcctattagagttcaccaatgaccatcattttgcaaaatccaatggtaacttccctgtcctctttatactcaacctctcagtagcatctgatcctgttaaccatgtcttcttgtaccaccatttctgctggattgctggatatcatactctcttgtttttctcctagtttactgtctagtcattcccactttcctttatgtgttcctctttctctgacttttaaatcttgaactgcaggccactggggcagaggaagcatgcacactagtgcatggtgtttggtatctcatcataccactttggtggaagagcagtggctgtagaatctgtttctttttttaactttgattttagattaaggagtatatgtgcaggtttgctatatagatgaattgcatgtctcggaggttttggggtacagattatttcatcgcctatgtaataagcataataccctatagattattttttgatcctcaccttcttcccagccttcatcctcaagtaagccctggtgtctgctgcagaacctctttctaggtatatgattagtgactgaacctccagtgccctgtctcctggtgctagaggattatttatttatatattgcattaacttctagttacttctttgcacctctgccctctttctgcattttgcatccctacaggactatgccctttggaatttatcctcctgaattcactttttacttaactaaagtagtatattagagaggacagacaggtagtttcaataagggaatatcaatgcctataagctctgttgtcatatcaaggaaaaatgacatatttcagtagaattaggaaatggactttctcttgtttaagggctgtgaggtggtaatttataagggaagattaaaagaacaaagtacatataacttggcttagagggaggtctaaagatctgcaaatatctctaactgcacaaacattagcaagagaaaatattgatttagcttagtacaagctacaaggtgctgtaactaagaataatgaagttaaattttaagaacacagagagaatgccatgaaaatattagaataaaaatagagtgagctatggaatattctgcaaagggaagcttttctaataaagggaaaacagctctgtgagatgaaacaaatcgttgttatgcaagatcagtgacatcctcaactccaagtctgcacaaatgtaagaacactagttttctatcttgtgttacattaattgggatgacagttcctatgcttctcaacatacctataaataggttctgggtcaacttctgcctgtaggtattccttgatcttttaaagacaatgattacccacttaattttttcacttcagagaacatacagaaaaagagaggtccttcacgtcccttgtaaggtggattcctaggtattttattctctttgaagcaattgtgaatgggagttcactcatgatttggatctctatctgttatcggtgtataagaatgcttgtgattttttgtacactgactttgtatcctgagactttgctgaagttgcttatcagcttaaggagattttgggctgagacgatggggttttccagatatacaatcatgtcatctgcaaacagggacaatttgacttccttttttcctaattgagtaccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccatcagtacctaatttcttgagagtttttagcatgaagggttgttgaattttgtcaaaggccttttctgcatctattgagataatcatgtggtttttgtctttggttctgtttatatgctggattatatttatcgatttgcgtatattgaaccagccttgcatcccagggatgaagcccacttgatcatggtggataagctttttgatgtgctgctggattcggattgccagtattttactgaggatttttgcatcaatgttcatgaaggatattggtctaaaattctcttttttagttgtgtctctgccaggctttggtatgaggatgatgctggcctcatataatgagttatggaggattccctctttttctattgattggaatagtttcagaaggaatggtaccagttcctccttgtatctctggtagaatttggctgtgaatccatctggtcctggactccttttggttggtaagctattgattattgccacaatttcagatcctgttattggtctattcagagattcaacttcttcctggtttagtcctgggagagtgtatgtgtcaaggaatttatccatttcttctagattttctagtttatttgcgtagaggtgtttatagtattctctgatggtagtttgtatttctgtgggatcagtggtgatatcccctttatcattttttattgtgtctatttgattcttcttttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttctctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcaggttgttcagtttccaggtagttgagcagttttgagtgagtttcttaatcctaagttctagtttgattgcactgtggtctgagagatagtttgttataatttctgttcttttacatttgctgaggagagctttacttccaactatgtgttcaattttggaataggtgtggtgtggtgctgaaaataatgtatattctgttgatttggggtggagagttctgtagatgtctattaggtctgtttggtgcagagctgagttcgattcctgggtatccttgttgactttctgtctcattgatctgtctaacgttgacagtggggtgttaaagtctcccattattcatgtgtgggagtctaccaagggacgtgaaggacctcttcaaggagaactacaaaccactgctcaacgaaataaaagaggatacaaacaaatggaagaacattccatgctcatggctaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacgctacctgacttcaaactatactacaaggctacagtaaccaaaagagcatggtactggtaccaaaacagagatgtagatcaatggaacagaagagagccctcagaaataacgccgcatatctacaattatctgatctttgacaaacctgagagaagcaagaaatggggaaaggattccctatttaataaatggtgctgggaaaactggctagccatatgtagaaagctgaaactggatcccttccttacaccttatataaaaatcaattcaagatggattaaagacttacatgttagacctaaaaccataaaaaccctagaagaaaacctaggcaataccattcaggacataggcattggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaatctactcatctgacaaagggctaatatccagaatctgcaatgaactcaaacaaatttacaagaaagaaacaaacaaccccatcaacaagtgggcgaaggatatgaacagacacttctcaaaagaagacatttatgcagccaaaagacacatgaaaaaatgctcatcaccactggccatcagagaaatgcaaatcaaaaccacaatgagataccacctcacaccagttagaatggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacacacacacgtatgtttattgcggcactattcacaatagcaaagacttggaaccaacccaaatgtccaacaatgatagagtggattaagaaaatgtggcacatatacaccatggaatactatgcagccataaaaaaggatgagttcatgtcctttgtagggacatggatgaaattggaaatcatcattctcagtaaactatcgcaagaacaaaaaaacaaacaccgcatattctcactcataggtgggaattgaacaatgagaacacatggacacaggaaggggaacatcacactctggggactgttgtggggtggggggaggggggagggagagcattgggagatatacctaatgctagatgacgagttagtgggttcagcgcaccaacatgtcacatgtatacatatgtaactaacctgcacattgtgcacatgtaccctaaaacttaaagtataataataatataaaaaaagaaaaagagagtatttgtgtggcacactggatatcacggcagactagccaggggctctggctacatctgaccctgctaaaccactccaaggactgaggggatagatatgttggctcacctggaagcaaatcttggcatactattgttcttcaacacactttttaggaagcactgtgcttttcatttagacttgggaggcagccagtctccaacccccaactcccaatcccttcttctattcctcctgtttcactaccttcttatggctctactgaaataagtcccttccgtctttctctttcctcatccccttctcaaagcagaaaaaaaaaaaaaaaacatgttttgctttgacataataatccaaacaatttctcccaagatccttacaatgtggaaagagagccatagtcagtatatcctgaggaggtaggtaggcatttttctagttctctaggacacatctagcttaccactactgtttacaagtctgagttgaagggaggcaatggtcaattgttacaaacttcataaactgaccaatgaatatttgcctggtccatatttaggttgttcttttcatcatgaaaagttccccagtttactaaccactagcaaaggtttgtctcttaaaagttgctaagtctaaataataacaacaaactaaaattctagaattattgagtctgattttatgagtatcaattacagtattttaattatatattcctgatcatacttaaggctgatgactatttaaaatttggcaaaaagaaaacacaacagtcttagagtactaagccaagttgtaatgctcaggccactaaatgcattaaaccttgtactcagaacacttgtataaagcctggaacacttatcagaatgtcaaaacaatcaggaagataacagtctttgcatctgagagattcagtgggataagtggaaagagcacaggaccaagacttaggagttctgggttctctcaagtcttgttcctgtcatttgcaaacattgtgcacttaggcctaccagatcctcccaagtgttaatagttttgtatttaaagacgaatgtggttagatatggtgaactgaacataggcctgaatctctactccatccctaaaccccactgaaatgacattaaaggaataaaaagggtataactcattaaaaaaaagactgagtaggaaatgacatcagacagggggtggtaacaaaaatttggaagctggaaagcagatggacaagtgttacactgactcagctgaccttgggaaagctaagcctaagcctgaagaggagggggatgcaaaggcaagaagcaagcccatttccaccatagaaccccagaaagtttcaaaagttagaaatatcaaataaattttcaggcagggaagtaggttgagactgaaaacaagtgaccttatgaaatgtctttaaagcaagtagttagacccctagatatctttcccacactgtactcccagataattgaatcctccactcctattctgattggagacagaaggtttactctttggggaggcttaactactcaggctctaggcttaggaacagtaggcccagctgaggacagcaaagatgacttgtactgaaaacagggaaaataagggaaagtctacatagtcaacaatgaacgtcccaatgccctttttccatactcagtttccagaaacaggtagctaaacttctaccatggtatagattggagccagaggacagataactctaagagcaatacttccaagtggaacatgagcctgatagcatgctgacaacttgaatgtgtagttagaggaggttttcaattattcagagaatttggtgatgaattaattactggtatatagaaagctaagcaactgaaaaaaatgagccaattaatgagctccagaaaaattaaaatgtcatacaagcaaagaaaggtaatcataatagagtgagtagctcagctataaataatgtgacataatcaacaatattgtaaacactgaactgatttaaccaactatggtgtatgtgctgggtagaaggggccttttaggaaagtggaattctcttcttataataggaagtcagcaggtactacctaatattgaattttaaaaaataacagtgtaagtgtataatttagatgtgtatgtggaggcaaacatcagaagaaaaagagcagagagttggatgttgtttactttgggagaaaatatatcagcagttagacagaacagagcaggggactgctctttgcattacaagcctagtagtactgcttgacttttattgtgtttatttatttttaagtgacaggtctcactctgttactcaggttggagtgcagtggtgtgatcatagctcactgcagccttgaactcctgggcttatgcaatcttcccacctcagcctcctgagtagctggaattacaggcacatgccaccagacttggctaactttttaaaatttttattttatgtatttcacagagatggtgtcttgctatgctgcccaggctagtcttgaactcctggcctcaagaaatcctcctgcctcagcctcccaaagtgctgagattacaggtgtgagctaccacacctggcactgcttgactttttaaagtatgtacatttattacttagattaaaaaattaatcttaaaaaattattaaatttggctaaataacctttggtctttcctattttgaaaatgtaatgactatgcaaaacattaatagtttcttctgagagcttgaacctcacactctttcatgaaattagatattacttaggaagagaaaacattaagacttccagatcctcatagacttcctagtacatgaagtgctcaagctactcatgtgggttgtttaaactgcagtttaaatttagtttggtgcatttactttctgccacatatatatgactgtttctactttggatattgcatgacatccacatatatgctaatcctgaaaaatagatggaaagcaaatatggcttgaagtaaccaggaattgaaaaccaccatgaatagtgtcagcctgacccaggagagaactttttatgtcccatgaatgactcttaccctatctttcaatagtggctgcactctgctttctgatcagaatttctctctggattgaaacttttatttccttctctttgcttgattcttagcatttactgaaaaacatcagttaccagtgcttacagacatcactagcagtaattatcaaattccagactaaacctaccttttgcttcctagtgaatctaagagctgattcttctctctcccattcctctttgtccagtccctgcattatatccagtgcaatgcatttaaaaaataaactacacttgacttcctaagaaccttggctataattttaaataaaagaggttggtgaccatcagcattatgtgtaagtcctgtttactggtaggtttgagcacagtgtccattcttgtattcttactaattgctattctattagacaccattcgtttttcattgtcctttctctacatcgcctactttacctacataagcactaacctttttttttttttttgggggggtgctagacctagtaaaagggccaacacaagcaatttgtctcaggcatttctctatctcccttgttctgccgccttcctcccatttggcagatagaacctttcacatgattttaaaccccattctgcccgctcccttcactcctgaatatctagaaattccagtaaaattccttccacatacaagaaagcatcccatatccacacctatctcaccctcccttgcctaacagaacttaactccctggatttccattcagcttgagctacgttctttctcatcacatgcagggagttgcatataccccttacatagagagttcttttatttttgaatgtagacttaatttaaatatttgaatttggcttaaaagatgatgcatatctagtagacaccattaaatattattccaaaaagcatcacagctttagcaactcatatttccttcaggctttttctttcagattaattcaaactattaattttgaacctctatgtatgctcggtatgccattttactctgtgtaaaattggcatgctgttttagccaattaaaacggaaaatatttctgtttggttttaattgatttatctatttattcacttactattattttggcaagaaagggagttcacttccctgaactatttcctttggattgagaattcttgatgttaggttgagtgttaatggttttcagtccagctgttaatgatgcaggattcctatgctctagggagattttagaaggaattaagtgtgaatacctcctcacctgcttgtcttctattctaacaagagcttttgctcattaaaaagtgcctgctctagcttaattcttctcagagtgaacacttcaggattatgcaagcaggctaggtagtctcctctgattcaatattcatacctttgaaaagagatataatgtgatgaaaaatagagatgctaactgaagaacaactattatttgctattaccaagaaaaactggatgacattaaagaaaatcccagattaaccatgtgaaaaaacttaatctgggaaaagaaactccttctgggagtcagtagattgagggaaaagaagagagatagaaagaaatggaaggtatagaacaaacccaatgaaagcatggtgactcaacagcctgaagtatctgttttagaaacgacttcccagaccaccactgagaccagtgcgaatgcagaagtgagcaagtaaggaagcagctctgtaaaggaagaaggaatagagatcacatcgcagcaggagtgtccattgtgacagtctaggtaaaagagagagaggaaccacagctgtgaggggacaagttggttcctcaaaagatattaatgaggttttcatgacatgtgtcaggatgcaaatgacaggggaagagtccacttaacaatggagttgtcaaagatgtaaaaatttgcagcactacttcaatattatttcacttacttaatgtattttcatgcttaatgaactaaatcactggactgatttgtttagggcagcactgtccaacagaaatataatgtgcactacatatgtaattttaaaatttctggtaaccaaactaaaaaatataaaataaaacaagtaaaatgaaatttagtaatttaacacaatatagtaaaaataaccattttaccaactaatcaatgtaaaaaatcattgatgggatattgcacattttttttcatgctgatacttcaagacctagtgtatattttataattacagcatatttcaatttggactagtcctatttcatgtgctcaatagtcacacgtggccagtagctgccatagtggacagtgtacatttagaggaactcatttttgcatcactacctatgaagtagtcttgaaaacaaaacaaacaggatatgattaagccactatatctgaactgtccaacaccgtcaacactagcaacatgtagaaatttaaattaattaaaactaaaaatccaatccctcagttgcactaaccccatttccacttctcaataaccacatgtggctagtggctcctctgttaggcaccacagatttacagacttaatgcctttatcttccaaactgaaaattagagaacaatgtctaaatcactggcaatttgtatcatccttgatgaaaacaaacatttcttctttttcatttcattccaaaatccccttttgccctgtcaacttgttcccacctatcccctcaataaaaccttaccatggtcttgcctgcaggatgcaaaattgtttgagagagtactgaaaattcagtcatgagggtagcatttcttactacttatggtttttttttttttcaagtttcatagagacctgtggcatcttgtgtttagaatatatagcaaacctggtaaagagtggtgaggagtggatttctgaaaatgctgacatatctttgaaaatattataatcttagctggcactatgacaattgtagaatgtatggtttgaaaattaaaaagaagagaaatggaaacatatagcaacattcgtttttaccccttcttcatgttaggcagattttctttttcttgtgggtgctctgggcattgttctaacttggtatttgcaagtcaatggcaaggcctgttcagtgctgagggaattacatagtcatagacaattagtcttttaaaaggtctgctgcttggaaatttgccactaaactcagtatagcctcagcacataatgtaaattcttaatgattataacttttctaaattcagcccttaacaaatctcataatagtgttttgaaacttttaaatcaaacataacccaattaggttggtatttgattaaactgaactgccacttcactgaagtgtttaaataaatcaacattaatatgcttttattatagtaaataaagttacttctatgtagttgaaatgtcaatactcacacatagctcttgaaaattaagtactccttgcactttgaataatgaatccagtattaattggggggaaactattgatttctttttataggcctgtggaagtactttgccccaaaactctacaagttcttaattaaaaaaaaatagtaaactaaatatctgttaaattctgaaactactgtcagagttgtccttatagtggttctgattcatggccttttctccctaaaaatgcaacacagactgatccttcaaataataattataaagaatctttttcattctaattgaataaaattgttagaagattcttggatgctttgcttcccacaaaatacttgcactgtgtgtccaataatagattttctctagcagatagtcattatcaaaggttaactagcatcaagtggtagaaaaaatcctgtttctgtccataggtgcagcatggtgaattccaatatctcatctaaggagtaaaaagtatgctttttggaagtaggactcagtacagctttccatttgtcatttctattgctattctacaggtagttgctataagatgatgctacatttttttatggcattcgcagatttacatttcattgatattctatctttatgtatactttagcagtctatttgatttttgactggttgtctgaatcctctgtaggatgagtctcaaagtagcctaaattcttatttaagtactctctaacagtgtgttccttacttttaaaaagttaagcctaaaagaagtctgccttggaactcttgtttactggacatagatgtttacacatttttgttacaagatctttggggtgtcgattttcctcccaaaacctctgtggccagtgcacctttgcctgagtttttgtcctgtgtcccaggtccaggaagaatgaggtacacagacaagtaaagggtaaagaagtcaaagaagagctttactgttagaacagctcagaggagacctgcagtacctagatcctctgaaggcaggccatcccctgagtgttcagctctcagcagagaggaggccctggagagggtggcttttctctgcaggcagattgttcagacatctctgcaggtctctgaagctctcagcagagagggtagctcctttgtgcagctggtcatccagttgtctgtccctcctctgccctctgccctgctccaagttgggtgcttttacggacctcggaggagaggaagtgcgtgctgattggtccgagggaagccatgggtgggcccagagcaggcacactaagtccccattccagtgggtctgcaggactggcagctgggccctcagccttcaggccctccctggcctgaatgtggggacctactggggacccacccctttttgcccaggaatctgtctgcctcctgctgccatttatggccctgggctcagcccaaccccactaccacatcagagcaggcgccaggagaagacagaggccaggcagcggagcagacaccccgagcctgcagggactggggggtcatgtctgcccctgaggtgcaggctgcagagatgcacaggtcctgtgcctcggagggcagccgcagctgcacccagggagcttctgctcagccaactcagaatgggtggggctcctgcttgtccctggcttctgcctggtccatggagtgggaagcccaggtcttcagctgctggtcagccagctgcagctgcatccgagagggcagatccccccaagagcacagggagggtcggatccactacacagtttgggtggccgtagccccgcccaggagggcagggctcctgtctgctccaaagagcaggaggcctgggtctgcagccacggtttgggcgactgcccctgtatctggggagctcctgccctaactcagaaagggcgggcctcccaccggctgcatggagtgtgcagctccagccatgcctccctgcggtagccggtgtgatggcagcagccactgccatcagtttcagctagaacaactatgattaattagaattagcctgggagttgaacaatgagaacacatgaacacagagaggggaacaacatacaccagggcctgttgagggtggaggatgaggaaacggaacttaagaggacgggccaataggtacagcaaaccaccatggcacacatatacctatgtaaaaaacctgcagtttctgcacatgtatcccatttttgtttttgtttttgaagaaataaagggacaaaaaaaaggattagccttgttatgactgacagaaaaccttaaataagagtgacttatacaacgtatgttacttttctcatgcattcaagtgcagaggtacacagcatggctggtatgggctagctctttgatcttgcagctcttccatgcttagcctatattctaaggcatacctcatggtcaaagaggccttcctctagccatcatgtctgcattctacccagcaaggagtaaagggaagagaaggacaaacttttccctttaaggacattctcaggagttgcatgctctgcttccacttagagcccattgtctgggactatctcctggccacaactagccgtaaagaaaactgggaaatatagtctttatgctgggtgaccatgtgttcagctaaaaatttagaattctgttataatggaacacaagggatattgaaagaaaattaggtgtctgtgtaatactgttctctggaatggaactcatggtcagcaaaagactataccgtgagcctggaagctgttgttagaaaaataaagaaagcaactaagattctgttagagctttccaaaagaagtacttaaactaccttttttttctggtttggtattttttcagagcccctctcatcacagcatattaaaactcctgctcctctcatagaccttaaatcccttggatttcagctgtttctttttttttttctttttttaactttaagttccaggatacaagtgcagaatgtgcaggtttgttacataggtatacatgtgccatggtggtttgctgcacctatcaacctgtcatctaggttttaagccccatatgcattaggtatttgtcctaatgctttcgctccacttgaccccacctaccgaattgccccagtgtgttgttcccctctctgtgtccaagtgttctgattgttcaactccctcttatgagtgaaaacatctgctgtttggttttctgttcctgtgtaagtttgctgaggatgatggctagaataatcagttggaaatgcagaaatcacctgccttctgtgttggtcttgctgggagctgcagaccggagctgtttctattcgcccatcttgtcccctcccctcagctgtttctcatcaaaacttcctgtactgcctgaagaagttactttccaattttccaccctagcataatgtatcatttagagaaaaaaagctgagttcttttctgaaatgcctgaaaattttattcttttccattttgcttttttcttttgccacacattaaaacacctctgctgatgttaaagctgcctgtacaaccccaaattaattgaagttttggagttgatcaagtaataataataatagccactgtgttttgagtgcttactctatgccaggcaccatgctatgggtgtcacttacattgtgtcattaagtcttcagaacaactcgttaaggtaggactatagatgaggaaactgcagcccacagagattacataacttgcccaaatccttatagctagtaagtgattgagtatagaatttatacctaagaaaacagagtctagaacctcctcctcccacacaccctgattggttgatattacagtatgtcctcacttaatatgttcatcaatagattcttggaaactgtggctttatgcaaaatgacatataacaaaaccaattttaccacaggttaattgatataaacaaatagagtaaagttctcacagcatatgtctggtcaaaaaaacatcaacaaccttttaaataaaaccaaaacacttataatgttaaacaatgaaataaatgtgagcaatacttacatttttaaaagatttaattagccaggcatggtggtgtgcacctgtagtcctagctattttggaggctgaagtgggagaattgcttaagcctaagagttccaggttacattgagctatgattgtattactgtactccagcctgggtagcagagtgagactctgtctcgaaaaataaaataaaataaataaaaacaagataattatttacccactgattacagtcctgggtggcaggtggccagagcctattctggcagttaagggtcaaagtgggaaccctctgtggacaagacaccatcccatcacatggcacactaatacacacacacacacatacacacgcatacacacacactcacactgagaccacctaacatgcacagctttgggatgcgggagggagccagagtacccagagaaaacccacatagatatggggagaatgtgtaaactccacacagatagtggccctagcaaggatgcatttttttttcatcatgagtaaaatgatgttgctttgatgttcaagaaactgctgtattgtatatggaaaaatctagatctgtgctatctgatatggtagctgttaaccacatatgtctgtttacttttagttacttatttgtttgcttccttaagacagaatcttactatgttgcccaggctggccttgaactcctaagctcaagtcatcttcccatttcagcctccccagtagctgggactacatgtgcataccaccatgtccagcttatttacatgtacagttaaattgaaattaattaattttaaaaaagtctcagtttttcagtcacacagtcacatatcatatgttaattagatacacgtggctagtagctactatatggaacagtgcaaatatgaaacattgctattaccacacagaattttcttggacagtactgatctagataaccctgctcctaacctagatttctttttagcctaaattgtctggctggctgtgtagatatggccaaagagaaataggtgcagcctcttaaagaagatatctgaatttatcattctgccccataaatttcacatttgtaaacaaatatttaagtgaaaaatgtgaattttccttgaatattatctccaaaattatcaacccattaagatatcctcattataacactatttgttatgtatatgtgaatagttcactggtgaaatcatgtcagacatatttcaattctacatagttgtcttagtctgttttggctgctataacaaagtcccatagactgggtggcttacaaacaacagaaattttttctcacagttgagatcaaggcactggcagatttggtgtctggtgaggtcctgcttcctggttcgtagacagtggtcttcttgctgtgtcctcacatggcagaaagagcaagggaggtctttgggcctcttttataaggacactaatcctattaatgaggactccattctcattatctgatcacctttccaaaagccccacctcctaataccatcaaactggggattaggtttcaacatacgaatgttgggggaaacacaaatattcagtctatagcaatagttaatgtctgatataacacagctgacatacatagccttcatggcatctgttagcccttttagcattataaagaataagttggttcttattatttttagcattacacagtgaatgttttgattggcaaaaaataaaataatgaggaacacaagaatacttatctgtatataggaactacacacagtcactctaatctcatcccattggctattttatgatttaatatttaaattgaaatctaaaacgtgagtacttagtaaaaagactggatttgtctgtgaatttgatgtacagtcaaatgcaaaatcttattctttagaattgcccacagttacaactccgaaaccactgtaggaaaagcccccagtctcactaaatcactctgggttttttcctgaaaaagcccagtgggtttgcctagttggaaattctatattaagagactactctggtagttggccaggaaaagagcaaccaaaatgacttaatacactactgcattcaattaggtccacttttcttctttcaaaggtgaaaggagaaacatttgactttaaaaagcaacatcttcctataattcgaatgtctattctttgtgtgcttaagaaaacattcagaacagaaattgcaaatatctcattacaattttgaaagaaaaaaatgacagctttcttctagtgaatattacaaattaatgattttcctacatatatttcttatgaatatatgtagctccaactaaaaataataaaatgtcatattaagaaggcaaatattctcacctccatatactggaagtcttctttgtgctagtaggtattctggaaaatctaaatttgcatttcaatcaaagaacatcaataatcggacagagcagactgatgatctttcaaagttccatttcaatgcacctctgagataaaagaggacttctgacaattttcagcatcctgtattgcattgtctattttgaggtattatgtaaaatccaaaaatatgttttgtcattataaaatccatacctctgaactggtttaaaaaaataagcatcttaacaggtatgataattacagtaccaatttgaagaaatcaagaactttaagattgggagaaacagttaagatcatctaaaccacagagaactcaccattaccattggatgtagtagatcagaccctgaatcctgaaggagaaaatgtggctgtaagtctcagctctgagattatttgtgagactttgtctaagtcactttctcttcccctggacctttgtttttctactctgtaaagagaaattaaacttctttcatatctaaggtctatgtacaatttcttgctatctgccaaaagttaagcagccatttatatagtactttagcagactctacttcagtaaaacactaaattagctagactatattactattaattaaatttggaggaaaaagaggctaaaccccaagcaagctagtatcgggaattcatatgaaaaaatgacttctaggaaatgtttttaggtcaaaacacagtcctagacattataatttttgcatctcctgctctgtagagtgaatattgatgtgcatggtgatgaccatgacgttctgaatggccattattgcccagtaacaatgcagtcctatgtgctagactgcattcacttgagcttcaactcaatttgcctgggccatttaaaaattaaaaataattttaaacaggagttgaaagcaacaaaatgctttctgctcaacttttgttagacaattcaattacctacaatatcctattctgtaagcatactagttaatcaaggttttactgtgtattctttaaactagcaagttagttaattaattggaggaagtgaaatgtttggccaggctagatgtctgcactgatgtaactgcttggattttattgttatgtttagtaaggagcaaaattgcatgaacagtgacatgtgtatgtttggctaaggaaaaggcactttatttatggtgagaatggtcaggctttagcagaagtagttgaaattgctatatgatacccagattatacagtttcccagctgatccagtaaatgatcctgaggcctccttacctatttctaggaacatttattaatgaattatcttttttggtcttatttcctatgccaaacaataatctagctacctccatctatcagagtccccttataatgaaggaaacagcaggatctctattgtggggaaggaagtgaagctgttcatctttgtatctctaccacaaaccacagtatctagcacatagtagatgattaataaatgacaaataaacaagggattatttttgactgattggttattttatttttatttatttatttttttttaatttatttattttgagatggagtctcactctgttgcccaggctggagtgcggtggcatgatctcagttcactgcaacctccacctgctgggttcaagggattcttctgcctcagcctcccaagtagctggaattacaggcatgcgccaccacacccagctaattttttttttttttttttgagatggagtctcactctgtcgcccaggctggagtgcagtggtgcgatctcggctcactgcaagctccgcctcccgggttcacgccattctcctgcctcagcctcccgagtagctgggactacaggcgcctgccaccacgcccggctattttttttttgtattttcagtagagatggggtttcaccatgttacccaggatggtctcgatctcctgacctcgtgatctgcctgcctcagccttctaaagcgctgggattacaggcgtgactcaccgcgtccagcctaattttttgtatttagtagagacagggttccaccatgttggtcaggctggtctcaaactcctgacctcaggtgatccacatgcctcaacctcccaaagtgttgggattacaggcgtgagccactgcacctggcctgattggttattttaggtggtagagtaataattgctctttcagggacagttttgtagtcatcttacattaggtttctcaaacaaattttagccaagaagaaacaacatgttacctgaacatatgtggaaacttaacctcttcctttctgtgcccctgctgtcaataagagaaaatcagccaaatctttgataacaaatgtctgttgtaaagacacatagtagagattcaattaaatttgttaaatgaatatgttggaaacaagggcaacttatcaaataaaggtagagccattttacagacttttttccttttctccagaaaaaaaaggaatgtatgacttagaacaattcagataatatcattgataacatggagaaggtatgcacatggaaggaaaaaaattttctgttaaatatgaacaagacttggcaccaagtgaggaagatgccatgtcagtttccatgatggaagccaaatatattaataagggtaatcacaaaggcagtttttgtcctaattacagttaacccttgaacaacatgagggttggggcagtgacacctcttgcagtcaaaaatccatgtataacttaaaaaaatgtgaatacacagtagatgtatatatttttggggtacatgagatattttgatactaacatacaatgcataataattcacgtcagggcaaatagaatatccatcacctctagcatttattctttgtgttaaaaacaatccaattatatccaattatactctttcagttatcttaagatgtaaaataaattactgttgactagtcatccattgtgctatcaaatactatatcttattcattctatttaactgattttgtactcattaaccatctccacttccaccccacccccagtacccttcagagcttttggtaaccatcattctactctctatctacatgagttctgttgttttaatttttagctctgacagatgagtgagaaaatatgataattgtctttctgtgtctcacttatttcacttaacataatgacctccaatttcatccatgttgttgcaaatgacaggatcacattctcttttatggctaaatattacttcattctgtagatgtaccagatgtgccaaattttcttttctttcttttttttctttcttttttcgagatggagtctcactgtgttgcccatgctggagtgcagtagcacagtctcggctcactgcaacctctgcctcccgggttcaagtgattatcctgcctcagcctcccgagtagcttggattacaggtgtctgtcaccatgcccagtgaatttttgtgtttttagtagagatggggtttcaccatgttggcaaggctggtctcaaactcctgacctcaagtgatccaccttcctgcctcccaaagtgctgggattacaggtgtgaggcaccgtgcccagcccacattttctttatatgtttatttgttgacagaaacttaggttgcttccaaatcttggctattgtgaatagtgctgcaataaacgtgggaatgcagatatctctttgatatattgatttcctttcttttgggtatacctaacaatgggattgctggatcatatggtagctttatttttagtgttttgaggaactgccaaactcttctccttagtgcttgtactaatttacattcccgctaacagtgttcaagggctcccttttgtccacatcctcgtcagcattcattattatcttgttttggatataagtcattttaactggaattagatgatatgtaattgtagatttgggtggggacacagagacaaatcatatcattgcccattcaatatggtactaactgtgggtctgtcatatacagctcttatcgtgttgaggtatactccatctatacccagtattttgagtatttttatcatgaagaaatgttgaattttatcaaatgctttttcagcatcaattgaaatgcttgtatggttttatccttcattctgttgatatgatgtatctcattaattgattagcttttgctgaaacatccttgcatcctttgggtaaatcccacttggtcatgacgtatgatcttcttaatgtgttgttgaatttgttttgctgtattttgttgagaattttgcatcaatgtttattagggatattggcctgtacttttcttttttctattctttttctttttcttttttttttttttttttgatatgtctttgacttgttttgttatcagggtaatactggcctcatagaatgagtttggaagtattctctcctcctctatttttcagaatagtttgagtaggattaatattatttcctcttaaatgttacttttctgttcacatgttggatttctttatgatttaatcttggtaggttgtatgtgtctagaaatgtctcattttcttctagattttttaatttattagcatatagttgctcatagtggccccaatgttcctttaaatttctgcagtatcagttgtaatgtcttctttttaaattctgattttatacatttggttcacctctctttttttcttagtctgattaaaggtttgtttacaccgtttttactttcaaaaagccagcttttcatttcattggtcttttgtattatttttttatttcagttttatttctgctgtgatctttattatttcttttcttctagtaattttgggcttggtttgctcttgcttttctagttccttaatatgctacattaggctgtttatttgaagtttttcaactttttaatgcaggaacttattactataaactttcctcttagtgctactttcactgtatcccataggttttggtatgttatgtttccattttcatttgtctcaagaaattttcatattttcttcttaatatcttcattgacccacttgtcactcaggagcatactgtttaatttctttgtgtttgtacagttttcaaaattcctcatgttatttatttcttgttctattcccttatagtcagataagatgcttgatattatttcaatgtttttcaatgttttaagacttgttttgtgatctaacatatgttctatccttgagaatgatccatgtgctaaggaaaaataatgcatattctgcagccattggatgaaattttctgtatatagcagatccatttgttctgtagtgcagattaagttcaatgtttctttagacagatcttccagaaagaaaatcaacaatgatgaaagtgccttgttgacatctccagctattaatattattgcattgggacctatctctctcttcagctctaatatttgctttatatatctgagtgctccagtgttgggtgcatatatatttatacttgttatatcctcttgctgaattagcccctttatcattgtatagtgacctgtctcttcttacagtttttgtcttgaaatctattttgtctgatacaaggatagatactgctgctctttttggttttcattggcatggaatatctttttccatccctttattttcagtctgtgtctttatgtatgtctcttgtaggcagccaataattgtgtcttgttttttaattcatacagccactctatatcttttgattggagagtttagtctatttacaatcaatgttgttattgataggtaaggacttactcctgctattttgttatttgttttctggggttttttgtagtcttctcttccttctttccttccttcctgtcttccttttagtgaaggtggttttctttggcagcgtgatttaatttcttgctttttatttttgtgtatccactgtatatttttttatttgaggctaccataagacttgcaaatacaatctaatagctgaatattttaagctgataaaaacttaatgctgtttgcataaacaaacaaacaaacagaaaagttctataaactctacaccttttttgtccttgctttttaactttctgttgtttctatttctatcttattgtactatctatatcttgaaaagttgttgcagttattattttcgattgtctcatctctttgtcttgctatttaaggtaagagtagtttacacactacactcatagtattacaatattctgtgtgtctttgtacttactattaccagtgagttttgtatcttcaggtggttacttattgcatattaacatcattatctttctgactgaagaactccctttagtatttcttgtaggacagatctagtattaataaaatctctcagcttttgtttttctgggaaagtattttaccttcgtgtttgaagtatagtttcaccagatatactattctagggtaaaagtattttttttccttcagcactttaaatacatcatgccactctcgcctagcctgtaaggtttccactcagaagtctgctgccagatgcattgaagctccattgtatgttatttgtgtcttttctcttgctacttttaggatcctttctttatatttaacttttggtagtttgattattaaatgtgttgaggtagttttctttgggttagatctccttggtgttctataaccttcttgtacttgaatattgatatctttctctaggtttgggaagttgtctgttatccctttgaataaacttcgtagccctattttgttctctacccccttttcaaggccaataactcttagatttgatcttttgaggttattttctagatcttggaggcatgctttattgttttttattctttttccgtttgtctcctctgactgtattttcaatagcctctcctcaagctcactaattatttcttctgtgtgataaattctgctattaaaagaatgcatcaaaattcaagcaagccccagaatttttctattattttaatctctttgttaagttcatttgataaaattctgaattccttctctgtgttattgtgaatttctctgagtttcctcaaaacagctattttgaattctctgtctgaaagatcacttgtctctgtttctcaggattggtccctagtgccttatttatttagttcattttgtgaggtcatattttcctggatgatctgaatgcttgtgctcacataatgacttcactctccttcctccaagcacacagattatctttctgtgccaagtgctcacctcaggggatggggtaggggtggtgtaggtgattcaagactgtcttctatccttgtcaatgcttatttccttaatatgttgtttgtcagtgtctgcaaattgatgagttaggtatttattttagtctgggtttcttttgtactcattcttcttgagaaggctttccaggtatttgaagacttggatgttgtaatctaagccatacctgcattaggtggcaccccaagcccagtaatgctttggttcttgaagactcacagagataccaccttggtggtcttggataagatccagaaaaattatttgaattaccaggtagaaacagatgccttgttttcttcccttactttctcccaaacagagactccttctctgtgctgagccacctggaggtggggatggggtgatacaagcatccctgtggccacccacagtgactgcactggatcagacctaaagccagcacagcactgattcttgcccaaggctcactgtaaccactccctggctaccacctgtattcactcaaagcaccagggctctacaatcaccaggtggtgaagctatctaggacttttttcttccctacatggtgataagttaccccaggactcaggcaggtccagagatgctatttgggaaccaaggagtggagtcaaaaaccttagaaatatacctcgtgttctattttactgcatcagagctggcactcaaaccatgagatgcaatccttcccacttttctctcccccttccacaggcagaaaagtctcacccatggccaccaataccacaagcctatgggtagtactgccaggctggcacaaatgttctttccatattatgatgttaaaaccaggtactgtggcctcttatctgatttttggttgttacgaagatgctttttttgtgtgtgttgatggttgttcagttagatgttccttgggttagggatgattgctgtaggcttcttttcagccattttgcttcaactcttccaatgtataacttggctactcaaaatgtaaccactaatatctggaaaccttgttaacaacatagttgattaacacatattttgtacattatgtgtgttacattctgtcttcttacaataaagttaaagaaaatatcattcaaaaatcataaggaaaagaaatatatttatttatcattaaatggaaatggatcatcataaacgtcttcatccttgtcttcatgttgagtaggctgaggaggaggaaaagggaagggctggtcttgccatcttaggggttgcagaattgaaggatgtgaaggtggaaggggaggcaggagaagcaggaacactcagtgtaacttttattgaaaaaaaatctcctcctcctcagcttcaaatcttaaaaatgcaagggcaggatcaagatcggttccctttgactcagagtgaatgcaaatctgtggagcttctaaaacctacagaccatatgtactgacactaaataattttaaactgatttaggggactgcatgttatatagttttctggaaacaaagctatgagactgaaactgacagctcaaatataatagttgcatttgattgaaaaataaaactaaaatttgctgttaatggaatatctagcccctgaagagtattgagtcaaatttaaataactagaagggtccaccacatcgtaattgtttgagggttcatatgacagacatggaaatggttctgtttggtttctattttgacatacaatagatcttcttggatgggttttgctgacaacctgtggttacaaaaacgtctcctgggtggtctgagacttcattccatgtttatagattatttatattaatttatttctattaggctcaaatactataattggcatctcatcgtaaaaagcactagtttctccctctggttaggcatcccatctgatcccagacagaataaaaagtgggcaagttgtaggggaacatggaatgaggacaaaaatgattttgagaaaaatcaaagattgggaatagagtctcaattgaataacctactggtagtcttggaaaatagatagaactgatgagtatgaagaacattgcaaaacgtacaaaatattttcagtgttcaaatacctaaaagctctcacttttatataaaatgctggcagtggggttgtgttgcctatgctattttaagaaatgggttctaactacactttgttttaatgtaattgttgttttgcaagttccgctgagtaagacctactgcatagaagatgtcactttaggcaggagttacattaaatttggtaaccaagacagaatacctagctgttgggtgatgattctttttaggtttatctgtatgtttatctctctcccttcccctaccccattccttacttcccaactctggagggggattcttgaagtggttttcagatctgtcttggtttaacacagtgggtaaaagggaggttggaataagctgaacactgcaagttactggtggtgggagacgggctatagctgaagggaggtgtgatgactctgaatgggaagcaggctgaacctcattggctcagaaatgaaaggctttctgtttcaaaacacttataccaacattttcctttctgtcctcactcccagaattcaatctcttccttgcttctccctaatacttcagggagacaattgcctttgttctggtcccagaacatatcttcatcagtttccctagtcatcctgcctacttaccacatctcacccttgttgcctattaattttaaccactttatatccaaaattatacttgatttactgagtaacagttccttgaaacaaaacctactacagtagtaccaactgtgatagtgactaaactcaaatgtgtcctaagagcagctactgacattttgactgacaaatatgattgttataagggatggagaagtgtattttgtcagttacatatatgcctggacttactagccccatgaaaatgtgtttttgataggtgtctcagagttgtgaaattcaagtaccaacttgaatttaaaaaataccaatgtggcttgtgggaactctcagtaagtctgtacactcaaataatcaatgctttgatggtgggtagtcttccctttgttatcatgctcccctttctccgtcgacacatattttaagtgacatttattaaatattattcttcatcatgaaggaggcaaattagggcagagtataacaaatagcatcaggaatattacagtgaactttgctttaaagctaagacagacaaggcaatagagttctaaaaggaatgccaaaactctcccttcccagaatcttctttgaaatgttatctgagttaatgccccatctctttaaatatggcctggaagtggtgtcaggagggtgctttaagaattttagacttcggttaagctgggcagattggttggaactggtgaattggaaaggaataccaatttggcaagtttatgtttcagcatgccacacaaagttaaaaactgcactttgttttaatttaattgttgttttgcaagttccgctgagtaagacctactgcatagaagatgttaccatgtagtcatcagtctctaggctggttgttcttaactgagggtatttaggaaactttaaaactcaggtaaaatacctgcagagacacacacacgcgcacacacacatacacacgtgtgcgcgcacatacacacatgcacatgaatacacatacagagaccctttccatctcctttccacctatgctggaggcttggattcagtagatctgaagtggagcctgagcatctgcattttaaatgctccatagtacattccaatgtacagccaagactgaaaaacccctggctcagacacttcaatttggtctggagtttgatgtcctgtaggtgctttattgtgcaacaaacttatttaacaagtactatttgtcaggcactgttccaagcattctataatagctactcatttaattctcataccaaccctatgaggtaggtattatcatcatccctattttgcagatcaagcgaaagagagatacagataatcttctatcttaagtaaaaagacataaaaactatgtcccattgaagcatactattaagttaattgtatattaaagtgctgtgaacattgtgaaataagtacatatgattaactgagggtatttaggaaactttaaaactcaggcaaaatacctgcagagacacacacgcgtgcacacacacgcgcgcatgcatgcacacacacacatacacgcatgcacatgaatacacatacagagaccctttccatctcctttccacctacgctggaggcttgtggcattaaccagagtgaaagaagacaccttggtctggtttatgaatactgaggaatacatgaatcatctttactctcgatatctttgaaaacaagatgaatagctaaagagtaggctctccagtaaaacttcactctagaagatgagaaaggagcaataagacacaagtcaaacatattataacatgtgaatgtttattaatatcattaaaatatatgattgggtcttccttttttgcctttttataaattaagaaaaaccctggtctacttgatgaccttaaaatggactccaggaataataatgatatgatctattactagcaaattcagcaaccaaaacttcagaaaactagtccataagttcagtattctgtgtttattaatccatagtgatgtgtcaacctttacaacacagtcttttattagtaaagttaaatcagacagaactatagatacaaaaacacctaggttccagtctcagccttgagactaatgtgttctacgttctttcccctctcaaagccttagtttcttcatctgtaaaatggatgcgtttgccctagataatctctccaaggtctctaccagtataaaaagtctataaatatgttaagaactattgtgacaggaagctcatggcttttgtttcttcgatgtaataatttgttcctgcctatctcctgggatctctgagtgagcattggttagaaagaatgttgagctctctggtggacagctgacttctcttacccagcagaaatgaatctgtcaactttcattaggcattgtcgggtagcatcatgctcagtgatagattgtaccagaagtagtgttaggttgacatccaattataccaaggttctaaaaaggtagtctatttcactcttcttaaaattcctgagaatttgggatgctgcaaaacacgtaaaatggttgataggaagcaaaaaattgtttgccatgcattttaatactttcattttgaggctattgaagctgtatatggtcgtattatcaatagaagtgccttaaaaaattgtcaaggttagaagaacaggtttctggaacacctcacagttgtgatcacaactgagccttgtgcttttagccaaattgctccctggcctgttccccaagatggcacaatgtcaggagagcttcctcctaaggaaaatggcccaagaaagaaaaaagataggggtggtggttaggaagtgaaggaggcttctcctgatttccttgaccttttaaacagccataccatctggaaacagagtgggcagcacatcacacagagtgggcaaccacagagtgggcagtggcaaatcagagtcatctggactacatgaataattatgtggacatttaaattcccacccaataaaatccactttacatttataataattttaaaatattaagtgaataaaaatattaatttttccaaactctgcaagccttcatttggatttggctgtataaatctggcctgaagataatttctttctatttaccaacatagaaaggaattcaaattatgttgttaaatgaaacaagcaagttttataacacagttttagtttgattctacgaaaacaatgtagtatattttagaaaaagaaatgggaacattatgttgtatggagcaagggctgggaattctagaaattctagataactttatctttgttatatatttctatatttcatttttatacaacaaaaacattttagctttacatcagattaaaacaaaataaagtcttgttttagaaaaaaaagtaagggatatttgagggctttgggggtaataattattttcttccaacaggagttgaattatcagaaccttttcattatcaacttttgtccttaaactaaaagttaaaatctattattctcattgggattgattttctgtttcttgctttacctcaacaacccttttggcgaagatccattgaataattcaagaattctttctaaggtataaaacaagtcaagatggctagccccagctccttggtcccttgcctgggtgagaaagatctcagcacagcttcttttgctgggcatagaatggcttttgattttcttgatgtggctgttacctgatatttcaagagttgctctgaatatgccttggtaatctcttggtctaggcaggccaggctgaagagactattttgctcattgtagaatagtatctcataaggctccttattatctgggcaaaaccaaaaatctgctactctgcctctggccccagcagagccttttctaattaatactttatttggcagcagatgttttctgtgtgccatacactgaggcaacagctaagcagaatcccttaagtgaagatattccactaggaagggcaccttcccccaacccttcaggcttctctagtttgctcaggaaggtcttccttattgtcatatcttaaggcagtctatttttcttttcataattggcttactctctaaatagttactgtgttttctcaaatttctaaagccataaagagtatgttcaccttttataataccagcactttgggaggctgaggcaggtggatcacttgaggttaggggttcaagaccagcctgaccaacatggtgaatccccgtctctactaaaaacacaaaaattagtcaggcatggtggtgagtgcctgtaatcccagctactcgggaggctgaggcaggagaattgcttgaacccaggaggtgaaggttgcaatgagccgagattgtgccactgcactccagcctgggcaacagagtaagactctgtctcaaaaaataaaaataaaaaaatatatatatatatttatgtgtgtgtgtgtgtgtgtgtgtgttcaccttttaaacaatataaaagtatacagaacaaaacatgaaaatccccctttgtttccttccccatcttcaatggtctgatatacatctttccagttccctttctatgcatttacatacacatgtatacataaatatatatgatgtttctttgcatccactaaaattttctgcaaggttgaaagtgttctaaatctgtgctatgcaatatggtagctacatgggacagctgagcacttgaaatgtgactagtgtcactgagggactaaatttttaattttaagtaattcaaatttgtttaaatttaagtttttaattggcaacccaatgggaaagaagaaatgaaattttctctgtagacaacaagatcatatacatagaaaacccctaaagactccatgaaaaactgttaaaatgaaaatggtaaaagtgcaggatacaaaatcaacacagaaaaatcagtagcatttgtctatacaaacaataaactatctgaaaaagataaagaaaataatcccatttaaaataaaatagaaaaaatacttatgaataaatttaaccaaagaagtaaaatatctttataccacaaactatcaaaattgaaataaaaaaatgaaaaatacaaatacatgggaggatatgttcatggagttgaaaaattaatattgtcaaaatagccatagtacccaaagaaatccacagattcaacgcaattcctatcaaaattccaaggccatttttcacagaaatatacaaaaaaaaatcctaaaattcatatgaaatcacaaaagatcccaaagagccaaaacaatcttgagcaaaaagaacaaaaccagaagcatcattctatctgatctgaaaatttaccacacagctatagtaaccaaaatagcatggtagcagcataagaacacttatacagaccaatggaacagattagagagccaaaaaataaattaatatatttatggccaactgatgtttgacacaggtgctagtaatatacaatggggaaaggactagtctcttccatacgtggtgttaggaaaactggatatccacatgcagaagagtgaaattagactctcacatcatatatgaaaatcaactcaaaatgtatcaaagacttaaatataagacctaaaattgtaaagatactggaagaaaacacaggggaaaagcttcttgacattggtctgagcaaagattgttttggagatgacttcaaaaacacaggcaactgatatagtttggatctgtgtccccatccaaatctcatcttgaattgtagttcccattatgcccatatgtcaagggagggactgggtgggaggtgattggatcacaggggagtttcccctaagctgttctcataaaaatgagggagttctcatgagatctgatggttttataagtgacagttcctcctacacacactcttttcgcctgctgccatgtaatgcatgcctgcttccctttctgccatgattgtaagtttcctgaggccttcccatccgcagaaccattagtcaattaaacctctttcctttataaactacccagtcttgggtactatctttataacaatgtgacatcaggctaaaataggaaattagtaccacaaagaatggggtactgctataaagataccaaaaaatgtggaagcgactttggaactgggtgacaggcagagttggaacagtttggagggctcagaagaagacaggaagatgtgggaaagtttgcaactttctagagatttgctgaatggttttgtccaaaattttgatagtgatgtggacaatgaaatccaggctgaggtggtctcagacggaaatgaggaacttattgggaattggagaaaagatcactcttattcttttttttttaaattattactatactttaagttctgtggtatatgtagaggacgtgcagtattgttacataggtatacacgtggcatggtgctttgctgcacccatcaaccagtcatctacattaggaatttttcctaatgctatccctcccctagctcctcactccccaacaggccctggtgtgtgatgttcccatctctgaacacatggaacaatgaatccatgtgttctcattgttcagctcctacttacgagtgagaacatgtgatgtttggttttctgttcttgttgtttgctgagaatgatggtttccagcttcatccatgtccctgcaaaggtgatgaactcatccttttttatggctgcatagtattccatggtgtatatgtgccacattttctttttttttcttttttttattattatgctttaagttttaggatatatgtgcacaatattcaggtttgttacatatgtatacatgtgccatgttggtgtgctgtacccattaactcatcatttagcattaggtatatctcctaatgctatccctcccccctccccccaccccacaacaggccccagtgtgtgatgttccccttcctgtgtccatgtgttctcattgttcaattcccgcctatgagtgagaacatgcggtgtttggttttttgtccttgcgatagtttgctgagaatgatggtttccagcttcatccgtgtccctacaaaggacatgaactcatcattttttatggctgcatagtattccacggtgtatatgtgccacattttctaaatccagtctatcattgttggacatttgggttggttccaggtctgtgctattgtgaacagtgccgcaataaacatatgtgtgcatgtgtctttatagcagcatgatttataatcctttgggtatataccctgtaatgggctggctgtgtcaaatggtatttctagttctagatccctgaggaatcaccacaccgacttccacaatggttgaactagtttacagtcccaccaacagtgtaaaagtgttcctatttttccacatcctctccagcacctgttgtttcctgacattttaatgatcaccattccaactggtgtgagatggtatctcattgtggttttgatttgcattgatggccagtgatgatgagcattttttcatgtgtttttttggctgcataaatgtcttcttttgagaagtgtctgttcatatcctttgcccactttttgatggggttgtttgtttttttcttgtaaatttgttggagttcattgtagattctggatattagccctttgtccaatgagtaggttgcaaaaattctctcccattctgtaggttgcctgttcactctgatggtggtttcttttgctgtgcagaagctctttagtttaattagatcccatttgtcaattttggcttttgttgccattgcttttggtgttttagacatgaagtccttgcccatgcctatgtcctgaatggtattgcccaggttttcttctagggtttttatggttttaggtctaacatttaagtcttcaatccatcttgaattaatttttgtataaggtgtaaggaagggatccagtttcagctttctactcatggctagcccgttttcccagcaccatttattaaataggggatcctttccccatttcttgtttttgtcaggtttgtcaaagatcagatggttgtagatatgcggcattatttctgagggctctgttctgttccattggtctatatctctgttttggtaccagtaccatgctgttttggttagtgtagcttgcagtatagtttgaagtcaggtagcgtgatacctccggctttgttcttttggcttaggattgacttggcaatgctggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggttcttcacatcccttgtaagttggattcctaggtattttattctctttgaagcaattgtgagtgggagttcactcatgatttggctctctgtttgtctgttattggtgtataagaatgcttgtgatttttgcacattgattttgtaacctgagactttgctgaagttgcttatcagcttgaggagattttgggctgagacgatggggttttctagatatacaatcatgtcatctgcaaacagggacaatttgacttcctcttttcctaaatgaatgccctttatttccttctcctgcctgattgccctggccagaccttccaacactatgttgaataggagtggtgagagagggcatccctgtcttgtgccagttttcaaagggaatgcttccagtttttgcccattcagtatgatattggctgtgggtttgtcatagatagctcttattattttgagatatgttccatcaatacctaatttctggagagtttttagcatgaagggttgttgaattttgtcaaaggccttttctgcatctattgagataatcatgtggtttttgtctttggttctgtttatatgctggattatgtttattgttttgcatatgttgaaccagccttgcatcccagggatgaagcccacttgatcatggtggataagctttttgatgtgctgctggattcggtttgccagtattttattgaggatttttgcatcaatgttcatcaaggatattggtctcaaattctcttttttagttgtgtctctgccaggctttggtatcaggatgatgctggcctcataaaatgagttagggaggattccctctttttctattgattggaatagtttcagaaggaatggtaccagctcctccttgtacctctggtggaattcagctgtgaatccatctggtcctggactttttttggttggtaagctattaattattgcctcaatttcagagcctgttattggtctattcagagattcaacttcatcctggtttagtcttgggagagtgtatgtgtcgaggaatttatccatttcttgtagattttctagtttatttgtgtagaggtgtttatggtattctctgatggtagtttgtatttctgtggaatcgatggtgatatcccgtttgtcatttttcatcgtgtctatttgattcttctctcttttcttctttactagtcttgctagcggtcaatcaattttgttgatcttttcaaaaaaccagctcctggattcattgattttttgaagggttttttgtgtctctatttccttcagttctgctctgattttagttatttcttgccttctgctagcttttgaatgtgtttgctcttgcttctctagttcttttaattgtgatgttagggtgtcagttttagatctttcctcctttctcttgtgggcatttagtgctataaatttccctctacacactgctttgaatgtgtcccagagattctggtatgttgtgtctttgttctcgttggtttcaaagaacatctttatttctgccttcatttcgttatgtagccagtagtcattcaggagcaggttgttcagtttccatgtaattgagtggttttgagtgagtttcttaatcctgagttctagtttgattgcactgtggtctgagagacagtttgttataatttctgttcttttacatttgctgaggagtgttttacatccaactatgtgttcaattttggaataggtgtggtgtggtgctgaaaataatgtatattctgttgatttggggtggagagttctgtagatgtctattaggtccgcttggtgcagagctgagttcaactcctggatatccttgttaactttctgtctcgttgatctgtctaatgttgacagtggggtgttaaaatctcccattattattgtgtggtggtctaagtctctttgtaggtcactaaggacttgctttatgaatctgggtgctccagtattgggtgcatatatatttaggatagttagttcttcttgttgaattgatccctttaccattatgtaatggccttctttgtctcttttgatctttgttggtttaaagtctgttttatccgagactaggattgcaacccctgcctttttttgttttccatttccttggtagatcttcctccatccctttattttgagtctatgtgtgtctctgcgtgtgagatggggttcctgaatacagcacactgatgggtcttgactctttatccaatttgccagtctgtgccttttaattggagcatttagcccatttacatttaaggttaatattgttatgtgtgaatttgatcctgtcattatgattttagctggttattttgctcgttagttgatgcagtttcctcctagccttgatggtctttacaatttgtcatgtttttgcagtagctggtaccggttgttcctttccatgtttattgcttccttcaggagctcttttagggcaggcctggtggtgccaaaatctctcagcatttgcttgtctgtaaagtattttatttctccttcacttatgaagcttagtttggctggatatgacattctgggttgaaaattcttttctttaagaatgttgaatattggcccccactctcttctggcttgtagagtttctgcagagaggtcagctgttagtctgatgggcttccctttgtgggtaaccagacctttctctctggctgcccttaacattttttccttcatttcaactttggtgaatctgacaattatgtgtcttggagttgctcttctcgaggagtatctttgtggcgttctctgtatttcctgaatttgaatgttggcctgccttgctagattggggaaattctcctggataatatcctgcagagttttttccaacttggttccattctctctgtcactttcaggtacaccaattagacatagatttggtcgtttcacatagtcccatatttcttggaggcgttgttcatttctttttattctttttttgtctaaacttctcttcatgcttaatttcatttgtcttccatcactgataccctttcttccagttgattgcatcagttactgaggcttgtgcattcatcgtgtagttctcgtgccatggttttcagctccatcaggtcctttaaggacttctctgcattggttattccagttatgcattcatctaatttttttcgaagtttttaacttctttgccattgatttgaacttcctcctttagcttggagtagtttgatcttctggagccttcctctctcaactcgtcattctccgtccagctttgttccgttgctggtgaggagctgcgttcctttggaggaggagaggcactctgatttttagagtttccagtttttctgctctgttttttccccatctttgtggctttatctacctttgatctttgatgatggtgacgtatagatgggtttttggtgtggatgtcctttctgtttgtcagttttccttctaacagtcaggacccttagctgcaggtgtgttggagtttactggaggtccactccagaccctgtttgcctgggtatcagcagtggtggctgcagaacagcgggtattggtgaactgcaaatgctgctgcctgatcgttcttctggaagttttgtctcagaggagtacccgggagtgtgaggtgtcagtccgcccctacttgggggtgcctcccagttaggctactcgggggtcagggacccacttgaggaggcagtctgcccgttctcagatctccagctgcatgctgggagaaccactactctcttcaaagctgtcagacagggacatttaagactgcagacgttattgctgtcttttgtttgtctgtgccctgcccccagaggtggagcctacagaggcaggcaggcctccttgagctgtggtgggctccacccagttcgagcttcctggccgctttgtttacctactcaagcctgagcaatgcggtcgcccctcccccagcctcgctgccaccttgcagtttgatctcagactgctgtgctagcaatgagcgaggctccatgggcataggaccctccaagccaggtgcgggatataatctcctggtgtgccgtttgttaagcccgttgggagggcgcagtattagggtgggagtgacccgattttccaggtgccctctgtcacccctttctttgactaggaaagggaattccctgaccccttgtgcttcctgggtgaggcgatgcctcgccctgcttcggctcacacacagtgcactgcatccactatcctgcacccactgtccagcactccccagtgagatgaacgcggtacctcagttggaaatgcagaaatcacccgtcttctgcatctctcacgctgggagctgtagactggagctcgccaaattttctttatccagtcatgctggagaggttgtagagaaataggaatgcttttatactgttggtgggagtgtaaattagttcaaccattgtggaagacagtgtggagattcctcaaggatctagaactagaaataccatttgacctagcaatcctattactgggaatatacccaaagtattataaatcattctactataaagacagagagacacatatgtttatggctgcactattcacaacagcaaagacttggaaccaacccaaatgcccatcaatgatagactggccacgttttctttatccagttcttgtgatggtttgctgagaatgatggtttccagcttcatccatgtccctacaaaggacatgaactcatccttttttatggctgcatagtattccatggtgtatatgtgccacattttcttaatccagtctatcactgatgggcatttgggttggttccaagtctttgctattgtgaatagtgctgcaataaacatatgtgtccatgtgtctttatagtagaatgatttataatactttgggtatattcccagtaataggattgctgggtcaaatggtatttctggttctagatccttgaggaatcaccacactgtcttccacaatggttgaactaatttacactcccaccaacagtataaaagcattcctatttctccacatcctctccagcatctgttgtttcctgactttttaataatcaccattctaaatggtatgagatggtatctcattgtggtttggatttacatttctctaatgaccagtgatgatgagcttttattcaggttggttggccacataaatatcatcttttgagaagtgtctgttcatatccttcacctgatctttgatggcgttgttttatttttcttttaaatttgtttaactttatagattctggatattagccctttgtagattccggatattagccctttgtcagatggacagattgcaaaaattttctaccattctgtaggttgcctgttcactctgatgatagtttcttttgctgtgcagaagctctttagtttaaatatatcccatttgtctattttggcttttgttgccattgaatttggtcttttagtcataaagtctttgcccatgccaatgtcctgaatgttattgcctaggttttcttctagggtatttatggttttaggacttacgtttaattctttaatccatatgagttaatttttgtataaggggtaagaaaagagtccaatgttggttttctgcatatggctagccagttttcccaacaccatttattaaataaggaatcctttccccattgcttgtttttgtcaggtttgtcaaagatcagatggttgcagatatgtggtgttatttctgaggcctctgttctgttcattggtctatatacctgttttggtaccagtaccatgctgttttggttactgtagccttgtagtatagtttgaagtcaggtagtgtgatgcctcaagctttgttctttttgcttaggattgccttggctatgcgggctcttttttggttccgtaggaaattgaagtagttttttccaattctgtgaagaaagtcagtgttagcttgatggggatagcattgaatctataaactactttggtcagtatggccgttttcatgatattgattcttcctatccatgagcatagaatgttttcccatttgtttgtttcctctcttatttccttgagcagttgtttgtagttctccttgaaaaggtccttcacatcccttgtaagttgtattcctaggtattttattctctttgtagcaattgtgaatgggagttaactcatggtttggctctctgtttgtcagtttttggtgtataggaatgcttgtgatttttgcacactgattttgtatcctgggactttgctgaagttgcttatcagcttcaggagattttgggctgagatgatggggttttctaattacacaatcatgtcatctgcaaacagagacaatttgacatcctcttttcctatttaaataccctttatttctttctcttacctgattgacctggccagaacttccagtactatgttgaataggaatggtgagagactgcatccttgtcttctgctggttttcaaagggaatgcttccaatttttgcccattcagtaagaaagtaagggatatttgagggctttggggtaataattattttcttcctacaggagttgaattattagaaccttttcattatcaaattttgtccttaaactaaaagttaaaatctgttattctcattgggattgattttctgtttcttgctttacctcaacaacccctttggcgaaggtctattgaataattcaagaattctttctaaggtataaaacaagtcaagatggctagccccagctccttggtcccattcagtatgattggctgtgggtttgtcataaatagttattattttgagatacattccatcaatacctagtttgttgagaatgtttagtgtgaagggctgttgaattttgttgaaggcatttcctgcatcgattgagataatcgtgtggtttttgtcattggttctgtttatgtgatggattatgtatattgatttgcatatgttgaaccagccttgcatcccagggatgaagctaacttgatcgtgctggataagctttttgatgtgctgctggatttagtttgtcagtattttactgaggattttcgcatcaaagttcatcagggatattggcctgaaattttcttttttttgttatgtctccgccaggttttggcatcaggatgatgctggcttcataaaatgagttagggaggattccctctttttctatttgttggaatagttgcagaagaaatggtaccagctcctctttgtacttctggtagaattcggctgtgaatctgtctggtcctggactttttttggtcagtaggctattaattactgcctcaatttcagaacttgttattgctctactcggagatccaatttcttcctggtttaaacttgggagggtgtatgtgtccaggaatttatccatttcttctaggttttctagtttatttgcatagaggtgttcatagtattctctgatggtagtttgtatttctgtgggattggtggtgatatcctctttatcattttttattgcatctagttgattcttttctattttcttctttgttaatctggctagcggtctattttgttgatcttttcaaaaaccaggtcctgggttcacagcgttcaaactttactaaggatcagactgcttcctcaagtggttctatgatctcgggtatactgaatgggagatacctcccagtaggagccgacagacacctcatatgggagagctctggctggcatctggtgggtgcccctctgggttgaagcttctagaggaaagaacaggcagcaatctttgctgttctgcagcctcctctagtgatacccaggcaaacagggtctggagtggacctccagtaaactgcagcagacctgcagcagacgggcctgactgttagaaggaaaactaacaaacagaaaggaatagcatcaacataaacaaaagtacgtccactcagagaccccatccgaaggtcaccaacatcaaagaccaaaggtagataaatccacaaagatggggatagaccagcgcaaaaaggctgaaaattccaaaaaccagaatacctcttctcctccaaaggatcacaactcctcgccagcaaggaaacaaaactggacggagaatgagtttgatgaattgacagaagtaggcttcagaaggtgagtaataatgaactcctccaagctaaaggagcatgtcctaacccaatgcaaggaagctaagaactttgaaaaaatgttagatgaattgctaactacaataaccaggttaaagaagaacataaatgacctgatggagctgaaaaacacagcacaagaacttcatgaagcatacacaattatcaatagctgaatcgatcaagcagaagaaaagatatcagagactgaatatcaacttaatgaaatgaagcaagaagacaaggctagagaaaaaaagaatgaaagggaatgaataaagcctctaaaaatatgggattatgtgaaaagaccaaatctacatttgattggtgtgcctgaaagtgactgggagaatggaaccaagttggaaaacactcttcaggatattatccaggagaacttccccaacctagcaagacaggccaacattcaaattcaggaaatacagagaataccacaagatagttgtcaagtatctactttgtcaagtagagcgaccccaagacacataattatcagattccccaaggttgaaatgaaggaaaaaatgttaagggctgccagagagaaaggttggattacccacaaaggtaagtccatcaaattaacagtggatccttctgcagaaactctacaagccagaagagagtgggagccaatattcaacattcttaaagaaaataattttcatcccagaatttcatatccagccaaataagtttcataagtaaaggagaaatagaatcctttacagaaaagcaaatgctgagattttgtccccaccaggcctgccttagaagagctcctgaaggaagcactaaacatggaaaagaagaccggtaccagccactgcaaaaacataccaaattgtaaagaccatcgacactatgaagaaactgcatcaactaataagcaaaataaccagctagcatcataaagacaggatcgaattaacacataacaattgttgcctcagagggtgcaagtcccaagctttgacaacttccacatggtgttgggcctgcgggagcacagaagtcaagaactgacatttagaaacctctgcctagatttcagaggatgtatggaaacacttggatatccaggcagaagtttgctgcaggggaagagctctcatggagaacctctgctaaggcagtgtggaaggaaaaaatgtagggtaggattcctcacacagagtccccaatggggcactgcctagtggagctgggagaggagggccactgtcctccaaaccccagaatgatagatccactgacagcttgcacagtgtgcctggaaaagctgcaggcactcagcaccagcctgtgaaaacagctggggaccgggggtgccccaccttgcaaagccactggggcagagctgcccaagtccctgtaagccaacctctttcattagcatgacctggatgtgatacatggagtcgaagaagatcagttcagcgttttaatatttagtgagtgcctcacttgattttggatttgcatagggcctgtagcccctttgttttggccaatttctcccatttagaacaggagcatttacccaatgcctgcaatcttatcatatgtaggaagtaactaatttgcttttggttttgcagcctcataggcagaggggactagtgttgtctcagatgagacttcggactgtggacttctgagttaatgctgaaatgagttaagactttggggtactgttgggaagatatgattgattttgaaatataaaaagtacatgacatttgggaggggccagaggcagaatgatatggtttggctctgtgtctccatccaaatctcatctcaagttgtagtccccataatccccacatgtcgagggagggaccagctgggagatgattggatcatggaggcagtgttccctaggctgttctcatcatagtgagtgagttctcatgagatctgatggttttataagtgtttgatatttcctcctacacacactcttctcttgcctgctgccatgtaagacgtgcctgctttctcttccaccataattgtaggtttcctgaggcctccacagtcatgcagaactgtgagtcaattaaacctctttcctttataaattacaggcttgggcagtatctttatagctgtgtgagaatatactaatacagcaaataaagcaaaaatacacaaaatatcaatctaaaaatcttctacacagcgaaggaaacaacagagtgaagagacaacctatattgaaagaaaatatttataagccatacatctgataaggggctcatagccaaaatatataagcaactcaaaaaactcaatagcaagaaaacaaacaacatgattaaaaatgggcaaaggacttgaatagacatttcttaaaagaagacatataaatggcaagtaaatacatggaaaaatgctcaacactgctaattattagggaaatgcaaattaaaaccacaatgagatatcacctcacaccagtcagaatggctactataaaaaaggtgaaagataaatgttggcaagggtgtacagaaaagagaactcttgtatatcattggtgggaatgcatgtaagcacagccattatggaaacttatatgaaagtttctgaaaaaactaaaactagaacttccatatgatccagcaattccattcctgggtatacagttaaccgttgaacaacatgggagttagggatgctgactctcacggcagttgaaagctcatgtataacttttgactccccacaaactttgctactaatagctttctgtttactggaagccttactgataacatagttgttaaacacatattttttatgttatatgtgttatttagtatattcttaaagtaggctagagaaaataaaatgttattaaaatcataagaaagataaaatatatttactattcattaagtggaagtggttcatcataaagcttctcatcctggtcatctttacattaagtaggccgaggagaaggaggaagaggagggggttggtcttgctctcccagtggttgcagagttggaggaacatctctatataagtgaacctgcacagttcaaactcatgtcgttccagtgtcaacagtatttacaaaggacatgaaatcagtatgtcaaagagatatctgcacttgcatgttcattgcagcattattcataataaccaatatatggaatcaacccaagtattatcaacctaagtatttacctgtggaagaatggataaagaaaatgtgatacacacacacacacacacacacagtggaatattattcagccttaaaaagcaaatgaaatcctatcctttgtgacaacataaataaacctagaggacattatgctaagtgaaataagctatgcactgaatgacaaataaggcataatttcacttatacatggaatctaaaacagttgatctcatagagccagagagtagaatggctgggggtggggaatgggaaatggggagatgttggtcaaagggtataaagtttcagttagataggaggaataagttttttgagatctattacacaacatgaaggctatcgttaataatcatgtctatttcaaaattgctaagacagtaaatttcaaatgttcttaccacaaaaagtgataagtatttgaggttatggctatgttaattaccttgctttaatcattctacattgtatatatatgtgtgtgtgtgtgtgtgtgtgtgtatataatcagattgtaccccataaatatatacaattataatttgtcagtttataataaaataaataattaaaaaataaataaaatttaagttttagtagccatatatggcaattggctatcatattacgcagtgcagatcaaaatagtagggaccaggaacttagaaaacagcaacagtgtgagaaatataactatgggtactagggtaccagtgttttactagagatgcatcatctcactttatcttcacaatcctattattaacagatttttaaaaaaaccctcaggcatagagaattttagaaagttgtccaagacagaaggcattagagtgtggattcaaattcagacaatatagctccagaaagtacccccctgagtttaagcatgtgggaaatcatgtgataaactggaaatggcataagttttggtatagagaaaactaattttggatcttcatcctgccacttattggactctgtgtgacattaggcaagtcacctatcctctctgattctttattataaaacctataatatgggactcacaatacttctcaccatcaatgggatatacactttaatatatcatatgttatttccccctcttccatcttccctatcaaataagtttgcctttggggcaaaactacctatagtaggggatgttttcactggccatgaaacagattaaaattaactgagattaaaacagatcaaaattaagcaaacacattattccttgtgggccagggcttattatcacagaattctagatagctgagctaattgaagggcaaagaagtctctggaactaccacactgaatgtaaggataaaggcaaggagcagtttggtctgctgcagattaattggctaatgcctatggtttgtaatcagattgtggttcaagttctagttctaataattactacttgtgtgaccttgggaaagtcacctaccctctttctctctgttttctcatatataaaatgggggtaataaggaagttccagagactttcttgcctttcagttatctcagctgtctagaattatgtactaattacatgttgtcttgtaacctttgaggaaagataatatgtaaagtctatttccctgaaattcagagctggagttgcttttgtgttcttgatttcttcaattttcttatctctgaaaaaaatgttggcacttctgcctatgtggtttatgaatcctgccatagttcgattagagtaatgtatttttgtaacacatttgaaccacatgcttgtgacatactccattgcatgactctttcgttaagatctactggaaatgtcagagtctctttaaaggcagttgttaaacattaacataagaatgtttgttaaactcttccagaaaaggatactatgtaaatcataacatcatttaaattggtcaaccactattaattcaggctaattgtggaagagtccaagctgaactgctgataaatctaaagagtacagtatatataaaggagtgctagctagctggtgatgagtaagactcatggtgggcctactttaatgaaagatatcattcatttgtaattgtaatcactataataatggagtggaattaaagtaattgaaagcacagtttggtctattaagtagtttgaatattcctctagcatttctgtttattccattaattttcttagcaatatcctttcatagatatatcctttcatagatattgcaaggtcaacttaagcccagcctgggtccaaatgatcacaaaacttgagtttattaggtccacattaatgaggacttattataatgataaatctataaagatcaaaacctggggcaggctatcggttatgctatctcttatttaattgctttggtttttttctattataaatttcacctttcataccactctacacatgatgttgggattagaacagtctcctgagaacaccataactaaatgtgtatgcttaaatagagacccacttattggtgccagttaatccttaatgaatgtaacatcaataaagtaggtaataaaaaaagttaaattttattgctaatcttaaatcctactttaaggagaagaaaaaccttaatgctatggctagagttgagtagcactagattagcattggtgtacattaataatgaaaatagctgagccccattagtgtcacttaaagttttgtgaattagagatatggccctacaaattaaacaccttgaatactgaatgggggaataattattatttaaaaagttaaaaccttcacatctcttctaaaggaaaatttttcattggtatagaattacataccattcactctacagtatgaaaaggatggaactttgcagaccataaaaagtataataaaggagccactaaaattgatttttatttaagcagattactagtgttttcttccttaactggaaggagtgccctgtactcctccaacctattttcagccatgatactatttctacatgcataattagacactgacccctttgaggaagtttaaatgtcccttattatccccaacctcaactccaaaacctttttcagccaagcaagagaataggaaatatatagaaatgaatgtgcaaaactttccaacatgtgtgcatatagaacaaattgtgaggtcagtgaagtgagtccctattttccttcttactctgtatgcttctttgtctccaaccatgcccaacccagtagtttcctctgtagcccagggtcttctacgtcaatgccctaaaaaagcctgcactccccttccccacctcattttccatcccctactccgcctccacaaaacttacttgttctgagtcaattttatcagatccctgctgtctttcaagagtgttattagtagtagtaatggcagtaggaggaatcatactataacaaggaaaactaatagccagtgtgagtataatgactgttatattatgctccaggcactctgcaagcattttacatccagtacttcatttaatcctcacttttacagatgataaaattgaggcttagaaagagtaagtgtcttgtctaaggtcccacagtgaataagaggactcactcttgtttgtttgttgtagctcttaactgctacaactctatactgcctacatagttttaggaaaagcagtaagagttaatatcccagaaagcattttgaaaaaagttaaaatggttgttccctcctaaaccatttgtagttcattatcggactttgctgtattgtcttatttttaaagtagggggatgggagagagtaaggaagagggaggaaaagaaaggaaggaggataaagaggaagaactgactttcaggccagaatggatactttgccttagtcaaacatccgagtacataatatctaggcttcttattctccttgacaagatgcaggccagtaatgccatgaaactggcataaatacagttgtccctcagtatctccaaggattggttccaggacccccacatattcccaaattcttgcatattcaagtcccacagtcactgctctgtagaacccacatatatgaaaagttggccctctgtatacacaggttttgcttcctgcaaatactgtattttctatgtttaactgggggaaaaaagtatgtataagtagaactgtacagttcaaacccatgtttttcaaggatcaaatatattccccatctccctttcccatccactcacaaattcctggtccaatcacttgtggctgaggtagcaggattggtttcacacaatataaataatagcacattgtgtgagaaaaaaactgtgggacactttccttaaaagttctatacatacagacatagcaggcctctgaggttacctcaacttctcttagagcctatcaagtacaaatatgtatgattctcttagggcttaattagtgggtggacaatataaaagttgaggacatcctccaaatgacagaaagggtggccttatctcaggaatgagagttcttctagccctaagactaatgccatgaaatatttgctactacacctttgcttctttctcatttccaaatccagtactctctcccaggtacactctggggtcttattggtttcatctaaagttcctaatcagccattaatgattctggctccctgaatgtaaaatttcttttgttttctttaatatgaactgtgaggactcaggatccagctggccctagatacttagggaaactattgagctctgctttggtggcaattgccttggctagttgaaagctctgtttagttccccatctgtgtttgtatgtgacttatataaattagttacttttgaaattgcaggtggttttaaaacaaaaactcgtattctaagtaaaaggataagtgagggctataccttctgaaactaacctgaagtaagtaatcttgtatcagtttcctgatcatactctagctttcttctccaactggagtgaccctttacaagacatggtctgaagctttttgcaaagacagcctcttctcaaatgtatacctggcagtaattttcccatgaatggtcttgatgctaacaatgtctgattcatctgcctttttattctcttctgttactaactcactagaaataatctctgacaaagtccacatgtatgagaattagccttagaacaagagaagccaagacattggctattagatgttagggtgatcaaccatcctggttttcccaggattgttccaagattaacactgaaaatcttgtgtcctgagaaaaaccctagcccaaagcaaaccaggatggttagtcaccctaccagatgtacatgtaggctatatggtgtattagaaagaacactggtcttcaaaagtctgagcccaagtcttactactgtcacttattatgttaaccatatagtcttctattttttcataatacttatcagaattttaattttgtattttgatatttatttgtttagtgtttgtctttctcattagaaggtgagccccatgagtgctagagtcatatcttgtttgttccccattacaactccaacacttacaatgcctcacaagaagtaggcactcaacacttatccattgaattaataaattagtaagtcacgactgctctagttttccattttctcatccataatggagacattacttacttccagtagttgtgaggaattgagacaatgtgtatgtaaaagagacaatgtgtgttttgtaaaccatacacaaaacattattaatgatggtacttatgatgtgtgcttgataataatatctgtcttttattgaggaacctattcagtggtaggccttttcaatgttttttttatttcattgttatcgtccttcatataggtaggttggtattttatccccattttagaaattagaagattgagtttacaaagaattacggccaactacaaggctagagggcacagtctccaagactgcactcacttctgacaccaactgcaactttggatgattcccaaaaccactcttatgtaggataaatcactagaaagactcatagaacttactgaaagctatcatactcatagttatggtttattgcagggaaatgatacaaattaaaatcaaccaagggaagaagcacatataccagaatccagaagtactaaatatagagcttccattttcctctctctgtggagtcaggacatgttactctcctggcatccttatgtgacagtgctcatggtgtattaccaaccagggaaacttacatgagccttgttgttcagagtttttattgagactcgattacctaggcatgactgatcatttgcccacatagttgatctcagtttctgggtagactgataccatccaatccaaagctcctactccaaatcacattgttagtatctgtctatcataaggcccctaagcaaataaaaattacctcctgggagctgagggcaaaggccagacctcttttggagcaattttaaattctttcttacagaaaggtgcagagaggtcaatcaacttgccaaaagttgcacagctggcacatgtacaccctagtcagcctccctctagtgcccatgctattattttccattgtgtgccctgtgtgcctgaaaaacaatgcagttttaatgtgctataaaataatgtataaccctatacatagaataaagaaaggcctaactggaagtaaaaaaaaataataggcagaaattgtactactttctcatctacctttttcctctcatagctctcaaatttgaaccttcctttattccttgaaccataacataggcccatacttggaaaagtgcaaagtggacaaaagtgggtagaaagtttgtctagggtatgcttccactctaccaacctcccctcttgtgcactagggcttataaataccctcatatgtgcacacatgcatgcacacacagaaacacacacacacacacacacctcaactcacaaaggggcctattttttatggtctgtctaaaaaattcaattttatgtgttaaataaaaattggaaatccttcctacggccatttgcttttaaatatgagcttcttaaacatagaataactatgatgacaaagaaattaacatcatttgatgagatttataatagggatttgtggttatagagtctccctgtgtctccaatcacagtatagccagccatcccatacatttgtgtgctagaagctggagaagggtgtggaaaaatgacaagtaataacaggagagggaaacaagaaaggaaggagggatactctgaagctctgaagtaatctgtacctattcagaagtggagaacagaattcaaggggccacattacatggaacatcatccaaagtttagataaaccagagtaagcctagcgaagactgaaagagaaggcaaagggtttggtacagccattttatttgttatcttttagatggaggagaaggagtgcaaaattatagctaacctactacagtggctagcagtagaaacagcacagaccttagagcgaggcacaccagagtttaaattccaactccaccgttaactatgtggccataggaaaattattttgcttctccaaccctcagtctcctcacttgtataattgatgctaatactaaaacacatctcctaggacccttaaaagagattaaataaggtaatgtatgcacagtatctctgaggtcagttaccaggtctttgaggtcagtattgcctggaatccttacttggcaatgggtagaggtgcaagtctgatgactagagcatgtgctgagccacctcctcagatgtggcaaaatgtgagtaaagctttgttatcctacttggtacaatggaaatatcttgcattatggggtcaatacattcaggtttcaatccaggctatgctactttcaagctatgtgacctacaggaaaatgtttagcctctctgtgactcagtttccttatctgtaaaatgggtaatagcacacatagcttgcaagttctgtaaaggacctatcccaatatattgctttcttatgctccacagtgtttccagagaccaaagaaagagcatcttcataaacagatagatccaataaaatattttcatgtaaactacatatcatacatatgcatatatatacaagatgtatatgtataaaaatatatacatacattgaaaaaattctttccttgagtaatagtggcaccaccctagttgaaatcaattgaccataaatgtgtatgtgtgtgtgttttctagactgtcagttctactccattgatctatgcatctatccttttgccagtattgcactgttctgattactatagctttgtaagttgtgaaatcaagaagtatgatactgcaaattttgttctttttttcagattgttttggtcattgagtctcttgtaattccacatgaattttaaaattaacttgttcatttctgcaaaaaaaaaggcagttggaattttgatagggattgcattaaatctggagatcactttaaagagtattgccatcttgacaacattaagtcttccaatctatgaatacaatgtcttacagcttacttaggtctttaatttcttttggtaatgttttacagtacttagtgtgcaggtcttgcacctccttgattaaatttattcctaagtatttttttcatgctattactaatgggattgttttcttaaattcattttcagatccttggatgctactattaatatatatttttgtataccaatatcgtatcttgcagctttgctaaactgttagctctaatagcttttctgtggattcctgagtattttctatatacaagatgtttctatatgcaaatagatagttttacttctttttttccaatatggatcatttttattccattttcttgcctaattcccttgcctgtcaccctgtacctccagtacaatgttgaatagaagtgaggagagtaaaaattcctgacttttttctgatgtttggaggaaacatttcaatcttttaccactaagtatgcttctagctttgtgtttttaatagattacctctattggattgaggatgtttctgtctattcttagtttgttgagtgctttttattatgaaaggttgtcagattttgtcaaattattttcctgcatctattgaggtgatcatatttttttcctttttattaatattacaaagctacagtaattatgactgtgtggtaatggcataagagtaggcataaagttcagcggaatagaattgagagtgcagaaataaactcatatatctatgtcaatttttttttacaaggatgccaaaagcattcaatgggaaatcaatagtcttttcaacaaatagtgctgaaacagctggatatccacatgcaaaagaataaatttggaccactttctcatgccatatacaaaaacgtaaactagctcaaagaggtagatataagagctaaaacaataaaactctcagaagaaaacataggcataaatctttgtgatctttgattggacaatggtgtcttaaatatgacatctaaaacacaagcaaccaaagaaaaatacataaatgagacttcataaaaattaacaacctttatgcatcaaaggacactagcaagaaaatgaaaagatcgcccacagaatgggagaaaatatttacagatcatatatctggcaagagtctagtatccagaatatatcatgagctcttataactcaacaatgaaaacacaccttaaatttttaaaaaggcaaatgatttgaatagccatttctccaaagatctacagatcaacaataagcacatgaaaagatgctcaagatcatcagtcattagggaaacacaaagtaaaatgacaataagatatcatttaatatcacatggaatggctataataagaaaagaaaaagaagtattggtaagtatgtggagaaactgggaccctcatgcattgctgatgggaggtaaaaatgtatacccattgcagaaaacagtctggcagttcctcaaaaagctaagcctagagtgttatcatatgaccctggcccaccaattatactcttgggcatatatccaagcaaaatgaaaacatatatttatacaaacacttctacataaattttcatagtagcattattcatattcataacagccagaaagtggaaatatcccaaatgtccatcaacttatgagtgtataaataaaatgtgttataaccacacaatggagtattttgacataaaaagggaattaaataatttatacatgatataacatggataaaccttgaaaacattatgctaagtgacaaatatcagacagaaaaggccacatattgtatgatttcttttatatgaaatgtccagaataggcatagagacaaaaacttggttagtggttgccagaggctgggagaaaggggaaatgggctgcgactatttaatggacatgggtttctttttgaggtaatgaaaatattctggatttaaatagaggtgataactgcacaatctcgtgaatatgccaaagccactgaattgcacactttaaacatacaaattttatgttttatgagttatgtattaataaaaaagttaatttttaatccaaaaagcactttgagaaaaaaattaaaaattaatatgtgtcagaaaaaaatacggacaatacaaaaatctatcacttgccctaactcttgccaggtgtatctgtgatactttaggctgcccaaccagcctttcacaagctgtagcagtttcaagatgccagggctggcagggcacagtggctcatgcctgtactcccagcactttgggaggccgaggcgggcggatcatgaggtcaggagatcgagaccatcctggctaacactgtgaaaccccatccctactaaaaatataaaaaattagtcgggcgtggtgactggcgcctgtagtcccagctaccgggaggctgaggcaggagaatggcatgaacccgggaggcggagcttgcagtgagccgacatcgcaccactgcactccagcctgggtgacagagcgagactcagtgtcagacaaaaaaaaaaaaaaaaaaaaaaaacatgccagggccccctcagagtattggcccaggtccaagctaattcagactgtgtgaaccttttcttctttctttacaacagaaattagcaagggtgtctcatttccaggaggggaagtacagaaaagagtactgtggttatatatctccaaagttagctaagatgaagctgcagattcaagattaagcaacattaaatttcagctgaaattgtatatctgtctgctgccactttataaaatttttcacttaagatgacacaaaagcctatttattgagttgtgtacaccattaaagtttaaaagtttgacatgcatatgctgttttttgtgtggcagtaattaactgtaattgaaaaatatcccattttttatggttctctgaattttcagtgatcttttcccctccctccttcctctcctctaactctgactgcttcaccataacataatcctcccctgccccacattcaagctactttaatagaaatgtaagcaatttaagtagggtacccgttacgtcacaaggttttaaaattattaaggctcctactctcctagtcgggtctatctttgagatatgtgactttatgcctggaaccatgggggagtggagctgggaaatatacccatcacatagaagaaaagggctctgttctataatattccttttgtccatctcaccttctctaagaatggaacataaacctcattcaagaaagatgtgtgaaaaacacttctgagatagcatatagtagaagaagtgtctatgccttcatcaggatccctgagaggtgaaatgtcctttttatagctggccaattctgaattttaatattatctccttcaaggagactcaggcctccttgctaaagcacagcttataattcttccacttgtactttctaggcaggatttttataactagatctacttttcttcatcagtctcttgctttctggcttcactcatttcatctccggttctacccataattcttggctgaattcccacttgatcctactactggtcataacctaccaggaaaaatccccatgggacatcattcactctgaaatatttttgtcttgcctcagagtcacagaaatttcgtcacctaagcaaggaaaatatattttcaaatagtaacatggtgtctgcctggacacaatttaaaataactcttaggaaaatctctgatcttgtattcccaaatatttggatatattttgatctgcaggtcttcttcatgctgttcatactttgtatgaaaggagtgtgcttcacaaagcatcagactgaatacaagaaaatcaatacgcaatctgtgtgataattaattaaggtgccagaatgaatgactttttcttccccttctgatttgggtcagagtcgtgtttgatttgggaagttgtccattttcaattatggtttgttctgtgttctttttatgtgaccagaatgaatgactggcagaaaatcatgttatggcaaaaatctatgggataagtttaacacgctgaagatgtggtttggcaaaagttatttccaagaaaaggctgataaatcagagtgagatcgtttaggagaaaggcatacctacatgtataggtaagactgtgatgaagccaactttattctctgtgcattgttttcagttttcacatacagtcattaagcaaacatttggtgagcaaatactctatgtcaagcattgtacaacgcactagaggtgcagctatgtataagaatgttgtgcgttcagaaaatttctaacaagggagagcaacattaaacaaagagtcccacacataattcattaagtacaattttttgtagtgctacaaagaagtatacagtagttccccattgtatcagtctgttttcatgttgctattaaaaaatagctgaggctgggtaatttacaaagaaaagagattgaattgacttatggtcctgcaggctgtacaagcatagtacaaacatctggtcagcttctaatgagggtctcaggaagcttacagtcatggcagggggtaaagcgggagcaggtacatcatttggcgagagcaggagacgggtgggagaggtgccacatactttttttttttttttttttttttttttttgagatggagtctcgctctgtcgcccaggctggagtacagtggcgcgatctccgctcactgcaagctccgcctcccgggttcacgccattctcctgcctcagcctccttagtagctgggactacaggcgcccgccactacgcctggctatttttttttgtatttttagtagagacggggtttcactgtgttaggcaggatggtctcgatctcctgaccttgtgatccgccagtctcggcctcccaaaatgctgggactacaggcgtgagccaccgcgcccggccgccacacacttttaaacaaccagatcttgtgagaactcactcactatcatgaggacagcaccaagccattcatgaggaatccacccccatgacccaaacacctcctaccaggtcctacctccaatattggggattacatttcaacctgaggtttggaggagacaaacatccaaacctcatggatttttggatgatgacaaacatcatcccttatctgtgtttcactttccatggtttcagttattcatggtacagtacaataagatattttgagagagagagaaaaatagaatacattcacgtaacttttattacagtatattgttatagttgttatagattttattattagttattgttgttaatctcttactgtgcccaatttataaatgacaattcatcatagatctgtatgtagacgaaaaacatagtatatataaggtttggtactatccacagtttcaagtatccactgggggtcttggaatgtatcagccacagataaagaagaactactgtaccttgtctagctggatttttccataactctaaagttactattcagactaaagccaggaaacatccagaaagctttctatggccttctgtacatgaaggctaagggcataaataaataatggatggagggattccttctcagggataaagtgagaggtctggtgacctcagtttggggtctagagtatcagacaatgtgccccaaccaaagaaagcactcaataatgtaatgcagctcattcccagtccaaagctcagcttcctttatgcttattttacttggtgagaactagttctcattgaacattgcccagagacaggttgataatgatgatcaagaacaggctgttagtgaactccagaggtggtagggctgatgacagacctaattctctggcaaggggatggccttaatgtctattaataataattctggattgcttggtgttaaaaatatcaggatgattgaatgaaggaggctagagaacatctataagtgaacagggtcctattcattctggatgatataggcatcaccagcctgaaggcaggggacctggaacagatctcttcaggtataagattctgtgaagtttaacttgctgaaggattaacactcctagaagaatggctgaatgccaattccactttccttaaatgtgcattgaaatagtacttgctggtgccaatttattcttagctctgtgggcctgcccatggatatttcacatagaggggaacattacttatatttgatgcaagggtcccagcctaaaggtgctcacagttttcataactcaatttagtgtaattatactcaacttagggaatgaacaactcccgattcctctccccagtgggcacatgattaattggcttagtgacgaaaaaaatggcttcaacacagacctaagctctagtgggctcccagaagattaggttttaaatttcgatagagtttacttggccctctgtcattaaactgggataagtcaagtttaaaaaccaaggcctttttatatcagcaagggcagaaaaaccctaaagtaaggacaagagtttatctagcatatatgccagacagatgccaaatgccagttgactagcacatctttatggggaaggatgccgcattttaataattagccccattttagaataattggcatgtagaatctttttgagatcctttggagataacattttttaggagtcattctgattctatttgcatgttaagcccttaccagtatctacttggtctgggctgttgcaaatgtaatgatcttagtcatgttcagtcatttgtgtaaccaatatactatatacgtaagtgtatttgtagccatctgagcatgaatgcatgtttcactccctttgtgagaatttggagatgttaaaaaaaaatgggcgtctgtaggaatggtgtatcccctttggcaggtatatgttgccactccacttacatactctgagaactctacaatcagggatttaaagacattgcttctgttaaatgttccctctaaacatgtatgtctaactgggggtaatgctttgcaaagaacgtatgctctagaaaagggtggtttcaaaatcagttattgccactcagcctgcagtcatcatttagctgaatgcaggaagcagggcttttttacgtttgactcttccataccattgtgacccccatgcctaattcaggaaatgatgtggaatagaaaaattaaatattttaaaatgcgcaatgtgtggagtgtggagagagacactatttaaagaacacctatagggaattcttagtcccatctagttttcgagagtagtcatgcagaaagtggtaaattatacatttagctgggcccaagtttctgaggagtcaggtgttacaagtctgatttcatgtcatcctcttccagtttagctgactagtctaacccttcacccacaccaattgtgctctctgaaggatttcagtttagctgtatgctaggccaggaggtaaataaaggcagataaagttatggcatccagttgcctcagctcttgaaaagatttgattctgactctaccctccccaacacaccgcacaaatgctatatcattctccttcatcctgtacaaatattctgtttctgacaacccacatattctcaactgacttactagttatttagccacttatattaatcagggttctccagagaacagaaccaattgtgtgtgtatgtatgtgtgtatatacatatgtgtacacacacttacataaccaatgggctacatgttagggcatttgtggctatctgaacatgaatgtatgtttcagtctctttgtgattgaaacataaacacatgtatgtacacatgtgtgtatatatgtgtatatatataaagtgatttatcataaggtattggttctcattattatggaggctggtaagtcctataatctgctgtctgtaagctagagaataggctattgcaataacccaaaatgaaagctgacagtgatatgaacctggtgctggcaatagaagtggtgaaatgtggttggattccacatatattttaaaaacacaggcaacagtatttgctgatgggttggaatgaggggtaagaaagatagtagtaaaagatgatagcatggccaagcaaaggaaaggatcaagttgctccttactataatgaggaagcctggaagaggtttttgggggtggagaaattttgagcacagttttaaacatgttcagtttgccaccttttcaatattaacatacaaattagatgtgtttggtgcctggaacagtgcccagaatgaggcccgtactcagtaaatagttttaactgaatgaattaatactctttaagttctctctgcctcctctcagttacaaccacatcatctcaccaagttagtctgcttcttcattataactgattctcacatttggtgttaagtgagcctaaaaacacaactgatgatttcctttgacctctttctaagataactctacttagtctcacatactttctattttctgggagtgtcaagaaggccctgtttgctctggtttcccatctgtgagcaagaaaaacaggtaggaagcctgttattaatcttcttgcatcaatacttacattgtaaacctatgccgccatctttcattagtcacagagaagactaattacattgactagactgatgaactcagtatgcaaatgttcatgtaataagatggtctgcccaattttctcctgcagttattcaaatacctccccaatgtatagcaaagccagaaagtcctacggttcactaatgttaaaaagtatatatgtgtgggcttctgggcctatggatacataaatatgtaaaattggccatctttacaacttgatggtggtcaaagtagaactaggctagggtactgggaccaagaaaggcagttaatgtgtatgagtgtcccctaagggtatgatatttgacagggatttgctaaccaggactagcacagactagtcattacaacctgaaggaggcacagtcatccatgaagattatttctgctgtgctgagggtaagctgaagataaagggtgttcctggtcccataataaaagagaaacaatgaattattttgtataaggcagttttcaaacgcctgggtaaaagtctaccctggtggcttcctttcctgaagcaatggcgttaatcactggaagttaactagcaggtccaataactgtagtcacaataatgagaacctggcaaacagtattttgttcagaggagtctgagcttcagggcctgtcttcattagtgggttctagtttagctgagagttgtgggctgagcagaacttcaagctctttctgagccccagaccagctatagtctcagaaaaggattttgtgccattaaaggtgggtcattagctataagcgttttatctccaccaagaggggtaaatttcccactgattattgtgctctgttttggagaaagtttcagaaaaaaacactagtgacgaagctttatagcagatgttgggggtggagagttattttgttattttttgtgtgcatgtgtgtgttggcaggaaggtataagatctaaaaattaaatttaaaaaacataagaattggaaagtaaggaacaaatttattgaaatctggtgagtgtaactggatgaacaatggatgtaaagatgaacagcttctcatggccaaactaggactagagctcttagctggactctggagcagtcagggcacagaaagaactcactgatccctaggcaaaggccaatggtgctaggggaccagagagggaagatttgctcagcaactcattcattcttcattcatttattcatttaacaaacatttattgattagtcactctgagctgtattggggcctcagtctacattgatgaatcaaacaaacgtgacctgtcccctggaattcacatcccagtggctgaaatggacaaatatgtagggaaaaaatacagtaataaaaagctgtgataaatgctattgaatgctgaccataaaatagacattgcacaaggagatttaatctttccacttcaaggcaaggatagaccctgtcactctctaacattttttaattacttgaaatgatttaattcttaaataatatatttattttctgttttctccaagtacattgaaagccccctgataacaagtcttgttcacaattacatgtcttgttcactgcagtgtctttctcagtgctcaataattacttgttaggcaattgaatggatgaattttttattatcttcatgttaaccctgttagatgtgaaatacaaaaatcaattatgcccatcttatagatgaggatatgaggctttggaatggatctggatttgggaatcagcatcttattaagatataactactactaataataatgatttattggatgctcactatgtgtcaggcagtgtgctaggttccctgtgtggatcatgttattgaatcctcacaacagctctgtgacatagatgctattattatcccctttatatacatgaggagtatgaggatcagagagataaagttactcattctagatcaagggggtgacagtccacaactaatttgaatgtctgttttgaagacctaggctcactccacccactataccagagtgcttgcatggcctttatctgttctacaggagaatgccaggcagacactgtttctgacttactttactacccgttgggctcgttagtttggtttgagtacagaggaggaaactagaaccagttagttccttatggttacatagtcttttatgacagagctaaggccagatctagggcttctggcttccaggccagttttctttgatgtgaccacgtgatctcttttctcagtgactttgaaatttaatccctcctataaaggtttcctttctgaatggggccacaaatattaaaagctccttgtactttcagaaacttgaaccttatacatgatacttgtatatatctgagcagcccccaattcgatatttcatattgagaaggaagaaaatgacctgagcaaagtagaatcaaaattctcctcatcctgaaaatctaccctcagctttgtagtccgccaaataagttcctggacgatttgtggaagagaagtagcccaaaagactgaaaacaaaagcacactgtataaagacaggtaggcagaatgaaataactaaagattcaccggtgcagagatagtgaaaaagcaaccccctcttcagtatggatttcaggagcctcaatgcatgaaagtcccatgattttcttcttaaaattatctttgtatgattcttaagtttgaaaatgtaaaaataacaagaataagaaaatataaaaaggttatggcaccaactgtttgtcactggttcatttattactatagctgtcacctaaaaatgtatgaagaatgtgacatagaagagctaagttcaggtgagagaacatattcatggttaagagcatggcctctggagccattctacctgctttggaaaccgggctcttccatctactggattggcagccatggaggagtcattttatctttttggacctcagttacctcatctataaaataagtactagttggataatattatattactatatattatatatgatattatgtattctgtttttcttaggtcattttccttcttgtcaatatgaaatatagaattggagtctactcagaaatatacaagtgtcatgtgttaagtttaaggtgctgaaagtacaaggagcttttaatatttgtagccccattcagaaagcaaatctttgtaggagagattaaatttcaaagccactgagaaaagggataagataaaatagtcgtgctgaggaaaataatattatccacactaatacctacaacctagagtttctgtaagtactaaatgggattacaccaataaaaggcttagaacaatgtctgtcataatagtaaatggtaataatagtttttattacatgggggaaagatcataaaattaaaatttatttccttatattctaccatgcatttcacatttattgatctctccttctgggccaagcagtgtgctaggcacttgacagatggatgagatgcatcccctgccatcaaggagtatccaatctaggagaacacagactcatacacaactgattataatgatatgtctattcccagtaagcatttccaaccacaggcattatttgccatcatgtatctctttctctttatcacattgctattcagcatacagaatgttaaagaccagatggtgttaagctgcccattttaggactagttgtaaaagttcactccttatctcacatttaacacattatcttaatgagaaaaccattcacaaagcatttacggagtacttactcttagttggtaccttgagaaggatataaaaaggagtgcagctatggggctttgggaaaagcaccagacttgaagtcagaaatcttgagtttgagtcagggctttgccactgatcaaattgattgaccttggatgagtcacctaaaaactgtgtagctgagaatattaaatgaactagaaaataggaaaacagctggctttcaataattttccagttattcagcctttcattttttcagtataagacacaagacactgacgaattaatgaatgtcagtaagatggacgaattcactgtaaaagatatcaaagcaattttgtgattaacatagctttctcctgacacctagagaacccaaatgataaagtggggagtttgaagaagtaagcagctgagtgcttcaggaggattcactagtggtaggtgcaggatggctttttggctggggcaacaatggagggtcaccacttttaatgaattcattctttttgagaatatttagaaagcaataaaaggtcaaatctggcatctcatcctcccatccattatcacgtcactgaaattgacttttgctaagttcaccaatgactttattgtcaatgaaaccaatggtcacttctgaatcctgattttatgtgactgtttagtagtattctccatagttggccactctgtcttccttgatacagttacttccttggacttctgtaacacactatcctgatatactttacaggtgctttttctcagtctcctttttgagcccttcttctattatctaaaaattatatggcagaggtcctcaaagctcagttttttctagaccctctttattcttaccactctaccctccctaaattcagttaccatgtatacataaatgggccccaaatccagctctgctggactccagactcacatagccaactgccttgtcaacatctgcatctggatgtccacatcctacaggtatgttaaactggacatgtcacaggatgaatttatcaactcactaccctctgcaataaccttgactgtacttgactatactcctcttcattcctcccaaatcaaatgcaccagcaagttctgtttttgttgttgttgttggttttgtttttgagatggagtctcactctgttgcccaggctggagtacagtggcacagtctcagctcactgcaacctccatttcctgggctcaggtgatcctcctgtctcagactcctgagtagctgggactacaggcctgtgctaccatgcccggatttttttttttttttttttgtatttttggtagagacaggtttcaccatattgcccaggctggtctcaaattcctgacctcaggttatcagcctccgttggcctcctaaagtgctgggattacaggcatgagccatggcaaccagccaagttctgtcattttttgcaccaaaatatactttggctatgttaaagtctcttaatcttctctgccaccaccttagtctaagcctcagtggtgtctgagctagaccactgcaacattctcttaactgaattcagcatatatactattgccatttgcctggatgatattttacaaacgtaaattagataatttcatgcccttgtttaaaacttttaaaataggtccccattatccttagaataaagccccaaataattactatgctctataaggccctgcatgaactgacctgtgtccatatctctgacctcatcttgtacctttctcccatttgctctcccgcttcactctacaaacatattgggcttcctgtctcagtgcttcagcattctctttctctctccctttcttacatttcagatttcagttcaaatatcacttccaccaggaagccttgcctccaggctagcttagtctacctgttttgtgttccatagaaagctgcactctctctttttccctctcagaacccattttcttacttgtttaatgttttccttctccattagactcttaagtttcatgaaggccagaactgtgtctgtctaattcaccaagcacgatacctggaacatagcagatatctttaaaaaatgattcttacacaaatatccaaagcagcatcattcataatacccaaaacgtagacactgcccacatctgccacttgatgaatggataagcaaatgtgatatatctatacaatggaatattatttagccatgaaaaataataatgtattgattcattatacaacaaaaatgaaccttgaaaatatataataaagaagtgagtcaccaaagatcacacattgtatgattccatttaataaaaaaaagtccagaataggcaaatccatagacacagaaagtacattcatggttgccaggtgctgagaagaggggaaaatgagaagtgactgtcaacagtatggaattacttttggggatggtgaaaatgttctaaaattacataggggtgatggttgtacaactctgtgagtataataaaaacaactgaattgtacactttaaatgtgtgaattttacatatgtgaattatatctcaataaagctgttaaaatgaattaatgagaataatataaactatagatctgacaacgtagaaaaatgctgagtgacttttaatttacgagagagcaaagaaacaagaaatagtaaagcttcatctcgtgaattgcacacacttatttcatgcaactgcttttacctccttaggaaccggcaactgaaagagaaaacatgggtcctaaatttggaaaggacctcagagattatgtaattcaactatctcactctacatatgagaaatggaggtgcagagggaaagtgactctacaagttcgcacagcaaattcatgaccagacatatacgaaagcctttgtctcctgagtctcatttcagggttctttccatgatacccagccaagtcagcttccttaagagtttttccagtagcccttcacaacttccgtttacaaagtagtaatccctatctgcaagggaagctgtgagatatagtttctgttagtaaggaagaaagggagaacgaccctttgggaggcaacttgtattttctgccacaagttcttttgcggaaaattttggattggccagtatttagatctggaagaatccaatgttctctgctgttacctctgaagtcagcatgaacatttccagtacagtgtgaatacaatagccacacatggaacccctttcatgataaacatctttagccccagttgagagtctccacaattcctgagcaatttgcatttggcagggctgtgtgcaagacattactggctcaaatgaatgtaaatttactttagaaacaaatcaaggtaacattcactatcctggaataaagaaacaaggtgaaagatccttttagaatgcaaattgcaacctgttttgtaaaaatactgagtgacagcaggcacagtggctcacacctgtaatcccagcactttgggaggtcaaggtgggcgggcacgaggtcaggagtttgagaccagccttgccaacatagtgaaaccccatctctactaaaaatacaaaaattagctgggcatggtagcgtacacctgtagtcccagctactcgggaggccaaggcaggagaaccgcttgaacccaggagacagaggttgtggtgagccaagattgtgccactgcactccagcctgggcaacagagcgagactccacctcaaaaaaataagtagataaataaataaaaataaaaataaaacatggagtgactttacttgtctttttaaaaaaataaaagtttaaattttctttcctacaggttttttactatatctaattacactggctttggaaaagagttgataaacatggataatattttaatttaaaattgtttaaaaatgtggccaggcatggtggctcccgcctgtaataccagcactgtggttagaatgtaacaaaaattgcaggaattaaaaaaaaagaaaatgttttttaatcattcactttacttttgagcctagtggttttaataggatgtaattaacaacattttccatgtttttctatttgttttctctgcttgttgcaaactacctctttaaagtaaaattgtattggagaagtctagggtacagtggcctcttctcttgtagtttgcaacaacttttccccaagtaaattgatactaatggcactgaaaatacctggaagcttgatgtctagaggacaaaaaggaaagagtggctgcttcttccctatatactgtatgctaacaaagaaaccaggtctgcagaatccttttaactttcttgacttagtttcatatcaaccccaaaagtcatgtagtattgaccatttgcagaacagagcaatgacaacaattcctccagataagttaattatctgcattaaagaatgcctcatgtttcttgatctactaataatattagataacatgggctattccaaggcattttaatgagtaccctggcgatgacagtctttgggaaaatatttctgacttctaattaactttaaaagtttccttgggcattttttctggttgttgttgttttgaaactgagaatgaaagaaggaaattatatggtagacatttaatgcattctttctgaatctttctgtagatgacataaattaatggctgttctcatttttcatgctcccatgcatgaaaagaaagaaattaagacaataatgttatttaactattataagaggaattcatctttgatcagaattatccagagctttctacctctggcatctgtgtactttactgagacacctcctgggccaatgaaccaactcaagctctgccaaatgtaaatgtttaaattttagtgattccggccccaaatcttactgtctatatccacagcattgggagaacacccttttctgaagcataagaaattctattacccagcagcctgggataagttaaattagtcagtagacaatttcactacaggagtatctgcctctaggaaaaccattaattttgtttaaagtgactgtgtcacaattattgaggacttttcaaatttttctattgccagagagtcttgcttaaagagaagaatgttgattgactacataatttttcttgctcctctcctcctcaaaaaaatcacacacacaaatatgcaaatatgtacagatatttaactcaattttgactgacctttcaataagttttctggataattaaagtagggcctttataagttaaaaagataatcaaaactgtggtactggacttatgctatgcacgaatgacagtgtctcacataaaggtattatatagaaaaatgaacagaaaagtgaataacaaattgtacgaaatgtaaggtgtgtggtctattaatctaaagtacaacaatctcactgaatatacgtatcagcttacatttttgatgttatgtttcagtttgcatttttgtgaacatgaaatcctcaaatgcaacataagtctgtgtgggtcaagtcggccatcctcactgcacacatgtgcgaatgcaggcatcccctgaatccaaaattgttacaaaagaaactgctaaagtagattaattctgcatgtagctttcttggtgcccttaagggcagcaagtattcctccagggaattatgtatgttcactcttcattgttttcctctaaagggatcatattatcagtgaaagaccctattggtcccaggcctactttagaagtgtcttttaaaagattgctaggccttcctaagaattaaatagaagaaaaaggcagtctgtacagatctcacctctggtaaccaaaagcaagcatctttgcagctaactttgcttctgttgcaattgatacagggacaaatggctgtaattatataggggaggataccaaatctctatttagagaccagagctctattagcagtgcattttccagggtctgatgactagtaaacaggaaataagcctatctaccttgaatgagcacagctatccccctggggagttccattaaggataacagtgatgatggtatgtgccactactgggcactcttctatgcagcgcatgctaagtggaaatggcattcttttctcagactctctgctcacttcctgtactgtatataactgcattatgagatcttgggtgtccttctacagaggtaggaccaagtgttctttcgaggattgagagaagagagatttggaggtgggacaatctagccaaataatcttagtcactttattattcataaggatgttaaccaagagttccttagtagcaaaatgagattctttatgttgtcagttttccaaaatatattccacttctctctgtctcagagcaggccttttcagagtagaacattgtgcctccactgaatggtaccttgctttggctttgaagtctctctatcattttgtattcctaactcctctccccaagtctccatctatctgtcctgaatcctctctgacagtcatcttattgtagattatatatgaaatgaaaaccaactagattttttcagttattgctgttgcttgtcattcctttttcttctccatattctgacttcagatttgaggaatggctacaattcttgattatctatgataattgtggggcccatgaaagctatttattcaaagcacaatgtagaaaaagggagggctttagagttgcacagctctacactgaaatcctatcactatcccttactagttaactgattttgggcatattaagttctctgagccttgtttacttcctctggaaaatgagtgtgaaggactaaatgtttatgctccccccactaaaatgtatatgttgagattctaacccccaaggtgatgatatgaagaggtggagcctttggaaggtgattaggtcataagggctgagccctcatgaataggattggtactctgaaaacagagacctcaaagagttccctaagctcttccgccatgtgaggttacagtgggaagatggttatctgtgggggaggaagccctcatcagacaatgaatctgctggcaccttgatcttggacttcccaacctgccgaactgtaagaaatgaatgtatgttgtttatgagctacccagtttatggtattttattatagcagcctgaacagattaaggcaatgagtctaataagaatatctactgtttggagttttaggattgaaaattattcccctttgcatattctgagttaggagccactctttgagtcaggcaaatggagatacaaatgtcaatttcattattaataaagttgatttaaaccggagactgattactgctactactttcctactcatccaccttgaattccaaacttacccagccaggcagtcatagacagaactgtgcaactgtggtcttgccctacaacgggaaatccttccccaaaaactttactaatggctaggctgggaatttacaggttctccaaaagagagactgaaaactcataagtgaatgaatcatacctgctcagtcccttctttcaatgttgccaagcagctttttcccctcttcagttaggcaggagtggtgagggatgacttggaattgctcctcccctattctttttcttctctatggaaacttgagcagtgaggcacaagagttgtcttattaacagctaggattagtgtgaggattaaatgagataccacatgccaactatcttatatagtacctggcacatgatagaagttcagatggacaatacaggaatcaaaatccagcattactcattagccatgtggttttgtgtctggaatttgtgggttcttggtctcactgacttcaagaatgaagctgcagacccccgcggtgagtgttacagttcttaaaggtggtgtgtctggggtttgttccttctggtgttcggatgtgtttggagtttcttccttctggtgggttcgtggtctcgctggctcaggagtgaagctgcagaccttcgtggtgagtgttacagctcataaaggcagtgtggacccaaacagtgagcagtagcaagattcattgaaaagagcgaaggaacaaagattccacagtgtggacggggaccagaaccggttgccactgctaggttgggcagcctgcctttattctcttatctggccccacccacatcctgctgattggtccattttacagagagccgattggtccattttgacagggtgctgattggtgggtttacaatccctgagctagacacaaaagttctccatctccccactagattagctagatacagagtgtcgattggtgtatttacaaaccctgagctagacacagagtgctgattggtgtatttaaaaaaccttgagctagatgcagagtgctgattggtgcattcacaatcccttagctagacataaagattctccaagtccccaccagactcaggagcccagctggcttcacccagtgggtcccgcactgggccgcaggtggagccgcctgccagttatgcgccttgcgcctgcactcctcagcccttgggcggttgatgggactgggcgccctggagcagagagcggcgctcgtccgggaggctcgggccgtgcaggagcccatggcggttggtggggaggctcaggcatgggggcgctgcaggtcccaagccctgccccgcagagaggcagctaaggcctggcgagaaatcaagcacagcagctgctggcccaggtgctaagcccctcactgcctggggcttgtgggccagccagcagctctgagtgcggggccgctgagcccacgcccacccagaacttgcgctggcctgcaagcgcgtgcgcagccctggttcccgcctgcgcctctcccttcacacctccctgcaagtggagggaagccggctctggcctccgccatcccaggaaggggctcccacagtgcagccgcgggctgaagggctcctcaagcgcggccagagtgggcactgaggccgaggaggcaccgagagtgagcaagggctgcaagggctgccagcacgctgtcacctctcagttttaggtaatttacccaacctttctgaacttcccttgtttgatctttaaaattaaggtaataacaattagcttgcacagttgtaaaaattagagaaaatatctgtgaagggcctggtgcatagtaggtacttagtaaactgcaactattatcattatcatgatccagttgtataaattgatttgtagattgtgtcctgcatttttttttcccatagcagattgacatagcagtgctcacatttatcaatgggaatagtcaagggttgaattggtaaaagtgtagctgagaagcaagtccaggacccaaggcaagcattctgggaatgtaagaatttctgtggctcatccatagagcagcaaacctacatgtaaatattttagaggtgactgaagtttgaaacgtccttttgtaatataagtatatttttgaagattaaaaaaatatttgttttgcaaagaacattttttcccatatggaactaattttttggtaggaaattagacttgtagagacaaggttttcatgcctttcattcttttcaggcttacaaagtatttcctatctggaaccccagttcttggccaatttaatgttgctgacaattgtatttggtaggataatttcagtttcacctaggttcagagaataattgccaatatatttcggaaagactctcttaaaatgttaagtttttccctagagagcaatctagtacaatgaaatcttcttgaaatattatttgccaccattttagaccttccagtttggtgaacgtattactgtcatacttcattactgtgtatttttggtgtacctttcacatcaaaaccaccattcaaaacattttgtgatttaaaagtacaaagtcttaaaaaagaacatagcacttcttcttatcagaaatccagcacagatgagaagatttattgtctgatagtcaagattggattgtgcagttgtttgtgagaaaccagtggatttgatcagaaatggaatgagtatactgatgtggcagagagaatggaaaatttgggttttgggtttttgacttttttggggaaaatgtctctaaaacattgttttcttaacaaattaattctaatggaaaggtagtaatcatttaggtttaaccactgaaacaaacaagttgctttcccagagttgacacagacactcaacaggtgagtgaatgggctctgtccttgaagctgtgtccccacccaaatcttatcttgaattgtagtttccataatccccacatgtcccgggaaggacctggtgggaggtaactgaatcatgggggcagttacccccatgctgttctcatgatagcgagtgagttatcatgagatctgatggttttataaggggcttttcccccctttgctcagcacttctccttcctgctgccctgtgaagaaggtgcctttcttcccctttttcttccaccatgattgtaaggttcctaaggccttcctagccatgcggaactgtgagtcaattaaacttcttcataaattacccaatctcaggtatttctccatagcagcatgagaacagactaatacatattgctcataagagggactgagtgagagtaacccagctacactactgtataaacaagccagagcttaagggatattgttgagatcattaatatcatttaggtacatgaagtacagtgacccactttctaccttccagaactaggcagaataaagatagaaataaactcttcttttaaactgtctctgttagttgttgcctgacagacttgaagtcaatgttggacccataaacctcaacaaatattcaaagggaaattccaaaatagttgtttaaagtggctaagttttcaccccagtgtagagaacaaaatagtctgtatgtactgtgactgtgtcaagaaaatatttgaggtggcattatcaaacaatttaaatgtggtctttgatgatccagaaacaaaaaaccaccagagaagtcaatctgttattccaaaggtcagggccatcagccccagtagctgaaaaaaggaaataatgcaaagagcttctggtcctagggctgatcaagtgagaggaaaggacatccccaggaagccactcttctgtattcttggctcagaggcagctggtaatgccaagtgagttacatatttactccattcacaaatgtgcaagtaaattgaggccaatttgtgttaggattaaatttattccaaagaggtgctcacttgagtggtcctagcaagccagccatttttagttacttcagctctatgggtaagtttaggaataccaaactagcaaattaagaaggaaaaaaaggaaaaggaaaacatgttataaaaatctaaaatctccatggacttttgagcaatttctgttgttcttctgaaatgtattgcttttcatttctccagatttgatgtttaaatgatagctgacaattcctgtttgggaaaactcatgcacagatagttattaccctgtaagaagagatgtgagcgtattcggaaatgttcatcatgtgccatagctcaaaaaacatatggtacacagccccaataaaaatgagatgcagaaattaaaatgggcgggtgcttctggtttttgtttgttaactgcaactatgtaggtctaaacttcatggttttgtaggtaagttactgatacagtggttagccgtgccagtgtcttggggacaagccttatggatcccagtattgcagaaaaaccaggctcagtgcagttgttacatttcacaggacacactttgacctgtgatgtagccaggtttttagttacaagctccatcataacagggctctgttgtgttttgtacagttcaataaatcaatttgaacagatacatctcttgttggaaagaacttagatactttttttttaatgagggagcaagcatttgaattgaaggatttgaatacaaattgaagtatattcttacatgtcttagagattatatgattgcaaaaaacaggaatcttcacaagttaagcctagtaaaggagaatgcattttagggtaaaggaagtctcatggaaccccaactcatgggggattagaaattgtcaggcagctagctcatctttccatctcttgctctctgtagcaacacaatctgtcatctctgcttctttctgcacagcggctcgatcctgcattctacaaaatggcttcctctgcctggctcttaatttctacttccccacacctccagctcagctgtagctttaggttgttgttgcacctattctggccctaaatgtttttgacctaatgctttcggtgcccaataacttctgacctatttagtctttgttttctctttgttcaaattttcaagaaaattggattggcttttgccagtcaacaattgattcactcccagcatgtgtgtccacttaggcagtgtttgggggaaaaagtgttaacaaaaaatgtacagctgtaagcaatgtagtttaaactaaaaagttagttggatactgtgaaatgactaatgtatcaaatacatccattattgtaatgataatgatgataacaatgactatagtaattaaattactatagtaatttagtatagtaattaaaacagctacatttatggaactctttgtaagcttattatatagacttatttaatcttcacaacaactctaaggagtaggtattattactgtcccagtttttactgatgggaaaatttaggcacaaagaagtgacttatccaaggtcacatggccattaagtggttgaacaagcctcaaacccagacagtctgacactagaattttgatgctctactgatgattctgacactgttacaatgaatttgtgaaatgtggggctgcaagatagcttctttgtgaagaaaaaggaaaattcatttaaaccagcaaaacctgtatgatacatactagatatatatatttagtccctccaatatcctttacccagggagaaagggattaggatctcaagaaatatttgtgtctctatgtgggtggaaagagaagaattactctctcatctgagttattttagtacttttagataaatgaaataacctttaaatattcgtgatcagagcattacccaattgtctctttgccttcatatttatttgaattcaaattaaatctgccttttagcaactatcgagaataagatctggcactttggagtggaagccaaaactggtatgtatgtgatgttactgccctcttcccaagccaccattttattgctcttctgggaatccagttaaattacagctgctgatatattgtggactgaggatctaaattcaggctttgaccaagtcatgggctggtttctttgggcaatatttcacttcctgttttatctgtgctgtcacctaaatttagcacttagactatactccccgatgtctgcagaagttttaaattattttccagtgatgcataccgtgtctatgcagaattgagtgtgacagatttgcagtaaaatcctggagctctccaactcctttttaaatgaattagatcagtagctctcacggatttgacttggaatgggttgtaaggtgatgtgtttcctgcaaaactgattgagttctctttggtgtccttttttttttcctctgctgtgcattttaccatttggtggactaatcagtttcttaaaagcaaaagatggatgctgccttctaaaccatgggaggtgtcaaatgcctgctgcattaagaccctttcccctacttgcaggaatgatagctatgggcagaactgtaatagtgttctaaattgagaaatcttgaataagacataaatctaaattccacacctttcttttttaatgtgggcttcaacaagcgtcagctataattggtagaacagcctgacctattaatccatagataaaaatgattcaattaaagagaaatataaatattgaaggtaatgtaaaaccaaatgaagcacatcaccgaatttatgtgcaaataaattaacttgaataaaaattctccagtacatacaatgtccatatgctgtcttggtaatgctataattaagtcagagagtcatgtcatactggccttttccatctgctctgtgatctgttaagggacccattcaaacagaatgacagctgacctcaaaatgatacactctactactgccattttaacagggctgttggttatgcacattttgtcttcatttatactgggctacgagtgtttttccattaaatcaagtaaattggagcatgtggttttctattaaataggtttatttaaaccaatattttattttctgaataaactttttttttatttttcagaagcaattgattgtattggagacatttttgttttgttttgttctaaattcaagtggtgttagaaagaaacagtgattaagaatagcaaaataaaggcactcttctctttttccttctaattcttgttattcgatcaaagcaaagtggttaattcttggagcctcaggatgttgtgtatgtaattgacacaaaagatgtgtaaaagaggagccaatatttataatactaattgatttcatttattttacttcccttgtgtatgcctcactgtcattcttgccattatcttaatgttcttgtttccaatagcactcagaaaagtcattttaaaggcaggggatctggagcacagatgtgtcaggtgtaaaggctctcctccacagagacattcaaattggctaaaggaaaccccacggaatagtgcagctgaagatccagcatttgtccatctgtttatatccaggttaccttgtgacagtctatttaatttctggtccctggagtgtctctatttcaatagtacatgcatatttcttttattagaactgcagaaggggaaaattggtaactcttggaaccaggatgacctttagaagattacatttttgttttgttttgaacaaataacacaagttctacaagagggtttgctctagtcaaacactcaacttcttagagggaattttaaatgtctcctatttggccttggaggaaaaaaggaagaaagaaataaattatacttgcaatacaacagagagtgcttagaaaatgggtttaaaatatattacaatttaaaaactttttaaagtaaaacccaagccataccagagacagacagtatccatagagtgaccaagactgacccacataagaggctggagaattacaaaagatgatcatcagacagatgcccattgctctctggggaatcttgaccttggcatgttggtttctgaattaattcagagaacctaatttgccaatgtggaaaagtcacataatacatggtatcttatttataaataaaaatccagatggaatttcttagtaaaatgtatttaggtaagtctacaagggacaaggaccatattcttttacttatgcagtctagaaacatttgctgagcatctaatatgtccctggcattattttagcttcaaatgatgtgttagtgagcaaaatgaagtctgtgctctcataaagctaacattacagtgtgggggttgtgggaaggcagacagtaggcaaacctgttatctgttctgtacagggcccaggacccattaattagccttgcatctggatgttggttcaaagataaatatttatgaggctttcctgaaattgtaaactttatacccaagagcatcctgatgagctaaaatgaaattgaccacatatactcatttcaatgaaataatgtttgaaaaatttcctttcattttgcccaagtccatatagtactttattgtagtgtggtgaaaaggatataggattagattctgccaagaaacttttacctgaggtatttatatcccagtggagagaaacaatgatgcctaattaaaagataaagatagaaaaaaggggcagagccagagaaggaaaaatagggagtaggggtggaggtagggttaggaaaactttattcctgcaatattctttaaatatataagaatttattttcatatcagggcaatatcctagtagcttagtttagttggtgagagccccacgttaggatggcatcatagttaaagattcagttcttatttgaaccagttagcttaaatctatcccatccctttaacccaaccagtcatgatacgaatatcagccacaaatcacaagcagttgcacattttccacactactggaaaaaaagaatgaatcaaacacatcttctttctgtatgatcagtgaggcatgagaataattggtagattgatgatctgagatgtagttgatgagttagaaccatgaattctgccagacctttggaacaaagcatattaaatagtattttttttgtgggtgccaatggcagtggtaacatgggagaggattatttaaaattgtgtttaaatattcaaagctgtatgtgctaggtatataagtgaactagtatttctcttcccttaagtaacctagagataggactacatttatcaacgttctctttttatctccttctgcagtcttccttcaaaacctacaggcttttaaacaaagaccctccatgactcttatcaacatatctgttcctgggcctctcccaaaatgatttagagataaattgcctcaaacctggcttggtttaatgctataatccattatggttccttttggaggtagcaaattctcatcaacttcattcttattaatcacctatctaaatgtagcatcatcagaacaatttcagaggtttttaaggcacaaccttgacttcctgtcatttgtaaattggcttataacagtcctggcactctgctaaagtgcttaactggtcattattcctccttgtactacatagcctttatgctgccagtagcccatctcgcctttctgatgtcccatcatattacctttaaaacagtaattttgtttttttgaactttgtgatggggggttagagtaggtcataggctatttttgagaatctagagaaaacagaaatctctacacaggagaaaatatacatgaacatatggttttgtgtacactttcaagggatttgtaaacttgtgaagcccatccatatacctcagagtacaaagtcatggcgtcaagattatatgatttacaaacatatttaattgaagtaaaccccatatatgcctatttataggctcataaatgttataacatttttatttttattttatttttccatctaaacttcctccactcagggtcagatttgcattgtggtctgccagcttttctagtcttctttgactccctcctcattttctattacaggaatttcccttaatgacattcttgcatgttcaatcctttcttggcatttgtttctcagagatcctagactaacacattcttctactacttctataaaaagatactatcatattataatatttttaggactattaagagaaggtgtctatttctgttttttccatttctttgaatttcactttaaatttttttcacctgctttgaaaaacgtgattgttcattaagttagccacagtgacaagtgtataaaatttgaataaaatgttcctggtatgtttttatgattcccaaatgcattttctttctcctttctttccctcctttcttttctttctttccttccttgcttcttttcctttcaattttatttaaagattttttaaatgtatgttacaccttacaaaatcatacatttatctaaggatagtctgaaattcttggttccaatgacatttcatttgtgtatggtactttctttaagctgcttgttgttgatttccaggcacttaaaaaagagaatactgtttgttaagttccaatatatttctgtgttaaaggtacaatggttaatgttatcatttccatgagtgaaaggggttgtctgttttattttctaccacatatattcccagaacttagcacagtgcctggcagaaaaaaggtgctcaataaatgtgtgttgaacgtataataaggcattagagcttataccttgaaaaaaacttaatgttttaaaaagtcatttaattatcctaatcccacaagcttcttaaatgttcatccatttttcccaaagtcacgtgctaactctttactaattctgtctaaatggctattgcaatgacaggtatcccagggaaggaaggccagtcaaaataacaaaatatctttaaaagaatgaaactgtatttcattcaagcacagaaattataactaaactaataaaaactgtttcaatagaagttctctgattatgtttaagaaataggtaataatttattacttttttctcagttgatatttacaaaatacagttgacccttgaacaatgtgggttttaactgcatgagtccacatatacatggttttttcttcaacgaactcatatcaaaaatacagtattcacaggatgtgaaccctgtgtatatggagagccaacttttcctatatgtgggttccacagaactgactatggaaatcgagtagagtgggtcctggaaccaattccccccgtgtatactgagggaaaactgtacttaaaatcaatcctctctgagaataaaggcaataaataaataaatatgaaaataattctctcaagtatgttaaaaatagtcctagaaaatagaattccagaattagaagggaccttagaaactatgtagttcaagtttttatccagtgtaagaaattcttagacagtacccctctgtaatggcagaacatgctatttttgtaggtagtctatctcattgctgagaagttcttcctaaacactgaggcaaatcctggttgtctgtaattttcctgtacttgctcctagttaagcctctgtagccatacagaatcaatgtactttctcttccatttgaaagtgctctatgtatttgattatatcaaatggatgtcacagatttgctattgatctatcatgtaattctataccagtctatactacctggtgtctgggaaatttcaagtaaggaatcagttggaaaaagccatttggagattaaagagacatccacagctttctctctgatctgccctctctctaggaaatcacctcccatgactcattgctcataaggatgtggatatgaaatcatgctagcaaacatccctgcataattgacactggctattccctatgtagtaatttgtttactatgttccttttttcctcctacatatgttggaaagcaaactttaacaaggttcctttctgaattcttataagttccaagctagtttcttttgttaaggattaaataaaatttccattcagctatttgctaaggaggtgaaattatgtttttagtgtttggaatatagcaggtgaatcaaggtgaattaatacgccattgaaattagttgcgaaaaccattctctttatcttagttctcattatagatgtgtaggtcagtaaggtttgtgtcataatgtaggcatcaactgtattattttctgtgaataccgacaaaacatttctttagtaacaaatgtaatcaggcaacataccagatattcagtattcttcccaagttgattgggcattgcttccagtttctgccagaagagcatcaccacatattacaagaagcatagccctccactctataacctttgatattttgcccagaaatgttgagagttggaaatcaattacaatatagcaaaaatgtatgagcatcagctaaagcttcatctttgcttccttttttctctctgaaaaattgagtctggtgattcttcagtttttacatgtgtgctatagagactcctaaaagagcaagcaaggaaaggaatttaattgctaaatgcacttgagtagatctcagataagaacaggtaatctttgaagttataaagcagcaagagaccaataactttttctctaaccaatggtttcgatatttggaagattgacaggcttagagacactttcttattccagcaaaagaataaatgtattgccagctacctccccaaaggctgtcaaccaagtatttgttcaatatatttatcatggtttattattttaatttatgcgtaggtatctgcattatgtcctgaataagtcatgtgactgaggaccatcagtggctagtttgagcatgagtgtaagttgcatgtggtagttttgtaggataacacatttttaggattggaagaaacagaacttttcagtttccaactatattagactaggaaaattatacacttaaaggaacaaactggcttgtccaaattcacatggctggttcataggaaacacagtggtagaactctttatgtgactctagttagaagtccttatccaaaaataatggaaaagaccaccaaaataatttcttcaggtttttataccaaatctgaaccttgccaaataagttgtattaaactaaagatttcttgtatgtaggtcattatttaatacctttaacagtatttcacaaggaaaatgcaaacaaactaaaatgcttcagtttggaagagacagacaaatgaaaaaaatttttattgagaattttaaaataggtaagcaaaaactacaaatagaaaacagccagagtatacatacatattcagtttaatctcctagacttcattccatttagaaatgtgggaaattttataatacatatagtactcagagatatttttgtgagaatgcattgtgatttggtgtgtatgcttacaactaaattgtaataatccaaaggagtctgctatctatctctaattccttctgcttaagtaacatgtaccaacccttaagcagtggctaaggaaaggacatgacagaactcttgatcctccttttttatgtccctgggcttcttcctgccaggttttgctgaaatatctcctctttgccttaagactgttattgctcattcttatttgttgtttattttttatgtgcttgcccaaaaattggtctgtgttatgacttttttcattctttcccttcctattatgttgccgtttactaccctcctacatcagaactacttgccttccactactttgaaacaatattaacaacatgatgtgtatatctacacaactttctatatgcataagcatacacaggaaattttgtttgttttacacaagtgaaattatgctatgtacacttctctgcactctcacttaatggtacattttggaaattccttcaagtcatttggtatgatacatataactcatattaaaaaaggtatagtgttgtgagctctgggtatatcacaatttattcaaccatttccctggtgtttactgactccatacatttgataatattattgacccaccgtgttctttctttttcttctgattctatatagtttatgctctgactgacccactacttctagctcttgcttctagttttccttgcattgccctctagtgatttcttatatttaggccttagttctatgaatgaattgtaagcttcttgaagacatacatgtttcgtatctaatattagctatagtacaaaacaaaatgtgtccacaaagtaagagtgttagattgataaattggccatggtggagtagaagttttagagctgtgaatctagactagggaagaatagaagaatctcagagccttaattaacttttctgttgtgttgttatttctgccaaacatctaaattttttccaaatccaactgagagtatatctcttctatgaagatatttaattctgtgaagtttttagtctctaataacttatgttgtcttagtccattgctgctgctataacaagataccttagactgggtaatttataaacaagagaaacttgtttctcacaattccagtctcacaattccagaggctgagaagtccaaaatcaaggctgccagaagattccaggtctggtgagggcttgctctcagcctcatagagggaaacttcttgctgaatcttcatatgtcaggaggtgaaaaaagggacaaacttgctacctcaaatacttttataagggcactaatctcattcatgacggcagagccctcatagcctaatcaccttccaaaggcaatacttcttagtaccatcaccttggggtttaagttccaacatgtaaattttgaagggacatatacattcaaaccatagcatatggcaccctctcagatcattgatttttgtctcatccccctgctgactcttaggcaacatggttgatttattggcagaatagaaagactgcaggggtttttagatcgggggtcattcctaatctcaggtaactctgcaactgctgctaatatctggaaccaggaggtatctcaaatgatatatcatctaatttatatattgaagatggctgggattaaagaattccttagtatgcagcccaataccacaagcctattgtgaaataggtgatccttcttgaccttttttggtgtagatgccctcaccatccaccaaagcccagttcattaaagcttgggcaactcttctgcttagaacccttcagtggttctccaaaacatccagattaaagtgcaagttgattaatattgaaaacaagactcccacatcatcttttctcatcccacctacgtattcagcttaatctttcaacacttctgttgctgctgctggtgctaataatgatgataattctgatgataacagctaatgttttactgagtgttttctgtatactagacacatgtattttgtatttgaatcttcacaaaacccctataaggcaggtacttttgttatgcccattttacaaatggataaatcaagcttcaaacaagttatgtaacatgatgtcacaaggctattgagagaactaggaatgtttgactaaaaaatccatgttcttaaccactattccagtgctcctcaaatattgtgcacagtaatcccattgactgcttttagaaaaacatgattttcagacctcactcaagagatttggattcagtagatcaagatttagggccaagtaatatgtgcatttacttagcacctccaggtgattctgatgtattaccgccgaccatttgagaagtactattctgtaccaatgcctctcaaattttaatatctgtatgaatcaaatcacttggtgaccttattatccctgctgatgctgaatcaatagaattagggtagggcctgattttctgcatttctaacaagcttccatccaggaggatgcaaatattattggtccacagattacacttgagatagaagtcctatactacatgccttagtgataaaatgcgagtttagcataagaatgaggtatatttcagttaagtagtgtgttatacaaatagatatatccctaaaaaactcagacacaaatcttttctgtcacttgaattccattttcacattgactttcaggatcatttcagagttactaccattatttatttttagtagatctctagtagcctaccacttcaactttgtcagtcaagtacttagtaagtgatgacctcttaagcaaacactcaagtaccctagaagagcttactagaaacagaaagcctgtcatgagtcctctaataaagtggatattctttttgttatataaatacgaaatttgaaaagaggaaaagcaaatgttagatttctagatctgaaaaggaccggagaaacaatttcattcaaactgaattttacaggtaagaaaaggcaggcaagaatgggaaggtagtgtaactaaatttacacaggggattagtggcagagctggaactcaaattctagtcttgttggagtttttatttatttgttcttgttggttggttggttggttgtgttttgaaagcatatccttaattccatcttagcttcagtgttggagatctgtacttctaagctgtatttaaggggaaagggcaacaattacagctgtttttcctaagtaaataggactctacatcggggttagcaaactttttattttctgtaaaaggccagatagtaaacagtttagaccttgtgagccataaggtctttgtcacaagtgctcaattgctgtcatagtatagaaacagccatatataattatatataacatattaatatataaacaaatgagggtggttgtggacactgaatttagaatttcatataatttttacatcatgaaatattattattttcactttttaaaaaccatttcaacctgtaaatatttttttttttttgctcataggccaatacagaaacaggcagcatactggatttggctcaatggccataatttgctgacacctcctgtaaattagtttagttcttccaaacgctaatataatttatcctcaagttgagcaggtagttcttgaacattacatagaaaacaagttagctattcaaagttcactggtaggattagtggcattgcatgaattttgtttactggaaaaatgtaacagtcagaaagagatacacattagcttatgagtggggatatctgctttgctgaattatttctaatctccagagaggaaaagtaaagcccaaggcgtaggcataccataaaacaatttgtttcatgatagccatagtagtctttttgactaaaagggcattgaaattcttttaaagacttctgtgaattggctgccatgctctgtgttactctctggtgggtataggaaatttgctgaagtcttaatatgtcctattcctttaattcgtggcagggaggcaggaaaatgaaaatagtttgaaagcaactgaagtatagatggcacttggtcaaataccaaaggtttcaatgaaagtcgtcttggttcattgtcagatcatcccaaagaatcaagaaaaaaaaaaaagaaaaagaaaatgtcatattagcatagttgttttgcaaatgtcggctttaacaatgctcaggttacaaagttgatgctctaccacatatttatttattttaatttaaaaaaaacacagttggaaattcaaccagaatgttgtcaaatgcattgagccttttaaagttttattgaaaatggtggttaagctgcttcctctcaaaaagttcatttaagataatttcgccatttaaaaggaggtgaggatccttataataataatagtgatcaaactttgaatgcagagttctttcaaaaaatagattttcaggggaaaaaaaacacaagaacaaatttaaccattccagtatgatagtttcacagactgcccagcttttggataaccacctgcaacagaaagatagctaagaaaagaggacaatgtgcctggatggtttcccactctatttcctttccaaaacaaatgagttcccttatataaagttatcctataagagaaccaaggaaagtattcttgttagggatgtatatgaaagaaataattaaaatctgagtctatttaccagaagagattatgttgtttcttctattctttatattgtgattaaagtagagagaagacatttttgggcaaacttactagggggagaagtgcacaatttgaagtttcttggtttctcaaagatggaacttaattgaaatcaatatgagaaaaagcaaaaaatagaaagtgctgttctgaacagaagaaacttgaattagctaaaagtgtgatatgtgtagcgttccttgcagtgttgaaatgtattcaataaaaatgtttctatgaagtaacatcactttccctatttcactggcaacagttgagattcggaatcaccaccgttgtttcttttatagcatccactggtaaatctgatgatatctataactgtctaaaaattataccaaaatgttgaagtggagatgatagatttcatttttctcagttaacacattatgagaaatattctgtgtaaatataacctctgaatcaaattcttttttctgtactgattttcataattttagagagatatgtaacattatttttattgatttttaatagactatggttgatagcaccttagcattgtttcttttccctcttcatttctaatttttgtcaaatggcacattataagcagataaatgtacttgcaacttaaggaaattcaactttaatattttctgtatggtaaaaataatttttatataaataactgcttcaatttatctcttcttaattttagcatttaagtaatgcatctgatgtgtgtgtgtgcacacatgcacacaccccaaatgtctttcaaatgaatttgctcacagaaccaacaataacaataattacaaatattataatatttttgttttagttcaggctgctataacaaaatactttagactgggtaattactaaacaacagaaatttattgcttatacttctggaggttgggaagtccaaggtcaaggcaccagcagatttggtgtctggtgaggacctgttcctcatatatggggacttctatgtgtccttgcctggcaggaggggcaaactccctcaggcctcttgtatatggtaactaatctcattcatgaagaatttaccctcatgacctaatcacctcccaaagactccacctcttaacaccatctactttagggattaggtttcaacatatgaattttgaggggacacccgtagtcggaccatagcatttttatagtataccatcacagaaagacctgcaggtattttcttatcagaaaataagacattctatcacttttctattttagtaagatacattatagctttgtgtttgtaaaattgtctttctaatctcagactgcattttatttccatttgctgtttgacctcttcagcttttgtgatttctgatgccacagactgcttttattaactttaaacatttacttgtgatgccagaacaattcaaaattgatttagtcatattagctaattatctgatcaattcagtgagcaaattcaattcaacctcttttttgatagaattagccaatggcttaaatgaaatttcttatcaaataaataaaagttgtagaaccagtagtcatgtagacacagccatactatgagctttcttccttaccccatgttattgaactattgtaatatgttgcacattcattcattcaacaaatatttactcattgccaattatgagttgagcactgtgctaagttctacagatatagtaagtatctctctctttagtatgtttacacacagaattattcaagagtagtcacttagtttttcctactctatcaacattgtggttttaatagccatgtagggttcatttagttcaggtacttaatactactgtctacaggagccagatatctgagggtgaggagagactttatgaacaataaaaagtagatgattatggaggcccaaactctataataaggactatatacagtttacaaagtctatacaatgaattctaatatcagcttccatttgttcttcagaaaggagctagtactagtcctggccaattatggatcttcttgtgtgtgccttatgtttgtacctaatctcagagtctgatctctacctttttcttttcttgtaagatccttcattctataacttaatcgttggcccataactccagaaattactgtgaaattgctgtattcctgcatctccaactagagtttgctatctctgtggtctcactacatggatcaaagttgttctgacggtgataaccaagatgacaaaggagtgctactttggaaaagccatatcttacttggattcagagctacaaaaaaaaaaaaaaaagatgcccacttgcaacattgctatttgtccatcccattttctgagtaatacacttaaacatattcaggtaatagtagttactatttaatatatttaatatgtatgcattgccaaaccttgtggaatatactagcatgagaaatctcatcctcatccttttacttcacttgttctctaactattgtagtgggtgactggtggttcagtagttagagcagccattaaatgatctggtgtgtttataagattctcccacaaaaacttgtaactattatttagtttcaatttttcaaaggctgaccaaacatcaaaattagttggctgtttatctagattaaaataaaaggagaatgtcaaaagcaaatctttatgccattcaagcatttcattatccatttgcaggctgcatgatagggaaagcttcattttgcaatagcataatacagataattgctaatgaaatatatttgacactactaatatatgatggtagaatgagactggagaattaaaatgtaaggtccttgagaatgtgagctgtatcttaaatcatattttccaaccctagtaactgcacagtgatgggcacataaatgctcaaaaattattacgtgattcaaaaataccaaaataattatgttgataattggatcctgctctagcttaggggtttcataaggaagtttgagaaatagccaccttttatagtcttccacaaggagatatgttatgcagatgcccagatcccccaaagacaactgcctttgcacactgtgtcaagtgggatttagggttttgaattactggttgtccttctgctctactgaaaccttaagcagaggttctaaaaacataagctgtagatttgggactaactctgcattttggcacttgggattactatcacagtgaaacatgggagagaagagttccacagatggccaagcaggcagtatcattagctttaatgaaatcagctccatgtatgcccaataaagcgtgggatgaagactaatcacaagcatcaaagaagatagtgttttgtgactttgtgcattatcgaatgtattcaagtgttaaaaagatgactattcattgcacttgaatatgcgtctaggttaatttttttttattgaaaggaaatttcattaggatagtgtttattcacattgatccagctgacttcagaatatggttatatatttttctgcatccaactgctattataagacccaggcttatattagattttctctggtattaattttgcttactttgacctttatttcctgttccacctgaaccctcctttctggacagttgcgaaaggatgccataaatatcctccacaaaggcacgtgtaaatgtgatcatattttcgtgagtctttgctatgtgcagtgcacaaatgctatgaaataaatgagcacttggatgactatagtgagtcacaccattaagagggtgtgctcaagtatagtgtttgttgatatgcacaaattaattctaaagagtgttatcataatttgctcatggtatatgtattcagattctttggaagaactgaagccatcattagaaaattacagtattatctcaatattttagttgacaggaggttgtaacaacaaactttcccattgtcttctaactcctcttcattgtatcactgactttgtgtactgcatagcaagagataagaggagcaggaatagagaatgggtaggactaatgtgaggaaattttctggagaagtccatttcaatgttagcttgtaaaatgagaaagatatgtgtaaggaggcagtagaaccaaattaaaatgccctgctacattcttttatgccttggcatgaagagatcttgggcagagataaagctatacaaattcatatggataaagtcatttccctatcagaagccaccccatgccctgccaagtaagccaagttaggaatgtggtatctgagtcattgtgtgctttctgatgggagaatgaagacttatgagaagagaatcttgatgaaaggagagggcagaataccagatgtcctaaggcaggtagagagagtagacagcactgtaagaggatggcctgtctttccacatataaagttgtgttgtccaatgtaatagctactaactacaggtggctatttaaatttaaataagctaaaattaaattcaattaaaaattcacttccttagtctcagtagtcacatctaacatgctcaataattgcatgtggctaactgctgctgtattagcacagatgtagaacatttctaccatcacagaaatttcccttggacaactctgttctagagcaatgagcagaaataactatttgacacactgggggctgggaggtctctagagagctatgagtgctgacataaccagaaaactattttttggtgaataagtgggaacaccaatggtatcaaagtgggaatcaacatcacaaacaggtatatatttcaccatcctggaaaataaaaatgcaactctgtaatgctttccactggaagaataaatatgaccatatatttcaatgaaggtgattgagggtttcttcttcattttttaaaaatttgtgttgatttggtctgatgtttttaactaaagacacctaaatgacttaattgttaaactgtcatctattttagtctcatttcctatgtgaaactagttgtcatactcccctcaaaatataatctaggccaggtgtggtggttcacacctataatctcaacaacttgggaggccaacatgggaggattgcttgagcccaggagttctagaccagcctgagcaacatagtgggacctcgtctgtacaaacacaataaaaaataaaaattagtcaggcatggtggcatgtgcctatagtcccagctactcgggaggctgaggtgagaggatcacttgagcccaggagatcaaggctgcaatgagccatgattgtgccactgcactccagcctgggtgaccgagtgagatcctgtctcaaaaaatatgtatatataatttattcataggcaaggattgtgatacagttgttcccagtaagtccttattgaattaaaaggaagctgcctgcctatgcttggtcagatgacagccactagtattaagtctccctttgcaccattcctggctacctcaactgatcaggaagaaaatccatttatttcaaataaatttgaaaatattatatttgcttgaacaaatttgtttcaaatgctgccttacaggaattaaggcattcatttattttttcagtcttttattcaataatggagcacctttcatctttgaggcactatcagcaggccttgtggactttatgaggttaaattagtcactctttgccctgaaggtatttataatccaatgacatataattaccaaaaaaaaaaaaaaaaaaaagcagaaaatgaaaaatcaccaaaaagagaggtaaaggcaaggtgttataagaaattagaggaagaaagaactcctttggggttgggaaactggaaggagagctgctattgagtacctactatataccaggtttttagcctatgtaattccactgttatgcctccccatgttcaaaaggttcattctgttattgaaatcatccatttttagtagtagctaaatatgaatattcttagagtccagtgggtagtggatagcatttcttgactttgtaacttgcagaaagtcagcctcaaatcagcatttgggagtaccttacctcttcccctttccacctctctgctgtcttcctagagttctggctccatcatgctagtggcctatatggtggaagcctgtgagactatcattcctggatccatgctggttctttcagacttccacagagataaggttacatgcctttagattcatgataatgaggcatctataaagagaaataaatctctctcatactaatggtgataatttattgtgtaaaactttgccttggggtgctaaaaagaacgtttaccatacataaggggtaagattggaaaggaactatagagcacagcacttccgcctgctccttctcccagcattcacatgtattatctcatctaatcagaaagattttatggaagacattgaggaatgtagatattgaatatggtaagacactgtgtgtaaaaggacaaattcaagtgccaagtttgttgttgttgtcactgcttgtttgtttttttgttattcaatcaagcatattacacagaataaatcatatatagattaattctgaacagtgagtcattgagtttgaaaaaggggggagaatgtggaagggatcaatgggacataatgctgcagaagttggtaggaagttggctaggttgaagagggtctgaaatgccaactaagtggcttttcttagtttgggatgctaaagcaaagtaccagagactgagtggcttctaaacaatagaaatttatttctcacagttctggacactggcagccagagatcagggtgccaacatggtaaggttctgatgagggctgtattccaggttgcaaattgctggcttctccttgtgtcctcacatgttggaaagagagctagcgctcatgtctcttttcataagggcactaatcccattcatgagggctctaccctcatgacctagccatcttccaaagacctgacttccaactactaccaaattgggattagatgttcaacatatgaatttttaagggacacatccagtccattagaggttggaaattattccatagaaaacaagtagccaaaccgtcattgaatgcgactccagctttttaaacatgatgcatattgcttgttctccctttttatgaactaaactcacattcacacagacagatgtcatctaacacagtgggagaggaggatgtgtggtagagctgcctacttggttcattcagttaccatcaggcatcgaatggttcacatatgctaaggggaggagagagaaacaaaagaaataaaattgatgacctccgacctgaggaagtttatagttcaattaaagaataggttgtggctacatttaacatgagtgaaaaacactgtagcagaaaatgttattgaatactccatagtcattctccttttaccttcctattagaactccaattttgttgttggcagcaacctgccttctcagatttgcttacacctaaggtggctgtgtaacagacttctgcccaatgacatatgctgagattaggcactacctcttccggctttccttcttttcttgactagaatgcagacattaggctggaagtggaacaaccagcctgggaccatgaagtgacaagtacaaagttggcaatcaaatgccaaagatagaataaaaggatataatgaacctggaacgtgaatggcattctggcacaaagcagccctggtctgtttacttctggcttttttgttatgtgagatgaaaaaatcatccatttgcatcagccgctgagattacattttctgttactactcaaagccaaatgcaaaccagttgatacaatactcatggaatagccaatcccagagtgcaaatgaatatgcaaatgcaaagaccctaaggagagtttatggaaaaatttttcagctaggtgtttgaaggattaaatgaataatttcagatgttcaatagcaaatgctaatgcagggttgtaatataaaattatgttcatgagacgaaagcatttaaaggaaaccaattgtgaaataaattagtattaggggtatgagaaatggatgtggatatgtagaggtgaagaggtgccagtggtggggaggagcatcagaaatcatggggcccaaacagcaactagaaaagcttccaacctcgttatcccaaaaagaggttgcaagggaatgacctggccagaatagaagcccttgccctgatattcacatccttatttattctgataaatgaatctataatgtgtctcaggccaagcctaaatgaatgccattctttttcattagtaagttatttaaaatcaatgttttcgttaaaagaagctttcagatgttactaatttaaatctcattaactgcttactttattttccagagttcaatctaagctgcatctttcatttagattttaagctataggctatatgtaattctacaaaaatgccctagatagaaaggaaggagtatttgaagcccacaggtgaacattagtttagaaagcttcaagcattgcaagtctttgaatgaggtttacctttataggctacttaagggatgtcaagcagaaataactggtggtatcatagcttacaatgctggggttgggggctgagatcttttctccatcttaaatttgcaactcaaaaaaaatttggttacaattttttatgtgtagcactaaaggcacactactgtgttccagagaaaggcaacctcagatctcatttttgatgccatgtttcagaatatttagttttaaatagagcccccaaatgacattataaagggcatgcagcttaaggcaagctgtcatagagactaaaaatttaatacagttttcctctaaaagtggttggctacaagcgtaacagtggcaccctattattttctttgcataaaattaacatatcacaaccaatagttattttcaattatgtggcatcaaatgaatcttaagagattgaaataagatccatggtagctttggaggatttctgcaattgacagtttgacacagcatggcttcagattatgtcaaaactgacaaaagcatgtgtagcctgcttaaaagaatattttttcaattctgtcttgttggaaatacttgccatgaagtaataataatacctttaatatgcaaatgattataactgcatttattacactgtcaaatggaaactcaaataccagctctttgttttacaacccagcacatcacacaaaataagagaaatgactgctttcatcatagagttcataagtggaagaacaaattctcttttccctgaggttgctttcattttctctcagatatgttctttttccacaactctgaaaaaaaataagaatttagttgatcactgaagcattctgacattcagattttctccttagtctttatctccatcctgatgatcctatatgtgtccaacacttttgcgaagaaaaattgcacctttgaaggggactttacagtaaagtaccccatataactatctttattcttatccattgtttgatcttactgctcatttttaaaaacttcccaggggtctcattttttcctcatcacttaaacaggaataatgttttgtgctgttcatttctccagcaacctccacttcattcaccttggctcatttcattagccaacagtccctgaagcactgccatcttccactccttgctggagaggccctgcctggatgcggtggtttttccaccattaggcacatgcggtgggaggggtggagaagcagggggaagtagtttcttcgtatcttcagtgaagatactttaaatctgtgacatttttttttttagctttcacattcttttttttcttttattattattatactttaagttttagggtacatgcacgtaacatgcaggtttgttacatatgtatacatgtgccatgttggtgtgctgcacccattaactcgtcatttagcattaggtatatctcctaatgcatccctcccccctaccctcaccccacaacagtccccagtgtgtgatgttccccttcctgtgtccatgtgttctcattgttcaattcccacctatgagtgacaacatgcggggtttggctttttgtccttgcgatagtttgctgagaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaacagtgccacaataaattgacaaatggggtctaattaaactaaagagcttctgcacagcaaaagaaactaccatcagagtgaacagacaagctacagaatgggagaaaatttttgcaacctactcatctgacaaagggctaatatccagaatctacaatgaacacaaacaaattcacaagaaaaaaacaaacaaccccatcaaaaagtgggcaaaggatatgaacagacacttctcaaaagaagacatttatgcagccaaaaaacacatgaaaaaatgctcatcatcactggccatcagagaaatgcaaatcaaaactacaatgagataacatctcacaccagttagaatggcgatcattaaaaagtcaggaaacaacaggtgctggagaggatgtggagaaataggaacacttttacactgttggtgggactgtaaactagttcaaccattgtggaagacagtgtggcgattcctcaaggatctagaactagtaataccatttgacccagccatcccattactgggtatatacccaaaggattataaatcatgctgctataaagacacatgcacacgtatgtttattgcagcactattcacaaatctgtgacttttgaaagatgcttccagcatatgggccttctctattttctcacagagacactttaattcagaacattaaatacttaggtctccatcataggtgggaattgaacaatgagaacatatggacacaggaaggggaaaatcacacacaggggcctgttgtagggtggagggagaggggagggatagcattaggagatatacctaatgttaaacgacgagttaatgggtgcagcacaccaacatggcacatgtatatatatggaacaaacctgcatgttgtgcacatgtaccctaaaacttaaagtataataaaacaaaacaaaacaataaacaaaataaaaaaaaaatacttaggtctcctagtgtacatcctgtactccatagattacagtcagagtctcctttcaacagatgggtgtgtgtgtgtgtgtgtgtgtgtgtgtgtgtgtgtgtgtgtgtgtgtaggggggtaaattcattgtctttcctctgttttttcacttcccccatttgcttctgccaatctttcctgtgctcttggctgatttcccttctcccattggtggatctagctacttactaacaccaatacttcatcattcccagtactttatttctttggattattctttactatgatttttcctcccatctacctatggtaggtaaatgagcagacttaccttcaatatgggaagattctgggccaagacattttgttctttcttttcactccgttgaatcacagttcaaactcgtagttaagatgtaagtcttctgcttaaacccttcagtgactccctgttgtttacatgataaaagtgtagctccttagcctggtaaagatgttcaggactaggccttagtaactatcttctgtctctgactatcactcaccatcttcttactttgctttttagtcatgaagaattgtttctacttttcccatgtaacccaagtgatttgatgcctctgtgtctttgttcacagtgtttcctgtatctggaatatacttttgcttattgtttggccaataatccatccccaagtcctgcctcccatccccaatgcctgccaattttagtagtacatagtaactgctaaaattgtattggttgaatgattgaatgaatgaatgttttttgtacatctctcaacttttctcagggattctttcactgagtatatccacacaccctcttcaccagtccaaggagctagtcaggtacctcttcttgcccccaaatcaccctatattccccgccatttataacacttactataatgctgtgagcttctctaaaggcaaggaccatattttattctgctgtgtccccaacacatgaaagagggcctggctgaggacggatgttcagtaaatgatttttgaacttaaatgtttcttgaacctatttcctattttggtgaataagaatcagcaaatcccttgtcaagtaaaacctaatttctgcttttctaacaccaaaccagtctcctgaagccagaagatctcttaagtcctttgaatagtgaccactattttagatattaaactgaaatagagcatgtaaaatttcattatgaaccgtacagtgttatactgatgagttgcattattatctgttttgtacatgtcaaatgaaacttctcagaccacttccaattaaggctggggccctgtactttcctacttcttccttcccctgtttcctgtagtccctaaaaaccctagaattcccctgcaatcggtagttgagtacacagaaggaggcaggttggttaagaactgtcagagttgagattatttactaagaatagcattagcaggggtctaactttattagattcaaaattgcccagctgctaaggtggccctgcagactcaaagtaacacttaacagattcaccagataatcccagcatggccacttacttttaatctgctttccagtctttcagagagataggaagtccccctctatgtccctgtggatgtcgaatcatttatttggggggcctaggtttactacagtgatccagcctgcactaatgtcagaatcctctcctttgctactaaaactatatagtacctctcactcatatcctaaaaaatccaatctcggctgtgaatgacattaaccctgttctaccctgctatggtttgaacgtttgtgtcccctccaaaatcatatgttgaaatcctaacccccaatgtgatagtattaaaaggtggggactttgggaagttattagatcaaaagggtggagccctcatgaatgaggcaagtgccctcataaaagaggcctcagggagcttctttgtcccttctgttacatgaagacacagtgagaaggcaccatctatgaagcagaaagccctcaccagacacaaaatctgctggtgccttgatcttggacttcccagcctccagaactatgagaattaaatttctattgtttataagccactaaaattttttgtcatagcagcttgaatggattaagacctgccccttcctgcaaactaaatatatcctactctgctttctaggattgtccagggggttctattcccattcctactgaccttatgccatattcttctggctctaaatttgcattctagaccttcccagggccttgccttcttattcctgttggccaaagaaagtcttagaaaatttcagaaagcatcttatagccctggtttataagagggtagaaaaaggttttcagccctactcattccttctacctgagtagcctagagtttaccaaattttcttatatggctaatataaatatttgtatcttatactaaagaaactaccctttctggctttctagtaacttaattttttaaaaaatatagcgactttattgagatataatccacataccatgcagttctgccatttaaagtgtacacttcagtgatctttagtatattcacagagttatcttaccaaaccaaatttgcatctgtccccctggtgcagcaaaaccaaacagtgacattgggatttgcagtgagaaaaaatgagacatttattgcaggagaccaaacaaggagaattagacagctaatgcttaagacctgagcttacctgaaaacaggtaagggtttttaaaggttgggaggcagaagttataggcaaagtcataaatcattacatagaagctacattggtttggcgtaaaaaggcaggacatcttgaagaagggtattataggtcatagattttggatttaaaggttttctgatttgtgattggttgagtaggcaaagttttgtctaaaatcttggggtcagcagaaagaaatgttgagctctggcatatgggtgtgactttctccaggcccctcaggaagacatttagaacaaagaagggatgtcagggtttagtcctcagtttccccagagctgaagtctgtgtgccagtggatggcattttccatttgatgggggtctgggtttctgaaaaacaactcagagacatagttaacatgttatctttagtttctataggaaaccaaacattctgtcactctaacttccttggctattattttaagctattattaccttctcacttatcaggctgctcatttacttctcagggttagctcggtgactagaatttcccttgaaggtacagagattttcctttatttccatgcatgaggggaggacaagaagaacctaagaggggtccctgcttgtctcagttgtgtaatcattaccacaatcaatttaggaacattttcatcatgcccaaaagaaacccaggcctatattaacagtcatcacccatttcctctcaacacccctccaatctcctggcaaccatgaatctactttctctttctatgcctgttctggatatttcatatacatggaatcatatatgtggacttttgtgccttctttcacttagcataatattttcaagtttcatccatgttgtagcatgtatcaaaacttcattcctttttatggctgataatattccattgtatgtatatgcatatttatatcatgttttgtttatccattcatctgtttatggacatctacattggttcaacttcttgactattatgaataatgccattatgaatattcatgtacaagtttttatatagacatatgattttatttcttttttgtatatacctagaacgagaattgctaatttacttctaaaattaagacccgagactgctatagaaaacaaacatctactatgttctctaatgggggtggagggaggaaagctttgccattcccaccttgtaaatcagtagggtaaacaaacctaattattaaaaagagttgctcttttcctgtctttagagtaatcaaagcagagcattattggtacacaagccccacgtcaggaggtaattgttttattttttgtgtttatcaaaagtcaatgatatattgacatttgcattactagtcatcctgtttcaaagtgagtgatgaaacactcttctcctaggaagctatttttttttctccatatatggacagagctaattaacaaatggacctatggccacctccatgctgtgacacatattctatattctcaggagcctgtgcatattacaattctggtggtaagtgtaatgtcgtaactttcattttatacctgaagagcagtggttggttgacagcatacaaaggaacatatgtgaaaatgtactttactagttggattttgtgaatagtatgttatgaatttgtcatgtagtagatttcatgaaacctgtatgttttaaaaaaatttccagcattttattgatatttagaaaatctgttttggtgccaagaaatagaagtgcaatctcttacaggcaggtgcaagggtgaggaatatagtgatttatagtttctccttaaagagggtttctgagttgccatttcacatccattcatggatttaaaattgtttttctgaatcttaggcatttttaaaaggaaatctccttgaatagcaagaaaattatcataggtcttgctattatctcaatatttgtgtccccctaaaattcatatgttgaagcctaatcctcaaagtattggaattaagagttgaggcctttgggagatgattaggtcatgacagctcttttataaggattagtaccctaataaaagaagctcaaagaatcttgttcatcctgtctaccatttgaagacacagcaagaatgtgccatcttgaaagaagagagcagccctcagcagacactgaatctaccagcaccttgatcttggacttcccagcccccagaactgtgagaaataattttctgttgtttataaattacccagcctgtggtattttgttatagcagcacaaatgcactgacagaggtcaccagatgcacatgttctttggctctgtatacaaggcttttaaaaacaacaaaaattagctgctcctgtagtacgatgctcttatctttggtttctttatgggagaggatctatggaatctttttaaatgccaacatgaatttaaggtatatctatatgtatgatccccttggactgaaatttcacttgagtaacctgaggacctagaaagagtaacataataaaagcccttaaatgaaagttctacaaaatctataaaaaatagcgagaatagaggaaattgagcagcagacttaacatctagttcaagtcctagtctgctgcttattaggtatatgacaatgaatatgttgcttaactattctttgccttagtttcatcatctgtaagtaggggtagtaataatagtacctacctcatgatgttgtggagatcaaatgagaacatgtatattaaggcggtatacaaatggtaaaacatggccaggtgtggtggctcatgcctataattccagcactttgggagggcgaggtgggtggatcacctgaggtcaggagttcaagaccagcctggccaacatggcgaaaccccatctcaactgaaaaatacaaaaattagcagggtgtgttaacaggcatctgtaatcccagctacttgggaggctgaggcagggagaattgcttgaacctgggaggcggagattgcaatgagccaagatcatgccactgcactccagcctgggtgacagagcgagactccatctcaaaaataaataaataaataaataaataaataatacaaatatgtgtttacataattattttaaaattgatttatattttaataatcataagaaagcaaggtcctatggtatgtggattgaggtataggggcagcctggatttacatgaatttaaattttcgtcagttaacacaagttcctttcaaaatttaggcttttgtttccctttacttcttcacagtaacatatatgagatgaagacactcatgtatcagattagttcaacatcaatatagaatcatcagccaagcagggacatgacatcaaaacaaactaaacactagttaatgaagaactagagcatgcaaatactattatcaaaagacacactgtgtcatcaggacttgattttggttattctctttggtactgggtcagagttcaacctttaattttggtctgccagtgaggtggagtgatagcaaagcggagcaacctctactttcaaggtcctgaggtacaagcctagtttcagctacatctgtttccactaggcccattgagggttaaaaatctatctgttcaaatatttcactggagctagaaatggcttgtttaaagggcccacaggtgcctttctttctctatacagtgcattctttttggtgtatctttgcttcttggtcttgttaaacatcttcattccttggtgtaaatgaacagctgtctcagtagaaaggagatttgctgtctgtttcagactagactggactgacagttcttaggctgcctcagccttaggggaaagaactaagtgatttgtctttcatggaggttaataagcacttctcttgttggttggtttgtgtataaacggctcaggctttggcacgcaatctgtcacggatcttaataaattaccctctgtttatgcacttagaagtaacacttgtattaccagtatggcaaccaaatgttgaagtaaatcaccacacgtgacaaacagaccttaaatcatttgcccaactatttccttgacctgtcttggaatgtgaggaaatggaaaaaaaaatcaagtgataggaatgttttgcatttgtggagaaatagaggaaatccactgtagttttaagggaaaatatgcatagcaactataaatccaaggagattgtttaggtgtcactatttcaaagtttgctatatattttcaagttgttaggaaatatttctaaattgtgtctacttccctgtcttgataaaaagttgatcaaagttaaataaatctttctataatgctgggaaatctcatcgtgtccctgagcatctttactgtacaactgtggtgcttggtgtctctggaccactgctttgatcatcagtgaaatatgtctaggatcatagatggagatgtaaaaggtttaggaaattgagctgaattgcgttgagcacttcattccttggaagtatttttagtaaaattactaccatgatttttttctatgtgacttgacattttttttaagtggaacattcaaaacatgacttgagagttcttttagttgtgatctggctgattaagattttattctattagaataattagagagaaaaagggaggtagagagagagaaagacataatattatattaaccaaaatggtgtctactctacaggcacatttacgatgtagaaggtttttctgtttttttttgttttttcgtttttttggtttgtttgttttagtctagagatttatcatagtagacaggagataattcaactaaaaggaaaactccacttcctctattttattgactattgaagttgggagcaagatgacaaacataaataataaaattgggatagtacccagaacctatgttgtttcaacataggctttcagttttcattagaaagtgggcaatatgcaaatgcccatcaatcaacaagtggataaaaaaactacagtgtatatatatatatatgtgctggaatactagtcagccataaaaaggaatgaaataatgacatttgcagcaatctggatgagattggagactattattctaagtgaagtaattcaggaatggaaaaccaaacatcacatattttcactcatatgtctgaactaagctatgaggatacaaaggcataagaatgatacaatggactttggggacttgggggagagggtgggaaggaggtgagggataaaagactacaaatacagtggagtgtatactgccctggtgatgggtacaccaaattctcacaaatcaccaccaaagaacttactcatgtaaccaaacaccacctgtaccccaataacctatggaaaaatggaaataagtaaactatggtatcactataaaaaaagtgggcaatatgattacacgaaaaagtcttattcccagaaaaaatattttttcaggtatatactgctgaacatgaatgcatacaattcttcttatgaaagaattttcaggtggttgactctctttctatttgtagtgcactgaatgtgctctatggcccataaaaataacaaggaaacttcttattatttgatactgcattattctaagttgcctctgcatagcaacaacttcttcctttgttgtttggtaaattctcaaatcaaattaattgagacattttatgtgccctataattcatttagatcatacatggtgagcattacatgcaaaatcttctgactatccatatgtagtttacatgggccttattcaaaatcacttaaaagtctagtcagaaaactttcaaattcctgaatatcacgaatctaatttaatgagtttgaatgtcccctatgaaattcacattgagatttaattgccattttaacaatattaagtggtgggacctgtaaaaggtgattaggccatgacagccctaccctcatagtgggtatatataacaccattatagtgggagtgagtatgttattaccagaatgtgcttcttataaaaggatgagtttgcccctgttttgtctctctcatcctctgtttgctcttctgtcattggattgtatggcaagaaggtccttgccagatactggccccttgatcttgaatttcctactcaccagaactgtgagccaaaacactattgttcagtgtaaattaccagtctgtggtattctgttatgggtgcacaatcatactaagacaatcagttgattgttttgtttatttagcttaaatgctgactgcaagattttttttttcttgagacaaagttttgctctgttgcccgcaaatttgacgtgtgtgtgttagttctctttcaacatatattaataccagattgactttgaatagttcttccaacttggagttcttttgggaaaatgagcaggtctctgtaaaggacaccttgtgaactagattatgtgctaatggtaaataccattttaacatagctaacatttattgaacttgttttatattacagccacatgacgtatataaacttaattctgacaacaactcagtgaggtagacattgttttcattacttccaatagatgaggaaagtgaatcacagggtggttaaataaattgctcaagtttgcacaggttcaaagtggcagacctgtaatacagactcaagcactctgactttagttttgtaaagcaaaaaatatccgagacagattttaatcaatttaaatagaggcttattttgccaaagtgaaggaccatggcccatgacagcctcaggaggtcctgagaacatgtgtccaaggtggttgggttacagcttggctttatacattttagggagatggaacttataggcaaagacataaatcaatacatgtaaggtatacattggtttgtcccagaaaggcatgacatcccaaagcaggggcttccaggtcataggtggattcaaagatctcctgattggcaattggttgagagaattaagctctgtctgaagagttgaagtcagctcgagtgaagataaggggtgttgtggaagccaaggcttttgtcatgtatatgaagcctccaggtaacagacttcagagagaatagatggtgattttctcttatgggaccttaaaagggtgtcagactctccaaaaatgacctagtaagggaaagagattctttctctacagaatgcatatttcccccacaagagacagcttcgcagggccatttcaaaataggtcaaagaagtatatttgggtgtaaaatattttgatttccttcagggcctgctatctgtcatgtgatgtgataccaaagtcaggttagaaattggtatcttattgctacaaatattctgttttatcggtattaagatctctgttttaatgttaatgctggtcaattgtgtctaaactccaaagggaggaggctataatgaggtatgtctgaccccacttcctgtcatggcctgaattagtttttcaggtttctttgggatccccttggctaagagagggatcccttcagtcagttgaggggcttagaattttatttttggtttacagtatctacactttcaatcactgaatcatatgacccagcaatgccaccatatgttatagtagagcaccattatatcagaattgttggttgatcctcttgtgccctttagcctgtgtcccattttgtcctctcctatccttggtgccaaacacctatttcctacatttccttaccatcagggcatgctatatcctgtgcagatggctttggtctttaatagtagcatcttgatctcctaatagaatcagagttgtcaagtttgttttgttttgttttctcctttattgtgtttaactctctgtttgttacactctattatttctttctattgttcctgtgtctcctccactggatcctcttttcttgttctcccttttatttttttcttcattctttctctttataaatgcatttataatcatggctccagtgaatacctctgagcagctttctcgccaacctctatcaccagctgtaatcatttttataagctcttttctctctaaccatgtactatatcctgccatgagctcacttagcctaaaacaaacttatcaccctctttaccaaaccagtttgacactacctttaaaattttaatggcacgattcagccttaaaacttccaactcatttgttattcaaccttcttgttcctttatcttgtcaatcatcaagtcctgttgatccttctttggtaatatatctcatccattaattcctttgtattcccagggcctgaatattttccaggcctcattatatcttgcttgtaatagtataataatctaactagtctcctggcttccatggtgcttaccccctagtgtctttccccatttcatatcctcatcatctgttccactgagggtagagagaaggaatataactataataaattaaagttaaaataagtagaaatagaatagtttgaagtcagaggagcaagctgtcattgttggttgagataatcagggaaagctttaggaaggggatggaatttagaatttatataaataaagaggtctgaggagggcatttaagattggggaaaactgggtgaacagaagcttgggatggaaatgtaagaagtttggggatacttagtaggcctggctgagctggaccattattgtaggaaaaatgaggttgaaaatatagtctgggctctgattgtagggatccttggataccaggcaaaggaatttaaaatgtatcatgtagaaaatgggtagagacatgatgaaattggcatttcaggaagatgaatctggcagctgtgtgtagggtagattagtgggaggagagactacagagagggggcctggttaggaggttgtaatagggttcagatgtgagttaatgatggctttgaatagaacgacagaacagaactgatgagatggatgcagatgtgcaaagcattatggaaggaaatttgataaggtttccttgagaggctgaatttgcaggcagttgggagaggaaatgggagggttggactctgggtgaccaggagaatatgtatcaaaatgttcccatccttcaagcttcagtgcttcctcctctaagagtacttgtcccaacggagcactgtgagcaagccactttgactgtaatagatgctcaaatagaattaaggaaaagcccactccagctggcagtgactttgcatgctctaaactcctagacacctattgactctacttttagtaagcacttagcatacatgatttctactaaactagcttttaatttgaggatgttttacctctacagtgagagagatcaggagagttttgagggcagaaatcatgctttattccttagattcccacctacctagtccagttttagacccatactagttgttaaaaatattttccttgattgtttcctttcatcctcttagggggcttggattgatcatctcacaggtatactttcctatccattattatgctgatgagacttacagtttaaatacattaccacacctgagcctcaggtacttatagaaacttttcatgtcccatcttcatagtctcttttccttttccagtgcagtttactgagtctgatcacgatcacgtattttgtgtttcagtaggtgcttgttaattgttggtttactttaagattcctggctgtggtataagctctgctacatagctaatgcagctttagttccatctgcatattttagcaacactacacaaagtgaatgtattggcacaaatgacagactttgttggtttaattttgtaaactgtttaaaatttggttcatttcttttcatttgcaaaatatttttattcaagtgtattatatagctattcatctcagaagaaatttgctattgcttgaaaaatacagtttgctttatgatcccaatattataaaggttcagagaaaagaatatctctacaaacaaaatatttatttgatctcgagacccttctcaaatacattttattcgtatctgatcagaatttctagaaacatacaattacacgttaccttaaattggtaagatttaatgtatttgacagtaattcccattaaaggaaactgttgcaggactctctctcctatgactatattagagccctgaattccaatgccagatctgccctttaatttctttgagaacttaggcaaggcacttggcattcctgggtctctttctcccatctataaagcaagagtattgaacaagatcacaagatcaccttctatgctagcattaattttggtttcgagttagcaaaaaaaaaaaaaaaaaagatctttcctttttttaaaaaaagcatatgccatgaaaatttcaagaactaagggcagattatgccccaacatacacagtcctcatagaaattggaatgggggacaggaaagccatcaggattggaggttattttgtctcaggatctggctaactacaaagctctctctctctctctccttttccccacatatctgcaatattctctttctactgctgacttccttgtatcttcagcttacatatggcccagaaaagttctatcttcaagtcccccatgtccttctaactcagccgctacaattatcaggctcatcctctcaattttcaattataaaattcaagagagaaaataattgactcaactcattttttaaagccagatcttgtaaaacatagattggctggtcaggctatagaatgaatgcatttgtaagaattgttcacaatggtccaattagttgtggccagtggaggtgggaggttgattcatttggaactgaaatgagagttaaggattgcaaaagttatattctagaaaagcacttagacagataaacaggtactctgaattgcacctaatacatcttccatcactgaaattctgttaatcaaaaagtattatttcttattgaatgacaaaagagatggtgctctaatggttaggatttcaggaattagtcagcaagtaggagagattttagttttgttattgttaaaatataaattccaatgtaaaagtaagatatgcttccagctgttattatttatctttagaatgtatgagttttagcttcctttttgaaaaggtgagcattggattcatagaaccaacttgtttaaaaaaagagtagaactatggggcacggaggaaaagcttcatctacagtaaggctgttttttacatcttaaccttaaaaatctaggcaaggacccaccaggcgccgtggctcacgcctgtaatcccagcactctgggaggctgaggcgggcggatcacgaggcgggcggatcacgagttcaggagatcgagaccatcctggctaacacagtgaaaccccgtctctactaaaaatacaaaaaaattacctgggtgtggtgcgggcgcctgtagtcccagctactcaggaggctaaggcaggagaatggcgggtaaacccaggaggcggagcttgcagtgagccgagatcgcgccactgcacgccagcctgggtgacagagcgagactccgtctcaaaaaaaaaagaaaaaatctaggcaaggacctcaataatgcatctcagtcttcacatgtccaaaactgaacttttgattcttacctttccctcatctactccttgtcacttcttttctttccccaccaaatggcaattccattcattttggtgcagacacgaaacctgagttattttttatttctctatttctccaataccccacatccaattcatcatccagttcttgaaaatatattccaaattttatcatctttgccattgctaccttgctagttaaagctatcatcatcttttactgggactattgcaatagtctgtgtgatggcttgttttgggccacataataaaatacgtaaagtagattttcagggggtggcttgaataggaaaagggaactcttttagagagtcacataacatatgggttctggtcccatttcttctattaactagctgtgcaaactggggcaagtcagttcacctctctggaacatgaaggggtttctaatggatctctttctgtctcggcattccgcaccatacttgccctcatcaccttgcttctgaattccctgctgtgctttctactgaccatctggagggaccctctcttcacagcatccagtgctccaggctggtgactgtgggaaagggagttctactatttatggtgctcactgtgtaccaggcattataccaggtgctttatgcacgttatctaatttaaaattctccataactatatgaagtaggtattattttattcccattttggagatgaataaattaagctctagatgcattaaacagcttactcaagttgtaaagctaataagaagtggatcagccttttccaggctgtttgtaaaaggaatatcattctgttttctagaacttggagcttcgagggaagttttgactataaaggtcaagagtggagatgaggaaaatttcaagtgctgatgttattcccattcagattgagaagccaagcaaactggaaatcctcatctgtttctgaagattcctacagaagtctttccccacctcctctaccaccaaaacaggaaacaaggcagggagacagaaagaatgggataggaaatgagatatgaaataggatagggaatggcttggtttttctgtaccaaatcccctatgggacactctttttgtatagaaatgaactaatgtgcactaacttggtggaaatgggataagaggtcctgaatctcataagtttccaaacacattctggaaacacattgctttccacacaaattactgtaatagatggggaattttaagttccaaactgaaacagtggaagaaccatttgggggcagacatgtaaagcacttcaggctgactccttctcttcactccacataggtagctgttcactctgctttctgcaagacttttcatgctctctgacatttggcttaatctgataccagagaataggtgattattttgtcatcaaaaaagtagaaacattgaatttgaagggaatttaaaattcgtgtagcccaggcctttttcctgagaggaaacagattacatgggttaagtgacttgcggttactcagctaataattagatacagctgacttaaagaacccccccccccactccaccccatttttttgtggttgtttgtaacaaaaatatttgctttcacaaagcgtaatctattggggcctgacctagtgatccaatctgaggcctgtatgatttgaacatttgataaacactagagctcaaagaaagccttcaccaacttttgttgcctggatttctttccctcaaaagttgatgagaatccatataactgatgaatttctttgcagtccgtttacgggtgtgtgattaaatcccaggtttctcgtggatgattctgagcttgcccatgctttaaggactcattgatccctgcatttattctacagcccaatacaagcagatatggaaattgtcctggcatcctggatgcattcttccatgttatttttattatattatatgatgaaattttgtaaatatgtttcctacatccagggatgcctgcacaatttaggggcactcaaaagaagaatgagagaatggacttagaattatgtgtaatatatattttattgtgctcatatatttagaggccttccccatttcaattgtgcaaatgcttgaaaaagtttctctggaaaaaaaaatatattaaaacagtttacccatctacacttcatttcattctccccaaaactaatcatctagaatttaaaataaaccataaatctaagagagaatgtaggggagagggaaggagatagaaagaagagggtattgattgagaggttgattgatttttattgtgatttatctgaggtcaccaaaaaggcatctaggtttctcattttctctgcttttaaactggacaagtctacccatttaattcttccaaatacaaggaagaaaactaaacagaatatcttattgaaaatttgcgcttctggtcaagacatgaaaatatttgcaatggtccatctggattgtaatctctagataggtagacagtgttcctttgaattgtgcatggtggcagggcacattggctcacacttgtaatcccagcactttggaaggccaaggtgggaggattgcttgaggccagcagtttgagaccagcctgggcaacatagtaaaacacaatctctacaaaaaataaaaaacaataagctgtgcatgggagcatgtgcctgtggtctcagctactcaagaagctgaagccggagggttgcagtgagccatcattgtgccactgcactccaacttgggcaacagaatgagaccctgtctcaaataataataataataataataataattgcgtgtgcttaaaataactcactacttaaattgctaatctgttttagaaagtacatcaacagattactgtgtttttttctcattcacttgaatttaaaattggatttttggtaacaagatatgaggcaaatgggtacaacaactgtacagtataaattgctccaggtgatggtgccatagcaaaattattacaggcagattcaagatacaaaaattatttatttgacagcaagcagaatgacaaattactcagaggctgtgtacatgtgcttctataattgctcataaattattatggttcatgttaaaattcaacgagtttgcctagaccacatggttttattttaaataagaaagtggcaaattattagcaattgggaaatgtaatctgcagtataaaatcattacactggaacgtggtaattttgtgtgcaactttttcatttgctatcgcctatctgtcaaaatcttcattttgtaacagtttttaagattatggagcttgcaacagaaaaatctgccactcgaatctcactaaaatattatttgccataaattagagttaattataaggtggatataacttggaccctctctgaggggatttagttactggatggcataagatacttttcctcatgatgtggctttcctggctttggtcctaaaagcggtgttatgggagacttcaggtgacttacctcttcatagcttcttgaactaagtttaatgattggaatacattttcttagcccaggaataaatgtctagtttttcaacccagtctatgcccactcaccattgttagatgacactgtaattccagagttacataataatataaactagttgtcatacttacgctacaatggcaagagcacttgttatagagtcaaacatggagttgtaacttactgtatgacataagtaggttgcatagctcctctaggcctcagtttcctatataagttgtaataccgtgaactctctgtctaccatccatgactgctgtgaggaagaaaacaaaaagccatgggaaagtgctttgtaaataaggccccatagaaatggaagacattaattttttgctgaactgaaaatcaattgctttacaatattattcagagtatatgtggtgagggaaaattttggaacttaaaaagcactcaaatcaggcacagtattccagggcatgttatgtatagtggccacaatcttctaaagagaaaataaacacaactttccttaagcatttatttctgagtttcaaataatgttaggacaaagatgtttcatcatttcatgtaactgaattattatatatttttaaaatgcttaataagagaaatataatgagtgcttttttataagcatttatacatacacacgcacttacgtacacatacttaggaaaacgtggatactgtgtaacaccatgtatggagggtgtgttagtccattaggtcttttataacaaaaatatcatagactaagtgtcttgcaaacagcaaacatttatttctcatagttctagaggctgagaagtaagatcaaggcaccagcagatttggtgtctggtgagggtctgttcttcccattcctcatagacagtgccctctagttgtgtcctcatgtggtagaaggaactcctaatcacctcctcaaaggccgcacctcgtaattccatcatgttgggagttacaattttaaaatatgaattttggagagacgcaaacattcaaaccatagcagagggacagttaagcaattgtcttggggtccctttaacttctagatcagctattgcaaaactatgacccaggggctaaatctggctcaccagctgttttgtagttttactggaacacagtcatgctaatttgttacatactgtctatggctgctttctcactaccgtggtagaattgagtatttatggcacactatggccaaaaaagctgaaaatatttatcgtgaggccctttacagaaaaagtttactgattcctgttctatgctttgctgaaaaggctgctcaaaaagcctccctcgcttttgccatttcaaatgaaatgcacatttcccccttgatgtgcaccaggtttgtagttacttattttgccaaaagaaagaatacaaaagggtcaactgacatgactccgggttttgcttttggtttcttccatttatcttctcaactttccccataatcaataagaatagtagataatcttcactaaatggagttttcttgaaagtttggaaggattttatttttcatgcaagtattttgggaaggtgaactgtattttctagaacctttgatatctctgctaatatgtcgtgcatattttacattgagttagcagaatctgcaagtatgataccacaacaaatacattctgtgctttttaccttggtttctgggagctcctgtcatttctgtatctctaggtcttgagagtgtatggctgaacaacaccccattcctaagaagatggtcatttcaggctcaaaaaagagagtagctacttatagttaggcttggccctaagtaggaagagactggcccaaggtcctttcctatgtaaacttgtctgtcatgtcactgaactttatctaaagacctgccatttgattgcaccccctccactccacctgagtactacagaggagagttaagagaactcttccaaaggttatctttatacagtagcaatactctctacaaggtatctcagcagctgacgaattagacatttattttaatgagttgaagacattcatgtgttcttgtcaacagttaaaggtaggaaaaaataacctaaaatgatttcaattgcctttggaaaaaaaaaaaacaagcagaaatcttgtattatcttggaattcactgattctgagctgacagcagattgctcagtaatcgggctgtgtctcagaagcagtgatttgattgagttctcatattcttctttgaatgagagatgttggtaagatggaaactggcctgagctgatcccaaaacttaccagactgaattatggttaaatgtgttgagagtgaccaatgtgttgagggcgaccaatctgttgaagtttgcccaagactgtctgtatttaaaactgaaagtcctgcattctgggtaacccttcagtctcaaggaaactggaacaagttggttaccccagggggactatgagataaaataatagctcgaccttgatactgtgcaaagaaatgtgaataagataggtgaaataccagttagtgacagaagtgagaaatgctattaagcaaaaggaacagggcaagaacaagagctctcttaagttattgcaatggttagcatacttcaggggctcctgacttaaccatatcctcctttaagtactttcaattcatgctctatatctgctatggattgacattatagcatagtgcttaaaacctcagccttgggaatcagacagtgtgggtttaaatcctggctctaccactgataagctgagtgagtttgaacggattatatacactctctgcctttatttcaccatctgtaaataaggttactaacaacagtagctgccttgtgaggcttagggagagattaaacacgtcattttaaatcactttgaacagtttctggaacatagtatgtgcttagtgttagctactattataatatttaaatcctgttttattcttctttgcacatatcactaccgtgtaggtgtctcataggcacctccagctcaatgtatctaaacctgaactcttcatccttgtccccaaactgctccttctcctgtgttggctctttcagtgaaggaaggaagttactttagattattctggaaggaaggaagttaccttagattattctgcaaaccttagattattcttgattcttttctttccttcaccctctacatacaggaaattatcctttgtactccccactgaccattcatttattctttattatatattcttccttttattataaaacatttgagtgccacccactgttccataaaaatttgggagcttaatagtgttgccactgaagcagaaacctaaaagccatgagccctttccatagttctccacatgcaatctcttacaagtctgatctacctccacatcacttatatccctatctactctactgttctctttgctacttccttggttcaccttcacttttttatctcaactatggtgacaatttcataaatgatctctgtgcttctagtcttgacctcttccagtctttgtttcacgctactaccagaatgatctttgtaaaaagctaatcattagagatccttcaatggctccacatggctttcaggataatttccaaacttcttgacttactatacaaggcctttaaatgatctgtctcctatttacttcactggtatcttctaacatttacccatatgctctagccatatggaaccacttgtaatttcctgaatatgtcacattgtttcaggccttcatgacctcataattgtagtttcctttgcttgggatgtcctgtcctctgtattcatctagctattggctcctcatttttcaaaatttagttcaagggccaattcctctgcagatccctctttgatcttccaatctggctcagtagctcccaagacacctcattctttctttcgtggtatattgaagatacctctggtatgcttaatggttaaaagcatagccttgggagcagtatccttgaatttgaatattggctctcacacttaccagtaaagtggccttggatgggttacttaatcctcagtgtccttgtctattatatggagaaatcatattgataaaaactacttgcaaggattagataagttaatacacgtaaagtccttagaatagtacctggcgcatggtaagcccattgtattatctattaatatcatcaccacaagtacttatttaataatcccactagaaggtaagcttcctgagacaaaggcccatatattatttgacagtgtagccccagggcctattccagtgcctgacgtataggtgctcgataaatgttgttgaaaaatgaaggaataaataaatgaaataaagaaatggagaactgaaatgccttccccctccaaaagcaattaacttcccaacccaccaagcgccatttagcttcatatacctgcaagagggagagactagtgactttagctggtccttatttttacatttgtaacatctactgtgctatttggaggaaagtatgcaggcttggctccattttcaaatgccagaagtttttgccttcactatcactttaaaccttgtgaaaataatcaaaagatgatactgtcccctattgcaaaagtgaaattctagcaaatcacaaaagaataaacggtgaaaagtcttcttaatcatggagctagctgtgctccatcctgctcattctggacacttggagagatgatttagagaatttgccagattgcagattaatcagaaagcacatgaactaaggtgagtgacagcacagtaagaagaacatctctgcttcacataaatggagacaaattgacttacatttgaggctgtacagttacacaggagaagtcttcttggttgtgtttttaaagtggagtggggaaaagccatcaatttgattggcaactcttgtataataaaaacttaaactaactacaagaccatttttataatgccaccaaatgttatcagccttattataaattattacattactttcatctatttctctttgtcatcgttactactctgtgggatttgatcttgcccttcttcaaccagataactaggcaagctggattaatggtccaacttctctcatctcttatctgaacctacaatcaaggagtccccagatcatcaactgaagtagtgagatagcagtttgaactctgatattcagatatagtgagatgggggaaagggttggcccaacactctgtgatgaagagatgggaatatttatcattttatgaccaacaattttctggccctgccaaaggaatttctgcctaaggaatgatttcataactctgagtcagctatatgggctgagatgagattttcaggagatatttttacctttacttggtcaattttgtttttccttcttcagacctgtttatcatggacttgttccatttgcaaaaccacttttgcattgtagctaatgatggcaaagcacctggtcgatttggttgattcagtctactggtgagtcactttaacaggagatgactccccgccattcccaaaaaaaggcagttctttgaaaacagctttggaagggctgtaaagctaagagagcatagcaatgcctcctccccccgcccacccccccacatacccacatccatgtggcttcacttgcagtagaagtggcacagcttcattgcaaaactgtaaagctggggaagtgtgtcttcaggagaggcagggaaagaacatggactttggagtcagagataccctgttttgccattttattatagttgttattattatcagttgcatgattagtatttacagagtatttgtaggtgccaagatctaagtcaaagtcttttatataatttgcatttcattctgtaatgacccatgagaaaggcactattataattccccttgtataggtggggaacctgaagcacagagaggttatcttaattgttcaaagtcgtacagccaagtcaatggcagatcctgaattcaaacatcggtatatctgattcttaacatttttcttctgtttctctaacaaatacatgaacttaatgaagtaatataatcctgagtttaacaaccattatgtcagagatcggctacagtgatgccaacacattgatccatcagcccttgggatagccagacaggcctgggatggccagccacattggtctgctagaagtcttgtcattttatcccaatgaggcaatacattttatagttttttatgtgtacgattacatgaaaaatttgggcagcaaaatttaacttctacgagtgtcagtgttttcctctaaatgcggggctattcatatgttttgctaaggttttggtgaggattaaatgagtcattgtattagccagtgttctccagagaaatagaaccataggaggtgtgtgtgtgtgtgtgtgtgtgtgtgtgtgtgtgtgtgcacgtgcatgtaaagagagagagggggagggaaggaggaagagagagagagagaaagagagagatggattaaaagtattggctcataagattatggagactgacaagtcctaaaatctgcagtcagccagctggataccctggagagccagaggtgtaagtttcagtccgaatgtcagcagtcttgagacagaggaagagccaatgtttcagttcaatctgaaggcaggaaaaaaaaagattgttccagccctaaagcaatcagacaaaaggaattctctcttactctgacttttttttttttctattcaggcctttaatggattgtatgaggctcacccacagtggggaggtcaatctgctgtactcagtctactgattcagatggtaatctcatccagacacaccctcatagacacgccagaataatgtttgaccaaatagctggataccccatgggcctgtcaagttgacacatgatattaaccatcacagtcaactaacatgatgtttgatatgtggtaaggacttaacaaacgatccctcccatcaggtccccttctttgatgtttataacaactctacactgtaaacagagctactctttattttacagataagaaactcatattatacccaggtatcttcaaatcttctatccttttaactataccatataaccttcatgccactttttgtcgaatgatgttacttaataaggaccagagagcccctatgggccaaatactcctttcctttttccttctttcagctctacccaattaaaagtcactatccagagtacaatttattcagcaggtttgtgctgggtgatgatagtgggtattggcttaatttgataaaatagtctatgctaatacataataatgatatctctgctaggagttttgtcatttctagagtacaagacactctaattcagtgaaaaaaaaaaacaaccatgatccctgaagtctctaaaaggtggtacaaagcaagtaaagcacttttggttgagaaactttcagtttctttctttcttttttttttttttttttttttttttttttgagacagagtgtgactctttcacccaggctggagtgcagtggtgcggtcttggctcactgcaacctccacttcttggctcactgcaacctccacttcccaggttcaagcgattctcatgcctcagcctcccaagtagctgggattacaggtgcatgccaccacacctggctaattttttttatttttaatacagagagtatttcaccatgttggccaggctggtcttgaacttgcgacctcagatgatctgcccgctttggcctcccaaagtgttgggattacaggtgtgagccatcactcctgggcccagattatttcaaactgaattagactttatggatggtagggatttggtggagtgggtggggaggtaggttctgcttgttcctcctataaattgagttggtcctaggtagtcaggaagaataggctttttatgctgtagctttgaaagccaatggacatcaacaaggtgtccatctcaggtaccttctcctagccacctgataatattaaaatcaatgtcatgaaggatcaaaagcaaatagccacaatttctaacttgttataaaaagcttccatgcagcttgataataatgaccctctaaaaaaatgtaaaacaaagggagagagtctttggaatcatttgtatttgtcagctaaaaaacagtgggcaaatatcatgataataggaaaaaaatacaaatgagcatataaaaatatttataatatcttaagatgagattatcagaatagttaaattatggttgccagtatgaactgaattatcacttctgatattatacattatttccaataatatagatgatcattccttatattaaatatttcaaatgttataaattatattaccaataagaataatcactgctaaagttataaatcaaattgtacttactattactaatattgacaataactaatacactagagctaactagatgatgttagatactgtttgttctaagtacctgacatgtattcattattaaatacaatgaccccatgaagtagtcacaagtgtcatttgttttgctgacatggaaactgaagcacagaaatgttaatatgacttccccaagaaaacttagctaagccataacaggagtagtaagtggacctagttccagcacccaagtccttaaccccatgctatactgccagtcaagaaatttcttttctagccttttctagtatctcactccatttaagaatctgtagaattaggcaaagagtagtgtaaaaagttcaagaagaactagacttcatgaggatttcgatgaagccctgcttctttcatttttaatttttgaagtaggattcagaaaagtttagacactggccagaagtcacacaacattagtcaaggtgcagccagagattggagcctgtgcctaggttcccccaattatgaaggtaacaggcagcggtaaagggtggtagacttcccctggagatgttcagcttatattccttcatggagttgttgagccagcagactgagataaaagatgcaataggattttaaaagaaagttcagttttgggaggagtctaagaccctctatgaggccccacctctgctaataaaaggatgtccaaatcttttgagaattcaccattttggtctcaaaattgaaagaaaatggccctatttgatcctgggagttgtggcatctatggaggcagacaacacttcgagtaggtatccccacagtgtctctacagaacctgtgacagagacctctggggcccatggtaggagaagtttcccaggatgtgaatgcagaagagccatgtgtcactgaagatggtcacacacagggatagagagaataggactgtggaaatcaggaagaaggtggggtatgtggtaggtgacagaaacagcaggtcccccgttcaaggccagcttgctccctttggctctcaactccacatccccctgtagcatagggagtaaggctaggtttatattctgaagggcagtcttttccccctgccctgtattttggaggtctatggaggcagttgatctaccttccatcatatagaatgtggcacagctgggaacattgatcttaatatccccatttgttcctgtccaggcttcaagcctgctaaactcagtacggactcaaatagtcaaaaactgcatgttgtgggtgtgtgtgggagggtggtgggggtgggggtgctggacagaccttattaaacacactcccattaatctctacctcaccttacctggcccgcttacctgcttatgtcagcccagaacatatacacccagaagagtggagactagtgctggtggaacagggaatgcccctccatgtccacctctaccactggcagttcatgcatcagaaaatctttccagaggagtcacgatgtgacagtgtcaaatcatagattcctttaaatccaacccttctctggctctagatggagtgagaaaagaatcagctatgcttggccagtcttgggtgtatatttggaggaaactcaatggtcaaaatgcccccatggcatgtgtggaaggcatgagggtaaagggtttgaacagagcaaaggcagcaagggcaagaggctgagaacattatggacaaaacgaatcatcctcctgaatggatgaggagaggaactgatatgtggggccccctcaggggcctgataacctgtggaggagaaagggaaggaggttggggattaagaagttatattagttttctattactgccataacagattatcacaaatttagaagatttaaataatacccacttattagcttacagttttgtatgtcagaagtctaggagggcttacctgagttctctgtttagggtttcaaaagtcaagtgtcagccaggctcagctcttacatagggcttctggggaagactccactaccaagctcattcaagttgttggtagaattgctgagattcttgtctccttgctggctgttagccaggagctatgctctattcctagttgagtttgctggcattccttctcaagtgtcccccctccatcttcaaagctagcaattttacatagagtccctattgtacctaagattttttctgacttccctctcttctgcaactcgagaaagctttctgcttttcagtgcccatgtgattaggtcaggcccacctgaataatctccctattttgtggtcaactgagccatataatgtaacattaccacagaagtaatatcctgttcacaggttctggagatgagaatgggggcatttggggggtcattttagaatttctgctacaagagtgtttatggagttggagggcagggacttagtatttcactaggaacaccaagctccaaagactcaccccatattcttagccaaatcatggtctagaaccttaaactttggttggagagataggcgtagggataagatgatgggcataccctgttaatggtaatctcttaataatttgtggtctaggtggtgatgttgggcctcagaaactgaactacaatgactaggggtgaggacagaaggtccttaagattctgggacttaagattttcccatccccaagtcttctaaaaacagagtatgcagagctgtcctccccacctggccacctacatggaaatattattcacccctctggaatttcatgataagacctatgtggtagggacatttctgatgtctctccaggctcactcatgtctcagtcacattaaacaacctagcgatatgatgaataacaactgcgggtttgcccgtggatggttcaggacagagccaggagcaatgcggaagccaacaggaaaatgaggtctgatatctaactctggttttctagagggaggagagtttccttggagaagggaaagaaagtagccaggcctctgttgtctggtgggaggaaggtacactgaatctggagctcctcatagcagtgttcttaaccttggcagtctgggttgtgttactgtcaaagtttctgcaggatgcccatgctcaatgacagataaataattaacaagaggaggctgtggcctggcctaggtagttgtgccctggtaacccatactcccttggttttaccctctagagctttctcacccagccgtctgctagcatatggagttgatgttgaggtgttatacctagagttctaactgctgcttctttttttttttttttcttgtttgagacagagtttcgctttgttgcccgggctggagtgcagtggcatgatctcggctcactgcaacctccgccgcccaggttcttgcaattttcgtgcctcagcctcctgcgtagctgggattacaggcacccgccaccatgcctggctaattttttgtattttagtggagatggggtttcaccatgttgcccaggctggtctcgaactcctgagctcaggcagtccacctgtctcggcctcccaaagtgctaggattacaggcgtaagtcactgcacccagcctctaactgcttcttaagcagacttccaaccaatccttttttttaggtctcatctttaccctcctaccacttctagagggaacccctgcctctaatcctttcctatgaggagctgacaaattttcaaatctccaccccattaacaaatctcccttgttccttctctcaattcctcattcaccctcattcatcatcatcattcatcctttcataacccattccctgcttccccacggatgaagactcactccattctcttggcaatcttccaggccatatcagttgagctggaccttatccaagtatatattggacacatgcaggctggaagtcttaacccgctgtttgatcttgaatattggctgcataaacagacataaacaactggctgttgacatgacatttttcctttgagcagggagggcagggagggtggatgaagattgggaggatggtaccacagctggagagaaaagggctgttgtcatccacttactgagtacaaggaagagtatctttctttacccttttgcctttttaaattttgcttactctttttacctgggctagtaggaagctaagagccatattgaatgattaaaaaaatttttgaggaaaatttattgtgtaccaacactatacaagatgcttttggcctgagctatttcatctgagtctgctgccaacataaggagggacaaattaatccccaccctcaccctgtacgctctggctgagtcccgaacatcagcaccttcaatgtcacccactgctggtgcctttgactgttttacacatgagaaagtggggaactcttcttcttcactgatataacaataagatcgctataatttgaataaaatactagttatgtgtgataattattcctatcaatacccatgaaagtagtagcggttaagagaaaggaacctggactcaaactggttgtgggacctcaagcaaggcatttaacctctgtctcagtttgctcaaattaaattgggtatatttataacatctgtcttataaggttgttgtgaggattaaatgagtcaatgaatgtaaagcacttaaagcagtgcttaatacacagtgaggagttaagaaactgtactattattatcatcattactatcattattactactatttaccagcttataaatcacttaaacttgacaaaaaccctgtaaggtgtaaatttctccctaatttacaagaaactctcattcctcacagtagcattaattccaattatagtactaacaaatgcaaatctcaatcctcacagtagcattaattgcaattatagtactagcaaatgcaaataataatagaaataacagtgatgcttcataattatgtccattttacagatgcatgccaagattatcaggagtgatattaattatgattatgctatcaatagagtatgttactgatattccaaaatcatcttaatttaacaggtaagagcagataaaacaattattcttatattggtatccattattaggatagttaccaaaataacattagcaataataataatgataacgttaactaggtaatataattttgccatttcccagagtggaaaacaccataccagcagtaccaggaatggcagttactatggttttttttaaaaaaatactgtattcaaatactgcaaataactgcattaacattttacctcacttattctgattctgacaagatgaaagggtaatatcaggattcctttaacagcatataactaatttgttattaactatatttattagtaaattattaattaaaactgtgctgtacttactgtaatacttgtaatgattatgatatacataacaatacataatatataatgatattgattataacgattaatggtatgaccatttagttatgacctgaattataataattgatgctgtaaaggtgaaattattaaataatataataataacgtaaacacaaataataatgggtgcagagtaattatactcagttaacaaaaagtaaagcgtaatagaaactttcctggtagtacttcctggttaactaatattataatattatgatattaatgtaaccaccaataatagtattaaggatatactagaattaggcccctttcactgcagagacagtcagtacatgggcacagttaaatatatttaatcctctaacatcaacctaaatgcatatagtaacatggaatatcctgtaactacacccatttcccagagggaaaaaggtgaggccagcatactgggtagttattagggcactaacactacagagacacaagttatactcaggaagtatgctatatgtggccatttcccagcaggaaagtctgggacagcttggccatgggtgatgccccttgatcagcctcataatgccatacttctcattcaccccaatgcatgcccccagtcctggccccgagaagctttccaggatcaccggcatcctgagagccccagtcttacctcagccttcatccacagagcatgctgccttccgaaggtcattgtcaactggcacctccactgtgccagttgcataagcacttcctcctcaagggcacctactgacatgtactcccaggtaccccacagcaacaccaccccatccacctgtggggagagaaggggggtggggctgcttctgggggcaagcaaggaggagtcctccctctttcattaccacccctccttgacattaacctgggtgaggccatagttcaccaggtggactatgtgaatgaatttgcagggtggaggaagtgctcagggtctgggagctgctgcttgagatgatgaaggaggggttttaacccactgatccctttgtccaatcagatctggaattaatccaagaatcagtaaatttcccttactcccaacctatttgaacagatacatgaagaacactagctatcagtgagtcatgtagctatctgagggaacagtgtatagcaggggtcttcaacctcctggaccacagactgtggcctggtaccagtctgtgtcctgctaggaaccaggccacacagcaggaggtgactggcaggtgagccagtgaagcttcatttgtatttacagccactccccaattgctctcattactgcctgagctctgcctcctgtcagatcagggacagcattagattctcataggagcacaaaccctgttgtgaactgtgcatgccagggatctagattgcatgctccttattagaatttaatgcctgatgatctgtcactgtctcctatcacccccagatgggaccatctagttgcaggaaaacaagctcaggtcccactgattctacattatggtgagttgtataattattttattatatattacaatgtaacaataataaaaatgaagtgcacaataaatgtaatgccctagaatcatccccaaaccatctcctcccccaatccctagaaaaatcgtcttccatgaaaccagtctctggtgccaaaaattggggactgctgtgtagaactaggcatggggcacagccattgcaaaggcctgtaggctagaagctgctttactggttttatgaactctctgaatggccctagaatgtacaaatttgtgtgacaaataataaaaatacgtaccaactaacaaagcttttcccaaccctatctggctctactccctcttttaagtataattacaattttatataagaaatgtttatgtttataatattttatataagaaatatactaggatgaatcatacaaaattgtcaatatttgaactttctaaacaatttacctttcttgatacataacaactgtgtgtatttatggggtacatgtgatactttgttatatgcataggctgtgtaatgatcaagtcagggtatttaggatatccatcacctcatgtttttatcattttgatgtgttggacacattttaagtccacacttctagctattttgaaatacaaaatacattgtttttagctatagtcaccttattctgctatgaaaaattagatcttgtttcttctatctaaccatatgtttatacctattaaccaatctctcacctcgccccacatacacccttccccaactctggtaactatcattctacttgctacctccatcgagaccaattcttttagctcccaataggagtgagaacatgtgacgtttgacattctgtgactggcttatttaacttaatgacctccagtttcatccatgtttctgcaaatgacaggatttcattcctttttatgaccacagagtatttcattgtgtatagataccaaattttctttatccagtcatctgttgatgaatacttaggttgattccatatatttactattgtgaatagtgctgcaatttacatagcaatgcaagtatccctttaatatacggattccctttccttaggataaataaccagtagtgggattgccagattgtatggtagctctgtttttagtttctttttgttttgtgttttttctttggtaaattgccatactgttttccataatggctgtattaacttacattcctaccaacggtgtataagagtttccttttctctgcatccttgccagcatctattatatttttctttttgatgatagccgtcctaattagggcaagatgatatctcactgtggttttgatttgcatttccctgatgattagtgatattgagcatttttcatatatctgttagccatttatatgtcttcttttgagaagtgtctatttgtgtcttttgcccacttttcaatggagttatgtttttttcttactgagttgtttgagttccttgtgtattctggattaactagtctcctatcagattaataatttataaatattttctcccattcaacaggttatctctttactctattgattattacttctactgtgaaggagttttttaatttaatcaagttctatttgtctacttttgttcttactgtctatgttttagaggtcttagccataaattctttgcctagactaatgcccaggagagttttccttaggtcatctcttagtatttttagtttcaggtcttacatttaagtctctaatccttgttgagtttctccttgtatttggtaagagataggaattcagttttattctgcatgtggctatccaattttcccagcaccatttattgaagagggtgttcttttcccaatataagttcctgttggctttgtcaaagatcattcgtctttaaatatgtagttttattcctgggttctctcttctgttccattggtctgtgtgtctatttgtataccagtgtcatgctgttttggttactgtggctttgtaatatattttgaaatcacgtaatgtgatgcctgcagctttgttctttttgctcaggattgctttggctatttcagctcatttttgggttcatatgagtttttgggttgttatttctaattctgtaaagaatgatgtcagtattttgataaggattatattgaatctgtagattgctttgggcaatatgtttattttaacgatattaattcttctgatccatgagcataggatgtttatctatttgtttctgtcaccttcaatttctttcaacagtgttttacagttttccttgtagagatcttttacctccttgtttaaatttattcctaggtatttttttttttttgtaaatatagtgagtgggattgctttcttgatttttttttttgcctaggtcattattgatgtataaaaatgctaaattttgcacaccgattgcgtaacctgtaactttactggattaattgatcaaatcaaagagttttagtggagtctttaggtttttttagatattagattttatcatcagcaaaaagggacagttttacttcctcatttccaatttggatgtcttttttttttcttctcttgcctgattgctctggctaggacgtccagtactatgtttaacagaagtggtgaaagtgggcatcctagctgggcacagtggcttacacctgtaatcccagtactttgggaggctgagactggcaggtcacctgaggtcaggagttcgagactagtgtggccaacatggtgaaaccccatctctactaaaaacacaaaaattagccaggtgtggtggcaggcaactgtaatcccagctacttgggaggctgaggcaggaaaatcacttcaacccaggaggtggaggttgcagtgagctgagactgcaccattgcactccagcttgggctgcaagagtgaaactccatctcaaaaaacaaaaacaaaaacaaaaaaaaaagaaaagaaaaaaagaaaaaagtgggtatccttgtcttgttccagattttagaggaaaggctttcaacttttccccattcagtatgttgtcaactgtggttttgtcatatatggcctttacctttattaatttgagatgtgttccttctttgcctagtttgttgactgtttttcatcataaagagatgttgagttttatcaaatgcttttttctgcatttattgagacaatcatatggcttttgtccttcagtctgttgatgtgtcgtatcatgtttattgatctgcatatgttgaaccatccttgcatccctgatataaatcccacttgatctcagtgtattatctttttgatgtgctgttggatttcattgtctagtagtttgttgaggatttttatgtctatgttcatcagatatattggcttgtagttttgttgtgtccttgtctggttttgctatcagtgtgatgctggcctcatagaatgagttagggagaattccatcctctttggttttcttggaatagtttcaggaggattggtattagttcttctttttatgtttgatacaattcagctgcaaatctatctgttcctggggttttcttttttgggaaactttttattaatgatgcaattgtgctactcattattgttctattcaggttttctatttcttcctgatttagtcttggtagcttgtatgtttccaggactttatgtatttcctctaggttttacagtttgtgagcatacagttattcataatagtctctgatgatcttttgtgtttctgtggtatcagttgtaatgtccctcactttatttctgattttgagttttctctcttcttggttcgtatagctagtggtttatcaattttgtttatcttttcaaaaatccaacttttcattttgttgatcctttgtattatttcttagtttctatttcacttagttctgttctgatctttttatttctttccttctgctaatttggggcttggcttgttcttgctttttagttccttgaggtgtattgttaggttgttcatttggcatctttctacttttttgatgtaggtgtttactactataaacttcttagtacttcttttgctgtatcccgtaggttttggtatgttgtcttttcatttttatttgtttcaagaaattttttatttccttcttaatttcttcactaacacagtggttgttcaggagcatttgaacaacttcatgcatttgtacaacttccaaagttcctcttgtttattttttgttttattctattgtggtctgagaagatatttgaggtggttttaacttttaaaaaaatatgttgagcctttgttttgtggcctaacataccatctatcctggagaattttcaatgtgatgataagaatgtatgttctggctgggcgcagtggctcacgcctgtaatcccagcactttgggaggccgaggcaggtggatcacgaggtcaggagatggagaccattctggctaacaaggtgaaaccccgtctctactaaaaatagaaaaaaaaattagctgggtgtggtagcgggcgcctgtagtcccagctactcgggaggctgaggcaggagaatggcgtgaacccgggaggtggagcttgaagtgagccaagattgcgccactgcactccagcctgggcgacagagtgagactctgtcaaaaaaaaaaaaaagaaaaaagaaaaaaagaatgtatattctgcaggtgttagataaagtcatctgtaaatgtttgttagatccatttgtttaaggtcctatttcaatccaatatttctttgttgatattttggtctagatgatctgtctaatgctgagattggggtgttgaaatccccctcattcttatataggagtctatctcttcctttagatctaataatattttctttgtatatctgggtgctctggtgttgggtgtatatgtattcagaattattatatccttttactgaattgatccctttatcattttataatgaccttctttatctctttttattgtttttgacttaaaatctgttttatatgatgaaaatgcagctattcctgctcacttttggtttctgtttgcatggaataccttttccatccttttactttgtctatgtctttatatgtgaagcgagtttcttgtaggcagcacgtagttgggtcatgtattttttttatacattcaaccagtctttatcttttaagtggaaattttaatttgtttataatcaaggttattattgataagtgagtattcctgtcattttattaattgttttctggttgttttgtatgtgtcttggtcttttgtttctctcttactgtttatcattgctgtttgttggttttctatagtggcagcagtgggacagacagatggataggatcttggactcctggccagcatgtgtggcatcagcaataatagtagtggtgatgggacaacacttggactccctggcagcactcactattgttagcaaggatgggaggacagtctgcagcccccagctgggtgcatgcaggtgggtgcaggtagtggggatagtggcaggctgggtgggctcatcctcgggtctctggtaggaatgcatagatgccagcaagggtggactgggcatggtggtccctaggtgcctgcatggcatcctcggcactgtggcgagtggagggtggtgtttcagactgggtgggcctatctctaggtcccccagtggtgcacatgggcacagattgtgataggcagggcaggatgacccactgtggtgggtgcagagagcctaatgtcagagtgcatgaagcacacagtggttctgttgctgtaggatgggcggtggggagtaggcgggggggcaatggttggtgttacttggagcaactccaagccagtgggcagctttcaggctttggagaatatttgttgtggcctctggtggcagcagcagcagcagttgtatgcagggaaagcctgtcctcatggtgtgttagtgcacagcagccatgctactttggggatagaggttgctgtcaatggcagcatccccaggcaagtgggtggctttcaggccctggggagcacatgcttcaacgtctagttgtggcaggagtcacaggtgtggtggcagcagtgtgtggggagaacttgtcatcaagtcacatgctagtgtgcaatggccctgctgctggtgtgggcagggtttctgtcaacagcttcagataggcagctctcaggttttagggagcatgtgctttggctctctttgtcccaggggcagtctccctgacatgttacactgctctgtttcctggagtataggaatctgtaggggctagaatgttgggaaccctgccacactgccaggcccagctggcattgcaccactgaagctctccaggtgaatgcagctggatgtaactggggctccaggggtttggagatgcagggactaatgtcagcacagaatccagtctcttgagggctggctctcaacatggcaccatggcacagtttcttaggtctcaggggatgtctgggatccaggattagctagcaccctctgtggagcaagctgtcacatggtctcctggaagctccttacattagtgccaggttccaggaagattcagggtctctcctatggctagggttgcaggagatcatggtgggaatgtggactgctggggtcactcacttacccttcccccacattggagagtctctccaggcttccagcctatcctagccaagcaagcggcctcactttcctttccatccttttcttaggtgtttcctgtcacttctttgttgaaattcagcattctctcttaggtgttctctttgaagtgtaattatgtactattttggttcttctttgtggaggaggtgagtgtttgatacctctagtaagccatcttgaatccttcctgaatatttgcctttttaacttaaaaaaaatttcatataattaaactattgcagttgacatataaatgtaattatatatatttaattataacaatatgtattatatacattatataacaacataaaatatttgaagagcacatgatataaatacatacacatttataaattatgaatataatatgcaattgaatacatttaaataatataatttataaaatatgaatatgttgtacaatctgtaaaatattggaatataagttattataatatagcatataccaagtatacatatgataatggtatatagtattattactgtatactatacatgtattatttcgtagtattatgtaaaatgaatatgtttgaaaatataggttagaatatttcataatgcccttttactgtcatgaagtgaaatttataggtaatatgactcacctatgacctaaatttgaaaaaaaatgtaatgaatttaatataaagatgaaatataagtaatttagtttgaactaatatgtattatatgtaaaggcttgagaggtacagtagaataattaacaaaataagtatataattaacataagcagtagtagtggtagcagtaggaataggaaagccttactgagcattatctgtgtgtcagtccctgttctaagtactttcaggtgtgtgatcacctttacgtacactctcttagacgtcagttgactggaacacatctcagaagaaccttcagttaactgacatttattcccacctacaccctctcccttgtaagacaagcttttagtcactaatatctttttttcaagatacttatctatgtatataagagcctaaacttgaaataaatagtggttatctcaaggcaggggtttgatatgaggaatgaggataggactgtgtgtgctgaataaaggagacattagctatatctgcaatgttttatttctttaataaaacaaagctattgaaagtgaattggaaaaaagttagcattattaattttgaatgatgaaatcctgagaatttttaatattattcattttagttctctgttaacattgaaattttaaaaaataataaagaaaatcaccaggagactttccaagtgatcacatatgcagcttatcttcccaaccttgaaactcaccaactcagataatccattttaccggtactgggttagaacttgtctggtttagcaccttcatttctttaaggagtagaaactggctttccttaaattgggtatcttgttaatgaggcagaggtggaaagataactcagattttctgatctccagccagctctctactattttcagtaccttggcatttgggtccaggatgatgacctcaaaagcctgacatatcttcagtcaagccacaaggattttattcgcttcacaattctctacttattgggacagaaaagtggattcagatgttttagaaaagatttctgaaaatccaaaggttaatttccagctaatgtgaaaattagttaaccaaagcagttcactccactagcccttaattatgtgagttatcgcaggatgagaatttatggattcagcactgtatatccacaggttccacatccatggattcaactaagcatggatcaaaaatattaaaaacaatataacaataaaaataacccaaacaaaaatagaatataacaactatttacattgtattaggtattataaatactctagagataatttagagtatgtgaaacgatgcgtgtaggtcatatttcaaatactacaccattttatatcaaggtcttgagcattcaaagattttattatcttaatgtaggggagagggtcctgaaaccaatcccctgtggatactgagggctgactataaacctgaattcagtaagacctcctaagtttctgatctaggaggtactgaggggagatgaagagtaaaaagaaagaaagaaaaacatgagtctctgaccttgactaaagtgcaaatcaataaggtaggaaaaccaagatgccatttgacacctacttaagctcagagcatgactaggatttggttgggatatgcatggaaggtgggaaaaatggtatgaggatgaagacaggaaagagctggctgagcaaaggcccacagcataactgctttctgacaaggttggataaggtgagacagggagggaagtcagcctgtctagagcaggaagtttctcttggagagtggtagacagacacttcgatagggtagggctgatttgaaagggtgtgggtggtagactttgtgattttgactattcagcatggaatcacgagttctggagtacagttgtagcagagaaattattttgttattcctgtttgttagatgctagctaacccaattaaaaaatgagcaataactgaacaaacatttctgaaaaacacacacaaatgaccaacagatatatgaaataatgtcaccataactaattaccagagaaatccaaattaaaaccaaaatgagacatcaccttacacctattaaaatggctattaccaaaatgataaaagattgtgttggccatagtatataattttaatgtagcaaacccccacagtgtgaacatgcctccctattcagcttcctctctgatgactgtctgccatcatgctatacttcaccaacccttaactgcttacagttttgagtacacactctattcctcacctttgtacctctgctaccacagtcctcttcatctggctgaactctatctggttctttagactcagcttaatcaatatccaggagcctacgcttaccctaaaatgacttttaagaaatgcacataaaaaacttgtaaagcactgatacatagaaaaaaaattaccataaactcttaaccctaatgtgagcattataactgtttgattattttccttccagccttttaaggcctattttatttaaacaatagagattttattgtacaaaattttgcattctgttttttatttgatttgacattatcctttgagcattatcccatcattaaaaaaatatttaaatggccttataatatattccaccatgttggcttacttcaatacatctaattattcttctattaaaaaaaaacagattgtgttggcaaggttgtggaggaaagggaactcttgcacactattggtgggaatggatatttgtatacacacacacaatggaatactattcagcctttaaaaagtagaaaatcttgttatttgcttcaacatggatgaacctggaggatattatgttaagtgaaataagccaagaacagaaagacaaataccgcatgatcttacttatatgtgggatctaaaaatgttgaacttacagaagcagagactagaatggtggttacaggggtggaaagtgaggaatgggataatattggttaaagggtacaaagtttcagtcgaacagtaggaataatttcaggatatctattgcacagcataggagctatagttaatatatacctgaaaattgtgaagaaaggcgatcttaaatgttatcactacaaaaaaataattcatgtgaggtgaaggttatgttaattagcttgatttaatcattttacaatgtatacacatagaaacatcatgtcatatatcatatatatatacaattttatttgttaattagaacttaataaagacaaaaaaagaatattgaaataatccaagcaagacatgagaagcacttagatagtcttcagtgtctttaagaatagaaaggaagggaacagatttgagtaacttcagaaatggcaaggcttaatgttttatggaaagggtaggaggtggtcagtgagaagagaaagtcaagattcagggatgactccacactttttggcttggatgactgtggacatgagaggtggggcagatttggtaggggagagaagctcactgctgagcatcctggatttgaagggacagtagaaaccctgttacagggtttggtgggcagtgctactaccctgtctcccacaggcacattagcattaacatcagtgcatctgattgtcttggctagtgtctaattcccaaggagactcatcaggcctcaggaaatcagaagttgaggagctggttgtaatgcctcaccatggcttcactttcagaatgcattggaggctcattcatgggataaagatgaaaagagtgatcttgacaaagcattgcacagattctataatgagagggaaatgaaaatggttgtcagcccattattaagtgtaataactaggttgcaatgagatgaaggacttcatttaggcagatctttcccattgatgaatagtagggggtaaaagtgtgaaagggaagcatataatccaattcataaaatatgtaaactgaacagaaatttctggaaaggtatttttaaaaacttgaggcaataatcattcattgtatatatagagctggagtgggaaatctttctattgatggacaatgatgcacagatgaaattttaaaaatcagtatttttttccactgacagaactttattttaaaaaaaatgacaaaagctctgtctgtacttctaggctaggagaaaagaggcacaggtgtagcaacaggggcacaggccactcacattttagagagtttgacttgcttgtgcctgtggagtgcccatttgaggcagacggagtccactgtgctgggtataaacaggaagaaacttttcttagatgggggcatatctgagacagaaatagaaggcattcaactcccacattaaaatattaggaaaaagagcacaacattgtattcaataagtaaaatatacacaaatgttaaaataaacacaactatatttctgtttttttaagaggaattgactgaattttatttatttatttatttttgagacagagtcttgctctgttgcccaggctggagtgcagtggcacgacctctgctggtgtgcagtggtgcgatctctgctcactgcaacctctgcctcccggtcccaagcgactcgtgcctcaccctccagagtagctgggattacaggcatgccccgctaatttttgtattcttagtagagatggagtttcactgtgttggccagactcgtctcgtactcctggcctcaagtgacctgcctgtctctgcctcccaaattgctgagatcacaggtgtgagccaccgcacaggctcacacacaactatattcttaaatataatggtaggatgggataatcattcctagatacttaattttaaataaattgttatgggtcagataaagttttccaaggtctagatctgacctttggaggttacgtcaagaacatgaattattaataattaattactctgtaaacactgtgtataattcatagataaataattagcatacattaccttacggctattcttcccacaatggttattatttgggaatatgatgtccctcacctggaaatgtctactcctggagaggcatgaactctgtggaatacatatgacaatttggatagcaccaagcaaattttaatcttttactagctcatgggctgggatgaagaagagtataggaggcaggatatagaacacataatgactaagattataagttctgtgtctaacttatttgggttagagtctgaattctgccactacaacttgagtgaccttgagcaagtcacttaaactctctgagctttctttttttcttatcagtaaagtggaaataacaagagtccctccctcccaaagttgacatgagaatgaaaggagaaaaatttgtgcaaaacacctagcacagttcttggatgttctattctaagggctcaatgaaactcatagctgctgctgctgttacacttttctgtgctgggtcattcactgggtggggggatgggggtgtagcctggttccccagtttgagcaagatcgcagctgtattctcaacttttggcttctgtcacctacaatggtgcatccccataggtgtgctgtgattcttctcaagcaaccagcagttggtcaatgataaatccttagttttaaagcttatgtggggaaaacatgtaaaacaaaaacttggacagctcgccctctagtggtaattttatgaattgccccccaacaattgcccttttagctcacaggaaaactgatagtaaaaatgaatgggattaagtttacatagttgaaacacctggtttaacaaatgaatttgttaatcacaaacacataataagctagtatagggtacacatgcttgcatattttctcaagtgctgattagccattatacctaacaagggatttccaatttggggaaaaaaaaatccagaatcagcaattctatacatagttatatatcctgtcccccaataaataattgtacatagtcattagagtctagttttattgcactcaatgttctttttttctaaaataatgttataattgttgataataacaacttatcctcttacaggtatgtataaacttttcacagggttttgtttttacaacagatagatgcggcaggatttgccttcctggttgtactgaagaggaagtaggaggcttatctataaagaggccaaatgagtttgcttgggacacccagggcactttgcaggggactgcactaatttttactcctaggaatctcctcctggcaaaataaattgcatagatgctggcatgttcctttctagtctttagatgctccttctttggaatctttatgtcaaactccctaaacatacattggttgtacagatcagaatgaaaatgattaaaatagagatacgagttttatacaagtggctttcttcactccattataattgttttggagaactcagatattaaagcattttgtttgtttgtttgtttgttttgagacggagtctcactgtgatgcccaggctggagtgcaatggcacgatctcagcttgctgcaacctccgcctcccaggttcaagtgattctctgtcttggcctcccaagtagctgggactacaggcatgcgccaacatgcctggctaatttttgtatttttagtagagacaggatttcaccatattggccaggctggtcttgaactcatgacctcaggtgatctgcccacctcagcctcccagaatgctgggattacagctgtgagccactgcacccggccgatattaaagcattggtacccacaagactaaaccaagagtaataactttttgagccttatagaaatctaagtcaagggagtagtgatgagaatcttaaaaacctgcaattgttcttttaaatactgaaattgctattcataagacttgagtgaacagagaaaggataatataggaataggaggtgttttcaaatccagggacaagaatatttataatcatactcactgattgtgaaacaaagggcagacatacattcacttatactttcagtgggttcgttccgtagcaagcttcagtccaactgcagagtttcactattcaggggaagtagtgaaattcccttccttcaatgcctccattcacatttgtggctggtcagggagatacagttatcaaatcacctgtgggagaagccaagctatctagtcaacagtcttctcaggagccctgcaaggagcttgcttaaataggtaccactggaattgtgaacagtatagggctggatacctcctgtggattgcaggcttgtgcagatgagatcaagcgcaccagttggctccctctatgggctactcagttccactgcggccccaattgatcagtagcctgcacctttgtcagctgcatcacagatgtattcattcagtatttgccaaatatgtatggagagtctacatgcaaggggctctggaagtatggcatgtgattgcaaactcctgatgacagaaatctgacttgcatgcattacttttaatggcacttggcaaattcagttatatgtgacctttcatctcttcttgcccttttgtgactttctgacacctctaagctcttccctcttaacgtcagtgttcaatccctccatgttgactgatcacctgacttttcaggcctcttacctcagcctatacttcttagttgcttccctagtcccaaatctaaaaataaatgtgctacatccttttctacctccttttgtcccactcttggtttattaagaatagcaatccaataaaaattaatcataccaacttgttggaatctagtaggggtctaatactctaatttaggtttaaggctacaatgccttagctcatggaaattgatttctactgatgagagtgtagtgtgggaaaatatttggtggcacgtaggcattcatagatccgtgttatcatacctctggtccattttaatgggaaaattccctgagatctcttgaaatatgttgtaaccttacactgcaaatactaagggaaaagaataaatggggataacgtttagaaattattttctccattattgtattgctgttctctggctattgactaccttataactaaatactctgatacctaaggcaagggaacagaagaaaagagaccataaatctattaagtcaaatacatattgctcacatggcccttaaagggaaatgaattatcagtgtacgctccaggtctgcatgataaaactaattgtaatggcaattaaatgtcttacactgccattgagcatgctcgctgtgactctggagcagatacattgattaccttcagtacttaccatgtcccatcacaaataggccaaagcagactgttaacattgtaaaagtgtagaattatgcaatagatcacttagaagacttagaagagataactaaagagatttgggaagcaaattgaaatagcatttcaatttttttttctatcaagtaggtaatgatagagtttgatgctattttgcaaagccaaatttgttaattcaaaaatatttgctgtgcattttaggattaggggaaaacaaaaactgaaataatagtttaaaaaaatattcccgtggggtttattttgtttctattaaccaacttttgaaaaacaagctgtgagaaaatatttattttctaacatacttatatcattacctctcagttgttttaatgcatgcaaacagtatcacagataatttataaaaagaataatataaaatccatttaaagatgataaaacaataaatattaaagttgtatttgatccagaggtgtatcactagtaatttataatgatccagaaagttcagcaaattcaagtttccttcttttccttcttgaaagttttgcagtgacaaatgacaagtaaatgatccaatagcaaggagtgaatttaaaagactcctgagagacaaccagtgatcagtacatatttagtctaaaccactgtaccttcttagctttaacagtgtacagtgatcatcagaatccatagtgatgaatctcatacctctgaatcctcgaagaaagtttagatgcccttcactatcaatttaaagggagttatttatttgtttgtttgtttatttctaatgaatacttcacatactataagaggagttgaggcagtgtgtaataacagcccacgtgcagcaggccagtgaaagccaaagtcagagagagagatcagaaaccagagttcaaaatctttcttgggccataaaaccctttgaaaatctgaaaaaaaagggctatggaaaatttccccagaaaagtatacctgtgcaaataggcacattgttttgccaactaccttgaagcccatgcaagcatcttccccctgggtgtccttgaaccctagttcaataatccctcatatagagaaagtgaaatcctgaggtaagatagttattacacttaaacattgcatttagctctgagcttcctgtcaactgaagttaaaagattaaacacgctgggttagagttctcaacatctaaaaaaggaagcagatcagttcacaaaatcataagtgaaacatataattttaaaatggcaatgtttatacatttctctgagatgattgttttttaaagggtaatcaagaaaagtgaaaggatacagcgtattttgatgacattttttgaaaataagcaaattagaaataaaatagctatgctaattatattgaccagcatatgcgattggccacagcatttcatttttaaccgttctggaaaataaggaatttactgtacatgtctttctttaatggtagatttgcctacctaatattatttgattacagctgacagtaatataatatattcccatgagcactcggcagctaagcagaaagggaggcctaagggtataaagagaaattgacctatgattaaatatatgctattaataggtcataccatagaaaactggcatgtatataacagcaaataatcactttaggtgcctactacttccaaccagagcatttactttctcaaaggcaaataatagcacaattgttattgtcacaattataggcataggcagtatagggtagaggttaagaacacaatctggaatcagagactggtcttccaccacttattagctgtgcgaccttgggcaaagtcatttaacttcttttgtctcagtgtcttcatttgtaaaataagaagaaaagccttcatctcaggaccgcttctaggctgtgtagaggtctcttggaaatatttgttttgtggggctcctgtctatataaacaattcgagtcacctaaaaccagtatgtcagcagcatcattctagtagtccaatttcataggctaatgtgatggatagcagaagcaaacaatttgcctggctactctgctggaattaggacctggccatggtgccacaggacaaccctataggcatgagttctggagctccttgaagaatctggtccaccccaagcagaaggtggctgtagaatattggaagataccccaaaggcacaagactggagcaggggctgtgcttactaaggtctaagcaagatacaagtctatctcataggattactgggaagattgaatgaagtaatctatgtggagcacttaggacatgttggtgatgattactgctcacactattagtgtcaacaatgctcactgtatcttatacctcttctgattttctttcagtggatggctgcattgactggtcagtggatctcaagacatacatggctttggcaggtgaaccagtccgagtgaaatgtgcccttttctacagttatattcgtaccaactatagcacggcccagagcactgggctcaggcttatgtggtacaaaaacaaaggtgatttggaagagcccatcatcttttcagaggtcaggatgagcaaagaggaagattcaatatggtttcactcagctgaggcacaagacagtggattctacacttgtgttttaaggtgagtgttgtgtgaaaacattgcccaatcacatggctgatagtcttttgagtgggacttgagtacatgtaggtatgcctcatgttgtataatggatatgttcttgaaaggttgcagtacatgtggagcttcagtaaattccagttctaattatctatcagaactacatagcaaattcctattagattttcataaaataggattcccatttactgtgtgtgcttatttaatttagaaaattttgtgactcgggccgggcgcagtggctcacacctgtaatcccagcactttgggaggctgaggtgggtggatcgcctgaggtcaggagttcaagaccggcctgaccaatatggtgaaaccctgtctctactaaaaatacaaaaattagccaggcatggtggcaggtgcctgtagtcctagctcctcaggaggctgagacaggagaattgcttgaacctgggaggcagaggttgcagtgagccgagatcgcgccactgcactccagcctgggcaacagagcaagactccatctcaaaaaagaaaaaaagaaaataagaaaattttctgactcatttcttccctcactccacccctgccgcatggtcttatattaacaattagttttgcatacagctagttgactcaattatcttgatatctggccacgaaaatgatctaaaatatcattttggccatggtcttgcctttcttgttgatgaaaaatagtttcaaatgcgtctagatttctcagcaaatgtactactgctgaaatccttcatagaatttgcaatgcaaatttgagtccactgtgtctaaataatcaacatcgagctctgtaaatacacagtcatcctgagtttctgggtactatagtggaaagatatcacagacataattcttgcttgcaagaagtttacagtaaaaagcaatatgttttttcccttagggattctacagtatgttctcccttccccctctaccccagtgatagaatctaggatctagcatctagcatctcaaatagagactggattaggtattgaagtaggtagctgagacgacctttaggccacctttcaattctgcaattttgggagtctttggtcttgctcaccagggacctgcactctactatttgattttaactccttggaaatgcagacctttcctatttttgtgtcctgtgaactttgatgccaaagctatgtcacttcctcatcaaaagcacttggaagcccctggcgaggtctcattgttcaaaagcccaggagaacaaggtggtatataaatagagagccttctggatgctctaagaatcacttttatgtgtaggggaagaaaatggagtgatgggggagcaaatggtgagtttagtctctgtttgtggtaggcaagatcttcaggatcttgggagaacagcagtcattctgatcacacccttagtgttaagcggtattttctcctacttgggcagctcttggcaaaattgagaagcagatgtaattcagctttagtgactgacactatattccctagggtgctgctactctttccttgcttatctcctctccatcccacactgtcattaaaaacccaccaatcaaaattatctctcttctcctccccctgcaccatttgctttttgtttgttgttttcacaaatttaaagttttatttgcaaagcatcagtccactatgtacaagtgctaagcttacaatgaattattaaacaaattattgctacttccccaggcctgctaatgtcttcagtcttgttacctcccctcttttccattctccgctctaaccccattcctttactcctagcaataataacaacttagtgatccctacatgcatttcccctactgttttaattatacaaacatactgacatggctattttctcctcattgttttataaaatgaaaggagggttatagatttctctgcattttcttagcttagtaaaaatacatggtataaatctctccaagtcaactgatagctttttttttttacttttattttaggctcaagggtatatgtgcaggtttgttatacaggtaaactgcatgtcatgggggtttggtgtaaagattattttgtcacccaggtaataagcatagtacctgataggtagttttttgattctctccctcctcccactctccaccctcaaggaggccacagtttctgttgtttccttctttgtacctatgtgttctcattgtttagctcccacttgtaagtgagaatatgcaatatttggttttctgttccttattttactaaggataatggccatccacattggtacaaaggacattcttatttacagctgcatagtattccatggtgtatatatatgtaccacattttctttatccagtctaccgttgatgggcatttaggttaattccatgtttttgctattgtgaatagcactacgataaatacatatgtgcatgtgtctttatggtataatgatttacattcctttgggtatatacccaataatgagattgctgggttgaatggttaaatatataatattgtatgttgcttaatattttatgataacacaagtcagtcaatcatttccctattgatgagtatacactttgtttccagtattttgtccctacaaaaggcgctgtaataaaaatccactatttgcttttcaataaactttaagaagtcttcgatttacgtagttattgcaaagataatatagagttcctgtacactttatatccagctttcccattttattaacatcttacatgactatagtacatttgttacaattaatgaaccaatagtggtacattattattagctaaagtccatatattcttcacatttcttcagtttttccttaatgcctcttttctgtttcagtatccatctctggtagcgcattgtatttggttgtcatgtctccttaagcacttcttggctgcatcagttcctcagactttcctcatttttgatgaccttgacagtttgaggtgtactggtcagatagtttgtagaatggtcctcaactgagatttatctgatatttttctcatggttagactggggtaatatgttttgaggaggaagattacaaaggtagaataccatcctcatcacattgtatcaagggtataaagtatcaatatgactcataactgttgatgttgactttgatcacctggcttgaggtgatgtttataatttttcattgtaaagttactttttttttcttcctttccatactgtagtctttggaagaaagttgttattcacagtccacacttaagaagaaatatctacataaattatttcaaattcttctgcatggaaatttgtctctccctttccccacttacttatgtgttccatcatttatttgtatcagtatggactcatttttatttatattatacaccggcttgtaatgcaattctacttaattttcttgctcagattcttccacctttgcccgtgggaagctctttcagttggctcatttgtccctttgatataattctatcattgtggagtggtggttgtatttttttttttttttagcatttccttacattgtagaaagatgctccaggtttatcttatatattttgtgccccagttctagaattagccatttttccaaggagtcctgtttttttaatggataattgcattagaaacctagatttggttgctaggtatgctcattgctattggggtgttgttgcttctaagtcttctcagctaacagtctatttgcttttaaacaaagccatagattgtgaaggagtactttagggatagtggaacttcccaaggtccctgaagtcctttcctataggtggctctctctttcaagtacatttcagattggccttttttatgtctattttggataccatatgagtcagaggttctcaactcacatctagaccaatagaagataaaagaattccactaagattggaacataacttgtgactttttaacttttgtgcagcaagccttagggagctattgggactgatagagataggtggaactgttgaatattacctctcatgtgtgccttagtaaggaaaaaatgtttggaaatcactgttctaatagaatcaaccaggcttttatcaactcagagatacataaatctattccaggtatataagtgaaatagctagcatatgtctgtgaataatgaacctgtttttcatatctagtagtggccactgacttctactatgtgccaagtgagaaattccgtccatataggtgattttatgcaattgccaagagtgacatttattgtgaaaagggctcttaatttgacaatgtcagtattcacctaaaatctccagttagataccactttaaggtaattacgaatgacttttctatgttttattgatctcattaaaagttactctactgatgtcactgtgattaaaaatgaagatatgaaatatttagtaatattctccacccatgtgaatgacagcaagaaaaatttactgtttgtgacctttcagtggccacttggctaatgaataatttttaaatttttccttggccagactcaagagtgattagttgaatttcccagcataataatgggctggtaatatgagaatggtagaggattaaatcatattgtgagagacggtgccaatcgaagaatcacaccaatattttcaatggaggcatgaattaataggataaaaatgataaaggtaatcttatttgacaaaatctcacatatcattttctcaacaacttggaacaaggggtgacttaagctgtgaatgaagatagatatagtcatataatcctgcattgaattcacagatattgaaaagaatgattggccaggtgcggtggctcgtgcctataatcccagcactttgggaggctgaggcaggtggatcacatgaggccaggagttcaagcccagcctggccagtatggcgaaacccggtctctactaaaaatacaaaatttcgctgggcgtggtggtgcacatctgtaatcccagctactcgagaggctgaggtacgagaattgcttgaatcgggaggcagaggttgcagtaagccgagattgtgctactgcactccagtctgggtgacagagtgagactccgtttcacacccacacacacacacacacacacacaaaattaaatataattgaacatctgtaaaaacctaacatttagggataattatggctgagtgcagagaatcagttagaggttcaaaattattatgaccatttacctctgcaacgaggtaaacataacaaggagttcccttataaaatgggagcataatcccaatatttttggtctctaatagtcattgaaagaagtgaggttctcaaaatctgaatgcctcacaacatctttctgaacagttccttagtatatgtctagccaggaggcacaattgctttgatttcaaatgtgaataatcaattcacagttgaatgattattactccagcaaaacagcatcagaagaaaagttgagggagtggatacacttgaaacgaaaagcatagcatgttgctaatttttgaatctgtatggtgggtacatgaggattcatcatattgccctgtgtattttttatcatgtttgaaatagtccataacaaaaaaaagaagaaataaatgtaagtatacagtaattttacttgattttattgtcacttaaatgatcctggcctataaatacctaggtatcatatataagcgagtatttttatttcagtcaacaaacattcattgaatacatatcatgggactcactttatggcatattgcaagaagacctgtgtctttagaaaagaaagtgatgctctagtctacatcagacacaaagaaatggctcttagcaccttccactctcctaccctacttcccatcgcggttacctagagattttcaaggacagtgaacatatctcataattcaattccaacttaactattgatccgtgaaaagttaagtgtcaacaagtcggttacccaggtagcaatttccaggagagcaggtagtttcttgtcagaaaaatgaaagcctggatcttatagaattaattgacctcagaaaagatcaagaaagtgtagcaggatcttgagacagcaggaatttcattcccgaaatgaaatgtaattagttatttttctatctgtttttggttataagcaggggtctctgattccattatttttatggcaatttgataatctacttgttaataaaattatataggaaaatttttacatagcaaagaagtaaccattttactttattttcatttcattagcattaaattagatatgttgtaatgtttagaaatataaccatactattgtacattaactatgtaatttcaacttcattcagtttgtttactggaaggaagcagatgcttacagtttagtcagcaggagtacctgctttgtaagaattaataggttatatttgataaccacaaaagaagaattgatctcaaatagtcactgatgagttggttaacactgttatttatatatactttttagtttaatcccttgtataattacacaatcttaagtgacttggttttatggctatcttgctcagaatcaaggttttaacctaatgcagggttgtaaactcaaaatcttttcagaggtcaagaaggtaatgtaatgagtgtggcaggccacctgaaacattttggagtgttggaagttgtagcaatcccctccataatctcatttcatgcattctactctattgccactacctcctatttttctagctcatttttttctataccttacctccaataatctattgattccacccaaccatctttctcattgatctcacatgttttccactgtaccttgttctcttcccatctagcatagttccaattcagtggatcaatcattataatcactcccatatacaccctcttgattctcttaaccctttctcccttcatcttactcgcttgtgaaaaccacaacactgtttaaacctaactgtccatctatactatgcctgcatccttgcagctaaacttggctgaaggaaaatatataataatgttgactggtttcacattaaattcattgtcatggacctcaaattgacctttaatgctaccaggtagttttattttatattcttagaccattcagtctcccatctgcctagatgactattttatatcatctccactcctcagatctccaatatctcctcccccttgcttccagtttcacagagaaaaaaaatgtagtcaggaaaaaaacttccactacatctgcccacctactggcatctatacctacatattctgccttccagcctgttaccacagatgaactggccttgcttctatgtaaggcaagtcacttcatgtgtacaccagattctatccctatttgcttacccaagaacatcacctgagcaattctcctctctctctcccatatcatgaaattttctatttctactggatcatttccatcagcatgtatacagatcagtatttatgccatctaaaaaaaatcctctctactccactttcctgacagccactattcccggtttcttgctcccatttggaaaaagctactttaaagaattatctggttatggtatcatggttgtttatataagtccaaacccttcaaactgtacccattaaatatatgcagttatttgtgtatcaattatatctcaataaaactatttataaaaaaaagtgttgtctgcattcagttttgagttcctctccacttattctctagtaaacccattccaatcaaaattttaccttcaaactcttccaaacctgctcttataaaagtgtccaatgaccacaacaatactaaatccaatgggcatgccagttttcagttctcctattacttgacctgtaatgtcatgtggcatagttgatcactcccttctttttgataatgcattctttacctgacttccagagaatagtactctcttggctttcctcatactctatcagttactctttcataagttcttttcctggctcctggtattctttctgaccccttaatgttagaaggcactagggatataggcccaacattgccagtttttctgatgttttgaaagctgaataattgtgtgaaatttctcaatttttaaatttatgggatcctcctgcccaaaaaagcccatactcagattcaaccattgaactcagttctcatactctaaactaataggttctgactccaacattaacctagagagcgatggtatagtcatcttaaagtaggactgcagcaggttttatctgtatcaaagtgaagcaggaaaatcaacactccaatggcaagatagattaaaggaaacccgccactctccctagagtacatttgagcattcagtagtagagtcatatggtgtccctttatgtggcaactggcccaattccagcttaatcccttgtgtggctattggagtcttcaaaaaatgcactgatcagtataggggtccttattgctagctacggtgtactgaaataggtattctatcaagaggattctattgctataaagtgctgcttctcctccaccttccttcctgtcaatgatcaaacagcaactctttaaaagggcagaggactgaagatgtgcaataactctagtcccaggcatgaaaagtaacttcagtgaaaatatccattcaatgcttatatggactaatattgtgcctatcactatggcgaacccaagagaaaattatgacacagcatctgccttttagcagttactaaaggaggaattactaagagttactgaactagctaggactcttctatacctaacactgtggtgcaatcttctatattactattaatactactgtgtcctattaggagtatggtctctggagctggactgcttggagtcaaatctcagttttattacttacgaattgtgtgaccttgagcaatttatatgactactcaggttcaaccaggggactcacagtttgcaaactctgaactattggttctgactccaacattagcctagggagtgatggtatattatggctgtgtgacctttgccttgcttttcctcacatggaaaataaagacccatttggttattcaacttaaaatattttgaacacttgaattaggtgttgagtaaatgcattgaatgagagattaaagtaatggagcttccattctagagttgggaaaacatataaataatgcaatcacaagactacactgggtaatcgtaattctacagtggtgagagtgaagaagggtcatgttaggggagtgactgactgagaggccactttcagttaggtgatcaagaagggcttcacagagaaagtgacatacaaactgagacctgaatgacaagaaggagccagtcttgtgaaaatcttggggcagagtattccagtcaaagtgaatgccatgtgtaaaggtcatgaaatgggaacaggcttgattcgagaaagctaaagaaagggctgggtgcagtggctcacacctgtaatcccggcactttgggaggctgagacgggcagatcacctgaggtcagaagttcgagaccagcctggccaacgtggtgtaacccctgtctctactaaaactacaaaaattagccaggtgtggtagtgcacgcctacaatcccagctacttgggaagctgaagcaagagaatcgctggaacctgggaggtggaggttgcagtgagctgagactgcgccacggcactccagcctcggcgacagagcaagactctgttaaaaaaaaaaaaaaaaaaaaaaaaaaaaaaaaaaaaaagtgctaaagaagggcagtttggttggagtgtggtgagctggggaataatgctactagataaggctggaaaagcaggcagagaacagaggacagatgctgttgcatattgtggaccagaataaaaagttgatttttaaattagtaatcagagataaaatgagtatttatttttgttaaactggagagtaacatgatccaatttccatttaaaaaatgattactttggttgcctggcgagaatggactacagggggagaagcaagaagaccaagttgagaagcaattgtattagttgaggagagatgtgatggtagcttggattgtggtggtagctataaaaatagggagacatgaatgaatcccagatatatattgaaggatgagctgataggacgtactgatgtcctggatgtgagaaaaagctgaataaaggatgactcctgttgcttttgactgaagcaactgtgtgaatcatggtgctattaactgagagagaagacctggagatgaacaaagatcatagtacctacctcagagaatgttgatgagcacttatcaccaatactgacatagagtaagcactccatacattatctcttatttctacttttactaccaccaccactgctactactagctataattttttagcttttattatatgaaagtattgtgctaatccttagaataattcaggaggtaggtcatattattgaagatgataaaactgatacttagagaagtgaagaacttgcccaaggacacatgggtagtaaatgatggagctgggatttggaaaggtttgactccagagctcatacacattatcagttttctctactgtcttctcaattattatctgttttcactgttctttatagtaatctgtatttgtatattacaacaaatgagatatggttatttacattaattcttgcctatataaagttctgtgcttctgtgtgtttttagtttcatcagtgaacattattgtctggtgatgaggatagaattttattgattaaagatggataatagaaggcaatgaaatagagattccaagttcatgaaaagtgatgattaagttaaagcaagaattttcagagaactagtcttcttgttttaccaagtttaaaatcctttgtgatcacttttcagtttacatatgcagaagtgcttaaaagttgttttccaccaaagaatagagatgaattttgaagcatatatatccttaaatggctctttttgtctgtttactctgacttcaaaacctctaatatataagactcgtgatgaatcaattagagaaacatatacatcagtatatgacaaagtgctagaatgaatataatcaggtgtcataaatgtatggttatctttttcaaaaactcattgcatgacactacttccctccattcaccttaaagttgaaaatgttcatggtggaacacaaatgagatctcattccttcctaactacagttttgttttgtttttgtttgtttttaataaaagcgatgtttttcagccaatatccttttaggtctcaggtatttattattcattaaacaaatatttattgagtacctcctgtacagagggtactaaaaaaaaagcaaaagtgaatgatagggctcctgacttataacaaattaaaaggggaattaggacatgtatacaaatcacaatcaaacaagcataactcccatgtggttcatcattaaattgtatcctagaaaacatagtctagcaactaaacatattttttaaagtctgaggatagatttaacgtagtcccttgaaaaatatcaaaggtaagcccatttgtaacccacagcaacaaaaatcattgtttgacattactatcactcctagtatctcttgtatgtttcagctgcccagaaacctctctcattgctcctcttgttacctgctaaaaaactcttcctggaatgcatcccctataagtttcttctctttttgccctttctcatcctctagcacttttttcctttcaagaagctcttttttgccctttccaatgtaatttaattaaactagcagtgcttcttgcaattcttcagctctttctgcccattactcctattctgcacaataaaatctcaggaactaacctgccataccaaggatctttgtaaaagttgttgcatttaaaaagaccaatgcagtgaaaaagagaattatgtttagaaggcaagaagaagggaaaagctgcaaacacttaacttgatggcttttattccatcatacatgagggaaagtgatacgtgctataggaaagataaagtaatagtacagtaaaaagtaggaaaaatagcttttgtcttatagaatcgtgcttgcttcagatggctcttgaggatctaaacaggtggtgatagtagaggtcttcccaggcagataaaacaatgtcccagggcaaggaggtagtaaaacatgggccatgcacagggaaaaacagggaggtaaatttggtcggaacctggatttatcgaggcgtttttttctgagtatgaacctaacaataatacttgctttatgaaggtttcagatgtttttgaaacatgagattttagacattgagcaattcttagaaaagaagctaaaagactcaactaatgagcaccttaacttgcagtcaggtaataaggcacgttttttgcagatgatgtttccacagagaaaatgtatatttaaaggaggcaaattcccttctatgacctgaccttcattaaagaaaggcagtgctgctgactaaagcgttgttagtcttagcatgtactccaaccagttttctcacaggtgttgataaattcacatggaaccatccccactctctcaccacaccgaagagtgatccaccttggtaggatggctcattaatattcgatgggtatagtctgtatctataaatatgagacagagaaaagctaagtgagaggggtaatgtatatttccaccttggggccttgatcacattcaagcaagacccaagccaatacaaatctacacactcgtttccagaccagatctcactcttcaacactaaggcaatatacacttacctgagtatagagatatagtatatacatttttaattttttattcctgttaccctgatcccatcagtgccttccctttacttcctacaaggaaagtggcttgaccatgtttcatatttacattattatcttttactcttgagcaagagatctctcctccttttaagctcaatctaaagcttgccacttaagcaccatgcacactgtccacacacagggcagcctttccatacatactgattgttgacttattggctgaaaccctcagatcagtagggtccagacgttttcattttgctcacatgaatctttttttagtatattgttttaccaatagaaatagatgacaggaaggcaattttacgaggtgacagtccaaataataatattggcaacgccagtattttacagcagggtacaaagtcacagaaaattctgatttttaagcatttagggaagcttctatattaggtaatgtcactatatacacactctgctcaaattttgactttgatcccacatgacatgaaacaaagataaaaaaaatcactgctgtttctaaataaaatatagtttaattttactttccattattttagagacaggtatagccaagtttgacttcctggcatgtggatgggtgatcagaaaaaaagaggtcaatgaaggcttccctggtttttgcctttcaccacttcacttgttgttatctcaaatggcaagcccagagaggaccattacagcttttctagaggtaaaactcactgtttttgaccaaggcattggtccccatgaaatatccatccccttccctcacccatcagagctgggcctttctcccagcagcattgtttttaaagctgtcttcctctgtaactgcccatctcactaagcatgcttactcaagggctcaaaggtcaggtcagattgcttctgctgggtttgtagaggatattcagtgatggaagtagaattaatttttatgtattaaaacctttcctctggacttacagagaaaaaaactttaataggcataacacaggaaatcatgaaaatgttaatatctttccataatcctgccaaatataaaacccaaatccaagcaaactgatttaatgttttactgaaaaaaaaagttatgaaaacaatttgtacgaccagagagataagtgtctggttcccttcctggaattattcaccttcctttctagtgccccctcctagggtcccactgctctcccctttgattttctttcagttgggccctaccccaatcgtgttttttatgcagcttgatgatcctttcctccccctcctccagtctccaccccatcccctaagttattcctaaaggtaccactgtcccaccaccaccctgaccttataggtccttactaaccctcaggtgccttgtctaacagacacaaaggcaggaaaccccttgggttcccacccccttaccacacagtgtctgctctccttttcccttctgttccagaggaagaagtggcctttccaaacccatccacctagtaaattaacttctttatattgttttgtatttctgtgaacatttaattactttactgtcacaaaacacaagaatataaagaagtaaaggccctctatctcatgccccctactctacctcactccaccctataccctaatgtcccactgcctaccatcatttgacccctgagcctaccctccctaggttactcataatgattttgccctctagtggacattcggcaatatctggagagatttttcgttgtcacaatttgggtggggtgggaaatgtacactactactgggcatccagttagttgaggctagggattttgctaaacaacctacaatgcacaggatggcccccagaaataaaaaagcatatggccccaaatgtcaagcatgccaatattgggaaaccctgccctagaaggatatagacaagcccgagaacatttttgacgagtacaaactctttaataactagttagggaactggccccaagtcctgaatgactgtcatagattcaacaggaaacaaactaatgtcacatctagctgctgcagagatgtcccagggccatgacagcttcttagtcactaggtccacatgccccaggtgatgtccaaggctcctccatttgtgtctcaatctggttcaggtctaactcctctccatccttccacctgttagctaaaacatacatgtacccccgatcaacacagcttacagtcatcaaagggatagaaggagaccaacctgccacccaccttttgaccccacccactcctatcctcccccacctcacccctccctctgaaagttgatttcccactgggatatgtttctgttctgtttcacatttctaaattcactaagagctttgtagctagattttcctcctacatttatcatggtggtgggttggaagagaaattccctcaggatgatggcatcgtgcttttgcccatggtctaaaccaggaaaccctctgagcactatcagttgctgactcacctccttggcagtggcaggagttctctgttcaaatctgactgtccctggttctgctcacttgggattgaggaggattctgctgtcatgagagctgtagagtcatagcagtcctcgcctggagctggtgctggcatcctctgtatgtagccctgaaggattccctcaggagtagcaaagcactgccatgtcgatttgagtcaatcataaacctggggttaaccccaggcctgttttgattgtttgtcatgatataactcactcagatcatgaatgaactttctatccagttcattcctagagactcctggaatgcaggaatctccactactcaccataccctgatgcaactccccagctggttcgaacatattatttgatggtctcttatttgcaactgctctcctggtaccaatttctgacataaaaataatctgatggggaggcaccaagatgaccgaataggaacagctctggtccacagctcccagcgagaacaatgaagaaggcaggtgatttctgcatttctaactgaggtccccaattcatctcaacaggactggttaggcagtgggtccaacccatggagggtgagcagaggcagggtgaggcgtcacttcacccaggaagtgcaagaggccaggatctcactcgccaagccaagggaagctgtgagggacaatgctacccagctgggttactacgcttttcccacagtttttgtaatctgcagatcaggagatttcccttgtgtgcctacaccaccagagccctgggtttcaagcacaaaactgggcagctgtttgggcagacactgagctagctgcaggagtattttttcaaaccccagtggcacctggaacccaagcaagacagaaccgctcactcccctggaaagggggctgaagccagggagccaagtggtctcgctcagcaggtcccactcccacagagcccagcaagctaagaaccactggcttgaaattctcactgccagcacagcagtctgaagtcaacctgggatggtcaagctttgttggcggagtggtgttcgctgttactgaggctttagtaggcagttttcccctgacagtgctaaggaggctgggaggtatggactgggtgaattcaccacagtgtggcaaagcggctgtggccaggctgcttctctagattcctactcactgggcagggcatctctgagggaaaagtaaaagcccctgtcagggacttacagacaaaacccccatctccctgggacagagcacctcagggaaagggcggctgtgagtgcagcttcagtggacttaattgttcctgcctgcctgctctgaagagagcagctgatcctgacaagagggactctcccagcacagcacactagctctgctaaggaacagactgcctcttcaagtgggtcccggacccccatgccttctgactgggagaaacctcctaacaagggttgacagacacctcatacaggagagctccagctggcatcaggttggtacccttctgggatgaagcctccagaggaaggagcaggcagcaatttttgctgtcctgcagcctccactggtgatacccaggtgaaaagggtctggagtggacctccagcaaactgcagcagacctgcagaagagggacgtgactgttagaagaaaaactaacaaacagaaaccaacaacatcaacatcagtatcaaggagccccacacaaacaccccatccaaaagttatcaacctcaaagattaaacgtggataaatccacagagatgaggaaaaatcagtgcaaaaatgctgaaaattccaaaagccagaattcctcttctccaagtgattgccactcctctccagcaagggcacaaaactggatggagaatgagattgacaaattgacagaagcaggcttcaggaggtgggtaataacaaactcctctgagcaaaaggagcatgttctaacccaatgcaaataagctaagaacctgataaaaggttacagaaactgctaactagaataaccagtttagagaggaacataaatgacctgatggagctgaaaaacacagcacaagaactttgtgaagcatacacaagtatcaatagccaaactgatcaagcagaagaaaggatatgagagattgaacatcaacttactgaaataaggcatgaagacaagattagagaaaaaagaataaaaaggaatgaacaaagcctccaacaaatatgggactatgtgaaaagaccaaacctatgattgattggtgtacctgaaagtgacggggagaatggaaccaagttggaaaacacacttcaggacattatccaggagaacttccccaacctagcaagacaggccaacattcaagttcaggaaatatagagaacaccactaagatactcttcgagaagagtaaccacaagacacataatcgtcagattctccaaggttgaaacggaaaaaatattaagggcagccagagagaaaggtcaggttacctacaaagggaagcccatcagactaacagcagatctctctgcagaaaccctacaagccagaagagagtgggggccaatattcaacattcttaaagaaaagaattttcaacccagaatttcatatccagccaagctaagattcataagcaaaggagaaataaaatcctttatagacaagcaaatgctgagggattttgtcaccaccaggccctgccttacaagagatcctgaaggaagtactaaatatggaaaggaaaaaccggtaccagccactgcaaaaacacaccaaaatataaagacctctatgaataaactgcatcaactaatgtgcaaaataaccggccagcatcatgatgacaggatcaaattcacacataacaatactaaacttaaatgtaaatgggctaaatgccccaattaaaagacatagactggcaaactagataaaaagtcaagacccatcagtatgctgtattcaggaggcccatctcatgtgcaaagacacacataggctcaaaataaagggatggaggaatatttactaagcaaatggaaagcaaaaagaagcaagggttgcaatcctagtctctgataaaacagagtttaaaccaacaaagataaaaaaaaaaaagacaaagaagggcattacataatggtaaatggatcaatgcaacaagaagagctaactatcctaaatatatatgcacccaatataggagcacacagattcatgaaacaagttcttaaagacctgcaaagagacttagacttccacacagtaatagtgggagacattaacaccccactatcaatattagacagatcaatgagacagaaaattaacaaagatattcaggaactgaactcagctctgaaccaaatggacctaatagacatctacagaactgtccacctcaaatcaacagaatatacattcttctcagtgccacatagcacgtactctaaaattgaccacataattgctagtacaacactccctagcaaatgcaaaagaatggaaatcataacagtctctcggaccacagtgcaatcaaattagagctcaaggttaagaaactcactcaaaaccgcacaactacatggaaattgaacaatcttctcctgggtaaataacgaaattatggcagaaatgaagaagttctttgaaaccaatgagaacaaagagacaatgtaccagaatctctgggacacagctgaagcagtgttaagagggaaatgtatagcactaaatgctcacaacagaaagctggaaagatctgaaatcaacacactaacatcacaattaaaagaactagagaagcaagagcaaacaaattcaaaagctagcagaagacaagaaataactaagatcagagcagaactgaaggagatagagacacaaaaaacccttcaaagaatcaatgaatccaggagctgattttttgaaacgattaacaaaacagatggaccactagctggactaatgaagaagaaaagagaagaatcaagtagacacaataaaaaatgatacaggggatattaccactgaaaccacagaaatgcaaactaccaacagagaatactataaacacctctacgcaaataaactagaaaatctagaagaaatggataaattcctggacacatacaccctcccaagactaaaccaggaagaagtcgaatccctgaatagaccaataacaagttctgaaattgaggcagtaattaatagtctaccaaccaaaaaaagcccaggaccagacggattcacagccgaattctaccagaggtacaaagaggagctggtaccatttcttctgcaactattccaatgaatagaaaaagagggaatcctctctaactcattttatgagggcagcatcatcctgataccaaaacctggcagagacacaacaaaaagagaaaatttcaggccaatatccccgaagaacatcgatgtgaaaatcctcaagaaaatactggcaaacaaaatccagcagcacatcaaaaagcttatccaccacggatcaagtcagctttatccctgggatgcaagcctggttcaacatatgcaaatcaataaatgtaatccatcacataaacagaaccaatgacaaaaaccacatgattatcttaatatacacagaaaagtccttcaataaaattcaacacccctttatgataaaaactctcaataaactaggtggtgatggaacatatctcaaaataataagagctatttatgacaaacccataaccaatatcatactgaatgggcaaaagctggaagcattccctttgaaaactcacataagacaaggatgccctctcaccactcctattcaacacagtgttggaagttctggccagggcaatcaagcaagagaaagaaatgaagcgcattctaataggaagagaggaagtcaaattgtctctgtttgcagacgacatgattgtacatttagaaaaccccatcgtctcagcccaaaaaccccttaagctgataagcaacttcagcaaagtctcaggatacaaaagcaatgtgcaaaaatcacaagcgttcctatacaccaacaatagtcaagcagagagccaaatcatgagtgaactcccattcacaatgactacaaagagaataaaatacctaggaatacaacttacaaggggcgtcttcaaggagatctacaaaccactgctcaagagaataagagaagacacaaatggaaaaacattccatgctcatggataggaagaattaatattgtgaaagtggccatactgcccaaagtaatttatagattcagtgctattcccatcaagctaccagttactttcttcactgaattagaaaaaaaaaaactactttaaatttcatatggaaccaaaaaagggcccgcatagccaagacaatcctaagcaaaaagaacaaaactggaggcatcacactacctgacctcaaactatactacaaggctacagtaacaaaaacagcatggtactggtacctaaacagatatatagaccaatggaatggaacagagacctcagaaataacaccacacatctacaaccatctgatcttcgacaaacctcacaaaaacaagcaatggagaaagaattccctatttaataaatggtgctgggaaaactggatagccatatgcagaaaactgaaactggatcccttccttacaccttatacaaaaattaattcaagatggattaaagacttaaatgttagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaatctactcatctgacaaagggctaatatccagaatctacaatgaactccaacaaatttacaagaaaaaaacaaacaaccccatcaaaaagtgggtgaaggacatgaacagacacttctcaaaagaagacatttatgcagccaacacatgaaaaaatgctcatcatcactggccatcagggaaatgcaaatcaaaaccacaatgagataccacctcacaccagttagaatggcgatcattaaaaagtcaggaaacaacaggtgctggagaggatgtggagaaacaggaacacttttacactgttggtgggactgtaaactagttcaaccattgtggaagtcagtgtggcgattcctcagggatgtagaactagaaataccatttgacccaaccatcccattactgggtatatacccaaaggattataaaacatgctgccacaaagacacatgcacacatatgtttattgcggcactattcacaatagcaaagacttggaaccaacccaaatgtccaacaatgatagactggattaagaaaatgtggcacatatacaccatggaatactatgcagccataaaaagaatgagttcatgttctttgcagggacatggatgaagctggaagccatcattctcagcaaatacaggaacagaaaaccaaacactgcatattctcactcataagtgtgaggtgaaaaatgagaacacatggacatagggaggaggacatcacacactggggcctgtcaggggatggggtgtgaggagagggagagcattacgacaaatatctaacacatgcggagcttaaaacctagatgaagggttgataggtacagcaaaccaccatggcacgtgtatacctatgtaacaaacctacacgttctgcacatgtatcccagaacttaaaaaaaaaatctgtccacccactcaagttagctaaagaaaagaggttctgtgtaaaggggattttcatgtagcacaactgtaggaagtgaaaagtggttgtgctgctgctctctccatctctctggagtcacaggatgattcctctgtgcctgtctgctccctggaaccacgtactagtgactcccaaagacacttgcctctggaaagcacccagttctattcctccacagccagggccaagcctcagcagtggcctcagcaaccatggctccggtcctggccccaactccaagtggcctacagcttcattgctcaacatcatggaatcggcctctctgttcagagtgtctagcatgaaaaatccatttggctctggatgggccaaatatccactcctgctccaatcatctaaggcctagatgcgagtagagggtggggtgttatacacatggttgcctcttttaccagacactagggcagggagagagcgagcgagacatacacaaataaaagctgcagcacttctggggtattgagtgcaagtgctctggaatacaaagggggtcaccaaaacatgtctgtctccatgtgtctctctctccccaccccaatctatacctcccctggccaccaccccacttctacacctctttcacaacccctactttcctccccctcctccagtcaccacccctatctctgaagttattcgtaaaggtaccattgtctcacctccttcccccactcttcccagccttcttcccctaccaccccggcccccgccaccacaagcctgccctctgaaaattaattcgccatcgagatatacatgcttcggttctattttgcatttctgcactcaatgaggtttttgcagccagattcccttcccacagtcgaagcaagtatccctccgtgaaaaattcacagcgttacaccaagggcagtcccagtcccctggcctgcgatatactggaggtctttgctgatgaggttcggagtatctcctgtctcttgggtgctcctgatggtctattctgtggggccccccatcagaccacaggctagtatcaaaggcctcccagtcggaaggcagctgaggcggaactggtgctgtgactgttgcttgtggaggggatatagtgggtatgtctgagaaggaggaaaaagggcttgagtatgagtatgagtatgaggcagggagctggacaggaagaggttctgatgaggctctggaccaggggttcgtggttccagagaaataagatgtggctgtttcgaccgaccggagatctccctccttctgcccccaataggtgtacttttcctgatcagcatctccaaggagctgcaggaggattctctccagcttctctgtggtctccatggaggcagccctggcctccacgtgggggaactgggtctccatgggggcagccccagcctccacagggggagccatggcctccacaggggcagccacaacctccaacatcccctctgctcttcttctgctccttttcctccagcagcaccagcagcagccaccgccgcctcttcttcctcctcagctgctccttctgtgcaaacccctccggcagtggccaggcctggccaccctgccccctgctcccactcatggggagacaccagctcctggagagaagtgggcagggctgaggtgtgttctgggggcaaggcgggagcactaagcagggtaggacggagctaccaggtgggaagggcggggcagggcgaagccatggagcagggtggagaggggtgggaatggggcagggcagtggtactgggcagggaccagttgagggatcttactgcatggagcggcttccaactcaccttgtctctctctttctgcacctccacgaggctggtctgggccattcttagccgggaggccgcctccttgcgttccgtctcctgctgctccctgagcttcttcaggtctgatgccaaggcctgtgcggctgatttgtgcagtttggcgaagccgtgcagccaccgcaccctgtgcctttgtagctgtgcctgcctgtgggcaaagcgcactcccaaggccaggctgccccaggtgcaggcctctttgacctcactgggcacctcgctgtcctccagtatggccctcagcttgtcttccaccttctcccaggataaggatatattctcaagatagaactcggggcctttcgtgtgcctggccattttctcgttgatgaaggccaccacgttgctatgccggaacccgctactggggtcctcaggtctcaaggccatgatcgcctaggggtttaacggtttcactagccctgtgtggatggagcagccaataggttcctttcctcccccttagcccctcccctcatccatcttctcccgccctcttgtccccgccctacccgctctgacaagaccgtcctaatgaccccctgaccggcttgtcctaccctaggacacctcccaccaggcctcacctcttcagccagggccagaggaagtacaggccaaccccgctgtcttaacacgcccgaagagagaggaagatctctctccctcctaaggttccagggaaaggaagactcagggccaacgtcggcttttactctgggactgttccaatttccagagataccaggagtggaagggagtgagtgaggaaggcccctgccactccattgggatttaagggaacctgtcacatggttgggagcccttaaaggtcggaagaaacaggagtggtcagaaaagacttagaaccaagaaaattaagcccttataatcaagtcaaaaaagtcccatgtatccctccctcttgacaatggtttgtcccatgccaacggctagtagggacccccctagaggttgaagggggaataatgggtatgttctagaacacgaaaaagcccccaacccatgaaaattctgcagttcattttccagactcctaaatcctagtatacaggttagtgacctttttctgaaacgggcaagatagcaggcatttgaggctttgtgggcaaaagattatcccaactacttgtagcacaaaagcagccataaataatacctgaagaaatgaccatggccatgttctaataaaagttcatttataaaaccaggcagttggcatgatttggcctgtagatgtcaaactcccaatctagattcacatttcatacatgtcctacagacacatacaatcagaatgttcatgatatgactcccccttttccctgttaaaagaaaaacgttagacaacgttaacagtttgtttacacataaacaacaaccaaaaaaaaaaaaaaagaaaaacgagtcatgaatttgtcagtactcagaaccagaagagtttcagagagctattcccagcaacatgagaagtgaatttttataggctgagtttggacacaaaagagaaaaatcacctgattggctacagcaaggcatttgccttatttggacatggtcttgtcacttgactgcctgtaattagctggagcctggctagttgtgtttggctgaaattaggctgtcttttatacagcttatgttaagtttcagtctgtttacatgctaagttagtttgcggtttgttagataggaactcaaagtatggaaacagcttcaaactaatggcctcttgcttattttaatatatgcaggagatgattcccctcctaaattcctatgttgtccaatacagaaacctcaaaatcaaatttttaagttacctacccttcataccgacccttaaaaacaagtcaactaagagacaaaatcttgttgctgtgacctcagaaacttctaagacatccatgcccacttagggaatgtccatgtttcttctcaaataatcttcctgtctttaatttcttcataatccctaatcacttcctaatctttcctatgatcatgtttctcttaagcttaaaatcatttgatggatccttgtggcacactccttgtcctgacattagaatctcaccccaggataccattctaatttaactctctccacaatgttatccaccatcatttatgtacctaagggactaagccatacagggatacactgattttggcgttttaagttattttcccttctgaaaaatcagagcattcattttttattatatgggcattatgttctattctatgaactacatttaaaaagacaatatttcttctctaagggtcctatgtcagataattagagaggaaaaagacaataaatcaagcattaaaatattacctaagaaggtagttaaaccccagaggcataaagtcccaccatttaaatgctgtttttagatgctgttttgtgatttctttccttctcagcttgtatattttatttatcagccatcagtggaaagggttcatgttttggcttattctagagtgacttctacagaaagagcatccagaagataatgtagaaaagagaatggtgaggaaagggggagagactggagtcaggaagacccattagggagatgctaaagcaattcaagaagtaaactaaagcagtggaaatagggatggagagaagagtgtagagagccatttggtagatagaatgcatagggatgtcagggacaaggatgagggaatgctgaggataatgcccaggtttctggtataggggactaagtagatagccctgttattgactagttggagaatgaagaagaattttttgggatgagttcacctttagacatattaacattaaaatacctgttggggccatgtgtggtggctcacacctgtaatcctagcactttgggaggctgtggtgggtggatcacctgaggtcagtagatggagaccagcctagcaaacatggcaaaatcctgtgtctactaaaaatacaaaaattagctgggcgtaatggcgcacgcctgtagtcccagctacttgggaggctgaggcacaagaatagcttgtacctgggaggcagaggttgcagtgagccgagatcatgccactgcactccagcctgggcaacagagtgagattcagtctcaaaaaaaaaaaaaaaatacctgttgggcatcctggtggagatacttagtaggcagtttgatatatgagtctagaacttaggagagacatcagagctgaagatgtagtattgagaggtgaaagctgtatttacagcagcggttgaaataactcagggacagaatatggagcaagaagagtagagggctgaggacagcaccgtggcctgccttcatggatctcctcctttctacagctgtgtgctaccattggtgattttatagttgtcccccttactcctttgtgttcttgtctactaagttcagaacatcttttaccttatctcttttattccctctataatactttaaacatgaacttcagtttgtgattagttgtctctttatactgccattctcccacttccgcttataaacacttttaagaaattaaaagtaaattgtttcttttagcagcctggaggagggagaaagtgaagacagagaaacctgttaagaggttccttcaacagtgcagacaaaacatgattagggcttgaactgtggcaggacctcgatgagatgtcagataacaagagatttttgacatacagttagcatgacttgttaaccaattgtattaatatatgagaaataaatatgggtgttggagcggaaaatgattttgaggcatttgacttgagaaactaggttttgtgacaagtgatgcctcaaatcgtaatagatatgaggaaaaatagactatagagaggagataataaatgcagttttggattgacaaatgcctttgtgatagttatattgaattatagttgaatggctgtactgggctggaagttaggtgagaggacaaaactagagatatgtattataaatttgggtgttttcagtgctcagtttgtggctaagaccttgtgcttcaataaaattgctggagatgaaggttggaaggagagaataagcaggacaaaaaaacagaggaaggaatcccgaggtcttggaaagggtagcagatacctttagggataggataagggagaacaagcagtaggagtagtcagagaagtagacaatcaaaaaagggagatattttagacctaaggagaaatttggaaggtaaaaagagtgttattagtttcatataatgcacagaggttacataggatgagggtgaacaaaaggtcattagatttagctaataagatatccttagtgattcaagtgacgagaatcaatagaatggtgaggcaggtgccagatgataggagatcacagaatgaaattagaggaataagtagaaattttgaatactgactagtctttcaagatctctgacacagtagagaattctaccaccaggagtcagaaaatagatcatggaagcataggatatgacagcttatttggtgagacaactaagttatacaattttcaacacaaagacggggaaaataatctgatatttactgtatgaagaaaggtaatcatatgtaaagaaaactctgtgttttgcattgtgacccaggaaataaggccaaacctttgtgaattctatgatagtaactatgaaataacatattgacagatgcaaaaatatcagtgtaatctgatatttacagagaaagagtgaggaagtgagaaatagttattagagtcagtgaaattggttggggaaggatttctggaggagagttatgttcttgttcttaatagaaacatcagggttctccaaagatttatgaagacctttctgtttgtagcatgatgtgtctcagattaccattcttaaaattgtcttcatccaaacaagaaagcaggaatcactcatactatgatgtggacaatggtggtgtcagggaacctttcaaatttaccttcgttattaccttacctttatccacatcctcaatcattggtagtcagattttgaacaagctgcctgtacccttaggtggcatattgcaactgcctttcccttaggaatggtgacatgagctcaccactagaatgatccacaattcttagttatatgtaaatggattgctacatatatatgtactgtatacttttttcttgagtaggtttctaactttaatgtacagcctccaaataaattatagtttgctttgaattcaaggtgaagaatattttgatgacaaaaattttattttgagtgagtagtttttaaaatatacataatgtttactataaccttgtccacaagctacttttttaaaaaacaattacaagaagaagaaaacaaaacatctttgattcactttatgggttgggttgggaatcggtagatagcatgataatagtggtgataatgttaaaggaaattagtttttattgagtacttagtatatgccaggcactgtgctatgagctttaaatgaactatctcattgttaggagagaattctccatggggcttttgcattttttacatgtctgtgagcagagtatcctttgccctggattatcttttcaaaggtgtatgtatagaaaacatacttttattttattttattttattttattttatttttttttctgagacagagtctcctctgtcacccaggctggagtataatggcacgatcttggctcactgcaacctccgcctctcaggttcaagtgattctcccatctcagcctaccaagtagctgggattacaggcacccaccatcatacccggctaatttttgtagagacagggtttcaccatgttggccaggctggtcttgaactcctgacctcaggtgatctgcctgcctcggcctcccaaagtattgggattacaggcgtgagcccccgtgcctggccagagaatagccttagaagatagaaatagtgtctatctctagagcaaaaggcaggtttgcttatagccttggaaaatacagttagtatctgcctctggaacaaagggccgacatgcttatggcccattgtaagaaatttgtgtttcttaagcttggggttcttctgtaatacaacccaatacttctacaagtatcacctgatcctctttgtattatcctatgggaattgagtttgtgtaagcaacacaaatactgatactttggctactgtcattgctccaattaactgtttattatttctgacctaggattctggtgtcttctaccagcttccatgaaactggcaggctaaatttttagtgcataagtaaggtaaaatttcagaccctttgccattctttcttttcccttttttttttttttttttttttttttttttgagacagtgtctcactctgttgctcaggctggagtgcaatggtgtgatctcagctcactgcaacctccgcctcctgggttcaagtgattctcgtgcctcagcctcctaagtagctgggattacaagagcataccaccatgccagctatttttttgttttgtatttttagtagagacagagttttgttacgttggccaggctggtcttgaactcctgtccacaagtgatccacccgcttggccacccaaagtgctgggaatacaggtgtgagccactgggcccagcccccgttaccattcttaacacttgcataataaaacaaccctattaagttagctgcttttattattctcattccacgcataccaaaaactgagatttagtcacccatgcaaagatccatagataagacattatagagctgggatttgaacccaagtctaactctaaaagctgcattatcaagcagtaagctactcaagtccttggattaaccttttatctgactgcatcatgaactataagaaagttatgcttaaataattctgggttgcagattaccagtgtcctgtcaaaggctgaatgttcatgtcagcaggagataagaacagttaaaaaacacaggaaggggaacatcacactctggggactgttgtggggtggggggaggggggagggatagctttaggagatgtacctaatgctaaatgacgagttaatgggtgcagcacaccagcatggcacatgtatacatatgtaactaacctgcacattgtgcacatgtaccctaaaacttaaagtataataataataaaataaaaaaattatgatatgtttatgcccccacaaatccttgtttgtttaattaccaggtttacaccttacggaaaaaatgtacataaacttaaaacctattatattgacatatttacaggctagagatatcatctatgaatgatggcattctttgttctgttttgttttattttaaaaaaacaataaaacaaaaatcccggagctctttacaactgtacaagcctagaagtaagatgatttacttaaagactaaaagtgacaaaaatgagttcattcaatagatcctgtatccccaaacttcttcttattagcatagatatttttatccttatattaggtttacatctgcttttcaatgtatataaacagcatgacacatagcaggtgcccattaaatgtcatttgaatgattctaaagggttgtgggtcttcatagaataataatacacagttcagggctttggccatcttggtcttttaatgcattaacattgcaagtttgcagttttatgtaattatttatgcagacatctgaaagtcccctttccaatcaagcttaaaagatttttcaataaaactttcttttcttttttaatatttgcaatttaaacttttttaaataaggtaaaatatacatatgtaatttaccatccttaccattttaaatgtacagttcagctgtaataaatacatgtatattcttttttcccccttatccccctttactagaaaaccttatttttctaatgatttttgagaaatagaacttatcaaagggcttgagatcttgtttgtttattcatttgttttccttccttgaatttgctacagtatcagttgctagttcttatgttttaacgtcagtcttattcaatgactgtagatcgattaattgatgttatatgtagcaaatcaattcaccttataaaatttcagacagtaaagcttgttttagtttccttatcattagatggtctctgaaatttacaaggaaagtattttgaagtgaggataagacaatcgaataaatcagttaggaaagtttcaactatatcctgaggcattttatctagggcttttgattttaggtacaagaaagatccctaatttatttagattattttcaccagcttagtcctggtgatacgacaagttcacatatgctcaaactctaaaacaaaactttataatatgggcatgttttataaatgtgagttagaaaaggaatttggatgtttcatgtgtattttaaattatgagttttacttttctccccagagaacccaagattgatcaatattttcccttagaaatacatctgggtaaaaagttctaattatgacctaaacaagctaacattaaacctttggaatagaaagcaaggtttatttataaattttctaattctgtgctatgcaaattaacattattccttagatgttatgttacacatctgctcttctttctatcagcttcctcaagttggtacggataaccacaagttagtttgactgttgagcaatgttagcatcaagttctgagagtatccaggggctagcagccaataaaccttggttctgaactactgaccagctacgtcagcttgacaaagttctttgtcctctctgtgtctatgttttactcctgtaagggatacttaccctgcccattttccagggttattgggataattaagtaagataatacacatagaagtacttggaaagattactaacatgtgtaattgtaagttgttgctgcagtatcattgcaaaggccttttgcctacattgagcctgaatgtgttccttgtcttcctcaggatgtgaagtagggagagaaaaaataccatctccattcttgcacactcgtcagtctgcctcctcaacctcacatagctctaattgtacctaatgaaagtaacatttttaggtcccagttgcaggaaatattttaaatagaaccagcctggggcatttttcaaaataaaatctaaataatgcaagattgttagcacgaactgtgccagggctggattacacaactaataaaaatcaacctgagtttcagactgtcaggcagcattgattatacctcccccaggtcacctgaggtgatagcaggactcacatcagaccttgtctttaagttctagggacctcggtcatcctcaacgacttcatactaggacttgttcatgagttaacaaagcagtttgtcagcatctattcacatgtcagcatctattcacatgtcagtgaccacaatgagagtgtatacatactgggccctggcttaaagttgtttgtggctaaggattaggaaggacacacttcctccttcaactcatcagccatctccagggtggcttccttgcctttaacaccaccccaaatcaatacaaatgctgctgacaccatctacgttgtttatactttggagaggtcagggaacgaacacatgaatggctcttgtcttgtgcctggaaacctggctttgaggtctctgggctttgttatagaaggcatttgtctaagaagctcccagaagtaaattttttgtttgtttgtttgtttgtttttttgagacagagtctcactctgtcacccaggctggagtgcagtggcacgatctcagctcactgcaacctctgcctcctgggttcaagcgattttcctgcctcagcctctggagtagctgggaccacaggcgcgtgccaccacgcctggctaattttttgtatttttagtagagacggggtttcattgtgtcaggcaggctggtctcaatctcctgacctcgtgatccacccgcctaggcctcccaaagtgctgggattacaggcgtgagccaccatgcccggccagaagtaaacctttttaagtggagcttttactacctctttgacctccaaggttctagcctctgcctagtagttagtactcagagtgcctggaagttccttcctgccttagctgctttctcttgatacacttctttttgtgcctaagtcaatgtatctttttgatcctctcagacctacatggctctctggtattagaccttttgcccaactgacctcttccagactgtttcctgtcaagtagcacttctaacccagcagactgttttaacccactgctgccagtgtgttgtttttatattgctcatgattattatatcacatgtaaattataagtattatatattagatatgtatattatacatatatgcatattagttatatatgtatacatatatattaattatacatatatataattattatatatatcttttaatatatttaacaatgctggcaatacctacaattctaattagagatacaattgtttgaatacctactttttgatagatcctgtattaggtattttacatacattattttatttaatacttacagtgatctgaacaggtcaggtataaaaatgtaaacctgtttttactcatagttttataatgaaaggaaatccttcctcccaccttcaatggagccaccataaacagcttcttatcctcatgtttcaggtgaagaaactgagactcagagaggttaaacaatttgtccaaggtcacagaactagttgagtctagtgaggcttagtttaaagatgatgctttgttaagaaaccactatatcagattggtcctctactttagtctaccctattttctacccagggataaatacatctgggacagttagcttctttcagagcattgaacatttcacctgcttctattattgagatctctggtcaacacttctccttctgtggaggtataacataataattgaaaattttttaacaagtatgtctctttcacctgtatgagtgaacaccatggagcagatatgatcaaagtcagtaacatcaagaactgttcagaacactttggatatccagcagagatgattacctttcttctgtgttagatactttttaaataactgtgaccatttagcttccctctatcccctgcccctgccggtcattcttgtctttcagatgtagccaatatttttaattctttgccaatatgctgctgcacaaaacttggctaatcttcctcctagtggctatccacaaatacctgcaaattatccgggtcatacttatacaaggaatgtgatatttgacaagccatataccttcatctgaaggaatgtgatatttgacaagccatataccttcatctgaagaaagggggatatataccatatgggactgatacaaaaatggaaaaaaaataacatgtctctcaaatagataccttttgatgcccattcatttaatcaactaacgtttactaagcatctactatctattcatttagatcccagggatggtgtaattaacaagagcaacaaattccttgccctttttagtgcatactttaacaaataaacaaatattagaagatcagataagagcaagtacaaaggcctattgtttgaataggcttagtgtgttcaatgaacagagaaaatgccagtgtggctgcaccctaatgagtaaaggagagaatgttatgttgagctagatcatgtatggccttgtatcaagcaaggagacttggaaatatttaacactgaagtgtttaaaaaatggtgaaaaagagctcaattgattgagctaaattgatttacccttcttctctgagattactactgttgtggctttagcttcatggcatttaaagaggctgtccaatgtctgacaagaacataaatgtttctttcacttaatccccagtgggcatatcttatgacctttgtgttccaggaacccatgtagaggaagaaagaaaagcaaatcccacagtctacatagtgtgatggggttgcatctaaacatcagaattggagtgctttgatagtttccttctcagatgacacaggcctgggcatagtcaggggtgcttgccagaaattaactttaccagaagcctaagtaggagtcattcttattaacttagtttgtaaacccaagaggcatcgccatctggattcctgtgttttgcatgatgtcggggatataaaatttcaatgagtgactactaagcagtatgaacagtgccgatcatttggtactgtctgaaaattattggttggcatgctaatcccatctgttaggattgttattactcagttataaagcacttggtttgaattgccacccttggcaattttagttttgacagcacgtatcccttgatgtttaaaacagatatggtcctgaaatgtcttccataaagtaaaattgaatactccaagatttacagctgatcttcatagtgttatcaggctgcttctgatttcttcctcacacttttccattttcttttgtgtttgacatcttctggaatccagataaggtagggtagagaaaggtcatggattatacatagaaaaataaaggcagaatttgtatttatttatatttattgtagttagttagattaattaaatatgtttattgaactcacattattgagaaagtgttaaccaaagtacaagaagacagaatttttgttcaataaatacccttctgtaatgtgttagccaattaatgcccaatttctaaagtggccttatgataacattctgtgttgagaattctttataatgctagtgctggttgatacaattaatcccaactgaccagactctagtaggatttcttctttataaaagcccaaaattcaacacctggcacatcttagtgagtaccttaaaaagctgaatagttggccaggcgccgtggctcatgcctgtaatcactttgggaggccgaggcgggcggatcacgaagtcagcagatccagaccatcctggctaacagggtgaaaccccgtctctactaaaaatacaaaaaaattagccgggcgtggtggcgggtgcctgtagttccagctactcgggaagctgaggcaggagaatggcttgaacccgggaagcagagcttacagtgagcagagatagcgccactgcactccagcctgggcgacagagcgaggcgccgtctcaaaaaaaatctgaatagttaacaggtaaattaacctgtaagctaacagatatcctctgtatgttgatctggtttttagtatatattctgtatcaggaaatattggctgagaaaccaatagtaaaattaaactatccctgtagtaactgttaaaggactggccacagggacagagcaaaaatggctacagctccagttatagagagactttctcacaggtttttattatcagattttcaacatagcaatatttattgctgggaaagaagtcagactatcttacagtttggaagatgggtatagcttctctatgtagctctgtggctacctcatggccacaaatatccacattagcaattagtttcatatcttctagtcagttgcagcataaaactgctctgtgttgctttgatgtttttttctgatttctaggcaaggtcctaaatggaaaagccaatactcttgaaatatatagagcacaaacaaagttgtaaacacccaataaagccattttgttatttctctgttcctacagaaactcaacatattgcatgaaggtgtcaatgtccttgactgttgcagagaatgaatcaggcctgtgctacaacagcaggatccgctatttagaaaaatctgaagtcactaaaagaaaggagatctcctgtccagacatggatgactttaaaaagtccgatcaggagcctgatgttgtgtggtataaggtaactcagcatggtgtcaaattcatattttacctcagtcaatagcagtcttggggatgaggaaagggagatttttttactagtttttggtattagatatttcactgagaagaatcaacagatccataactaaataattcagagctgtgactcttatgtatcactggtttttaatgcaggtgttagaagcaatacgcctttctccaactgctaaaagtagaatctccctccagcctgacagcatataagaactaatgggaagaagggtaaacatttaaataacacttgaaagaaattatttgggggacacagaaatattatttactggtgggaacaaaggcctgccattacaagtagtagtacttataaagaataacaactatcataatggtctactctgtgaaagccacaacagtgaatgcagaggagagaaatgggcccagtacaggatgtataaacactgctaaggttaagtttagctggaaataaaccacactcaaaggttgaacagaagagaattgtggccaggtgcagtggctcatgcctgtaatcccagcattttgggaggctgaggcgggcagttcacctgaggtcaggagttcgagaccagcctggccaatatggtgaaacctcatctctactaaaatataaaaattagctgggcattgcagcacacacctgtaatcccagcaacttggaaggctgaggcaggagaaccacttgaacatgggaggcagaggttgcagtgagccgagatcatgtcactgtactccagcctgggcaacagagcgagactccatctaaaaaaaaaaaaaaaaagaagagagttgaatgaaaggattatttacaaaggtttgggcaggcttgaagaaatcaataaaggagcaagctgttgattatcacccctagacctgcagtgtcaaggggaaggagcagtgtcactggaacctggcaagagtggaggaagctgccaagagatacagccttaaaggaacatatgagggtggcagataggaagggagtgggtaggataaataccctaaccatttataactcctgctctctgtttatttgctagttgcttccctctcctgccaccctcattcaaactgaaacagaagccagggggcagaggcaggagatagaatcaatagtgttctgcttttctgagcatagagtagagcagacaagcgtggataattggatctaggggaagaagcagataataaccacacaaccttccagctatgatattctagcagctaacctggggcccacggtcttgtaacagaactaagtcaactctcttctgtcagctctgaaccacagcaattgacacactgaagttttatgatgtgatggtagatgaccaggaaggttttctgcacagatgctgtgtgtactgttggaaccaaacacacataaaaggtggagcaggttgtttctataggatctgacagaccctcagttcctagggaagcttaatccctaactcccacagctgtcatatgcctttacatttggaagcctctccattttcacacctagggaaacttaccaatagacaccaagaacatactctgtactagaacgtccaggtctcaatgggaattatcttaatgaagacaatattgtgacagataaaaaggaacataatgtttattatgcacaaacatatagactacaggtaatttggtgggtttatgccatcatcaacctcatttgtatttattaagcacttattgtgtgccattcattgtagctaaacttgatttcaacattatcttgtttaaatctcagtgcaactctgtgtgataggtgctattatcctaatttaatggagaacaaaaccactgaggctgagagagatgtgacctatccaaagttacacagtgaacaaagcctgattttctattcaaggcagtgtgactccagaattcattttcttaatcactaccctctccggcaatgggcctgggactaaacccagccttggtcatatcttgggaacttttgtaagatgccatgctggtgcagtggagcctggccaaagaaagaaaaagaaagttttattttaattttatggttgaggaagggaaggtgacctgcccaaagagttagcagctgggagtgaaatccagataatcaactttcccttataagagtaattctactatctcatcttactttctgctaacttctttcttctccttttctcatatctctagacatcactatcatccttacatactcaagcaatttactgcttggcaaatgccacttctcactcttccttagaaatggaccaacaatggtgaagcaacaggcctttccagctctgcctggataatatttaatatttctataatattttacagttgataaatgatcatcataatgttagctaacatttcctaagtacttactgtatggcaagctgtgttttaggtgcatgagatagattaatgcaattcttagaactaccatataaggtaatattatctctattttatagaagaagtgactggagactcagacaagctaagtgggttagcaaaagtcaacagtagtttgtgacttgcagtttggctactagccccactcttagcccctacagtatactaacggattaggataaaatactagaatcagaagttaaagagtacctgaagctcaggatgtattgctaactcttggttctcatacaaggtttcaagtaaatacctgaagaaaatgtaccaacatattaggaaaatatttctttttcagtcagtatttggatagtctgccttgcctactttatagcccatgtattttctttttttatttattttttaaattttattttttattattatactttaagttgtagggtacatgtgcacaatgtgcaggtttgttacatatgtatacatgtgccatgttggtgtgctgcacccattaactcatcatttacattaggtgtatctcctaatgctatccctcccccatccccccaccgcacagcaggacccagtgtgtgatgtccaccttcctgtgtccaagtgttctcattgttcaattcccacctatgagtgagaacatgcagtgtttggtttttttgtccttgcaatagtttgctgagaatgatggtttccagcttcatccatgtccctacaaaagacatgaactcatcattttttatggctgcatagtattccatggtgtatacccacattttcttaatccagtctatcattgttggacatttgggttggttccaggtcttttctattgtgaatagtgctgcaataaacatacggtgtgcatgtgtctttatagctgcatgatatataatcctttgggtatatacccagtaatgggatggctgggtcaaatggtatttctagttctagatccctgaggaatcgccacactgtcttccacaatgattgaaccagtttacagtcccaccaacagtgtaaaagtgttcctttttctccacattctctccagcacctgttgtttcctgactttttaatgattgccattctaactggtgtgagatggtatctcattgtggttttgatttgcatttctctgatggccagtgatgatgagcattttttcatgtcttttggctgcataaatgtcttcttttgagaagtgtgtgttcatatccttcgcccacttgttgatggggttgtttttttcgtgtaaatttgtttgagttctttgtagattctagatattagccctttgtcagataagtggattgcaaaaattttctcccattctgtaggttgcctgttgactctgatggtggtttcttttgctgtgcagaagctgtattttctaccaggctgagcaagttttgctctgtctatagcaatataaagaagaggatacatttgtccagagtttattctggtgctcattcaaagttagaaatgtccagtgtgttaaaagaaaaatttcagccaaattaaatttaaaagattaattgagcaaagagtgattcacaaatcaggcagtcttctgagccagagtaagctcagagactccagtgcagccaagtggtagaagaatatttatggacagaaaaaggaaagtgatgtacagaaaatggaagtgaggaacacaaacagctggattggttatagctctgtgccttatttgaacacggttcaaacagttggccacatttgattggtcaaaacttagtaattggcacaagagtaggctatggtctatttacacctccacttgttatagttgacagtgtacagagaaacctttaggcctaacttaaaatatgtaagaaagcagctttaggctaaacatgatttaacaatttcccccttttattcatcctctcattttgagagattgaccaaaactttagtcattgatgtcactatcaccatcataaatgtacttatttggccttgaaacccactgaaaaatagcagaacagtgggttgtgtaaggtgtgaacaaggacttcaggtcattttttttttttgtaagggttagagtagaggataacttcttagtctggaacatcctgtttacaggagaaaaagacaaaacccagtctgttctaggatatatgtgtttccttaaagtcttagtttgattatgttacatttagcacaagtgagtcccttttggttttgtctggtctgttggggcctagtgcatgacatgagctgagtccaaaacaatggcctcccataattttgtttaaaaattcccccctttttgtcaggttctcacttaggtgagagtgtgccactctcagttaccgtcattttgggtttccaggtctcagcaattcattcataggttatgatgccctcatggtcacacatttccttcagctattggcattccaattgaatagacaacatttgccattcttgagatggctgaatgcaaacgtttaaaacttttgagagaatacagtacaccaaggggactactattatgattgtcaggaggataataccaagagtttggagtatgccccttacctagggtcaccaggaaccaaaccaactaaaatcaaatagatcaaagaatgagctaaagagtctactcactttaactaagcagtctcttcattaatctcctacactgaatctctataatacctgatgggatatatttctccacaggccacaagcaccagcagttgcacagatacttctgatacttctctgtttagccagtaagtaatctagagcaattctattatttagcataattttcacaagagaatttaaaatctgttgtgtaaccatagcctttacagtagaatcagttatagagcctatcataagggatacatttctaattattccatcttttactccacaccatggaaaaaagcacttaacaaatgatgcctttctagaagaatgaaggactcccggcaatgttgtctttaacccatgatgtagattaaaaggagtgaaccaacattctgtttctgactatcaggcaacgtatgtaccattaaagttattcacctacattgggccttcatttttcatctatcaaggcatacggttatccatgtataaggctggttatccatgtataaggctggccatttttttttctggggagaaacttccctgggtagctttaccttaagggttctaacgggtgtatagttccataagtgtggagcaaccctccctcagttgtgagattataagcccaaggttcaatgtcccttagctttgctgcagtgtggatggcaaaggaagtccttctctgatgttctcggaagatccagtctttgagttctagattgtgaaggggttgattgtcttcagttagtgaaccgtaaaaatcttttattcctggtgaaaatacattgtgacgtaataatctgttataacatcacccttctcgcaaggaaaagctttgatacaaccagaaaacatacattgaaaatgacaattgaatgaaatccctctataaatgtttaaatgacccatcaggtagctgaatgtatctgaagatttgagtgtcttcccaggaatacgggtttgacaaattaaacattggttataaactattttagcaatgtacaagtcaccacaacaatatatatttaatttggattattttatctttttcatgagtcatggaatgcagaacttttaataacaaaaactttaaggactcaggaaggacaaggcagctgccctggttctccatgagtccatacttaacattggtcttatgtcctcttgaataccaattgtttctccaatttaggtgcgtagcactgataactgatgggttatcataggtcatttgacttagaccatggagttcattcaaattgtgtatctatacaattttggtattggctgatttagcatgataatctggcaaagtgtcttcttggtattcaattaatttttgttctacttgggttagcagttatataaaccagtcttttcattgaagttccaggaattcttacccagtccaaatgatatgactctaaagttatgagaaacccgtattcaagagtgcttttcagggtcctttccaaccttctaaaagacaccatatttctaggattttgcatgcttgtgaatttttcagaaactgcatcagaattaagcaattaactagcaatgacttcaagtaaagacacagttgacaaggaaatttggttatttctgtggtctacaataaattaacataataaccataattataattgatatcatatactcagacagtagaattttagaaatcccataacattttggaacatatattaatgaaattcattaaaatataacctaaagaaggttaatgattatttctggctgggcgtggtagctaacgcctgtcatcccaacactttgggaggctgaggcaggcggatcttttgaggtcaggagttttagaccagaggctgaggcatgagaatggcttgaacacaaggggagggtggggaaaggttgcagtgagtgagctgagagcgcaccactgcactacgctccagcctgggtgacagagtgagactgtctcaaaacaaacaaataaacaaacaaaaatttcttattttgacggtgcttcccatgtaacttaatatatcaaataatcctgtttacctctcttttggatgcttcaggggccctctgtagcatcctaaagttagtggtcaaaagagacttaatttcgaaattggaatttgacttggggaagcctgtcaaatatgttaaatgtttaaaacatttgatattatgaaatagaattccatgtcaccataaatcattcattttgccaaaataatgactcaaaaattttaaagatgtaaaaacctttactcattgatagaggaaagacttagctttccaaacaatctgtctcttgtctttcccttctttctcctgtagtttattcaaaaggcaaacaaaaatctttcattattctttaatattacatgaaaatctcattcaagaaagaaagccaaatttcatccttgcattagtatactgttaatgtcaaccccaatttttaataaaacctagtagacaaatctatctaatcttaatcagttttaccataaggtgagattcacataaatcttttataacccattacaaattttcattaaatagtagatcagtgctctaagaaaacccttttgtgcttttatttcaatgttcaatttacaaaaaaactgaacaataccccctttaaatttagccaatatgttcacatgtagaatttctcttacaagtttaatttttcacaatcttccacaacttgctcaactttcagctttatcctatctaacctaaatcgtcatttaaccctttaatctaggcacaaaaatccacattcccatgccttcttataatcttttaccaaaagcctacttcactttcctcacacattttgcatgtaaaactctttcttcagtagtctcaattacatgttagaatctcaactcttagcaatttttatttttagtgaaaaacccggtaaggaagtgattttaattatgtactaggtgtggggcctaggacaacagactgaagtgcaggtaaagtccaactctttccatcatagctaggggcatggttaactccatgtgtccctaggccttatctagaatctaatggctctaaagcaggtaagtctaacaattttcaaaagtcaaaggagcagtttatgacatcaaagcatttagcaaacctaatatccgacctgcctaatttagaccaaatgtctttattttaccaataatcttataaaactgtgtttatttcccaaagattactaaagtcatgtgaactaaaagacattacagtttttatttttctgacaaaatatttgatttaagcacttattccttttaaaccaattaatcagagctttttcgtataaacatcactcacacaacacatacagacagaagaaaatccattacttgtaagaattttcatttgtcagttttaaaatagcttttctttctcccgttcagtctatcaatcttccaattactggtttcactgaactaagcaattgttgactaggcaacaaatttgtatttctaaagggacaactgttaggtggaaccacaaaaaataaaaatttatatctcataagcagagagcaagattttggtctaaaaattatattattgtttgctcaaaccaggggcaaaacaaaaacaaaaacaaagacaaaaacaaaacaaaaaaaacagtgctctcatgaaagttccatcaagagaagatggccagaaaagcatctcaaccaaaagtatgatttattatgtaaatttaaaggaatgggccgggtgctcaagcctataatctcagcactttgggagaccaaggcgggcggatcacatgaggtcaggagttcgagaccagcctggccaacatgtgaaactccgtctctactaaaaatacaaaaattagctgggcgtgatggtgcatgcctgtaatctcagctacttgggaggctgaggcaggaggatcacttgaacctgggaggcagaggttgcagtgagctgagattgtgccactgcattccagtctgggtgacagagggagacttcatctcaaaaaaaaaataataatggtgatatgatttggctctgtatccccacccaaatctcatcaggaattgtaatccccacatgtcaagggagggacctggtggaaggtgattgaatcatggagatggtttccctcatggtattctcatgatagtgagtgagttctcacaagagctgatggttttaaagtgtggcacttccttgctctctctctctctttcctgttaccttgtgaagacgtgccttgtttccccttcatcttctgccgtgattataagtttcctggggcctccccagccatccagaactgtgaatcaattaaacctactttctttataaattacccagtctcaggtatttatggcagtgtgaaaacagactaatacaaatggtaagtttctaatgtacataagcagatatccctacaaatggagatttcatatatatatgtgtgtatatatatatatatgtgtgtatatatatatatatatgtgtatatatatatatatatattttttttttacaaaagagttttaagatagtcaattaaattccagaaagatgtattttagttcaatagggttttctttttaacatagctactgtttcttagctaaaattactgagttcagggtaatgggtggagcccactaaagaatagggccaacaaagcatgcattgtatgcctagactcagcatggatagatctgtaaaaagaagcatgcctattttacctgagggcctaacttttataaacatcttatctaggataactttctttccaccttttgggtgggaaaataactaagccaaaaggttagcagacttaatttttaaaaatcagttagttgcttaagatttgtatttgccttttataaagtctttagataaaaatattgaaatatttttagaagcttctgcatgtcaataggcatccctaggtgagactaatttgggagccctcaatcaaatgcacttcagtgcattgccattcatttggaacgttccactctaacttatctttagtgagattttgcgatttcaataagactttgctgcttgaggggcctcatacttgtgcgtgtataagccagaaggaactcagttcttcagaaattaaggatcccatttttacctcaaatattgtcttttttctcagattcccttgatcaacttagccagtgtttgttttttcctacttaagcatgcaagaaaaataaaacaaaggggtagaacacaaaaatctctgtgaatttccaaaagccaaattttataccccctgcaatattgccatttactactaggttctttctgacccaatcagatataagaggcctctaactggatccaagccagttaattaccagatccaatctgatcctggacctagtccgctttctgccatgacttccaaacctagtttggatcagaaatttgctcaaagaaactcagagagctcaaaacagaaaaccatggagctttggaatccaagagagaacttaaccacgatccccagttgttccaagagagtaatggacacagtgggtctggtgggtacctcacttggtcattcaatactccttggggtcattagaagctctactttggatcccacttctggtgccatctgttaaaagaaaatcttcagctgaattaaatttaaaatactttaattgagcaaagaatgatttgcaaatcagtcagcctcttgagccagagtaggttcagagactccagtgcagccgtgtgttagaagaagatttatggacagaaaaagtaaagtgatgaacagaaaatggaagtgaggtccagaaacagctggattggttacagctcagcatttgtcttatttgaacacattttgaagttggccacatttgattggtcaaaacccagtgattggcacaagagtatgctatggcctgtttacaccaccacttgttatacttgaagatgtacagagaaacctttaggtcatacttaaaatatgtaaggaggcagtttaggctaaacttgatttaactaacgtcttaactccagggctttaatggtgaaaactattgctttgcatgatccgttttccaggtgtcttttcaaatatacagaatctttaaattcctttcgtttccatcagtctctgtgttttacttaattaactaattatattgtatcactctcatagtccgttttgagtttcctgggctgtttgaaatatgctatggtaggcctttaaggactatcattctgtgcctgcacgtaatcacagctggatgggaagctagaggtgaatcaggtggtactggaggcatgttcataaagatgcctgagtaagccaatccagcctgtctgaggaatacaaaggatatgtgtaagaggactgtatattctctatctgaactgcatcagttatcaaattgagataaggagaggggctacacttttagaaggttcttctgacactatataaataggatttagacattagagcagaatattcaataatgttagtgtttttaaaacgttttacaaatgagagataaggattcttttttaaattgaaccaagaagaacactaaacctacttaattattcactgagcaccctgttgtcacagaaatgtggagtcattttatcccatttctaaatgtcctaattttgataggatattggcaagaaaaatgcaaatacacactttggagtgaaacactcatctatgtgattagttacctcagttggtaaaagtctggtgttaataaggtcaaggctatcactttgaattctcctttttcttgtcacaactatctcaattttagatgtttgacattggttataaatggaattggttgggaatgatggatggttcagtacaaacttatttgtacaactgatcattcattcagcacatatgtattgggtgcctacctgtgcaaggcactatgctaggaactgggaatactgaactgaccaaaataaacacatttctcttttctcatgaagggagatagatgagtaaatagctctttctcaacactccaggaaggaactacatcaattgaaatatctaaaagaacagctcctacttgtaatcaatagtgtctttgtcttgagtaaagggcagcagacatacctgtttttaatcacagacatgaatctctgcaaaggaaaattacaaaactaaataagatcagctaatattttcatggtacataatagtcaggagcaatcttttgttacctaaacatcaagggtttactttcagtcctgcagcttgctgcacagaaagccaatcactgagacaatgagtattgccagggaagaaggctttaattgggtgttgcagctgaggaaatgggaaatcaatatcaaatccatctccctgatggactaaaatcaggggtttatatagcagggaacaaatgtaactaaatgcaagtaaacagaaattagggagaggtaaggaataggagttggctaacaggaagcaggtagttgcttagacaatcatgatggataaggggttgaatttctccttgtctggatgtagtgatatgttaagttttggttccttgatatcatttgggagtcctgatggttggtttcctgagaaaagaactcagataagacaaatgtgactttctcaagttttaagactaagggggcagtttctacatttattcaaaagaaaccataaacatcagttatataggacaactgggtcgatttaaattttacaaatctttttatgtaacagcacacatagaaagtgataatatggcacatcaaagtgagtggaagactggccttgagagcttcaggtgctctcagccctcctgactgatttggggctgaacaacacaaaatcaatgtgcccatatactggtagccctcacatagcactccagagtgctgtgacccactggtttggaagctctggtttaccttttcataaaatgtaatatatatattttttatctaaagatgactgagtaatttaatcttgattgtcctgggaatgcaagggatatgtgggagagagttgtatctcctctatctgaactctatctgttagcaaaaggaggtgagtctgcttattggtggttgttatcttctttttacagatgaggaaactgaaataactcacagagggtcacttatccaacatgtggccaattagattcaaacgctgaaattctgacatctagtgttctcataatctcactatgattgctccactacatgaatatgttatgcacttaatcactcacatcactgatataaacagaattctctatcaaaattgttactccagaaacaaatcctgtaatgctttctaaggactctttaatgactctgagtgttgaaagggactcaaatgaggaaactgaagcccaaagaggttaagtgacttgcttaagtctaatgaaacccatgtctttctttttttacattcattaaattttacaaaaagagaccactaaatagaatagaagtgtgtgtgtatatatatatatgtgtgtgtgtgtgtgtgtgtgtgtgtgtgtgtgtgtgtgtctgtatttaaaagctgattgttttgacaaatcgaacagtgaagaggtatattaatataaagttagtttcatcctctcttccattccatttcagccaccaaaataactaatgctaactgttaaatacttcctcactttcctctatgctaacattttcttcctctctctctccccaccttctctctttgtgtgtatatatgtgtatgtgtgcatacatatataaaacacattatttacttactttcatatatacacatatatgcaaatattttcccttctctaatttttttttataaaaaagagaacatgctatgcatatcatgcttcagctttccccatcacacacaaccgtatgagaaacatccttccacgtcttctacaggtctaattcattttgctgcataatagttgacaggacagaactaccttattttattcaatcagttcttctactaatggatatttatgcattttttttctatttttgtttttaataaccacagtgttggaacatccttgtaaacatacatgcttccttacatccatgacatacaagatggaaatgctctctgtcactattatagttttgtaggttctagctgatgcaataagaaaatgaaatgaaatatgctatataaatattggaaaagaagagacaaaataatcttaattttcagattatatgattgcatacctagaaaacccaaaggatgcaactacgacaacaacaaaaaatagaactaatgagaaacttcagtatggtagcttcctaaaaatgtacaaaaattcaacagcttttgtttttgcaaacaataaccagttagacatgtaaaggtgaaaaatgaagtgatcttgtttaaacaatgacactataaaacacattagaatacatttaacaaggatgcaaaggggcttatatgaaaataagattagcatttgcaaaccatcaatcggacaagggattaatcaccagaatatataaggatctcaaataattttgtaggaaaaaaacctaatctaatttgaaaaatgagcaaaatatttaaatagacatttctcaaaagaagacatacagatgggaaacagacatatgaaaaggtgctcaatatcattgatcatcagagaaatgcaaatcaaaactacaatgagatatcatttcactccagttacagtgacttatatccaaaatgcagacaataacaaacgctactgaggattcgaagaaaagggaacccttgtacactgttggtaggaatgtaaattactacaacccctatggagaacagtttggaggttcctcaaaaaactagaaattgagctaccatatgatctagcaatcccacagctgggtatatacccaaaagaaagtaaatcagtatatcaaagatatatctgaacttccatgtttattgcagcactatgcacaatagccacaatttggaagcaacctaagtgtccatcaacagatgaatggataaagaaaatgtggtacatatacacaatggaatactattcagccataaaaaaagagattctgtcatttgcaacaacatggatggaaccagaggtcattatgttaaatgaaataggccaggtactgaaagacaaacaccacatattctcacttatttgtgggatctaaaaatcaaaacaatggaactcctagacacagatagcagaaggattgttaccagaggctgggaagggtatggaggggttgcagagaggtggggatggttaatggatacaaaaaaatagttaggaaaaatgaataatacttagtatttgctagcacaacagtgagtctatagtcaaaaataatttaattttccattttaaaataaaaagtacagttggattgtttgtaacacaaaagatagatgcttgagggaatggaaaccccattttctatgatgtgattattacacattggatgtctgtatcaaaataactcatgtcatcataaatatataacctactatatacccatgaaaataaaataccattgaggtactattatgtaatagaaaagctaaaatcgaaaacacagatgacacccaatgctaacaaggatgtgtagcaacaggaagaattattcattgcaaatgggaatgcaaaacaatacagccacttttaaaaaacagtttggcagttcattacaaagttcaaagtaagcttaccataacatccaacaactgtgcttgtaggcagttaccaaaattagttgaaaagtttcatccacacaaaaacctacacacaaatgtttatagcatctttatttacagttgccaataattgtatgcaaccagcaagtccttcttcctttgtgaatggctaaacaaactgtggtacattcatataataaaatattattcagatatgagaaaaaatgatatatcaaatcataaaaagacatggagaaaccttaaatgtgaaaccataagtgaaataagccagtctgaaaagggtacgtactgtatgcttagaactatatgacattctggaaaaggtagtactatagagagaataaaaagatcagtggttgccaaggtgttgtggaggaaagatgaaggaaggaatcaatatatggatcacagaatatttttagggtgggaaacaatttttaggatggcaaacaattctgtatgatgctgtaatgatggatgtatgaaattattcatttgtcaaaaccaattggactgtacaaaacacagagtgcaccctcatgttaactgtggacctcctttaataacaatctataaatattcgttcatcaattagaccaaatttatcacattaatgcaaaatgttaataatatgtagaaaacttgatgtgagagtttggagggtatgtggaaaccctgtactttctgcacaattttttctataaacctaaaactaaaaataaagcctattaattaagaaaaaaaacaaaatttattataggacataaaatatgatccaaattaatgaagagacaacatgtttctgcatgggaagataccaaagaataaaagatacgcttttctgaaaatgtataagtaatgcaatttgatagaatataaattatttgaaactggacaacataattacacagttaatataaatgaatatgccagaattgccaagaaaatattggaaaaaagcattcatgagaggggacatattctatgagttgctatcatttactacaaaacaacatcaattgaaacagtaagctaaggaaaagataattgacctgtagaatagagaatccagaaacagataaaaatacttatgtatgagaatgtagaatataataaaggtaacatttcattttaatgtaggtggagggagaatgatggtttatttaaatatggtgtggacataattgaatatctacttagaaaaaaattagatctctgactcttgtaccctgtttaagaaaaattctaaatgaattgtaaagagttaatttcatctacaaaaatagtggtttaggaatgaccatttctaaatgctaccacttatttcaataagttaagtttttaaagaaaagagctttacattgatttatcttgttatacattctgactgtttttctaaaggtggaaaaaatgtcattagaaacctcataataccgcagcctgaatgatcaacacttgcttgctaaaaaaaaaaaaatggtttcccaaaatgcttggagattttgaatccctttaggaagtgtaataaaattaatctgtgccttctgtcataaccataaaattgtatgcaacccttgaatttttaatcttgtaacaagaattttcaaagacatatttatccagaaggaatgagttgcaaagctcatgaaggcttcagtttggtgtgccctgaaaccatagtcagcaatacaaaatttaagatccatttgtacttctttttgttcctagatatggcattagaagtggggaggtttttttttttttaactgtttgtaaattataaaataggtgggctaatacaataggaatgggtatttggcatgtataagaagcactgggctccatgtttgaggacttggattctgatcaccatactaccattaacatggataagtaattaaatatcactggacctcaatttccccacatataaaatatatgtaattaatagctgttatataccctagacatgttataaaagtttaatgattaaagtctttacttgagatttgctacaactatagaaatggaaaagttatgtggaagccagaaatatagttacctaagacatctcagattctaatttaaggctgaggtttttttaaaggtcaaattattatgtataatttacaaatagcaaaattcatcccttttacatgtacaatttgatttgatgtgttttgacaaatgtatacaccatagtcaagatatggaacagttctgtcactccaagttcttctgtgtccttttgtattcaatcctctcgtcccagccttagtctttggtaaaaattcctttgtttctattcctataattttccattttccagaatgtaatataaatggaataatatgatatgtagcttttttgtctgtcttcctttacttagtataatgcatttaagacccatctatgttatgacatatatcaataattcatttctttttatgctgagtagtattccactgtatagatgtaccactgtttaaccattcactaattgatgaccatttggattgttgccattttttgattaggaataaaactgttacaagcattgggttttgacgttatattttcttgctttatcaacatgatttgtttttgtcaactttgtaatcttttaacaggcatgcctttttaaaatttaacaagagattgctcttgatctttcccaaattgttctaagaatctaggcttagaaggtccttgagtatatctttaatggcatcccagggatacaaacagttcaaagcaaactaaagcttcttaagcaatgtctttcctacagtatatcttcaatgtatccagcagaatgatcttttagaaatacatatctgatcataggatgctacttcttagtgaactctaatgattctataaaatcatttagatgacagctcctttttactgagtgtttgcagggcctaacattgtgccaaatatgttcatgcattacatgactcaatcattagtgaagccttatgagataggctacacggtggcagagctgaatttgaaccctgacggtgtgcaaatatcttagaatggaatttaaggctctttacatttgaatccagccactctcaaaagagcaaaattatttggaacttttttgtctacttcaagtgttttcacatctgtgtgcttctacacatgttgttccttctgtcttctacaccctgcctgccttttatatgttgttcaaactcagctcagatgctcatagtagcccacctgcataccatccccttgcccagacccagtctgctccaatacatgaatgactcagcattgaaatttaaacatttcttctttttctttctctatttcttcttgttctagtattcccattatgcctattttacaccttttgtagttccacagttcttggatattctgttccactttttttccattcttctctctccttccttttcttgttgggaagtttctattgacattatattcaaactcattggttctttcctcagctatgtagtctattaataagcccatcagaggcattattttatttctgttgcagtgtgttgattcctagcatttccttgagattatttttaagagcttccatctctctgcttacattacccatctactcttacatgatgtctactttttccatcagaattattaacattttaatcatacttattttaagttcccaatctgggaaatataaaatttctgccatatctgagtctgtttttttttaacttttattttaggttcaggggtacatgtgaaggtttgttacataggtaaacacgtgtcacaggggtttgttttacagattatttcatcacctaggtattaagcccagtatccaatagttatcttttctgctcctctccttccaccttcaagtagaccccagtgtctgttgttttcttctttgtgttcatatgttcttatcagttagctaccacttataagtgagaacatgtggtatgtggttttcattccctgcattagtttgctaaggacaatagcctccagctccatccatgttcccataaaagacttgatgtcattcttttttatgtctgcatagtgttccatggtgatatgtaccacattttctttatccaatctgtcattgatgggcatttaggttgattccgtgtctttgctattgtgaatagtgctgcagtgaacatttgtatgtatgtgtctttatggtagaattaatgatttatattcctctgggtatatacccagtaatagtattgctgggtcaaatggtatttctgttttgctctttgaggaatcgccatactgctttccacaatggttgaactaatttacattcccaccaacagtgtataagtgttcctttttctccacaacctcaccagcatctgttattttttgactttttagtaatagctatccgactagtatgagatagtatttcattgtggctttgatttgcatttctctaatgatcagtgatgtcgagcatttttttcatatgtttattggccacatgtatgtcttcttttgaaaagtgtatgttcatgtcctttgcccactttttaatggggttgtttatttttctcttggagatttgtttaagttccttatagatgctggatattagacctttgtcatatgcataatttgcaaaatttttctcccattctgtagattgcctgtttatattgttgaaagtttcttttgctatgcagaagttcttaagtttaattagaccctacttgtcaatttttgcttttgttgtgattgcttttggtgtctttgtcatgaaagttttgcctgtgtctatgtcctgaatgctgttgcctaggttatcttccagagtttttatagtttggggttctacatttaattcattaaaccattttgagttaatttttgtatatgatgtaaggaaggggttcaccttcaatcttctgcatatgactagccagttgtcccagcatcatttattgaaaagggagtcttttccccattgcttgtttttggcagctttgtcgaagatcagatggttatagatgtgttgtcttatttctggctctctattcttttccattagtctatgtgcctgtttttgtgctagcaccctgctattttagttgctgtacccctgtagtatagtttcaagtcatttaacgtgatgcctacagttttgttctgtttgctcagaattgccttgtctatttgggctgggctcttttttggttccttatgaatttcaagtcctgtgaagaatatcattggtaatttgataggaatagcattgaatctataaattgctttgggtagtagggctataataatattgattcttcctatccataagcatgggatgtttttccatttttttgcatcttctctgatttatttgaggagtgttttgtaattcttattgtaaagatctttcacctctctggttagctatacacctaggtattttattatttttgtgacaattgttaatgggactgcttttacaatttggctctcagtttgcctgttgttggtgtatgtgaatgctggtgattttatacattgatttaacatttttctcatattttcaactttttgatgtctgccttaatttcataccattcaacccagcaatcccattactgggtatattccagaggaatataaaagtgtataaatcaaactttgctgaaactttgctgaagttgtttatcagctgaaggagcttttgggctgagacaatggggttttctagatatagaatcatgttgtctgcaaacagagatagtttgacttcttctcttcctatttggatgccctttatttctttatcttgcctgattgccctggccagaacttccaatactacattgaataggagtggtgacagagagcatccttgtcttgtgccagttttcaagggggatgcttccagctttttcccattcagtatgatgttggctgtgggtttgccgtagatggttcttattattttcagatatgttcttcaatacatggggtattgatagtttttaacatgaaggggtgttgaattttaccaaaagcctttgctttgtctattgagataatcatgtggtttttgtctttagttctgtttatgtgatgaatcacatttattgatttgcatatgttgaaccaaccttgcatctcagggatgaagcctacttgatcatggtatattaactttagatgtgctgctggattttgtttgcaagtattttgttgaggatttctgcattgaagtacatcaaggatatcagcctgaagtttgttgttgtgtctctgtcaggttttattattagaacaatgctggtttcatagaatgagttggggaggagtccctcctcctcaattttttggaatagtttctgtaggaatggtaccagctcttattggtatgtctggtagaatttcgctatgaatccatcaagtcctgggcctttgtttttctttttggtggataggctatttattattgacacaattttttttcttttttttttttgagacggagtctctctcagtcacccaggctggagagcaatggtgtgatctcagctcgcttcaacctccgcctcctggattcaagcaattctcctatctcagcctccagggtagctgggattacaggtgcctgccaccgcacccagctaattttttgtattttagtagagatggggcttcaccatgttgcccagactgttctcgaactcctgagctcaggcaatccacctgcctcagcctcccaaagtgctaggattacaggcgtgagcgaccgtgcctggcctattgattcaatttcaaagcttattattagtttgtccagggattcaatttcttcctggctcagtcatggaaggttgtatgtgtctaggaagttacccatcacttctaggttttctaatttgtgtacatataggtgtttctagtagtttctgatgggggtttttatttctgtggggtcagcagtaacatttccttcatccaattgtgtttatttggatcttctctcttcttctttattagtctagctagtgggctatctatcttattaatgttttcaaaaaacttttgaatggttttttgtgtctcaatttccttcagttcagctgtaatttttgttatttcttgtcttctgctagtgttggagttgatttgttcttgcttctcactttcagttttgatgttaggttgttaatttgaaatctttctaactatttgatgtaggcattgagtgctgtgaatctccccttaacactgctctagctgtgtcccagagattctggtatattgtatctttgttctcattattttcaaggaacttgttaatttctgcctttatttcataaattacccacgagtcattccagagcatgttgtttaatttccatgtaattgcatggttttaagtgatttttcatagtcttaacttctatttttattacactgatctgagagtgtgtttggtatgattttggttcttttacatttgttgaggattgttttatgtccaattatgtggttggctttagagtatgtgccatgtaccaatgagaagaatatatattctgttgttttcaggtggagaggtctgtaaaggtctatgagatccatttggtccaatgttaagttcgggtcttgaatatctttgttaattttctgcttcgatgatctgtctaatactcagtggggtgttgaagtctcccactattattgtgttggagtctatgtatctttgtaggtctctaagaacttgctttatgaatctgggttcccccgtggtgggcgcatatatatttaggatagttaggtcttgttaaattaaacccatcatcattatgtaatacccttttctatattttaatctttgttggtttgaaatctgctttgtctgaaattagaattgcaacccctgctttttttctgttttccatttgcttggtagattttccttcacctttattttgagcctatgaatatcattacatgtgagatgggtcttttgaagacagcatacaattgggtcttgcgtttttatccagcttgccactctgtgccttttaagtaaggcatttagctcttctacattcaagattagtattaatacgtttggatttgatcccgtcattgtgctgttggctggttattatgttggcttgtttatctggttgctttacagtgacactggtctgtgtgtttaagtgtgtttttgtattagctggcagtggtcttttctttctatatttattgttattttcaagatctcctgtaaggcagttctggtggtaatgaattccctaaacatttgcttatctgaaaaggatcttatttctccttcatttaggaagcttcatttggttgggtatgaaattcttggttgaagattttttttctttaagaatgttgaatataggcccccaatctcttctggcttgtagagtttcagctgggaggtctgctgttagcctgatggtgttccctttgtaggtgacctgccctttctctctagctgcctttaacattctttctttcactttgaccttggaaaatctgacaattatgtatcttggggatgatcttcttgtgtagaatcttgcaagagttttctgtatttcctgaatttgattcttggcctctttagcaaagttggggaagttttcatgaacgatatcctgaaatacgttttccaagttgtttgctttctcctctcttctttcagggatgccagtgattcatagatttggcctctttacataatcccatatttcttgcatgttttgttcattcctttttattctctttatttttgtctgactgtcttaattcagagaatcagtcttcaagttctgagattctttcctcagcttgctttattctgctattaatacttgtgattacattatgaaattcttgtattgtgttatttagctctctcatacctgttaggttcattcttataccagctattttgtccttcagctcctgtatcgttttattgtgattttttcccttggattgggttttttcatcctcctcaatctcaatgatctttgttcctatccatattctgaattctatttctgtcattcctgccagttcagcctggttaagaactcttatgggagaactcatgcatttgtttgtaggacatacaacactctgaccatttgagttactggagttcttgcgttggttctttctcatctctgcctgtggatgttcctttaactgcagtgtagattgagtacagtcaataggtgtttctggatgttttcactgggctgaggctttgtgcatggtctttatttgaagcttacttcctgtctctggtttcagagggggggtatgttaatgaagtatttttaatgttgaagatttagggtgtgatccagcaggtggcacataggcttattggtcagttggtacactcttgctcagttgtgtggctttcctatgtttcctcacatttggagccctgttccctctcaatgctctgaaggtgtggcttcctctctcctttgagtgctggctgtagattgcaacttggcactactgggcttctcatagtagctctggggtgatctcagtgttttatgttttttccccaacttggaagcagcagaggaagggaccttagtagtggttgtggccaaggatcatttgcttgtctcctgggagctccactcgagagaggtgcaggtcagcaatggcttagtgcaatcagcccaggatgaagggcctgtgctgtgggtccaagccaagacttccatgtctggtgacaagttgtaggggatgtgtgggacctgtgggagatggactggcctcctctccttgggtcaactgcagcttgctggtggtgtggttaaggtacttaggatatttcctccgtagtctgagggtagcaagggccgttccactacagaggtagtggcacagaggttttcagttgtccttggagactctgtccaggaagttgctaagttgcctggaggacctgcccggtaaggagatatgggaataggcacccacataacagtctggtcagtttttcttagggctgctgtagtatgctggaggcctgctttagtcagtagtcaccttgaattttctagtacctggaggtatcactagtggaggctacaaaacagcaaagatggcagcctgcctctccctccgggagcttcatccccgggagatatggacctgttgctagcccaaagtcacctgaaggaggtgggtggagaccctggttggaaggtcccactcagtgaggaggaatgggattggggacctgcttaaaaaagaagactggctacattttggtagagcagctctgctgtgctgggggtctgttctagcccctggttgccttgggcactccaaagccccaaagttggaacagctaagtttcccaaacagcaaggatgacggcccagccctccttctgagagcttcatcccagggaggttaaaaatctctgttagccagagaacaccaacaggggtggctggaggcccagtttgggaggtcccgcccagtgagtaggaaagggattggggactcactgaaagaagcagtctcgccacattttagtagagcagctgttttttgctggggaatcccttctgcccctggtcagctcagactctccaaagcctgaaggttgaaatggctaggtcacccaaacagcaacgatggtggcccacccctccctcttggatctccttcctgggaaagttacaaatctctgttggttggaaaataccagcaggggtggctgcaggcccagtctgggaggtcccgtccagtgaggaggagtaggatcggggatccacttaaagaagcagtctagccacgttttggtagagcagctgtgctgtgctgggagatcccttccaccactggtcagcttagactctccaaagcctgaaggctggaatggctaagtcacccaaacagcaaagattccccctgcccccggccctgggagctcctttttagggaggtgcaatgcccctaccggtggctagctggaattccaagtcttgttctgttaggtgctgtggacatggggcctgaaggctattgctgctcagccccctgggttcagcctctttcctaggggtatgtttggaggtctaaccttccactttgccagagctgcagctaccctttctggaaagcccaagtatataagactccagggtctcctcacatgcttgagtggctgctctgccaaggctccacatagctctgtctgttagactgaaggccctggtggagtgggttcatatggagatctgctgatctgagggttgcaaagatccgtgggagaaggtggtttcctgtggtcacacattcactcaccacttctctgcacaggggaggttctcctggctccatgttgcttccaggtgggccgtcatcctgtcttgcttttcttcattctccacaggtcaagttgttttcttgattagtcccaatgtgagtacctggatgtttcagttgaaggtattgtatttactcgccccttcttttcctctatgggccacacatgctagctgcttctagtcagccatcctggccacttcatatcttagtctatttctgatgcttgctctctcttcaggctgtttttttgtttgtttgtttgtttgtttgtttgttttgttttttgagttggtgtaccttgtaatttttcgttgaaacccagacatgatgtactgactgggtaaaaaggaactgagataaataggcctttagtgtgaggtttttagatttttctggctaagagtaaggctgtttttactgttttctataactgttggtgttagaggctacagttctttctggtgtccttgtttttcactcttctattgtctttgggtttccctagagacttcttaaataagatgtgagttgtgcagttctttaaactgtgatgccctattattagacaggagtcctaattgatgtgttggtaagatacagggtgagagtaagtgctatataatattatgactaggtctcagtgttttagtgaaccttgtctctgaactgtgaccacaagtgcttctcagcttctctcccacccactacttgagacaggaaggctagaagggctagagctggctttttttcttcttccacttcaaaggctaaaaggagctagagttggatagtttccttctccatgtcaaaagctagaaaagggtaaagagttcataccagttgctggctcgtgcagctgcttctgctcccagtgagctgtgattctctatattctcctgtctctccagtttttggggtagtagttttctttgtgacctcagttatctgatggatctgaaaatggttattgatgttcagtttgtttggcttttttcttgttgtgaggatagtattgatgacttctaagccctttacatgtcagactagaaaccagaagttaatctcagccttagaatgataactttaggttaaagtgttgtctctagactgctatagaaaattgagtcacattaactcctgatgatcattaatatatcataacacatgtataacctgaaagcaaagtactaaaagtaataaaaataatagactaatagttaatatttattgagtagttttagcatgtgatgccctatattacagggcatttacatatatcacctcagttaatctttataatcaccccaattggtaaatattatcaccacctgttttttttaaataggtgaagcaactgaagcttagattgatttagtagcatgctcaaaaacatactacttggaattctaatcaaagtgtttagtctagaacttatattcttaaccactgtgggctaccaatatcaacattaatactgtgaagatagaaagttggagaaacagagcttggaagggaagggctccttgtagttggttatcctaggcctttggagtagagataggctgaaaaggacaaggttcatacctaatttgcaatcgtactcctaattgtctcttccatctttaaactgcagacagttcagtttccctaaagatttttttttttcttttgagatggagtttcgctcttgttgcccaggctggagtgcaatggtgcaatcttggctcattgcaacctctgcctcctgggttcaagcgattctcctgcctcagcctcccgagtagctgggtttacaggcatgcaccaccacgcccaggtaattttgtatttttagtagagacggtgtttctccatgttgatcaggctggtctcgaactcctgacctcatgtgatccacccgcctcggcctcccaaagtgctaggattacaggcatgagtcactgcgcctggccccctaaagatttttaagcagatgtttagatgccctgtgggagaatacagtctccaggggaaaggagaaaagttgcctaaggggtggatgttgggtattcaaacaaaggtgtttgaggactagaggttacatggttagtttatggtcgcatagctgctttgtgcttaaacctcagaatcagaagaaatattgaaatcaatcttcctgatgttcttgccatgaagaatgaatcatgtgctctgaatggcactaaagtaaccacaaccaccaaatcaaatggatttaaaaaacacctgtaggtatgatgatgatatctcagaagtagactatgaatacagtggtaaatatttcaggttggaaactccaagatccaaatgtagctggcaacaggttactttagggttcttagtaaacagatatctcagttgtgcattctgggctttcaacccagcaactactggcacgggacatttgccacctaggaaggtggggagggagaggaaaaaagctgggctttaagtgttgacattatgttgactgggtaaggatgtcctgcaacaaactactctatgaggggatagcaaggccacaaaacggatctgattgttgaacttaagcaactctagcaagacgggctctcagcaaaattttcaagttgttcaggtttaatagtcccagggacaataaatagtagggggattacacagtgagttcagtattagggaactgctcaaatttgagcctttggtggtttgtcctggcctcagacaaccatcttgagacttgacctatgcacttcaaattctttgcctagtatgttgctataattaaacacagctggagcagtggggtatggtgatattctttggctgtgtctgtactcagatctcatcttgaattgtagttcccataatccccatgtgtcatgggagggaccaggtggagataattgaatcatggggatggtttcccccatcctgttctcatgatagtgagtgagttctcaggagatctgatggttttataaggggcttctccttttgctgggcactcattctctctcctgccaccctgtgaagaggtgccttcctccatgattgtaagtttcctgaagcatccccagccatgcagaactgtgagtcaattaagcctcttttctttattaattacccagtcttgggtatttcttcatagcagcatgagaacagactaatacatatggcaatactgtctgttcattaggaagttagtgagcaggagagaagtaatgacagcagtaagcctagcagccagcagcttactgggagaaagagtgccaataatggaaccaagagcctggaagacttctgagagtctatataggcatccagactgaggtagaatagccaacaaagtaactttgcaaaaggcgtattagtggaggcaggatgggaacctttagaaattgtctgtgttgtatgaccactccttatggtgctgcccaacaagaatgtaatgaataaacctgcaagcctctggattctggctgctcacatggtagtgaatattattcccataagcaaatttgctgaagatgacagaacttgggggagccccacattttaacctagagatgtcttaccctaaagccagtttgccttttcatctacactacattgtctctagagggatgttggtgacctgaagacaacattttcttatgccacagttaaaaaaaaataaagatcctctattggatacaaagaaccttttataaggctagatggcagcttggaaaacacatagggctatctcgatcattcccaaagaacatataaagattccaagctgttcttcatcaggagttattttataattcctatacactctttagtttttacttcctggggaaaaaaagcaaaacagtgagcagagaaaatgaaaattgttagaattaattgcatatggactttccctaaaatgacataagaaaatgacaccatttgtctttgaatgagtgtgtgggcttatttgcccacccccaccactgttgtgtgaaagcgcagcagctcagttttcattttcctttcctctcaaaatgcccagagggaccatatttttgtttaatgaccttcagaatgattctttagaaatctgaggctatcagagttggaaacaatgcgaaaataattgtggattattattgtatgacggcagtggcagctgggctgtttctttttctctgtgttcagactttcttcttcattttcccagaaaccttatatcccaaggtttaactcagaagcaaatctcagataggtgataaaccttgccagacatggtatgtaatataatttcagacaggcccttaactgttcttcaggaagaccctagggagtgaagcagccttatatctacatgctctcaatagtattacttttatttactctctgacaatgtgtgtgggtagttgtattgaacataaagcaagcatatctcttaaatattatacttgtgaattaaagcaccagtttgtgtgttttgttgtcaaaattcctgctaacatgaaagaaaaaaaatgttatgaaaaaaatgggtactcgctgtctcagatcacttacacacacacacacgtacacacacatacacatgaacacaaacacacaagcactcacagctggggattgagagtcagcacagattctaactttacatgaatgtttaagatatgcgtatggaggcaggggtgaggagtggtagatgcagatgttgtatacaccatagtggggaaagtaaaaagtgctctcaactattgttcacatcatctacctcaaaatcaatttatttattgccttaactgacagaatttacatgataaaatactttttttttttttgagacagagtctcattcttgtcacccagaatagagtgcagtggcgtgatctcggctcactgcaaactctgcctcctggattcaagagattcttctgcctcagcctctcaagtagctgggattacaggcacatgacaccacgcccagctaatttttgtatttttagtagagacagggttttaccatgttggccaggctggtctcaaactcctgacctcaagtgatccgcctgcctcagcctcccaaagtgctgggattacaggcgtgagccaccgtgcctggcaataaaatattttttgccttgaatattcagcactccctaacagctatcccctacgccttgactgatgtttgtacagcattcggctaccactttggtagaacatttgaggcgaatgatagccagaatggggcaatatctaataagtagtctgaaaaaaaattcctaaaagacaaagataattgcctgaatattcttacatacttggatattgttatatccttgtcactttctggaaaagtattaaacattcctttctagagaagtccaatcttggtagcaagattccctcacattcctatcaggagagtaagataattggcttcaaaacccaaaacttgttctgtggttatatatcactgaactcagaaagtaagtggatgatttctccaggctgttactataacaaagcgtgtcctcattttacctagctatgtttctagagaagtccttaattttttatattccttccctctctacccccacatggatttcttgattacaagaagggagattctggagtactagtattagtttttataataaggagtaattaatgaaacaattgtaaacttcattgccaatataaaatcctattatgaaagattaataatgcctaagactcccctggagtatactaagtggctaagtgaaccatgtcctcttaggactcttaggaaatatccttgtcaaatagaaggaaccaggacattataataatatttagtgactgttaaggttctgctatacctctcttgtaattggggagcctctatgctattctatttatttttttcagaatgcctctaaagacttcttgctcttggggtcaggcctttgaagtggtttgtagtgcagtagttgtgatattagaattggatacaataggacacatttgtgatttttcttggtcattgacttaactccttagttacatattttgaaaacgaaagagaataatacaaaaaagtaaaagtactaacttgctggtactgagatgtagtctgtgaaattctattttttgcttacttgcaaatattttatctgcaggaatgcaagccaaaaatgtggagaagcataataatacagaaaggaaatgctcttctgatccaagaagttcaagaagaagatggaggaaattacacatgtgaacttaaatatgaaggaaaacttgtaagacgaacaactgaattgaaagttacaggtaggaatcagttctacaaaattacggcaaatgagattttaagtataatttggtttgggaagcaagagttttgttcaaagagtcaactttctgtgaatttagaattgcctgcaaatcaaatagttgagaaacttgctattaataagttgtactgagtaaaagcaatatatggaatatgaaaaaagagtttagagaacaagggcctagttgctgtgtgtctgttctctgtctttatgaaaggttctgaactcttcaaggtatcattattactaaacatctcagaaaatatatagtggagccaatctagaatgttgacttaacccatttgtggaatctccttgtaggtgaaggctgattttagaatgagaatctgttagatttttggaatgaaatcttcttagactgcatccaaaatatcatttatacaaaattctccataagtgagtgatgttattgtgagcttctagtgattcttagagcaactccaaatgaagaacatgcatgtgtgttttaaatctgaagtacaaacaaaatgtaaactagtggaaggataaactcagaatattcttacttgttagagaattttaggaagtaattttcagagacataagacagaatctaataccaaaaagatatcccttacaatgaatgtgatggaacctgagaaactgtatgacaaaaaaatctacttactattgctcacaaacaaatcttgactaattttcctattattatatctgtcatgtgtattttaatctcatatatggaacctaaaaaaaagttgaatgtgttgcaaaagagagtagaaaaatggatacgggacagagagtggggaataaggagtgtaggtcaaaaggtgcatacaaagttgcagttatataggatgaataagtctagtgatttaatgtacagcatgtagttaataatgttgtatgctgaggccagcgcagtggttcatgcctgtaatcaatcccagcactttgggaggccaaggcaggtggatcacttgaggtcaggagtttgagaccagcctgaccaacatggggaaaccctgtctctactaaaaaaaaaaaaaaaattagccaggcgtggtggcatgtgccgataatcccagctactagggaggctgagacaggagagttgcttgacacaggaggcagagtttgcagtgagctgaaatcacgccacttcactccagcctaggcaacagagcaagactctgtctcaaaaatgaaaaataaatataatattgcatgttgaaaatttgctaagagataaattttaggtgctcttaccacaaaaataaacatatgaggagattgatatgctaatttgtttggactgtggtaatcagtttgctatgtatatgtataaacaaaaaacatcttgttgtataaccttaaatataaacaattaaaaaagtatgtgtgtgtgtgtttgtatgtatacacatacatatttctattgtggataatatccaagccatgataaacttcaaaattacctagacaattgcaatattgattgcattaattgacttatgattaatgtacttgggcattacttgtttaaccatctaatgccaacatcagccagttggttaatttataacatactctttctaatgttagcaatacattttttcttctattttatttttgtttaaaaaggttcaaaaaggtctggatgacctttttgagatagtgttaaaatcagtcaactaattaatacttgctgagttaagttgattgctacaacccatatatttaatttggtttttgatccttgagattcattgtttttgtctttttcaaaattctaaatgttagcacagggaacacaaaatatatatttttaataaactaatatataatatacatatatattacttcactctctgtactaataaatgatagttttacttcttagtttgattttgtagagtgccttctatgaaagtttaaaaattcttttgattagaattgcatgttcttttccctatgagctttcaaaataactaccatattgggccaattccaaatagcaaagatctgcttttgattagtttctgatttcttcaacatgaactagacttccctgcctcatttatggcagaaaattcaatcatgggcagttgtacattattaataagtgacctgaccatgcacaaagcgtcgcagcatcatcactttggccacagtcactaatccttatgagaggcttgcagagcacttccattttggatcatttgctgaatcttgtaacattatagtatttggcttgagtttcaagttgaaccagaataaagtaaatacgaaacctccttttcactcacatcaaatgggttctgttgacaacgcatttgcttctttcatttcattttagattctggaaaagagagctagagctacttattttgtatattttataagatgttagtttacttgttttaactacagatctaaaatttcacttgaatacctcgcagaggatctcaaaatttaatgtgcatcagaatcatgtaaagggacccagataggatgaagatgaagatctctaaatacagatcctcagatttctcccttagattctaatttagtacatcagtaagactaggaatttacctttttgtccaggtgattctgttttatgctttccaaggatcatgtttttgagagacactagagaagagaatggtgctaacaagtcaaagtcataggtttgattattttgtgagtatgttagttcacacatgcacacacacacactgatttttataggccccaatttgtttcctttaaatttctaggaactgccatgaaaatagagatcatggtaaccaaggaaaatgtgtcaaggtagtgtgtgggtaaaagcgacttcaactagggaaagcaatcatttattcacttaccacttaaataaatatttactgagtacatgttacatgccaggcaacaagctaggagctggaaaagataattcagaatttgtttatgattatccttgggtcagtggtcgtcattcatataagaaagtatcatatttgtgtatttattcacacagttcaaatgttatgcttgatgtagaaacaaaatggctacttggtatggaagttcaagagtttgctctgtgaaggtttattcttttttggaacattatataacttataccatgctttgtatgctcaataatatgaaaacaattaacaagcagattgtcttctcataattcaaaatataaggctaggattatttaaagagtaaccactcatacttgttttgggtttagcatgggataagaatttcaatatgacatgaatagaggtggttaattacaaaattatgtaaatagaggttctttaaatggtgtatttcccttatgcaaattttgaaagattgtcaaatttctaaagcttattttctgactattctttttaaatttatgattctgagaaatataacttcagtaaaacaagtgtttcttaaaggtacataggtgctatttgctttaagaaggtcaaatataaaaagatccagatattcaaaactgataaactagaaggttatcatttgctttaatgaaataatttctccatatatgtcatagtatttctttagatagttagctttctttctgcattaaaacaggatttgatttaaatgcaacttttctggaacacttttattatataaatcgtagcagacttttgttatattattgtggaaatttctttttattccttcaaaggctgcagatgcatagggaagggtttaacaacaaatagacgtgcacagtagcatgtttaggtcatttgctaatgatgcctacagcgacagttttatttcccacagcatattttaggtgactatatgctattttaaagtttttttctttattctcatgttgaatttgtgcggagggttaattgaagtgaaaaagtaagacaggagagttggttataagaaggtgagaactgtagtacaggtgataatggaaaaagaagaggagtaggagagagtgagcaacataatgggatagagtctctagggataagaagagaaagtctgccttaagaaggtcaaaggcagtatggccattttcacgatattgattcttcctacccatgagcatggaatgttcttccatttgtttgtatcctcttttatttcctcgagcagtggtttgtagttctccttgaagaggtccttcacatcccttgtaagttggattcctaggtattttattccctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcgtctgcaaacagggatgaaattggaaatcatcattctcagtaaactatcgcaagaacaaaaaaccaaacaccgcatattctcactcataggtgggaattgaacaatgagatcacatggacacaggaaggggaatatcacactctggggactgtggtggggtggggggaggggggactgatagcattgggagatatacctaatgctagatgacgagttagtgggtgcagcgcaccagcatggcacatgtatacatatgtaactaacctgcacaatgtgcacatgtaccctaaaacttaaagtataataaaaaaaaaagaaggtcaaaggcagacattacttatagggattcttcaaaatggacacaagaaggaagccagaactaattatctttatttggaaggcaattcaccattcacctggcaaatcattcagaaatacatgcttttatgcagctttttagacatgagcattagctacttagaagaaaccactaacctgtttcctggtgaatatgcaaacaacacctctcctcctgattattgtagacagctctagagtccctggttggagacttttcacacattaggggtaatctcttaacccattggcatttgaatatgatggcaagaaggatttattccttgaaaatacttcaaagatttgctgctagattactattcagcaatagtagcaaagcaatctggatataaagcttggggtaaaactaccaagtaggatttgggatcagtctttggtgaatatgttcaaacgcatggctttagcaaatgcttttaattccactttgcaaagtttaattgtagtgccttgttgcaggtgtcatttagattacatagcttgttagaaaaactttcctctggtgtggaaaatggcagctatttacacacagaggaagcaatttcacattcaggctggaaaacacactttttgtggtcctggctcttagtttatttatccttctactgttaatgctgagattttgcaggggagggtgagtttagaaaaaaacagtggaacatagcaatatggtggagagttggtgaaataaatagtagcggggattttgactgaataaagataatataacagatgtaatctctaagccagcaactccataataatcataaaaagggctcccagagagcttttatctattgagagctcactgtgcaacatacattgcgtttagagattttcattcattttctcatttagtcctcacaaccaacatatgagggtggtgttggggctcagaaaacaatacttcaaaatgaaggactcataagcaagtttgtctttgaccttttcctgccctcctgtctctcagtcccattctccccaccctccccggaggctagccatagaaactggaatccctcttccccaaagcaggtcatagaaaccagaacccctttcctgcaaagccagccataaaacctaaaaatattactctaactttctctccacttctctgtgtgaaaactggccacaaagaagttatttgacctaccttgtttaactataggtcataaggtccccattccagagagggtcctggaaggaatgtgtgctcagagaagcccagaagaatctagacagacaggccttgctggttttccccactcagctcattagcattagatcatagtctttttatcaaatcatatgcctacatggctgtccattctttgctgaacctaagcataaaaatgggcaattttccctgtatctttgggtcttcattctgaaggctcctgtgtatacagtgtatacatgttagataaatgtatatgcttttctccaattattctgcttttgtgagttgatttttcagcaaatcttcagagggccaaggggaattttctgcctgggcccctatggtggttactattattgtcccaatttatagagaaataaactaaaacttaggtgaaatgatgtacccaaagtcacatactcaggaaatggcagaacacagatataaacctaggtctttccaattctcagatgtagctttttaatcaccaccaggcaaaaaactgcatgatttcactcaccaaatgtgtattgcatacctagagaacataaaccaaaatattggacacgatgtctatcattccactataatatcctttttggacattcacaatttggtcttcaataattccctattagaatttagatatccataaaaaaagcacacttggcattttgaacttagtccttagctcttagcactttagttaagatcgttaggagtagggccaataattgaatctgcatgtggtatggtgccaggaaaaaagcaaggaaaagtgaggctccagaaaaattaagaatgcatgaaacatggtaaattgttactgaattttgtgttttgatgccatatggccctactagtatgataatttatattgagaatattccaatgatgttcattgcagttatgactatgatttcaagctagtggaagtgaagcaatggatgaatgtctagttaaacaatgttggctcagttggtaaagatcaatcaacacataaatcagtgcctactgtgtacagtaagaagttcaggatccaagtttgtaatgttgttctgaaagcagacaggtagggacagaagtgtgttctcctttggaacctgtgaaaagagagttattcactagaatagtgcttctcaaattgtattttgtggaaccctgattctaagaaatgttaagagagagatttccaagagagaaagaagaggaaaggagaggagaggaagaaaggagaggaagagagaagagtggggaagggagaagagagtttctgtagttatttgtgtatctgccaggtcaaagttaaacagtcatcttttttgcagggtatctcagggcaccttagtgcccataatatctaatgtgtactctaattttctaaaagggggttggagcccaggtgtggtggctcatgccagtaatcctagaactttgagaggctgaggtgggtggattgcttgaggtcaggagttcaagactagcctgaccaacatgatgaaaccccatctctactaaaaatacaaaaattagctggctgtggtggtgtgcacctgtagtcccagctacttgggaggcagaggcaagagaaaaacttgaactcgggaggtggaggttacagggaactgagatcaggccactgcactctagcctgggttacagagtgagactccatctcaaaaaaaaaaagcggtgggggaatgggatatatttttaggacatttcctaaacttgtatgaacacataatattcccagcccccaaagcatctgaggatgttaagtttccacagaacaaactttaggaaagctaagtgaataattgagtgagtatctggctctattggcctcctgctaatgcctataacatcaacagttgaaataaaatacttatttggcatttaggttatgattagtatcacttattttttccattgtttattttttcaaccatcctgtaagctccttaagggaatggatttgttgactaattaatatctacatctataagtgctgagtatatgataggtattcaaaaattatttgtagcttgctttggctgagtgcttatttgattggtaagtgttttgattgggtacaaataagacaactttgtgtttgtagagcatcttataatttcaaagcactttcacttctgggatctcattctgttacaagaactttatggaattgtcagcaaatgtagtattattattattaatcttggctgagagagtttaaaacaatgaccctaggatataagctggtgaattgcacagctaggactagaatccccatcttataagtcctagttacacttttcctactctgccccactgttactctgtttgctgtcccttaatcctgggtactaggccagaagaagagatgcaactcaaggaggattccaaagttggtgactccagagctcaggcctaagaatctctgaaataaccttttatttaaaatgttggtataccaatccattgttttgtcttttggaataactatttctgattctaaaaggaaaacgatttactactgatgtctgaaaccaaatcagcagaggtagccgctaacaatactcaaatgcggccaggcacggtggctcacgcctgtaatcccaccactttgggagaccgggatgggcggatcacctgaggttgggagtttgagaccagcctgaccaacatggagaaaccccatctctactaagaaaaatataaaattagccaggcgtggtggcgaatgcctgtggtcccagctacttgggaggctgaggcaggagaattgcttgaacctgggagttggaggttgtggtgagccgagattgtgccattgcactccagcctgggcaacaagagagtaactccaactcaaacaaaacaaaacaaaaataatactcaaatgcttccagcagccaggcaggtcatgtccacagtgtgaggtggaccaggtgtgtgaagcaacaactgaaggaaaaattggagagtactagctgtactgactcaaccctagctgattgctgccatgtgagattgagaatccaatattactaggccctctgatttataagagacacctgaagtctggatttttgtgtggaaatccgtaaattgtaaagcactctgtagaccaaataaaacagcctgtatgctaaattcaacatggggactgcatgtttgtggcttttgcctttgaagatttggttcagtaggacttttattaaacaagcgactgactgtgtgactgactcagactctgttccactatttccatctctagcagtgagtggaaaaaaatttaaagaaagaaaacctgaagtggcctggagagcagttaaaagacaaactgggaacagcattcagaagccatcctaatcacaccatccagtagactagtcgatccaacaagagtgaaaggggcacaatttatggatgtaatactatgggacgggtattgacaaatggatcaccttagaaaagtgagtgatttagatgatgaagcaagttggtgtccagtattacagataaaggaagagccctggggatgaagcacccgccttaaagctgccctgaagcggtgtgatgtgaagcactgaagggaacaaatcattggcatatgttctctctcctccatgttcactatgagcaggcagttaacatgatctgaatgtacgtgtcctgattatcacatgaacatgtacctcatttgtaccttttgtgtgacctaataaggaacaaccacagcagtcaatagttcttggatgcattaagggaacattcacatgactgactgtgcatttcataattgactgttcttttgcacagtgcagaaatctcatgaccagcttgcagcagtttctttgtctttcctcctaggctttattctccttttctggatgaccctggcctttcctagcctacccagcccaccctggatgacatctttgtctcttatctgcctcttttaaatgtttcaatgacctgttttctctgcagctcatctcctcagatccttgctttctcctggggttaatctaatgtctcaatgagctaaaaaattcatgactgataaagaccaaaaatgcttctcttctcagctaacatatttgcaatttaatagatatttcaattctgtaactcataggcataactaatggtgggaatttctggggactttgcagggcctgtggggggcatttcccagagtgtcacaatctaccctgcaggtggctgcttgttccttctagaaacaaggtcaacaatattcatgaccttggggaactagaagaaaaaaaatcctactgaggatcactgaaaaaaaaagggccttggatgtcagtccatagagtgacttttttccttcttctgcatttttattttgtctctcctttctttcccttatttccttcattctgcctcaacctatgacacagggctatctattaaccctattgatgacaaccatggagagattgccagtctttgtcccaggaaagtttttgtatcatgtttctatgccctacagggagatgaacaaatactattaactttcccataagaagaaagacagtcttatttttctgtagagtcaggggctgtgagagcattcattcctgtgggcttattttgcaagcaactgtgcaggagaccagtttggatagctggggttgaacaagttagagcacatgacagcagtatatggcaaacgtgtgcaatccaggccagttctactccaatggctctcgtccatcacctaaggtgaccattgactccttggctgccttctctgacaccaagttagtgctgggggaagggattcttaggaaggggttacactgtgactcctagctatgtagtttcctgagatccatgggagcagattttcctaggtccattatgtatattcttgggagtctcagttaccttgttctctcccagcctgaaagcagtggtttgagcaagctgagaatattctatcaaggcacccttccataggaatgaaaactaggagcttggtacagagggagaccagccatgaactagatccaatagagtagagcagatgctcagagaactatcatttattaggtcaaggattatactttataatcagtcaaagcttctcacaacctcaaaaggctggtgattatttcctatattttataagggaagaaatgaacagtcagagaagctaagttacttgttatgatcacacaccatagtaagtgatggagctaggatttgaatccacgtttatttcaaaacattactcttaaagcaccctgttacaaattacctgaatgggtcctgctcaatacatgtcactagttctattccttcctgcttgcctgcctgcttcatgctttttccactcctctttgctactacatgttttacatttccgtaatttcctcgtgaagccatcacagactaacctcatcttataatcgcctattttttctcctgaattccctcaataattttgcaaaagttttcaccacattgcctgatactaatttatagtaataatttatgagagatcttctttgtgtagatcttgtagcaccaattacattagggctcttcaagatctgctgctccctatacaaagctttgccttactatttagatacaacataaaattatggaactaggagctaggctctgtgtttcataaatatcatctcatttgatcagctcagaatcctgtaaggtatgtcattttagccctgctttatagatgtggaaattgaaatttggggaatttaagtaatttttttctcaatgttctacagcaactaaatgataatggtggaataaagcctcaggtggttgtttttccaaagcctgagcccctcccactagtaaatgcttataaaattatctgctgcacacattactatgatatggtttgactggaacaatttttttattattttttgtttgtttgttttgttttgtttgagatggagtgtcgctctgtcaccaggctggagtgcagtggtgcgatctcggctcactgcaacctccgcctcctgggttcaaaaaactctcctgcctcagcctcccgagtagctgggactacaggcgtgcaccaccatgcccagctaatttttgtatttttagtaaagatggggtttcaccatgttgaccaggatggtctcgatctcttgacctcctgatcctcccgccttggcctcccaaagtgctgggattacaggcgtgagccaccacgcctggcccatcttagttatttcttgtcttttgccatgctcatggataggaagaatcaatatcatgaaaatggccatactgcccgaagtaatttatagattcaaggctattcccatcaagctaccactgactttcttcaaggaattggaaaaaaactaatttaaacttcatgtggaaccaaaaaagagcctgcatagccaagacaatcctgggtgagaagaacaaagctggaggcatcatgctacctgacttcaaactctactacaaggctacagtaacaaaaacagcatggtactggtgccaaaacagatatatagaccaatggaacagaacggtggcctcagaaataacaccacacatctacaatcatctgatcattgacaaacctgatgcaaacaagcaatggggaaaagattccctatttaataaatggtgttgggaaaactgcctagccacatgcagaaaactgaaactggactccttccttacaccttatacaaaaatcaactcaagatggatcaaagacttaaatgtaagacctaggaccataaaagtcctagaagcaaacatgggcaataccattcaggacatagacatgggcaaagacttcatgtctaaaacaccaaaagcaattgcaacaaaagccaaaatagacaaatggaatctaattaaactaaagagcttctgcacagcaaaagaagctatcatcagagtgaacaggcaacctacggaatgggagaaaatttttgcaatctatccatctgacaaagggctaatatccagaatctacaaataacttaaacaaatttacaagaaaaaaaaaacgcatcaaaaagttggcaaaggatatgaacagacacttctcaaaagaagacacttatgcagccaacagacatatgaagaaatgttcatcgtcactggtcattagagaaatgcaaatcaaaaccacaatgagataccatctcacaccagttagaatggtgatcattaaaaagtcaggaaacaacagatgctggagaggatgcagagaaataggaatgcttttacactcttggtgggagtgtaaattagttcaaccattgtggaagacagtgtggtgattctgcaaggatctagaactagaaataccatttgacccagccatcccattactgggtatatacccaaaggattataaatcattctactataaaggcacatgcgcccatgtttattgcagcactcttcacaatagcaaatacttggaactaacccaaatgtccagcaatgatagactggataaagaaaatgtggcacatgtacaccatggaatactgtgcagccataaaaaaggatgagttcatgtcctttgcagggacatggatgaagctggaaaccatcattctcagcaaattatcacaagaatagaaaaccaaacaccgcatgttctcactcataagtgggagttgaacaatgagaacacatggacatagggaggggaacatcacacaccggggacttttggggagtaggggtctaggggagggatagcattaggagaaatacctaatgtaggtaacgggttgatgggtgtggcaaaccaccatgccaggtgtatacctatgtaacaaaactgcccgttctgcacatgtaccccagaacttaaagtataatcataaaaaaatacttagtatgatgattgagaaatagtaggtacttaatacatcatattaattgcagtcatgcatgcataatgatatttttgtcaatgatggactgtatataaaacggtggtcccataagattataatactgtatttttactgtaccttttctatgtttagttatatttagatacacaaatccttaccattgtgttacaattgtctgtagtattcagtacactaacatgctgtacaggtttgtagcctaggagcaataggctatatcatatagcctaagtgtgtaggaggctataccatctaggtttggtaaggacaatctatgatacttataccatgatgaaatcacctaatgacacatttctcaaaatgtattcccattgttaagcaattcatgactatattataattagtattattatcatcatcattattattacaggaaagttttcaaaggtgagttcatggccatttcatgacaagaaagcagtctgacaaatggtctaagacaaattgctgttgttaatagggtgcttcatttacagagcttgaatggaaaaaaaatagaaagttaactagggggctattaaaaagcaaagagccatataaataggtattaatatttcaggcagaaatattttattcaaggagatgcaatcatgtggaataatttgtcaattaaggtggtcagggcaagtattgttgtctgtataaatgagtttttgcagccagcaagaattttaagggatgtatgagccaagagcaaaagctgctaagacaaagctgaggtggaaatgagtccggaggacaagcatgttgaggaaactggacttttcctgtctagcatttccttatgtcattatgattaatccctggtggtttataaaggcagttaaatggcctcctttggcatcaaataggaaaataattcatcagttcaagtctgtaaatcatttcttggtactggaagtactttatatagttagaaatgtctccatgatttgtcactgggctccagtggggatcctgaagagcaactggcaaccaccagatgcagaggcctatgtgatgagtctcatgggcatgggtctgcagggaaagaagattggttcctttctggggtacattgccttgatcctctctgactggcctggaggaataaccacttctgtgtctgtcatatagtagtcacttagtatgtttgttgaatgaatgaatttacatattttgtgtgttttgagtcctttgcattggagctcatcttacagtgtctgataactctctctagctatattctgggaaaatgagatagaagggcagtaataatgatgttttgaagctactgggtcagtaccctagttatttgcttaatgttgatggtcaagacatcatagtctcaccataaactgtagcataatagttgaatgaaaaataattgtgctgtaattttttatgataaaaggcattttaaatcacagtttaattacccaatcccccttgctcttaaaatcaacattttttgattttgttatccttacattttgtgctagtaaaattatcttcatgatgctatttaatttacctcctggcgagcatatgaggtgaaaggtaaaaaggacattttgggacaagtgaaaaaatatctaatgaagtggaaaccgttattcaccctcactccacatgtaatacatttgatattcttttaacattcatcaaatactcattgttctgggtaaatagataaactaaaaaaggtatgatgtctgtcctgagtgagcttgaagtataatgagaggggggagaatagacagagattaagtgaataaacatatggatacatgtataattatatattgcaatatatcattataaggaaaataacaaagactaattgagattggggatggcctacttgaacaaaataaagttgaggctggaccctgatggttaagaaaaagccatctagatgaagagcgggtgaaaaatattttagagggaacagcatgtgtcagctataaaagaaagatgatggtggcttgggtcagaagggtagtaatagaggtagtaaaaagtagacagatttaagagatattatagagatagaatgactatacttcctcatgatgattcctgggtttttggttttactaatagggtagacagtagtgctatttcctgaaatgaggaagactgagggaggtcagattttgtgaggggttacaaaagttctgttttggccatgttttagaaatacttattatatactctagaggggatgtagagtagacagttaaatatatgaatctggcattcagggaaaagtttgaactagatatataaaatttggagctgtctgtatggtatataggatgagctgcaataaagtactaaattgtgtggggcaattgatgattactataggagatcaatgcaaactgcagctcctaggccctatgttacatattttctccagaattgtgaacagtataagaaagctacttgtcatgattttttgaaacctcatcaaattgttaaatattaagcatgataattgtacctatattttttctgctatatggggatgatatcttgtatttagctgacatttgaatccttcagagctagaagaatataactaatgccacactaaatacagtcactatttatgatatgtgctgggtgccatattaatcattttacacacattattgctaatctttaccacagtactgaatagtacaggccccaatttatagataaaggaactcaaacttgagaagttacacaacttgcccaaggcaacaaagcaagttttggggggtcttttccccattccatttccacacattaggaaaagtgactctacatttccttttggattcttccaatttccaaagtctcttacaacccaaggaacagaaagaaatattgagatatgcacatttgctgctagatttccttgctattgaataaaagcctgtctgtaagtgtctggtgcacatgcacagcctgctgttgggatacccatcacttgttaactgcctgcctggactagcaactgtcttcaaaccctctgtataccatactgaattcttagttggaggtctgccaccaacaggagggcaactccctgtgtgtggtacaatgaagggagaataaagcctggtacatagttggctctcaataaatgatagctaatattattataattttctttatcttatgcaatgacgacttctcaaagtccctatgaaatatgtattattatcttactggtgaggaaatcaagactcagcaaggttaagtaacttgcccgggtcacacagctaatgaggaactgagttgggatttgaaggccactctctgattctgaaacttaagattcatgcatttctcaagtttaatgactgagtgaagccaggggtgtcattggagaatatcaagagataacgttagatagagaaagtaggtctaattactggagggccttgaatgtcaggaagaataattcatatacttagcctatttgggtatatgtgccacaaaagagctatgatttttcctcactgataaagaagttcgagtttttggacatcaggtacctgtttccaagctgaatgccctaacagctgtgagtaacacctgctccttgcacctgtgcaaactcagagacttaccttctctggtgctgattcgcataacattctttctcctattttctcattttaactcaactcaatgaagatcttctgagtatcttttctctgccaaggcactatgctagttgctgcttcactggttgttgggagcatgcagttaaatgtaatcacaccaactggcctgtataggtttgtgaggtggaaaagtctaggaagaaagatacttgagaaatagccaatgtctttttttggagcccctgcaagagaaagcataagtttatcctgtcctattaaccaaataatctctaatgattggagatgtctttttaaattaattaattaatttctacttgctgggaattctagctacacagacttttgatttagccagtaatattttcaaactataagtagcttaaaatgtggattagaactagaagggactttgaatagcatacagtctgattcccctcattctgtagatgaggtagcagaagcctggagagattaatttatgtgcccccaaagacacagcttggcagtaactaagttgatactttctccaatacaatggtgctttctgccactttctaatactccacagtgtctttctgacttagtcctgagccttgcctaggaggcttttttatgccaaatttaatcaatgttccattttaattgaaatatttaagtcagattaatgtaaagccttcagagagttctgctaatctggtttataaaagtcactcaggcaaaactgtgaaagtatataggatttctgacattttccagaagccattagcttatgttcttcaataactcttagaatatatgtcaaaggaggacaattttccaactaaccttggcacactccatatgtattcctttttggttggttcataaatcagttttctaattcaaagatgttttaatcctcaaaacatgcactcttccttaatgattgtatgcattacaatattaccccacaaactagtttatgaatattaaagtttattagtagggagataccaggaagcagaactgagaaaataactccagcagtctcccttgcttgaaaggaaatacgatggaatgaaaagggcacaggctttaaagtcagaaagacatggtttcaaattcttttcttaccatttaccccctggatgaccttggggagattattgaacccctttgagcctctacttcctcatctgtttgtatatctttgcttacagagctgttgggagaatttgagatgacagagtagatgatagctatttccactttgctattgtcattatgactgttatttactgttcctactactagtactattagaactactgctactactaccaccattaatctgctttgcagcctcaaaaaaaaaaaaacgaagatgctttatactactactatcaccattaatctactttgtatcctgcaaaaaaaatgagaatcagctgaagagcagaaaaaacttaagacagagtaagacaacgatagaacaaaacagccttttttttttttaaaaaaacaacttctattaacacattgccagccagaaagttcaaacaacctactgaataaagatagtaccttagtcaagttatggaaaatatatttttacaaatgaaattgttaagataataaccctttcattaaaccactctgtatattccatcaggacaggaatcatatctattttgcccttttgtattcctatcactttagtaaggtcttgacatagagttggagatgaaagaatatttgttgaatgaacaaataaaatccctaaaggtaaaaataagtattattcagctgctattgtttcttcattagtgtattcattaacctattgaaaaatatctgtgctcctattatatgataagcgttgtgctaagccctgggaatgaagtggtaaagaaaatcacgcacagttcttgtctttaagagcttaaaatctagtggagaaaacagcccttaaaccatcacacaaataagtatgaagttttaattgtgaaattgctatggcggaaagaaatgcatggactaaaataacatgtgttaggggaatttgacctaatcagtgagatcaggaaaggcttcttggaggaagtaaatcttaagcagagatataaagagtaagtgagcattaactaggaaagacagggaaggagaggcttttgggacaaaagggtcagcatgtgcaagcgtgccctgtagagggatcatggtgaataccaggagctaaaataaggccaactacagctggctggagtgaagtgaggaagcaagaaactagaataagcttaggctagaggggtaggtaagggacagacagtgcagagcctttgccacattcaagattttctcttcatcttaacagtaagaggaagacataaaagtgattttaaggaagggtgtgggtgtgacatcatcaaatagtttcagtgtggagaatgaattgaagagaagcctgaatagttatgcttgcactagtccaggctagaggtgatagtaacttggactagggtggaagttgtgactatagagaaaagtagatgcattttagggctagttagaaggtaaaatcaacaagacttggtgatggcttagatgtggagtatcagataaatagatgagtgtctcttaagtgatgattaggtttcttgcttgtctaattggaaggattgtggtaccttttagtgacaggtccgggtatgacaaggttcattcaatcacaaatctttatatgtgctactatgtatcaggcaccatgttaggtgttagaaattcaggaatttctaaattatggttcttatctacaagaagcccacagtctagtagggaagggagtacagaaaatcaacaagtagttacagtgcaacaatgagctagcttgatagaggaatgccaagagtgctatggaagcccagaggaggagaatcacctagcaaatgggcagagttgcagaactgtggggaaagccaaaaaagtggagttgggttattttggacttggtatgcaataatttgtcagacctgttcactagacattaaattttgaaagagaaagagtccttttttttccttcctcatctcctgcttagtgtaataagcaacctggttgtatattccatggctgagagtggagacaattcctgatgtcactggctgatttcaaaatctttgcagaactattcatatgttcctcttcctttacaagatataataggcttcagaaaagtggtgtgtaaatcatattggggtaaattaaatcctactttaaatgaactgagtcatttgctatctacttttgaaaaaaaaaaacagcattctctaattttttcacatatatttccatttaattcttcaagtttctttaaggcaataagggatccagtttcagctttctgcatatggctagccagttttctttaaggcagtgcccatttttttattgttttatttatataacttctaaatatattttacacatactttattttaaatcaactttattgaggtataatttacattcaataaaaatgtacccattaatgagttttgatgtataatatgtaccctaaaaatatgtgtagccctaaaaagttgcagtaaatctccttcaccccagtcccaggcaaccacctatctgctttttgacattaaatttgtcttggtggggctcacatttaatggcctccagtgaatattgtcgtgagcacatattaggggaaagccactttcttttatttcaattagaattcttatatcccaaccttaatgctataaagaaaatactgatcttatcatgcttgttttagtatgctttttggggttgttttggtggtggtttcacagagagaattcttgaaaagataatctgtgggggctacaaaattatgggccttgatttacaggcagtcagtcatttcctcactaactacgttaccattatgtattgatactctcttttttttgttaaaactgtcaatttttttaactttcgtaagtcagtgatagtatataggaatgggctcaggatttgccatgtagaccagagttcagactttaaggaacaaccaggaggctggagtggttggggcagagagagtagtggagagaaaattaggagatgaggtcagaaagatggtgatggtgggggatcagatcatgtagggctatgcaggccattgtaaagagtttggctttcactcttagatggaaagccattgaagggttttgaacagaggcttggcatggccaggtttattttacaaggagaactctggatattggatagaacatagactgaagggggcaaggactggagcagggagagcaatcaggaggctattgctatagtccagagggaagatgattatggcttaaaccagggtttagcagtgaaaggaattaaaagttgtagagttccagttatattttgaagatagaaccaacaagttttctgatatattgaacatggggtactagaataagtaataagtcacaggcaaatccagattttttggcctgtataactagaagtgtagagttgttgattaatgagatggggaagatggaatcaggagtttggttttggacatttgagatgcctcttagacatctaagtagaaatgttggatgggcagttggatatgtgagttcaagggagaagtctaccatggagaaataaatatgggagcgaacagcatgtaagttgtaagcaaatctatgatatcactgaagaatgtagatagaataggttcaagctctgagctgtgggtacatgccagcattagaggctggggagataagagagaaacagtaaggaagattgaggaggagtattcaatcaggcaaaggggaaaactaataggaagtaagtaaagatagtgctctcaagaggatgggagtgaaggactgtgttgaagctgttgattggtcatgttatttagaaacgtggtagttgctaattgacaggatcttgatctgacaggatccaatctgggttcctttcattatactgcattccttgttcaggttcttgtccttaagagtatctcttcactcctttacatagaatttactaacagcctgttgtgtgccaggcattgtcctagacactaaaacccaaagataaataagatatggtctctgcctttaggggatccatggtctagtagagagatgagatgcattaacaatgataatacagcatgtatagtgctatagtagagacacatacaaaatattatgggaacccagaactcatcttgggtgtaggtaggaggtggtgggagaaggcttttcaaaggagatgactggacagggatttcagtaatgagtaaaggtccactaaacaaaagtgcaacttatccagaaatactcacagagctgaaacatctgaacattatcttgaaaggtggattgtaatttatcaagtggacaagttgaagaaggactagagagaaagtcaagggccagataataattcagggtcttctgtattggaggagttgatggtgacaaattgggaagggggaagagaaaagaaggagtgaagcaaataacttctttattttctgcttggatgattgtgttggtagttatgctaaagtctcctaggttatcaaagttacagtattgagtctttcagaaggagtacaggtctcttcctcaaatttgttttgagttgagtgtcctgacactagacaggtgattactaaataactaggtgcctcacttacacttgatggagatagattttcttttaagtgaaccaagttcatggaatttcacttttctaataggaacatttctcttttgctaaggcaaaaatgggtcaagtgctgagacacatggctctgaagggccatcaaatgagatccacagctgggcccttagcccctcataaaggccatttctgcctatttaaagcctcctctaggcttgatcaaaatcaaaaccatttcaaaatgtaataaattattacattttgtgctgaattgctacttctcaaaatctcttacatagaacaggatgtttgagaattgagtttgttggaagttttgtaaaacattttgtgctttgtaaaacagaaatgaaaatattacaggacagatatattagagatatatctttttaatgacaaaagtcttttgtactgtctttaaatacttgtttactgttaatcaactatttgagagaaagggaggggaagcaaaagtgaaatttcagtgtgaaatttgtgtttcacaatttgtctcagaaactaaattgtaatgttttttaagcaatcataatggatttgtggcatttatgaaatgatcacaaaagtcatcaggaatatgataaccaattctcaaagtttgttattttgttcagagttaagtttttttgttttgttaagaattattgatgaagtcacttagctttattaaggaagtgaaaagaaaatttatgtcagtctttatttgtttttgaatatgtaatacccacacccagtagaagatccaaacaataaaaatatgtacattgaaaaaatctcctttctgcctccaactccttacctagatataatcatttttttcagtttcatggatatccttccataaatattctgttggatgtaatagtgattctaaaagtgtagcccaaggactcctagggcctcaaagaccttttcatgggttctacaagttcaaagctattttcctaataatacagttgaccctcaaaaaacacaattttgaactgcacaggtccaggtacatatggatttttttcaaccaaacatgaatagaaaatacagtattagtggaatatgaaactcacttatatggagcaccaacttttctaataagctggttcctcagggctaactgtgggacttgaatatgtgtggattttggcatatgcagggcgagataggggacagtcctggaatgaattccctgcatatactgagggacaactgtactaatgaaattaataatgatattaatatatatgatgttttgatattgaggtatcataaaatgtatcaacatttagaacatccatataactcaatgaagtagtattttccagataaccaatgtatgttgttatgaaattatgcatgtataaaagatccattcaaagagcaatatgggtcagtggattttaatgtagcaaggtatacaaagttaattgatatgatttcacacttggtcttagccaaaaggccaagatgcaataattgatatgatttcagattccacacttcagctaatccttaagaaactgccacttgttgtgtttggtatagtatcgaagaagatcatccacacttttttgaaaaggctgttaaaatacttccttattttccgactacttatctttgtgggactagattttcttcatatatttcaaataaaatgatatatcacaacaggttgaatgtagaatcagatatgataatttagttgtcttctgataagccaggcattaaacagattttcaaaaatataaaaacaataacactcttctcatggcctttttgcttttgcaaaatatagtttctgtgataaatatgttatgtaataaaatcatataattataattcattattttaagtaaattattaaatattttaaatccctcagttttaatttttaatatagtaaatacataacctatataaacaaaagcttcttagtattctctttaatttttaagagtgaaagcagtcctggccgggtgcagtggctcacacctgtaatcccagcactttgggaggccaaggcaggcggatcacaaggtcaggagttcaagaccagcctggccaatatggtgaaactccatctctactaaaaatacaaaaattatccgggcattgtggcaggcgcctgtagtcccagctactcgggagactgaggcaggagaatcgcttgaacccaggaggcggaggttgcagttgcagtaagccaagatcatgccactgcactccagcctaggcgacagagcacgactctgtccaaaaaaaaaaaaaaaaaaagagtgaaagcagtcctgagaccaaaatgttggccaactgctgatatattttaaaaagtgtacatttggttattttctctatcattctatttgtgtttatgtgtctatatttatttttatacacataggcagtgttcgtgcaactgtcctgtgacttggtttttgggatttaatattgtttgagcatcatttcatatcagtaatgatagatatttcacttttatgtgactgcatagtatcccatggtatacacatacagaattcctgaaaggagaattgctggatcaaaggttatatgctttttaaatttgataagactgccaatttgtcctacaatttatgctcccaccagcagtgactgagaatacccgtttccccaaatctttgtcagcagttttccctcaaatcttttgctgcttcctgagcatatagggaaaaaattatatctcattataggtttatttggtttatcttattatgattggtgttaagcatgttttcatataattcaatatggttatgttttacttttttgtaaaccatatgttttcacttctttaaagagaaccctcgcaccttggtacagataatctttcaatttctaaatataattctgaaaaaaaaataatgtgaaccttcaactttgaatggaatgaccttgagctaagtccctcaagctctaaggaccctttaagctgtgacattaagtctcaaaacaataacagatacatttgagctatacaagaagttagcttagcatgtttacaacatagtaattgaattgtttgtaatatgatttaactaaaagcagaaagttgagcaaaagcaatttgcaaacaatagatgataatgtaataagaaacatttatttctatatgtaaatgatgtgctgtttcctttacctgtcctttgtgaaaaacaatgaggaacgttatttctgtatctgtcaccatttcccacagttcagtggacaaagttcctcaagatcttccagtttccatttactagagctctgctttttttggagctgaggcaaggggaaatttccttatacttttatcaaaaaccttgaggttaataatcggagtgatttcagaaataagcctgttctgtaagagaatgggagtgtattagagttactatcatgcttaatataatgggacttcccattcaacatagatgtgaagattttataaaaatagccacagccacagaattgacatttgtgttttgagtcccttgttgcaatttagtcagcagagaaaaatacaacaaatgaaattttaagggtagaggaagagtcacagcaacacataagatggtcagggaagagcactgcctttcatggtctgtttgctgtggaacctcccataactaatttctgaaaagtaagccaaatgaaaaagtaaatggtttaacctttgtctctggttgacctgtttagctgactgtgtttgatgactgggaaaattttatttatttgaatacaatagtggagaagagtgaattgattaatcagtaaatcaatcagattttactaagtgcgtactatgtactcaaccctatgttagatgttgtataagatgtaatacctttttccagggaaagaacatgcagtggtaagtagttgttgagcacatttcaggcactattctaggtcctttacacatgttattgcatgtaatgttcacagtaaccttgtgaagaaggtgtagagtcagtactgttattcacacttaaggtcaaacaccctatagttctgtgtgtgggtgttgacatgattcagagtgaagccaagtaattagcagcagatacctcatggggtagatgggctagagtaggtatttttcgattggtgaagaaaaagaaaaattggtcaagacaaaggcaacaatatgagctcattatagaggaagggataagcagtatatgtttgtagaattaatctaacaagaacaagtgtgttaaggagttttggaaaatgagattggataggaagggtgaagctaagttatgaaggaccttgaaagccaggacatataatttgggcattttggactaggcagtacggaaccatgaaaggtttctgagcagaaaaggagtaacatatggaaaatgtttgtaggcagattactctggaagtggtaaatttggtggcagggtgactagacctgagattattgaaatagtttgatgtgaggtaggtgagtatctttttaaataaaagcatttaaaagaaacaggctactaaaagcatactttctctaggctttgaattatttgctttgggtcgaattgattagctcttggtagatgattagacaggtgtaaagtgaatcctgtgacctagacatcccaatcacttagactaaatctacggcaatatttttcaagccatgagttacatgacccattagtaggttataaatcagtgttgaaatttgcaaatagtgttttttaagtgaaatagaaaattgaatagagtagaaactttcaatgtgcctatagagtgataagaaaaagtgtgtttgtgaaaaattatttcagtcatttgtgttacatctgtgcatacatgcacattggctcatgatataaaatatatttattactatggcttgtggtaaaaaaaataagtctctgatctagagtatagcactgaattacttaatcctttttcctgccatgtaaattgtcaaagcttgcatgattgatttgaacattaagataaaaaccccaccacctagttcaggatgtctttacctttttcctggcccatttctaaccacccaaagtgatctgtttaccttcagtctttccataccaattcatcttatacccagctgccagatcagtctttctaagagtatttctcacatcatgtcattacctttgtccagaaaatacactggtcctcaatccatttatttaatattaatttagcaaatctcagttaagcacctaagaaatgaagtccacaatctttgtttagtcacatatgaaaattccttttaattcttacctcaaactgtatttccaactatgttagcaccacagagaccccatagatcagcttaattgtactacttactcttcctagaatatatgcatttttcactctactatacctttgttcatgctaatccccacttattgcccttgtcatcctttaaggccatgacttttataatcatctcagctggacataattagttcctcctctggacccacataatactttttgtcattcatgtgagactcatcacattctgtcttgcattatattagttgggtttattcccttttctagattataaactcttgagagtaagggtcacttcttgtttatgcctgcaatgttaacagtgctttgcaaaaggtagatggtcactatgcagctgccaaatcagtgaaaatgctgaattcatgacacagttctgtctttttctttcatttaagcagaatgacattatatagttcagcaaacaattttcccaatatttttcttagtatgactgacagcattagacagaatggaacagagcaaagagcactgggctaggaatcagaagacgttgacactagtcttggctctgtcaccaaaaaattctgtcacctttaatatgccatttgatctctctggttattttagcataaggcactcctcctttaaaaatacgggactgaaatgattaacttaaggttttttctaactctaaaaacattcatcttagattatttactgtgccagttgcattcactcagcagatacttattgagtccttactggggatatagcaatgatcaaaactaactatatgctttcatggacctgacattaaggtagtggagacaaataataaataaatgaaatgtaatatataatgtaaaatagtggtaagtgctaaaataaaaataaaacagggaaaagggatggagattggcaaggaaggtctctctgaagaggtgacatttgggcagagatctgtatgaggtgaaagatttggggagaagagcataccaggcagagggagctgctatgcaaaagccctgaggtcagaatgtgctttgcactttgggggaacaaataaaagtcagtgtgcttgagtcatagacagcaagaggttgagtaataaaagatgaggccagaaaagtagtaaaggactagatcatatgaaaccttttcaacggagtaaagagaatgttattctaagcacagtgaaaagccactggaagattttaagcggggtgttttagtccgttttcacactgctataaagatactaccaaggactgggtaatttataatgaaaagaggtttaattgactcagagttctgcatggctggggggtgcctcaggaaactacagtcatggcagggaggcgaaggggaggcaggcacctttcttcacaaagcagcaagagagcaagtgagagtggggagaagcgccagacacttatcaaacaaccagatctcatgagaactccttcactatcacaagaacagggtgggggaaactgccccaatgacccaattaccttccacctggttcctccctccacacctggggattataattccagatgagatttgggtaattacaattccaaatgagatttgggtagggacacagagccaaaccatatcatagggtagtgatatgatctacctactttgcatttaaaaatgatcgctctggctgttgtgtagagaatagatggcaagagtggaggccaggagactaattaggaagctgctaaaatattccctttaagagattatcattttctctatgtgtgtgtgtttctaaatagatttttgtcttttctttttaaaattttttaaaattttatttttaattgacaaaacttgtatgtatttttggtataaacatgtttatatatatgtgtgtgtatctacacacacacacatacattgtggaatgataaaatcaagccaattaacatatccatcacctcatatccttatcattttttgttatgagaacatttaaaatctattattttagcaattttcaagtatataatacattattactaactataaccaccatgctgtacgatagatctctggaacttagttctcttatctaactgaaactttgtaccctttaacgagcaaggagatgttgaatgattagactaaaatggtgacagtgaagatggagtgaagtgaatagattgggaatataatgtggagggagaatggacaagatttgttaatgaattgaatatggcagaggtgtaggaaaagcgggaattagagatgactcttatgtttgtcacctaatcaactgagggagatggtgataccatatactaagacggggagaatgaggaggaataagcttgagggttgaggctggagatttaaacaagagttcagtttgtgatataagtttaaaatgtctatttcagttttaaatgaagaaataaaagatatatatgaatatggagtttggagagaagtcaggagtggatatgcaatcttgagggcttttactatttaaatgacacttaaagccatgctactagatgagataacctcagaaatcattcaacattttcagactgggtaggaaaagagtcaacaaaagagaatgagaaagagtcgccaattaggtgaaagaaataccaggagtatgggtgtcactgaagccaaaagaagatactgttttgagttgaaggaagtgatcaactctagcaaatgctgctgagtttgaataagtggaagactaggaatagatcattgcatttggcaacatgtaggtcattgggcaccttgacacaagttaattttgatgtggtagaaaaaataggctaacagaagcaggttgtaaagagatggggaaaatgaggaaaaggggacaatgaatctataatgagaaatttttctgtgatggagaaatcgaggagttagctaaatgaagatatggggaatcaaataagcttttttgttgttataatacatataagatctctaaaaatatgttagatctgtttttaagctctactgaggtttaattgacatagaaaaaattgcatgtatttaatgtagacattttgatgagtttggacatatgcatgcttctactgtgatactgttcctataaccataatagttttattgcctgatgcacacagcaagtcagtacactgaaacatcaggttgtagcagagaaagaggtttcatcatagggtcactgaatggggaaatggaaaggaacctcaaattaatctccccaaggagtttggagctaggatttttaagtgtctcggagtgggctgaagtgtggagatcattgattggtcaaagagtacagggtgaagccatgggacagcaagatgaggaagctgtattctcatgctaatcttgttcctctgtgggggtcttcaaactggttgctggaatttgaggtttgaaaaacatcttaagccatcctcaaacaaaagccttaaaattctaatgtcagagatcctgtctataggaacaatggggatacaaatcaatttttaatttcctatgaccctaatgccagaaatcctacctataggaacaatggggtgcaaatggtcagttatctaatgctacatgacttttagcaacaaggaaatgagcaagagggcagcctgataaatgcttaactctaactatatttctgtttggaacgcggcatgcaattcttgtcaaccctgtaggaatgatttcagttctgctttgtcttgttaatcctctatcctgagctgtgatcaataaggagggaattgggtgatgacttctctggctgtgtcttgctgacaaggggcacagatagggaccataatcaggatttgaggaataaaactgctttgcagtggcctgtaaatggtcttgagtgccaagtctagagttttgactctgcatggcaaaaatgtcagttcttgttactagtccttgttgtctgtgggaaatagaaaagaaatacaacaataattataataaaaagaatttgtaaggaggcctgtattagggcattctcacattactataaagaaatacctgggggaaaaatacgtgagactagataatgtataaaaaaagttttaatttgctcatgattctgcaggctatacaggaagcataatgggttttgcttttgggaaggcctcaggaagcttccaatcatgtcagaaggcaaagtggagcaggtgtcttatatgacaggagcaggagcaagagagagggaggaggtgctacatatttctaaatagccagatcttgcaaaaactcactcactatcatgagaccagcacgaagaggatggtgctaaaccattcatgagaaattcaccccaatgatccaattacctcctaccaggccccaactccaacactggggattatatttcagtatgattttgggcagggacacagatctgaaccataaaagggaccaaaaccagtttcccattcccataagaagccagctaaaggatcattaagagggtttgtgacatacatctcttgccaaaatgccatatttgggggtataggtttctgagccccgacatcccctgtctgaaacttccctagaagtttcacacattaaaagctgagttggtggaaaaatttagtaagtagctgagtggcaaaggatcctagtaaaccagtctcccattcctggaataggccagttccattaaacagctgtatctcatttcaggagatggcattgcaggcaaactatagtttgtgtatcacaaagtatgcttgcagttactcaggaaaacagtagtagcaatttaattgagtataagtcagagaaatggaataaaaatttggtaatataagtttggagacatgcttagaaaagaattcaggattcaaactaaactgtagacaaataagaaaaactcaaaataatggacacagtatactaataaaaggtgtactgtagtttcttttgaaacataatttttctctcttcagtgcctcatttctaccaaataaaaatcagtaggaccaacttattggcaaaataagtttgagtcttattatatttggtttgattatttgcatagagtgcagcaagagtaattattggtgatgtaggctttttaaattatttttaatttttattttttgtaggtacatggtaggtatatacatttctgcagtatatgagatattttgacacaggcatgcaattcataataaccacatcatgggaaattgggtatccatcccttcaagcatttatcctttgtgttacaaacaatccagttatactatttttgttattttaaaatgtaaaattattgactacagtacccctgttgtgctgtcaatactaggtctgttaaccatccccatcttccccccgccctcccactatctttccaagactctagtaaccatccttctattctctatctccatgagttcagttgttttgaagtttagatcccaacaataaatgagaacatgccacattcgtctttctgtgcctggcttatttcacttaacatgatgacctcccgttccatccatgttgttgcaattgactagatctcattctttttttatggctgaatagtactccattgtgtatatgtaccacatttttaaaaatccattaatctgttgatggacacttggttgcttccaaatcttggctatcatgaatagcattgcagtaaacatcagagtgcagatatattttccataaacagatttcctttattttgggtagtgggattgctggatcatatggtagctctagatttgtcctttcaaggaacctctaaactgttctccgtagtggttgtactaatttacatttccaccaacagtggatgagggttctgttttctccacatccttgccagcatttgttattgcttgtcttttgaatataagccattttatctggggtgagatgatatctccttgtagttttgatctgcatttctctgatgatcagtgatgttgagtacctcttcatatgcttctttgccatttgtatgtcttcttttgagaaatgtctgttgagatcttttgcccattttaaaatcagattattaggtttttttctatagagttatttgtgttccttatatatcctggttattaatcccttgtcagatggatggtttgcaaatatcttctccgattctgtgggctagcttttcagtttgttgattatttcctttgctgtgcagacacttcttaacttaatgtgaacccatttgtccaaggcctgcagtgagtcttgcctggctaacactgctgattactcagggcccaaagactctttagtcagcaagtgatgaatcctgccaggacttggttcttcccttcaaggaagctgattctttcatggtgcacagtgtgtttagcaatgtcatctgtgtgctagggcatggaatgggggcctcaggactctgcctggtaccctgttctactgtgactgagctgatattcaagttgtaagacaaagtcatcttaatgtcccctctcttctgaagcagagggaagcagtccctcccagagctgcaagctatgctgtctgggtttggcagaggggtgacacaagcactcccttgggcgctctcactagattgtctcactaccttaagtaccttaagtccactggctgtaagctcagcacagaaccaggacttgcccaggaattgcagtccttgtggcctaaactggttttaaagtttattttgtaccccagagcactttagcccatggtgacagggcttgttgagacttagcttctgaccgctgggttggatgatttgcccctggctagggcttgtctaaatgccccttccatgggtactgagttctgccctatattgctttctgccgtgacagggcatcactgaattccaatgcaaagtccacaatcactgcactctcctccccaaaccacttgattctctctccatttgacatggttgctgccagggcatggaggagggttggtgattcaggactgtctttcataccctctttagtgccttttcccttaatatgatcttaaaaccaggtactgtaattgcgcccgcaaattaaaacctttcagaggagacaatgatttttactgtccattcaactggattccgcacaaaaagagaggccaggaggccaactgggaaggaattcttacccttttactggctttttgggttcctgaattccttcaactgcagcttccagaagagcagagttttgaccaccctgatcgctaattactaaggaaaaccattttcattattttcatgggttcataggtgaaagccactcaattttataagacacaagggatccaattaacattccccatatcagcagagacaaaattacaagatacacataacagagacacaaacacccgttattctactcagtttccaagttttagccaggcaaaacagacaaaacaccaaaatggttactcccagtcaggcctgctgatattctgctagtgattccttccagcttgcccacacacaaatggggcaagacaaaaacaaacacaaggcctcacaagtcaaaattctgaaaccagatttcagaactgtgaccagaagggtcctggcgtacttccctctaacagtgtgcctttcgttctccttccaattggggaaaatccccttaaacagggcccttcctataggttagggaaggtcaacaggatctccgaagaggtcacaagacctctgaagaggccaacagatcagaagaatggaaaggagatgtcagttgcacttggaagtactcaccagattcagaagacatctttcagattcagaaaccatttctctgctgcaagcaaatgtatgcaatgccctgccagcaagtgaggctccagggacagcccctggtttaaagaagccaggcatccacttgggctttcctctgggccacagaaatgggtgagggagcaccaagccacagccacataaccatgaggggtgtccctttgtggggttgccactaaatagcagccagaatatgttcattgcccaatgcacacagcaagtcaatacactgagacaccagattgcagcagagaaagagctttaattgtagggtcactgaatgaggagatgggagggaacctccaatccatctctccaaggagtttggagctaggattttttaagtgtccttggagtaagccaaagtgtggagatcattgattagctgaagagtgaagagtgaagtcatgggacagggaaatgaggaaattgcattctcatgttagtcctattactctgtggggatcttcaaactgctggaatttgaggtctgaaaaacatcttaagtaatagttaaacaaaagtcttaaaactcttgtgtcagattctgtctataggaacaatggggatacaaatcagttcctaaacagtcttatgaccctaatgtcagaaatcctacctatagaaacaagggcaatacaaatgatcagtgtccagtgctacatgacttttagcagcaatgaagtgggccagaaggcagcctggtaaatgcttaattataactatatttctgtccagaacgtgacatgcaattcttgtcaaccttatggggagggtttcattaccacatcaaggtactaaatatatccattacctacaaaaatgtacttgttttgctcaatggatattgtgttagtctgttgttacactgctataaagaaatacttgagactgagtaatctataaagtaaagcagtttaattggctcacggttctgctggctgtacaggaagcatgatggcttctggggaggcctcaggaaactttcgatcatggcagaaggggaagcagatatgtcttacatggccagagcaggaggaaagggggagggaaggtgctacacacttttaaatgaccagatctcatgaaaactttatcaggagaacagcagtagaaagatggtgttaaaccattagaagccacccccatgttccaatcacctccttccaggcccacctctagcattgagtattacatcttaacatgagatttcagtggggactcaaatccaaaccatatcaggtataaagtctgggttatgtgagatgaataagttctagagatctgcagtacaacacagtactcatagttaacagtacagtattgtgcactttgaaatatgctaagaggatagatctcatcttaggtgttcttcacacacatacacacacacacgcacggatctatttttcaatatactttatgccttaagcattgtcaatgacactttcatctttaaaatatcttttttcatttttcttttccttttttctctctatgtcccttcattcctcttcctccccactcctttctctgtctccccatctctctcttccttccctcccccaactttctctctttcgctctacagtagaaaagccaaaattcccatttgaaaagtttttgctatttttttcgaatgcttagcattccctcctgaaggggaattcttcccaaatatttgtgaaggcaccaaatttatgagaaaacacaaactgtaaactactcttgctggataataaggttgagcctttactatgtctaatattccacactggagggtaaataatttaatttataaaatttagaaatattttataagagcttaggatacaaaattaaatggtggacctgtaagggacatctgctcggggcagagaactattctttttcccctttctccccgtcattattgtatttatcaagaacgatgggaaaataatttttcaaaatccagggttttttaaaattttaaatatttttccatttatgtctaaggaattggatgatattccttattattatgcaggttcaattcttatacttcattttataactacttcattttgtgttgaaaggtttaaagcatgatacaagaaacacctaaataccattcatgaagattcacaaattttattgcagaggttcacaattttaaaaaatattttgccctatttgcttttttatttacctattttagatagataggtatagatagacatctaatttgtaacatatatattaataacatatactacataatgtgtatttttttcagaaaaatcttaaagttggagatatcatgcccctttcatcatatagacttcagtgtgtatttcccaagaaaaggagagtattctcatacaaagactccagtatagtttacaaaatctaaagatttaacagtgatatgttactttcaactaatctgaagtctttttaaatttgtgtaattttcttaatcatgtcttttatagatagtttttatctcagtaaaggataaaatttagtatcacacatttcttaggtaccatgtctctttagttttctttaatctggaatggtttttgagactgtgttccttgatattgaaatttttggaaagtatagatcaactattttatagaatgtccttcaatttgattgcctcatgtttcctcctaattagattcaggtcatacatctttgagagtaacacaatttaaacgaagattgtgttctaaaaagtgcatcttattaagaggcatatataaagtgggtttgtctgaacgttggtgtggttagattgggtgtggtggctcacacctgtaatcctagtgctttaggaggctgaagtgggaggatcatttgaggctagacattgtagaccaggctggacaactctattagttcattttcacgctgctataaagaaatttttgacactggttaacttataaaggaaagtagtttaattaactcacagttccgcatggctgggaacgcctcaggaaacttacaataatgtcagaagcggaagcaggcacatcttacacggtggcaggcgtgcgtgcacatgcaagagagagagggtgagcgcgagtgtgagtgtaagtgtgcagaaaaaaaactacaatttataaaaccatcagatctcatgagaattcattcactatcacaagaacagcatgggagaaactgtccccataatccaatcacttccctccctcaacacgtgaggattacaattgtcaatgagatttgggtcgggacacagaatcaaactgcattggcaacatagtgagaccacatctctcccaaaaaaaaaatttttttttaaattagctaggcatggttacacatgcctatagtcccaactacttgggaagctgaggagggaggattgcttgagtccaggagttcaaggctgcaatgagccacaactgcaccactgtactccagcctggatgatccaggatgaccctctctctaaatatgtgtatatatattttatattatatatattatatataatatatatattttatattatatatattatatataatatatatattttatattatatatattatatataatatatattttctattatatatattatatataatatatattttctattatatatattatatataatatatattttctattatatatattatatataatatatattttctattatatatattatatacagtacacatatataatatatatgatattgtttgattacttgatgaaggtagtatccaccagtgtactgtaactcttttttattcagtgagttacaatcctttataatgcttttcttgatgtgcaaattatctcagaattggccaggacgaatgctgtcaaactggctcctgtgcccttttaacatgcctctattccttgagcacttctttactttatgatgcaacaagctgttcaaagctcattttatgctttctctgctctgaacatgaaatcagccatttcctcatggaacttttgttcatttcaataaggaatagtttagaaactaggatctgggcactagatgtctgcattccaacaagcttcatcatggtgactaggtcttctcagtgaacagggtgaaatttatctgttgatatattaaaaaccatgagtttatactcatacctccagtttcaatccaccaccactgaaaacattctagtctttcccctttccctttccatattcataacatttttcctaaaataggaaaacatggctcccattattctcaatacatttactcatttgtttaagactaaaatatgcagaaacctgttttagaattgctaatccattcctccatgataaggtagcccaatgagtagaattcaatatgtgtttacagtttatttttattgaggtaaaatgtacatgccttgaaattgttaaatcttaagtatacgactcaatgaattttgtcaaataaatatacctatgtaacccacacccctgttaaaatttagaacatttcaatcactccagaaagttctcttgtgtcatttccaagtcaatccttctctcctttccagaggcacacattattctgaatttttccccacggattgtttttgcctattctagaagttaataaaatggaataatatactatgtttttgtttgtgtgtctgtgagatccattcatgttattgcatgtgtcattctcctttattactaaagatccgtcgtcctgttgatgaacatttagattgtttctaattttggataattatgagtaaagctgctataaacactcttgcacaagtctttttatgaaaatatattttcctttctcttgaataaataccaagacattgaattgttgggacaaaaagtaggtgcatgtgtaacttaaactgtcaaatattttgccaaaggttcttgtattattttatatcccaccagcaatgtatgagagttccagtcactctatatcattcccacattgggtgttcttagtctttcccatccatctattttacattctagtgggggaaagagggtatctcattctgttttaatttaattaaattaattaattaattaattaatttttgagatggagttttgcccttgtcgcccaggctggagtgcagtggcacaatctctgctcactgcaacctccgcctctcgggttcaagtgattctcttgcctcagcctcccaagtagctaggatcataagtatgcaccaccacgcctggttaatttttttgtatttctagtagagatggggtttcaccatgttggccaggctggtctcaaactcctgacctcaagtaatctgcctgccttggcctcccaaagtgctaggattacaggcatgagccatcgtgcctggccacattatgtttttaatttatatttccctgataactagtaatattaaatgttttatgcttactggttattcatagatcttcttttgtgaatatcttttaaaattttctggttttggctgggcgtggtggctcacgtctgtaattccagcactttgggaggccaaggtgggcagattacctgaggtcaggagtttgagaccagcctggccaacatggtgaaaccccatctctactaaaaatacaaaaattagttgggcgtggtggcacacgcctgtaatcccagctactcgggaggctgaggcaggagaattgcttgagcctgggaggtggatgtttcagtgagctgagatcctgccactgcactccagcctggccaacagggcgagactctgtctcaaaaaaaaaaaaaatctgtttttaaaattttgggggtttgtatattattggattgcaagaaatctaaaaaatatacattctaggtaaaagtctatatctaggtcagaaatattatgcaaatattttctgttttcaagtatacatatgtgtatgtgtgcatatttatatataaaggccttttgcatctctattaatgagccatatgatttgtagttttctgctagtatctttaactagtttgagtatcatgattatgatggttttacaagacaagttaggaagtgatccctccaactcttttatctgaaacattgctattacttcttaagacatttgatgaaactcacagtgaaaccatctgggcctggatatacttttttatgagcaggtttttggagaggaattgaattttttttatagatttagggctagtcagagtttctatttcatattgttgcagtttcagtgactattttttaaatcatttattttatctaagttttcaaactggcacaaagttgtttataatattgccttaatattcttattatatctataggatttatagtgctatcctgtctttctttctggtattggtaatttgtgtttttacatctttcttttttgagataagtcttgctacagcattatcaattttaatgatcttttcggatagtcaactgctggactgaattgatttttcctagtgtttgcctacctgcaattttatttatgtatgctcttgtctttattacttccttttttctgcctactttgggtttaatttacttgtcttttaaaatcttcttaaggttagaaacttatataatctattttaaacattttttagcataaacatttgtattatacaattttttccaactcccttagccacatcccacaaatttttatgtgctgtattttcatcattatttagttgaaataattttccagttaccattacgatttattatttggtatatggtatatttagaaatgtgttaatttccatatgttagtgctttttaaacataatttattgttgttcatttctaacttaattccactgtgatcaaagaacatgcatactctgtaacagctcacattgtgtaatttattgggacatattttatgtcttatttttaatctaatcattctaccaatgcagaaaaaggaatgtaaaaatctctgacttctcacttttattatggcttagtgtatttctttgttctgtcagggtttgcttatgtattttgaagattttttattaggtgtagatacatttatagttgtttatgtctcctggatgaattgacccctttgccattacaaaatgtccttctttatctttgggaatactctttgttttatagtctgttctgttaatagagcaactccatctttctttcttagctttttccattcttttattctcaacctgtgttttgtatttaaaaatgtatctcttatagacaacatatagatgttccttgctttttatccaatttgacaattgtagccttttaattgaactatttattccctttacattcaatatatatatgatatgcttaagtttatgccttctatttgctgtgtattttcaatttgtcccatctggtttttttttctgctctgtttttcccttcatgctttcttctgggttaatcaaatattttttagtccttcattttaatctctttatggtcatttaagtactgtacattcattttaggggtgttattagggattataatatgtatatttattccaatctacttagagttagtttttctacttataaaatatggaaactttgctttgcaacagtttgttttcatttatcccccatcactctttgtggatgattatacatacatacacacacacacacacacacacacacacacatatatatatatatatacacacagacacacatatatataatttatatacattgtatttatacttatttgtatttatattttatttttatccatggtagtcccaaaacaatgttataatgtttaaactttaaaaaagtaagaccaggaggcagctccaagtgagtgtagaggcatcattaaaaaatgatgactaataaacttaggtgaaaaatgtgttccttgctaatttaataattcatgagttgctgtcagtgtatgcatatatgtacaagcacatttatatagagacagtatttgtgttcagattcatttgtgtgacattgtttacaagaaaattggcgaaaggagttaccaattcagacatctcttccacttgtggtgatggttaagttaggtaagtgacctcttttttgaacacatcatttaaatgactttctagtaaaatgactacctgaatcttagttattcccttaatacctgggcagagtgtgaaacaaaagcagtatttcaggttaggataagaaaatttgacccaacatggaaaggatggattatggaatggatggaaagaaaggattatgatactccctctaataaaacatgaaataaaaatccacaattagctgaagcagcaagatgcagcctattctcttttattggaagtgtacatcatctaattcagtatctagaggctttagagtcagttaaagatacctgtgaattatttgttgttacggcagtaatgtcaattcctcaaaatagttccattatggaaacaggcctttaattttcaatcccaagtgatacagtcagataacttatgtcctaccattgttcctgagacaacttgctcttttttctttttgttgggaaatctgtttagatacagaaatagttggtatgacatttttcctgaagttgtatagcaatatacatgaggaaagctcaggaattatatggaatctttgcattttttaaaaggatatttaggactttaagacttgtacatatactgtcatacttttatatacattgtaaatagttaagataaaagtcaactttgcataaccttatatagtttttttttgtggtgagaacacttaaaatctctgtaaggtaatgcacatgttaattagcttgggttaggaattctactatgtatatacattttgaaacatcatgttgtacatgatagatatatataactttatttgtcaatttaaaaaaatgaaacacttttaaaaaggcaactttggacatttgttctttctccatatgcccaagatatttttcatagatttaaaccacagttaattcccaattaaatgaacaagaggtataaaataatgggaaagtagaatgctgagagaccaccacatccaacaaactactcaactttgaaatttgtgttcattcaaatacactgacattgtcagaatttatgctgtgggcattccaaaagttcagcatacagtgatacaattccccattccgacccagtacacagtactcctgggaatggaatagctcattctttctctttttttgctatctcccaaaaccagcctatagtgatgtgcctgaactcaaatgggaagatttcaaagatcttgcttagaatttgtaaaagttagggttattactgatgtgaaattttaacagataaagtaattgaacagagtacagtaggtattctctgtcaataattgtgaaacctagtgatcagaaatgattttaggtcacagaatgacttcaacagaaacagggacaaacatcaggactcgatcctttccatcttttagccacatttcttctcctagtagaaagcagagaaaaattagagttgtaaggtctattgatgcatcttggtaagaacatttgcagttaaaccattgagctcctaaagagatgcatctcactgttacactttgtgcccccctccatttgtttattcttccatgtcatgcacagggcaactagaggtacctaccagtaatattacattttggttaactattctttacacacaaaaaagatctttcacaatagtctcaataacctccttttgcagtgatttttttacagattttgtttaggacatgtgaatgtagatgatttactgtacagtttaataacataactgctttgttactcaccaaagtttaggtaaataaatttatggcatgagggagtgcgggaatggaggggtggggaaacacagagctcaccatacactcacatttttaatgccatacttcttatcaaagagaggttactttagaaaaccctatggcagtggacttttgttcttatggcatcagcaaggattatgtagcaattcatttgcagatgtagattttagcccaagtaaattataatcaaaatctatctgacacattgtgcttcctttatctaaattgccctgttaatgagttttctgaatacactaaatcataatcttttatgaatcatttcagtttaaaagccttcagaatctcaattagattatcttagatgaagagaaaagtaaatgttacaatgaatgtctctaactgtggcaaagtggaatgttatctcttaaaccactgtctcctttagtggcttcttccaagaccaggacctacaatttgttcccatttgcttgaaaaaaaaaaatcactaatattggtggtatttggtagtgaacttaccctctagtcgatcttgctgttttcaaggatgatgctcagcatgacatactctgggcttttaaaagagcctttctttgtatgtatcaacacggtagtttctgtagctgcggacaatcaagcagaccaaacaggctaagccagactgtgtcggatcacaccacaaattagaggcagatgcacttttttcaatctggcgttctcctttgacttactatatcattctccattttttccttctattatgttataccacacctaatttcccaaaaggctgagtcattttatgaaaatacataaaatatgtggaaatgggtgaaaaggaaactaagggtgagtaagctaagatggagccaggataaggtcagtaagccaatgcaaatcatgctgctatatgattcagctgcaggtacagaagagcctctttaaacatagcctgtagcaactggggtcaggatggagtgagatgggagggcatgaaagtatctaatgtttacaacatttcagtggccatcttattctagttctctagggaagaatatcagtccctctggaaaagggagggaaaggatgagaagctgaaagactgcaatcattttttaaattgtcaaatgagtccatttgttggaacagaaataatttagtagaaaataggcaatcaagttgaagttttcttctcctcactatttaatcttgatatattgagaggctcttaacatattaaaaatggacaatgaccaaaatgagaattggaatttcagccaaaagtatatgtgctttcatccacttgtggaaatacaagttctaaatgataattaatgttagtcccccatccagagtgatatccttattctgtgtagctttggccgtacaaaccagcctggtccatcaacagggaacaacttgacctctgatgaggaacacttttaccctgacagaaagtggtaatgttttcttagcttctgtagtctgacttaatgtcaggcaaaggcaactttgaagagacagtccttcaaataatactattggcacataatatttattacctttttttaaaaaaaaatgagatgaaagtcacataatttagaattaatcattttaaagtgtatgattcagtggcctttagtacattcacaatattgtgcaactataacccgtatctaattccaaaacattttcatcatcacaaaagaaaaccccatacctgttttattagtcagggttccctagagggacagaactaatggatgtatatatatatatatatatatatggttttattaagtattaacttacaagatcacaaggtcccacagtaggctgtctgcaagcttgaggagcaaggagagccagcccgagtctcaaaattgaagaatttggagtctgatgtttgagggcaggaagcatccagcatgagagaaagatgtaggctgggaggctatgccagtctctccttttcactaatttgtgattgaaggatgcaaagttaagcagttactctccatctccctctctccctagcccctggcaaccattaatttgttttctgttgtgcattccttgttgactatatgctttttgatgaggctggtgaaaaacagatggaactaacactgggcaaattagtctgctgtaataagaagggtattaaaaaataaatataggccaggcgcagtggctcacacctgtaatcccagcacttttggaggccaaggacggcggatcacctgaggtcaggagttcaagaccagcctggccaacatggtgaaaccccatctctactaaaaatacaaaaattagccaggtgtgatggtgcatgcctgtaatctcagctgctcaggagactgaggcaagagaatcacttgaacctggaaggcagaggttgcagtgagctgagatcaagtcactgaactccagcctgggtgacagagcaagactccgtctcaaaaaataaaaataaataaattgataaataaatatagctggtgatgggccattataaaaaaatctgcttgctaatcaatgaaaaaaggcatgaaatgagtgatggccaagactgtgtactcgttagttatctagatttaaccagaaaaatgaagcaacaatatatgaacaatttagttaaaataaagacattgcaaaaacagttattgatgaaaccaggcagagaaagagcagggtcaggaaatttgagtacatgtgtaggctttccatcttaaggagaaaaaaaattggataccatctggtacaagcactactctcccatgtaacatgaaaacttgatgaaaacaaaatcaaataaaccttgaatgaagaatcttactcataagaaagttcaacttcatccatgtgcaaatgtttgggcatgttgggaggcagagattaataggagtgacaatgggtataaactgaaggagctgttaaatccaattttgccttcactgtgtaatgacacaattcaccttctaccattcagtgcctcctgaaaccagatgcacttgaaatactgatggggagcgggggaacattgtttaaacattcagttttaacccatgactcaaggttgaaggtctccagtaattttttttttttgaggtaaaaagcccaatatctgtaaagccaaacttgagatagctaaattaggaatcactaaaggccctaatccagggttcagtagtaatcactttggtgaccttaggctagtaatttacccattctaatcctattttctcatctcactctgcctagctcataataatttttttaaagtagaactaggctgtatgtttaaaaacactttgaaatagaactcagcaactttttagtttgaatatttacaaatatctgtttattggacctgtaaaaataagggaaaaaccctttctgtgtgacacaaatatttattaagggcttaatcactagcattgaattcctctataaagtatagtcactaatacttcacactggtttttgatgaggtttgcaaatatgaaacagtgttgacagtgatgatccatttgcatggggttttcgctttttctcctctcagcttcttagtttatcttaaagccctcagaagcttcttgtatttcttcaacctaaaccacaatattttatctgtatgtcttgagattttggaggaaccaaggcattttcgaggaattataagtcatttcttgttgttgaaattcacacttgggagaagagtgtccttataaaagattattctggagagctaaacataatccagatcatgaaggatcgttcatgatagatatgaaccaggttaagaagctccttttttagacccttatttaaggtcagaaatcctgtttggtggccagtcagtcttcaacagccttctttactgaacaaagactcaaagactctctgaagtggcatttttcttttttcccccctgagaacaaaaagcattaatataacttaggtggaaaaagtgaaatatgagaacaggacagagctacttctgtgaggtagctaccattatttccacttcacaaatgaggaaactgaggcttagtacagttaaataatttgcctatattcacacaggtagcattagagttgggattcaaagttcatacattttaccactaagaagtaattattttctttctttcttcttcttttttttttttttaaagacgaagtctcgctctgtcgcccaggctggagtgcagtggcgcgatctcggctcactgcaagctccgcctcccgggttcacgccattctcctgcctcagcctcccgagtagctgggactacaggcgcccgccaccacgcctggctaattttttctattttttagtagagacggggtttcaccacgttagccaggatggtctggatctgctgacctcgtgatccgcccacctcggcctcccaaagtggtgggattacaggcgtgagccaccgcgccaggcagaagtaagtattttctaaattactgtgtgctgagaacacttaggcactcctctaggagttttatgttagagaactatgcaagatcgtgtagaagcaagggccaagttatatggtacatccaataggtgctatagaaataaataaaaggaagacattactgggatttgttcagtcagagaaaaaaaatttttttggaggagttggaacctgagctagctctcagagaaaaatataagaagtagatcaattaaagttggaggcaggagcatgggttattccaaacagagacaagaataaggtgaaggcacagagagagaaatgaacagagtgtgtattgaaaggactctgacttggtacaatactagagtcatggtggggagtagtgaagtgaagcctggtgtggcagggtaagctatgtagaaggccttgaatgccaaccacagggctttctctctgccttagaactgtttattgaataagcaaatttctgcctgtctcaggtactctcactattgttatccatcaagcagaacatgagttgcatttgctttccaaagtgctgttatattttatgtttatgaggagaaatgtgacaatacaggtccaggtgtccaaagggaattatagctatcgccttcaatgcaatacaaaactccatggctgctgggattttcatgcccactggcagcccagagatacattatttatttcaaattataccttttcccctaatgggcctgtgtttctttcaatgttctgctagttctagcagcttcagctgttgctgtcatacttaataaggactttgtggagcttagatattgtgcggctgcactatctttcccacagcccagtaaaggagctttgagatgagctttttctttctgtgttggctatgtttagatttcaacctgaaaaatattccaggttgacccacagcttattctgctatcagtgagagggtaggaatcagtaagattagcttcctctaatgccacagcaaggtcacccacgaagcccgtagcttgtcgaattgcatgaagtgatccaagctagttcaaaactcccaatgtattaaatgtcggtgcccacttttgcaaattcaggcatccaaattgtgcctggtatgaagcattaggcagtgggtctaggaaattgagctcaagggcaggaacatcataactttggaattattggcgttgacatggctattttcactcattgtgataggaatatgttcctgaaagaagcaagatgattctaaaaagtaccgtgcaattataaaatagtgggaaattaaagaagggtgcttttgtgcttgctttcttgccactgattttgcattccctattttacttcatggtagtctatatgtcactcaaatcaaatataattggtgctgtttagtatttggtaattttactgctgcttgtacaacatacgcaaatattctaaaatgtgttaatgatgtcagtacatcacaaataaaatgcacgtgaaatggaaataacgctgtgcacactcatacacccacaagtgcatgggagtctgatcttgatagattcagaagaacccttagctggcagttttaataggcgatcatagaaaagaatgccagcaaaaatgacagagctcatatttctactgacaaaataccaaaatgacttacgagttattttctcaaaaatggaagggggcagaactgaagagtcagtgtgtgtgtgtatatgtgtgtgtgtgtgtgtatgtgtgtacagacttatataaggtcagtggtagattggcgagatagactaatatgtgagtaaagttatggagtttaataacataatcatggttaactaacaggatctgaaactgtaaaaaatatagggaagcatcagtatttgatgaggaagattgggggtactgggctgggcagctacgatagaactgggaacagaactcttacattgaactgacatttagcccttgactttatgaatgtgtgttgaggttgcaactacaaagtaactacatttcttaagtgtcagaatagtgaattctaaccacttggcaaccacgtttcagagggaggattgtagttacttcactaactgggtctaggggcaataaggagaagaaatggctgcctactaggcaactgcacacattcagtaaggtggggggaggaggaagactattggtaacactcacagaaaagtggggcctgcctgcccagagacagagaattacagttgagaaaggcctgtctgcctggaagtgtgtgtgagtatattgtgtgagtatatgtgtacgtgtatatgtgcaggtatgtgtatgtgtgtttgtgtgtgtgaggatatgtgagtgtgggtatgtgtacatgtgaatgtgtgtatgtgtatgcatatgtgtgagcatgttgtataagtgtgtatgtgtttatgtgtgagtgtatatatttgagtgtcttatgcatgtgtgtatgtgtgaatgtgtagatgtatgagtgtataagcctgtgagtgaagtttacactgatgcagaagagggctggagcccatggagagaggtgatcagtttgaaccaggcctgatttgaaccctgccccatgcctggtgagcccatgctctgcaccagtgtttcatccctagctttgcacataaacaccatctctctctggaaaatctttccagtctctgactgggtaatgtaatgtagccccatccctcaaggaccagctcaggtgcagcctcctccatgaagccttccatgatttcatttcccctatctccaacagatgtgacctctcctgtggctatgggtttggggtggggcatctgtgctggggtgtagaggagtgttggaacactgagatgggagcaaactgacaggaagaatcagaggtatacatttagaatttgtagtttgtattaataacaagcacccttggtgatcctcattatcaggtaagtttgggaaacactggcccagtcttatcccctcattttttagaagagacaactgaagctcagagaggggaaatttactggcctaggatcacacaatcctttagtgacagaaccaagaccagcatgcagatatcccactatctttccagtccagttatgtttccctttgtattatattaccgtaacaagactggctacataatttgcatggcccagtgtaaaattaaaatgcaaggctctttgttcaaaaattattagaaatgtcaagacagcaaaagcagagcattaaaccaagcacagggcccttttacatgcagagccctgtgcatctgcacagatcatacacctgtgaagctgacgctgtcccacaaagagtgtttactatatcttgcatgtggtaggtcgttctataaatacttgtcggatgaatttatggattgaattaacacctcccatttgccaggaatctatgaaagtgagacactagataaatatgttttgatggaagtgtaggaaagaagagaagaaaaataggtctggaacatgatacatagggttactgacatttgtgtttggattttttatgtgagtttttgcacacaaattgagattgctacaaaggctatccagtataagcaattgctgagtaaccaacacagggtctctgactggtaataacaatggattttaaacacttagcaaccatgactggggaggaggctttgcagccctagcaggccaaggggctgggaggaaaagaaaaataaaattggctgcctactggacaactgtgcatatttaacaagaaatagtttggggtgcaaataaatcatctgagttgattaaatccagtctgtttagggaattggtatgtagcttgctcccttggtgaaggtttgacctaaggaataatcaaagcttttctgaaatgtctgtaatcactatttggaatccttatgttgccataagacttctaaaagccacatctgctatacaatattgtctggtgatccatataaactctttaggccacaggtttttaatttgtttgtattagttttctattgctgtgtaattcattgccacaaacttaatggctattaagccatttatttattttcccagtttctttaggtcagaagtgcaggtacagtgtagctggtttctctgatcagggtgtcacatagttgaaatcaagttgttgtttgggttgtgttcccatctggagcttgggatccttttccaaactcatttagattcttggcagaattgagtcctttgtggttatgaggtatccatttacttgctgtcacctggaggtcattctcaactcctagaggatgctctcatgtcccagttacatgtctctctccatcagcagctcctaacataatcatttgctttcctccaagtcaacagaatagcatctctgccacttagaatctttctgacttctccagttttttaaggtttcgcctcattgggtcaggctaaacttgggtagtctctttttttggtaacttaaagtcaactgattaggaaccttaatttcatctgcaaaattctttcacctttgcagtatagcataacttaattacaggagtgagaacctatcagattcacagaagggattatacaaggtatgtatgtacaacagtggtcaagattattggaggccatcttaaaattctgcctaccataatattaatgaatgaactttagggacatattcaaaactctaacattttatgcaaaaatttttgtgactgttcattttttccgggagccagttggcagcattcatcaagagaggtctgtgacccaaatcctattaagaaccactgatggaccagataatacacactggcaagaagtgatctagaaccaaatacttatttctgaaagaatttaaccagtgtcttttcaaggaactaaagaaatctcatgtggtgtttattgagatgaggtggctcaagttttattcaaaatatatcttttagtgtgtgattttcttttaaatcaatgaataattggtatttccaaacagattttgttatcaaagtgttcgtttctttttaaatttaccattgttactttatttttcacatttgtgtaactgtgcctccaccgtccttccccatctggctgcctataacatttccaccaatggcaaggagcggttaagtcagataaaatttggatattagttggggacagacaatcatcagtgctgtgcgcattatattccatacaggaatataattaaattttggaccttctggctaggttgtaagcaacttgagagacaggaatcagatcttgtgttatattctatatagcactatattgggtcaaaaataagctctcagccaggcgcggtggctcatgcctataatcccagcactttgggaggccaaggggtagatcacctgaagtcaggaggttgagaccagcctggtgtcaaccaggtgaaactctgtctctactaaaaatacaaaaattagctgggcgtggtggtgggtacctgtaatcccagctactcaggaggctgaggcaggagaatcacttgcgctcaggaggtggaggttgcagcgagctgagattgcaccactgcactccagtctgggcaacagagtgagactctgtcacacacacacacacacacacacagacacacacacacacacacagccctcaataaatattgggtgaattcactttgattcagaaaataatttttagagggtattgtgtgtaggaactgtaacaaaaaataggacaaaattctgtgcctcaagtttacaatctaaggattatcagataatcacaacccaaagattgtaacgtgatacaaagttaggagaatgccaaatgagaggtatgagcagtgtggtcagatcagattacatgtagcatctaatgggagtgtgggtggggctgggcaaggtaatgagtcagagaagagcacagcagaggagttgaaatttgcagtgtgtgaatagaaatggagtacagagggaggaaggctttaggatgtcagaagtggtaaggaagcaagaaagccatacttcaggtaaatagatgtactgcacattctccatgtgtggtccagccttcccctgctttttctgattggattcccttaacctattgactcaaatgcaaatatctgtcatggcccagtttaaatgtcagcatccccatgaaacctttttgttcactcagaccaaaaagaatctctcgttcctctgaaatcctgtagcatgctatctacatgtctcacaagtcactttctgttgtttagcatagttatatatatatatgcatgttttttcttctctatcaccactgatttaaaaattcccttactttatattgtaatttctgtttaaaaagcaatttcacatacattgttctagtgttctcttggttgcagatgaaaagaccaaggctcacaaagccccaagctttactgctagtaagtaacaaagaaagggcctgagtctaggttttcagaattcacacctaatacatcttttttattttgttttcaccagattattgtttgtgtgtataggtacgtaaaatgtctgtgaaggtgacagaaataaaatctgctgatatttaaaatgttactagtcttggccacttcacttcagatgtccagtgaaaatgctgtttagcttatctgatagatcaacctgtgtaaataatctttctcataagtaaattatgggaaaatgtgagtctgagtttcatatccctatatttcttctaacatggatgtttgatgcacgtttttaacagctttattgctatatgattcaaataccataacatttgtttcaagtgtacagttcagtgggtttttgtaaattttgtaaatttacaaagttatggaactgttattaccacagcccaattttagcatatttccttcatcccaaaaagatccctcatatccatttgcagtaactcacattttttcagccccaggctaccactaatctcttttctgtctctatacattagccttttctggaaattttatataaaaggaatcatacaatatgagttcttttgtgcctggcttcttttactttgtacagtgttttcaaggttcatctatgctgtagcatgtatcggtattgcatttttattgcaaagtatagatatactatattttattttcccattcaccaattgatggacatttgcattatttacactttagggctcttataaataatattgctgtgaacattcgtgtataagttcttgaataaacatgttttcattttatctctcttggttttatatatatatatatatatatatatatatatatatacacatatgtatatatgtatgtggaaatgctaggtaatatgacagctctatgttcaactttttgaggaactgtcagactgtttccaaagtgactgcaccattttacatttgcactaacaatgtatgagggttcctgtttctccatatcatcaccagcatttgtcattatgtctttttaattataaccattctagtaattgtggagaggtatctcattgtgcttttgatttgcatttccctgatgactaaatgatgttgggcatcttttcatatgcttattggccatttgaatgtcttctctgaagaaatgactgttcaggtcctttgaccattttttaaaatcaggttatttgtctttttattatttgagttatgactttttatatatttaaggtgaatgttttttaccgaatgtatgatttggaaatattttctcccagtctgtgattcatgttaattttccttattttatgttttattttattagttttttagatacaggatctcactctgttgcccaggctggagtacagtggtgcagtcatagctcactgcagcctccaactcttgggctcaaacaattctcccacctcagcctgcagatagctgggactacaggtgtgcaccaccacatctggctaatttttaaaatttttttttgatagagacagagtctcactatgttgtccaggctagtctggaacttctggcctcaagcaatcctcctgcctctgactcccaaaatggtgagattataggcatgagccatggtacttggcctgtcttctttttttttaatggtaactttcgaagcacaacaatttttgaaaattttttacgaagtccaattgacctaatttttatcttgttgcttgcgtgttgttgtcttacctacaaaatctttgtctaacccaatattacaaagatttgctccaatgttttctactaagagttttacacttttagctcttacatgtaggtctttggtccattttgagtaaagacttgtgtatggtatcaggtagaagttagaattaatctttttgcattgttctagcaccatctaaaaactattttttatcccattgaaatgcctttgtacctatgtaaaaaatattaataataaatgtagggttttttttattccattgatctatacgtctatccttatgccaatacaagactgtcttaattactgtaactttatagtactttttgaacttggcaagtgtaagttctttgttctttaccaagattgttctggctgttcttgaacatttgccttctcatacagattttaggagtagcttgtcaatttttgccaaaaaaagcctactaagattttgataggcgaatgtctgtgtgagaaaaaatggaaaaggatctagaaaagactgtgagagtcatcataacataaagccaatctgacaccaagtgagagagatgaaagggaagttgggtagaattgtcctagacttccatcagtctaaagaaggtttaacaggagagtttggctgataatctttaagccaaagtcaaccaacaaattgttttctgtttcccaagaatggacctgcctttgtgtccctgccatgctcagtcattggctgggggaagcctgtgggacacacgggctcaataccagtgtggtgatggattttagtgcacagaagctagagcctttcgtcagttacattccttgtagttggaggtctgtgagttggattctcatagttgctacaatacatgaccaagaaacattcttctttctccaggagaacttcagaagaaggatctgatcattctggcccagaatcaattttccttgaagttcagtcttataatgtctgtaatactatgcaatatagattctcctacattcagactgtcactgtgttcatgtgcttggctgaatcatggttgtttctagaggaagtagccaagatgatgtgacttgacctcaacaatactgattatttaaattctagcagtaagttctgctatggaactatccatgtatattttgtataagattccttctagatatctgtgtgcatcctcctttcataccatgggagtttactgagtgggaagtccataggggctggtaggaaggcttcatttcagatatggactttgtacccattgagatgaatgtcatagaaagggttagtttaaagaagtagatgagaaacattaccttggaaacagcatgtaggtagagtagggggctactgaaaagatgtattccctatataggcacttcagtggcattttaccttttttatgtaagtagtaattatacatttaaatcagcaaaccttgggagagcatactttctcagcaatgttttcattttttcatatctctaaaaattaatcttctgttgggagtgacttaccaatgatccccacgctatcatgtgatttcagcattctttccattatgatgtcttttcagcctccagcagaggtaagagataagttgtgaagtagaaagttcttaaatcaggaaaatgaaaaaaggaaatcaatgttacaactatgaaagaagcaagagtactttccagggcaaagaatttggtgtaatctagatagtatatctgatccctttgtcaaattcttttctgaacctaggaggaagttgtaacagtcctcacattgccttgtaccctccaagaaagtcattaacatttcaaaaatattatcagttttttttgaaagccatgggagaaccttaccattttaaagtaaaattatgctttgctttgtatgatttcaactgctctgattccattttagttaagggtagcttaattctcatggctctaacccatcccagtatatttgcctgaagctctattaagtagattgtattaagtaaaattttaccaacttgaaattaagaagaggttttaacctgttaaggttttgccatgagaatggatgtagtcatagtagtcataccttctatgccttcttggtttctatctgcttgcttcattttggctttggcattgcgtttacctgcagcaaaaccctacagaattcacctgaggggttagacactaattatgatagatttacagtcatgtgctgcataacaacattttggacaaggatggactacgtgtatgatggtggtcccataagattataatacgatatttttactggacttcttctatgtttagatacacaaatatttaccactgtgtttcattttcccacagtattcaacatagtaacatgctgtataggtttgtagcctaggagtagtaataggctatgccatgtagtctaattatgtagtaggctatgcagtctaggtttgtgtaagtacactatatgttgtttacacaatgacagaatttcctgacacatttcttagaatgtatcctcattgttaagcaatgcatggctgtgctgactggtgtttatcacaactctatatctggcaggtcactgctgccatagcaaaggctatttatttttctttgttgatttaatatagtttcagtcattagaaaatatttttctgtggattctgattcaaagttcattaatcaacagaactgatacattgttgagatgacccaggacctggaagtgtagggatgtgcccatttgttacatgaagtgttgacttgtaattagaatgtactcatgatgcatagtgttaaatacaaatgagtagaacatgagaattgggagaaatcttagagattatctggtccaaccccctacattttactatggaggaaactttgtgtggcccaagtcacataacaaataaatagaggcagaactcttttgggcctgaatttgtatctctagattcctattccagtgattattctatttcctgttctgtttcttaagtgtcttagtctaaagtgaatttatcatatattgggtagcttacatggaaattaaaagtaaacattgagctaagcaactgtttaatttcatattgaaaactaagaacaattggctatgaacaggtgggataaaaactttcaaatgcattgtgaagaattaaggtctatttttatgaggatgacagtgatcattgattcaagacatctaatgcagaactatctgggcttgcactgtactgcatatacggcttttaagcacttgaaatgtgcctagtccaaactgagatagatgttgtaagtgtaaactagacactgtatttcaaagagttagtaccaaaaaagaatgtaaaatatttcactaatactgtaaatattatacataatgaaattatgttatttggatatattgggttaattatatacatattattaaattagttttaccaatttatttttactttttaatgtgactactagaaaatttaaaattacaggtgtggctcacattgtatttctattgaatagcacctgtccagagtgttgctaccaaatgtatggtccatgaaccagcagcattggcatctcctgagtgcttgaaattaatgcagaattttatgactcaagctaaactgactgaatctgaatctgcattttaacaagattcccagggtaatttacatggacattaaagtttgatatatactgagcaagcatgtgcacaccttgttcagatacttcctagttctccacacagaacttgttggatcccttctgattgatatgtgacatttagagccaggtcaacccacgacattctggctttaagctttggtagatttttaaactgcttttatgtgcagtggttttctgatctcaaaaagctctaccctcctcgtataccaacatgtttttactaataaatcagacagcagtgatgaaggtgggaactccagtaggccaaatatgaaagttacaaatgctgttaataccccaatctcccttctgctcagatatctctcctggttctacatcagtacagccaactgtctgttttatatttacctctgttattctactagaatctcaatgcaaagtgtccagaacaaaattcaccatgttacctaaaaaatatgattatttttatatttcatgtcctgatgggtatcagtaccatctacctatacatccaagtgtgacctggaagttataattaataatccttctttcacgtcttcacacaaacctgaaatccaattagccccttaagtagtcaactctgcctcacatctctctctggaatatattcttactttccacttatactgctctaattctgagttttcattaaatctttcctgaattattatagtagcctcctatctagtcttctataccctgtactatctcccctttctaaacattcttccacattgcaaccagaaatacctttctcaaatacaaatctgatcacgcctaaaatcctttggtggcttctgagtagctcagtctccttgttaaatggggctaataatagcacctatgtcaaaggctttttgtaataattaaataaattaatgtatataaagtgtttagaatagtgcctggtacaatgtaagtgatatgtaggtattagcttatattatgtttattattcaaggctctttacagcatgtgacctcaacctattttgttagtgaaaccaatgtcctatcaatttcttacaacacacagaacattttatggcttatgcatggtctgtcacactgtttgtgctgcctagaatactctttatttttgtgccagaaaaaaaccccacttcacatttttccccaagttggttcctggccttcatggctcctttttgatggcaaaaatttacctatattccatgcttgcttattaaaatacattcctaaactatgattatctaatgctggaagcttacatattccatttggtaaatggatgatgctgcccaaatggaatgtatggcaacatttcagatttcgttaccatgaacatttaaaccaaagtaaccaaagctttcccagatggtgaaatgaacagctaatttttgtaaacagaacagcaggtggtctcctaatttatctaaactcaaaggaaaaaaaacttgtttgtgaccttcagacagatactgactactggggaaaaatgatttttgtcagcttgtttatataaagttttaaatcactggtgcttggtgttttcctcctgttttaattgaaataattaattccaattagaataacaggcataactgtctttataaaatatttccattctagaagagatatagttcaacagcatttcttcaaataaaatactaccaaaatgtcattggacaaagtaggaatttatagaaatctgatagtgaattctactaggatatcacctcctaacttaaggtttccttaagtgtgcattctgaaaagctgcatcagcttcccttgctggaacctatcacacttccaaatttcttgccgctgtctcttcaagaagtgacaatggcaagatagacaggcagaagaaccagcacaagtgacaacaagtaggcaggaaggatcaatgcgtattcacagaatcaccagaacaatccaaatgaataatagcagaaggttcctgttggggaccagaagcaaatgcaggtatcgcagacatataaaacagaatctcagggaataggtccaaaaaaaattttttaacaagtaccctgccaccccaaataatacagatgctcataaatatttcaaaaccactgggctaagtcttcaatttggttcacctgcatttgttgctggtccccaacagggaccttctgctataattcatttggattgctatggtgattctgtgaacatgcattgctccttcctgtctacttgtcacttgtgcttggttcttttgcctatcttgctgttgtctcttcttttcatctttcattattttatttgcttctcaaatgttctgtactcaatgatacttttctgaaggatgccaactttcaccactgttactcaacatagtactggaagtcctagctagagcaatcagacaagagaaacatataaagggcatccaaactggaaaggaagaagtaaaactctccctgtttgcagatgatataatcttatatttggaaaaacctaaagacaccaccaaaaactattagaactaataaacaaattcagttaagttgagggatacaaaatcaacacacaaaaatcagtagcatttctaatgtcaacagtttacaaactggaaaataaattttaaaaagtagtagtccaatttacaatagccattaataaaatcaaatacctaggaattaaccaaataagtagaagttctccgtaatgaaaactgcaaaacgctgatgaaagaaattgaagaggacaccaaaaattggacaaatattccatgttcatggattagaagaatcaatattgttagaatgtccatactactcaaagcaatctacagattcaatgtaatcctatcaaaataccaatgatattcttcacagaaatagaaaaaaagtaccctaaaatttatatggaaccacaaaagacccagaatatccaaagctatcttaagcaaaaacaacaaaactggaggattcacactacctgacttcaaattatactacagcgctatagtaaccaaaatggcatggtactggcataagaacagatacataggccaatggaacagaataaagaacccagaaacaattccacacgcctacagtgaacttattttcaacaaaactgtcaagaacatagactggggaaagaccatcttttcaataaatggtgctgggaaaactggatatccatatgcagaagaatgaaacaagacccctatctcttgccatacataaaatcaaatcaaaatagattaagaggttaaatctaagacctcaaaattgtaaactactacaagaaaacgttgggaaaactctccaggacatcagcctgggcaaagattttctgagtaataccccacaagcacaggcaaccaatgcaaaaatggacaaatggaatcatatcaagttaaaaagtttctgcatggcaaaggaaacaaccaacaaagtgaagagacaacccacagaatgggaggaaatatttgcaaacaagccatttgacaaggggttaataaccagaatatataacaagttcaaacaactctaaaggaaaaaatctactcatctgattaaaaaatgggcaaaaatattggaatagacatttctcaaaaaaagacatacaaatgggaaacagacatgaaaaggtgctcaacatcattgatcaacagaggaatgcaactcaaaactataatgagatatcctctcaccccagttaaaatggcaaatggctttcatccaaaagacaggcaatagcaaatgctggaaagaatatagagcaaagggaaccctcgtccactgttggtaggaatgtaaattagtacaaccactatggagtccaatttggaagctcctataaaaaactaaaaattgagctaccatatgatccagcaatcccactgctggtatatatccaaaagaaaggaaatcagtatatcaaagagatatctacactccagtgtttgttgcagcactgttcacaatacctaagaattagaaacagtatctatcaacagatgaatggataaagaaaatttagtacatatacaaaatggagtacaattcagccataaacaagaatgaaatcctattatttgcagccacatagatggaacaggaggacactcagtaaaataagccaggcacaaaaagacagcattgcatgttctcacttatctgtgggatctaaaaatcaaaacagttgaattcatggacatagagagtagaaggatggttaccagaggcttggaatggtagtggggtgtggaggcagggatggttaatgggtacaaaaatatagttataaggaatgaataaggcctagtatttgataacacaacagggagactatagtcaataataatttaattgtacattttaagataactaagagtataattggattgtaacacaaaagataaacgcttgaaaggatggatatcccatgctccatgatgtgattattatgcattgtatacctgtgtcaaaatatctcatgtatcccatgaatatatacacctactatgtacccacaaacattaaaaataaaaatttaaaaaatgctctcctggaccctgtttttgggagaaatctctctctcttactaaactgtgttttcacacatattgaattgggagctttgtatgcaaattatcatcttagtcttctctcttctaggatgaatctcggtgttttactcactactgaaatcctgtacgtacttgtgtgcacaacatataccatccttcacacataaaaaacatgcaacaaaacttgaaaactagttatttggaagaaataaatatatattttatatagaggtttttttttaaaggaaagtattggcatatttcagcaaggtaacttgatgtgctaagatgaattcttgagacaaagatatgacttggtacagcttggtagagtaaagcctaaaggtacaatcttctaaacctgtgactgctcaggcttcccttctgctcagacccttttttctctacctcccatattccaaggacttctatgtggctgccctcattttggttaccttatattgatgtctttgccatgaatttggcccttgatgcccttgtcctttatcttggcttttaactcttacccagattaggtacaccatagctgttcagtgggtagggccagataccttcccttaacacatatacattcgtatgtaagagggtactttctgccaactgatgattaagttaactcagtgctaactggtgccataatatagcatagagctgtgtcacatagacccagtcctcagtgggtctctctgatgcaaaggaaaaagtgagtcctcggttcagatgacttttttcttctcctagcagccacaatattgctttagctcctagctcttggcctactcatttcaaacttagaaaaaaagctatggtattgaactgggacatagttcaggcccaggacagagattttaaattaatgtctggggtatccaagcatgtgaaggcatagacacatacatatgaaacccatttatactggatacaaaaacttagctgaaaatctttccagtcgaccacctcaaatagttggatccatttttaataaaagtaaggctgatttggtgcaactacctttcagttaggatcagaaggggtagatggtggtgaaagggctgaaaatagaggattccacctagaaagcacaaactaagctttaatattgtctttcttgagtaaattttacattgtgaattctggtctcactacccaacaaaaaccatgggtgagagaaattaatgtccttagctttcctctggagacatctttttgttctaacacagagaaatgtttgccaataaaaattcatacccaaatgagtacagttattggttaagatgaaatgtttctcatttgaaactttcatggttgttataaagaaaatttctgcatcccttcataaacgttgagactgactgaaactgactgagttaagttatagtatcaatgaatagccacacattttctactttaaaaatataagtgatcagagagccattcggctcaaaagaagatgattgtcatccagtcaggaggtttgttgaaccttatagaatacataagataaagttataaaatgatagcatcacttacacactgaagagttataattgagatgcccagttgctgatggtagctaagatgtttgtgtttttctgaaaaggactcaatgtggcctaatgttcttgccttctatgctatgaatccttcaaagcatcactcatgcattcaataaaactttattgtatgcctactatgtgccaagcactttgataggctctcaagtttgtgctattccttaaaactttttcctgctttgtgtcttaagacattgcatttccctcgttctgctccttagtcatagatgtagcctttgctttctcttatttacctctaaaatgtaggtgtttcccaggactttgtccatgttttcttctcttattctgtactccccctgggtagcatctctcagcacaatctctacatttatgtctcctaatttctacctctggcttctctcctgaattcaaaatacaaacttccagatgctctgctggcaaagtcatcatggctattctgttgataccttcttcatgatccaagtgatacataataccttctgcctaatcgccaactccaccttcaaacctgctccttcttccttatatcatttattggtaaatgtcactactgtattacctgtcctccatgttagaaacctaggcatctctgatgccttttttccttcctatcacatatattgagtctgctttcatagcctactaattctgcctttcctgtgagctctcttttttccatttccacctccaataccttattttagaccagtaattacaaactgacagcctgcaggccatatgtgtttctttcaacagcagtgtttatttttaaaaatgtaacatcctctaaaatgaacatatactctcgagttcaccatgtttctgctgtatcttcaatggtgctaagccagtaccttttatataatagatagttaggcagtatcttgaattgagtgacttgtcctcggaaagcttataacctggctggaaaacatgaaatatgtatatgtaaaatgatttagtaacaacccaaggcagactataagaagaatgtaaaagaaaagtggagcagacaattagtttttcatgtgatgagagaagggagagatcattttgggagtaaccagagaataattcacagaggaaaaggcatttgatcagagctttaaagagtggatagagattatgaaatattaaataaagttgctttattttgatgtttacatcctaagtaaggactttgttgcaaatactgtggattaatgagggagaatgggtacttatttccctcaaactccaaaccatgggacaaatgaaggggggagggcccgtgatgattgaaaagagtaaatataaaactgataggctgggtgcagtggctcacgcctgtaatcccagcactttgggaggctgaggcgggcggatcacaaggtcaggagatagagaccatcctggctaacatggtgaaaccctgtctctactaaaaatacaaaaaattagccaggtgtggtggcgggcgcctgtagtcccagctactcgggaggctaaggcaggagaatggtgtgaacccaggaggcagagcttgcagtgagccgagatcgcgccactgcactccagactgggagagagagtgagactccatctcacacacacacacacacacacacacaaacttgataaatggaggtgttactctaaagggtaagaagtacatttccaaaagtatcaatagcttcagatatatttagaactttcaacaaactcatttgataaatttatgaatggcaagacatgggttttaagagaaaccacaaagtttgggaaaagatgcttggaaagtaatcatgccttcctattatttgcttctttgttatctatttaaagattaaatatagggctgggctgtccatgctacaggcaggcccagaagccctgttttgatgttttcattacctacattctctcctacagtacagtgatatatattagaggactttgccttagttgatgttactgtcaggattgtaactagaattactcatatactctttgctgatgaagaggtaagcctgtaaacagcttagcaggaaagaccatgccttactttttttattagacacagcacctagaataatgcaacaaacatagaggctgttcctaaattccttttgatttcctctggctgaatctaaaggcaatatttgtttcttggagcctgaatcttcatctagcctcagacacaggttatacctacttcctgcctatccctcttccactattctctcctcctcagagcctgttgtactctgttatttttgaaagtccttgcaattccattatcatagcattgcatataggctagttctatggtgaggccaaggggagttaaattgcaattaccctactccagctgggcctagcaatactgcatttgaaaagagtcaggcttttgaaggatgacctttttcatcctttttttcttctccttcagcatcttttgctgccaccacctcctcctacaactgaccatctgaagcagtttaaatatctgctcatttaaaacagcagcacaggctgggtgcgatagctcatgactataatctcagcacttttggaggctgaggtggatggatcacctgaggtcaggagttcgagaccagcctggccaacgtggtgaaaccctgtgtcttctaaaaatacaaaaaaaattagcaagatgtggtggtgtgcgcctgtaatcccagctactcgggaggctgaggcaagagaatcacttgaacccaggaggcagaggttgcagtgagccaatatggcaccactgcacatcagcctgggtgacagagcaagactccatctcaaacaaacaaacaaataaataaataaatacaaacaaaacagcagtacagcaaactgacatgtggccccaaactgggatgttgtgctagtatctagcccatcactgtcaaacccaggagtctagtgttgtttttgatggtttctcttggatgctgtactttgttatatgccatgtaggttcctttttggaaagtctaggatttccccaaaacatatagggaatcgtgtatgaagtctccaaattaatagctcatctcagattttagttgttggaattctctcagcagatatattttcagaatctcatagttaataatatatggagcatttggaaagaaactaaagacagggagatgatggagaagttgggaagatatatgaaacatatgggtaggaggataaggggagatacattttaaactaaaacattaaaatgaaggatcaattttaaaaaatcaaaacccctgatttttctaatcacaatctaatgttatccttaggaggcccttatgcttataccaggctaagcacagagcagatatatcatctcagaaactacctgtctgctcaaaagcgtaaaggaaacttagtgagggaggcttctaattagaattaagagaaactgaggcagatgatgatcagatgtaatcagggtagacaatatacatagaacgaaagccaggttacttaattatattttaaactagattatgcaacatataatcagtggcatactaaggctggagccacggaagcagtccactccgggcacaggaaataaaggagtgcattgtctgtagagatataaaagcagtaataaatgtgattaataatcagtttgacttggtgtgcacattattatcactttggagtgcccaggcttaatccttggatttacctttcttttctgtctatatttactctttaagtaacttctatatgctgatgactctcaaattaaaatatctgtatctatccaactagtaactccacatctacatagtggaagtctaataaacacctcaaatgtaacatttccaaaattgaattcctagtatctccataaaacctgcagtcttccccatctcagttgatggggtcttcatccttctgattgctcacaccaaaattcttggagtcatccttgactcattcttcttttctcccacagcacaaccaatctatcaggaaatcatcttggctctaactttgaaatatttccagaatctgaggactcctcaccactctctctgttatcatcctggtctgagccatcatcatcatcatgacttgcctgatttactgcaaaaatctccaggctggtctccctgctaaactgagaataaaagcttaggctcctttagtggcccacaaggccatatatatctggtacttggataccactgtgacttcgtctcctgttcctctctccttcactcccttcacttcagccacattggccaccttgatgttccttaaacacacctgagcatcctggggaagtttcttctgcctgtgatgctcttccaccctgataactgcatgctttgtactccctcgtctctaggtctttgatccaatatcaccttcccagtgaggtttatcctgccctgcctgtttaatatgcaacttgtccccactccactcccacctccccatactctcaatccaccttactctgatctaggcttttctttgatgcatatcatttgttactttctaatttttcatgaaatttgcttattaattttgcttactgtttattgtctgtcttccctcactggaatgtaagtgtatatttttgctcacacattcccagtgtctcaatagttcctgcttggcatatagtatgtattcaataaattattgttgaatgaatacatgaattgtatttaactatatatatctattaattatggaagtaatttaactgactgaaattagagaaaccaggcatggggcacatctacacatcacaaccaggcacttcaacacagacttttttgttccctgaagcatttgtggatgtttgtgtattgtttcctttagattacaacctaatccttgacagaaattgtaagtgcttgttcatacatacttgcaattgcttactttctgccagtctaaatcaagaatatattataagaatttccctggtttgatgaatgtcacttactgcaattccttcttacacatttgcacatttactttttattgtttgtattttcttttcttttcttttttttttactgaagattgtttagaaagttctatataatatagaacttttaaaaataagcatgattgtttacctaccctctcatccatctagatatttccagtgagaaaaaaaggaaggcaaaaaagagaaatcacctggaaggttaccagaattaactcttaactggcatttaaaacctttaatctctaactgccctgtaaacaagatagtactttcatacttaactttctgtataaatcaagcaccttttttatacaaccttatgagaactgctagccatgtgacaaatattaagaattgatggccaggtgcagtggctcatgcctgtaatcccagcactttgggaggccgaggcaggcggatcacgaggtcaggagatcgagactatcctggctaacacggtgaaaccctgtctctactagaaatacaaaaaattagccgagcatgggggcgggagcctgtaatcccagctactccggaggctgacccaggagaatggcatgaacctgggaggcggagtttgctgtgagcggaaagatctcaccactgcactccagcctgggtgacaaagtgagactctgtgtcaaaaaagaaaatgtggcacatatacaccatggaatactatgcagccataaaaaatgatgagttcatgtcctttgcagggacatggatgaagctggaaaccatcattctcggtaaactatcgcaaggacaaaaaaccaaacaccacatgttctaactcataggtgggaattgaacaacgagatcacatggacacaggagggggaacatcacacactggggactgttgtggggtggggggaggggggaggcatagcattaggagatatacctaatgctaaatgatgagttaatgggtacagcacagcaacgtggcacatgtatacatatgtaacaaacctgcacgttgtgcacatgtaccctaaaacttaaagtataataataataaaagaaaagaaaaaattattatctgtatcttacaggcagggaacataatttagtaatttcatagaaaggtctatactgaactattacaaatgtttttaagtacctgatttttccccatcattaactgtggttttctcttcaaatttctttttcaactttcaacaagaacatcctgctgaagcttgtggccacatctagtacaattgtcctcaaaggcttgtgctgagaagaatggaagatcgctagatagcttcctagggcagtgtaggattgaagggaagagagaacctcagagcaaactcagttaattctgatttaatcattaatgaaccagacaacaggctatatttacgaaactgttaatcaaaacagacaggatgtaaatttctgggacaaaatgttgaaaatatcaattctgtagcaaggttaaacctgtttattatttatttaatctcaagacacagcagaccatttattgattaatgagaaataagaagcatgttgcaattaaatttaacttgtaagtcaggaggccctggcaatttggtctgatactatatgactttgggggatgaattttgaaaattcctactccaggataaggaagacctcatttatttctttccaaggtctcatatatcatgttttatcttaaaaggaaaacagggaaggacagcaattggctgcattctgaaatccaggcaatagatctaacatagctattctattaaaaaaaaaatgaggaatcctcgaacatagaaaacattctacacaaggttggtcaggtagctatgttgaagaggcaaagtccttggaaggcccatttgtcctcagaaaatcattagacacagctagtgaaattctgactctccatcaagcaaggcaaggctaactttgtatgtaggtaatatgttctttgcagtatttctttattttatgtcttttaaatgaaaaacaattaggaaagctacattgtaaatatttgtaaaaatagaatgagttttaaaagatttaccccactgctaccattcctataaaacttttattaatattttgatgtatttcatttcagtctttttttctatccataaaagttacatagttgtaatcatactgtccttacaattttgtatggtgctttttaaaacttaatattatatcataagcttttccaaactgttgtgaaattctcttaatcatgattttaatgtctgtaaaatgatccattgaatataccatgatggacatttaaattatttccaacttgaaccatagtaaataactatttggtggcatgtacccccatagttatttctccataactggatttttttctttaatgcagagacccacaaataaaatcattgggtcaaagaacatagctcttttagcgaattatattacagtttgattttgtttttacaaaaagtatagtgtgtgcctggaaagatacataggtacttaaaatttaacagtgattatttctgctgctgggtctacaaataaatactaacgaatagttgcttttctttcttttttacttttcgttattgtcaaagttttctttttttttttttctttctttttttcatgagatggagtctcactcactctgtttcccaggctggagagcagtggtgtgatcttggctcactgtaatctccatctcccaggttcaagtgattcccctgcctcagccccctgaatagctgggattacaagtgcatgccaccacacctggctaatttttctattttcagtagagacggggttttgccatgttggccaggctggtcttgaacccctggcctcaagtgatctacccacctcagcctcccaaagtgctgggattacacatgtgagccaccgctcctggcctttattgtcaaaaatttctacagtgaatatgtattcctttttaagttgagaaattataataggacaaagacagagtaaagtgtaatgacttaaactcgggctttagaggcagactcctgggtttgaatttctgcttagctagttactagctctgtgatcttaggcaagtaacctctttgggactcagctttcctgtctgtaaattaggataatgatggtacataagctgttgacctcatgtctgtgttgaggattaataaattaatccacatgaagtgctgaaaacaatgtctggtatataataaacaccccataaatgttcaatatcattgttatttgggactggacagcaattcaaaattcctatccctcatacagatcatgccaccctctctgaaattctaatgttggcaattcaatccagtatagttcattcataggacaagtatacttgactttacttaagaattgaagtgattagaagagggagcatctgaaactcagatccttctgccgtcttatatgtatacgttattctctgtgctctccagaatagtctaattgaagaaaaaaatgaggatatgctgagagccctggttatatgccataaatagctctggtttgaatgagagggaaatacaaggcagacttttaaagacagtaccttacaattttatctgtgacaggcactgaacttaaatattatgccatgaagtatgactatgaacatttatagaagtagatatgtcttggtacaaatctctgtcattcaaagatggctttcccctcgaagcaaaattgattgttttgcttcattgaacattgcaaaattggatatcttgtttactcttccatataccaaagatttataaggtacaatctattagtaaatataaaaatgagaaccgagtttcatttttaaaatacttttagacgactaatctacctagagacctacatttaattctggagaataatctataaattcttgaatagatatgtcaatgccctttatcataatcaccctagtttaaaaatcatttatcagatgcctactcaattatctacgtcgtatctttttatttcccagtataaacaaatacgcatactagggaagctcactgtgtgggatcaccagagaaattagttcatgcagtgaataattattattttttccatcggatagttaagctcaggattttcatctgtgtaacttataatgtatttctactatataacatagatgaggtcgtgttaatatgaagccctcctgcccttctgagacccaggacagtgtttggcagccttctgatgctttaatactttgaagaaaagaagtaaatattcatctaattatctggaaagttttttttttcatttcagagactcaatagcctatgtaaaatggacaccaaatcattatttcccaattaaacttttcttgctctgagcatgatagtggcatttttttaggccatccaccaaacaaagtgttgttcctcgttcctccagatgttaccatcttcttttcatgcccagggatatacaacggaatgtgtcctcaggaggtagttagaaattttgtttgcctacacttctaagtctcaaattaaaagacatcaactactggtgtatgccagtcattgcataagcacaggaatagacttaagctatttgtctaaatttccattccagggagcaacaagaaaatcataccaacagtataataaaaaggcatttgaagctcagggcatatctattgtctcctttatggcaggcttgagagaggaagatattatttggacgaggagtttacctaatatctgcgacatcactcaagcctactctaagcttttcttaaactgtcctttacttatgtagtgctgtaaagtaaaaataattaaaaaaaaacaagcattgtcttaagtggataccactgagcgtaaagcctacaaggtgtttgaatgggctgtctctcacttaagcctaataaactctgattgtattaggaaatgtagtttaataactcctgtaaaccgggagtcaacaattctgtgtcccagaaaaataaaatgaaataaaagagttggaaattattgagagctttgaacacacaatgtagtggatgaacacaggcatttcacttttgatttctatgagcagtaatttttttgttataaaaacaagaaaaaagaaaactactgtcatactcagatactcacttccctgtactagtataactcatgaggaaacaaaagctctccctatgagtaagctccagaatctatcagaaaataaatcaccttaattttcattgttattggaaagccttctgccaaatggggaagtagatgttgtactgactgaagcttcattttgtgacaacagcaacatagggtctgacttggaaggccttgaagaaggctgtaaggcctttgtaatacaggtttgcggggacaggactaacatcagtagacaagctagctgagatagagctggctttgactgatcggggctattatatttccaagatgcagcctagcctctgagtatcagaagcagcttaagtattaagggggtggtggtgctactgtagtttaaaagcagatttttaaaaaaagactttattgtgtaataatttagcattgagaaaaatagtaaatgtagctatttttttctccaggtagaactgttgaaagggacaattttaaacagccttcttcacttttagcagatataacacatagattgtccttggtgagaaaaaaggcttgatgtcaagtccagaagaaatgtgaatgtggaattgagtttgaaataaactgattcccaatgctcccattcataaaactgcatacagacctgtgtgttgagtgatgtacaatctttttgaaaattcactgatttatatcagtcattttattcctcaaactcttcttcatagcaccttccccatgcacccatacctccaggtacctggaaagggtttgtctttgtgtccatttcttgcttctgactcttgaaccaactgtataccctaagccaattgcacacatactatagagtataatggtctctggagtcaggcagaattgggcgtgatgcctgattggatcacttacagttatgtgatcctgaacaatgtaattaactttctgaacctagttttccacatatgtaaagtggagctaataatagcacctacccttgaggattattttttgcctggaggattaagcaaggtaatgtaataaagagctttgcacagtgcctagtaaacactcaaaaatagtggattctgctttcattttttgttggagtattgtaatttattcctcctcccgctcttccctctcttcctccatcatcatcatcatcatcatcatcatcatcatcatcatcatcagccaacatcacctatagaggctacctgggctacctggttacggttggtcatagactcatacctctaggccacagtttctcaaatagcagcactcttgacattttgagccggatagttcttggttggagtgggaagaggttagcctgtgccttgtaggatacttactgtaggatgctcatttaacagcatccctaccttctacatactggatgccagtagcacacatactccacacctttgtcgtcaagctatgcaaccaaaaatgtctccagacaatgtaaaatgtcctctggggagcaaaattgctcccagtcgaggaccactactctaggtattctttggcttaaaaatatccatgaaaagtatctaccattcatgtatctattactcttcattagtttgactcatttcatccagtaatcttggtctttatcttaaattctcctttagattttcagagttctctggtttttatcttgatttttgaaactaaatcttatttctctattttccttactacaaaccagcaattctttgatagccggttctgggccttaatatatctctgaactaacaacttactgttttttgctttgagctaccagcacttatctgcacacccctagtgctaggtcactggtatctagctagagcctttcctttaaatgtttttataaaaggcagttgaaatgaggactctagagccagatatcctgggttggaatcctggctcttccaattaatagcttagtgactttaacctctccattttcctccatttaagaaatgaatacattaacagtcactatttcatagagctgttgtgggacttggtggtttaaataaataaaaatttacttagaacactgtctggcatatggtaaataccatgtaagtgtaaactattattattactattctcataaagactcccatgtgtctttactagcataacataaactaaactgcaagccccatcttagtatgttatgaaacgccaggggttcagtgtagctcccattgctcacttcacagagagccaatcactgagacaatgtgtattgccagggaggaaaggctttattcaggtgctgcagcaaaggagacaggaaataaatctcaaatccgtgtctccaacaaactaaaagtgggggtttatatagcagggaaggagtgcagctatgtgcaagagaacaagaattaggagaaaggaagcaatcacgatgggtgaggggtctagtgtcttattgtttgaatgtggtgatctggtaagtttcagttccttgatagtatcagggaggcctgaagattggtttcctgaggaaggaactcagataagacaaatgtgagattcaagatttaagactgtgagggtcaatttctgtgtttattcaaaaagactataaacatcagttcttttggacaattggaccagtttcaagtgctctggaagactaccaatgttttcacctcatggtacatattgaaaattttaaatatgtattcagcaaattggagttaatcgtggtggctctgaccacttgaggactgaggtgatcaatatcttagccatgtgtaactgacttgtgacatgcagttgtccacagcactgtggtttgaaaactttgcaccaggctcatcaaaattaaaggggaaaggttttaaattgtaatccagttagaaattgtgatttcctttttggatgtgtaagatcccagcatcttctaggtccacaggccttgtaaggtctatagctgccctttagttttcttccttgaacaagctaaaataaaacaaaggcaatttctggggaatatcatgaggttttaaacatgtgtacatgtttctctctaatagttcagaatctagtaattcccacaagtataatggtatgagaatttaacccaacaatgttagagaacagcagctcttcattcaaatttcacatgatgacccactcattctattttgtaattttcttttgaaaggtttggggcagaaatagctcagatattttaaaaagagctattttctctgtttttctgtttgagtcctgtggctttcattttatggcatgagaggactgtttttcatttgtaacctctccaagtactgattttaagcaactcattaacatatgcttcctcttcataatccatcacattcaaacatttgattggtctcttcagcacaatatgaataataaactatcttcctcccagagacattcaaaattgtggtttagatatgatgaaccagaaaaaaatgttgttttttagtccactttttgaaaagtctcttagatgaaaggatactacaaatgaactttctaaggtaaatcagggctttggctaaaaaaagccaaacatttcagtcaaggtctgacttacaaagcatgctgtcagccctaccagaatatgtggcactggacacaatatacttcaatttttaatttctattgtcaatgccttcgtttatgcctttattagtttatgcctcaactttggtgatagctacatattggactgctttttctcttccaggacctcccatatgagttcttgaaacgtagctttgatagtatcatttcactccaccaaaaccttcaatggctccctaatgattgatgaataaattcctgggaatcatagaaatgctagaatgtcagtgttggaatgaatcctgaagtataattcaccagttgccaaactatggtctctggaccactgccagaagtttgcactagtcctcagtggaaagagaaaaataaggacaatgaagtcagtgttccataaaatgaaatttacttattttaaaaattatttaaaagtatcttgaggttgggcatggtggctcacgcccgtaatcccagcactttgggaggtcgaggcgggtggatcgtctgaggttggaagttcaagagcagcctgaccaacatagagaaaacccgtctccactaaaattacaaaattagccgggcatggtggtacacgcctataatcccagctaactggggaggctgaggcaggagaatcgcttgaacccaggaggcagaggttgcagtgatccaagatcatgccctcgcactccagcctgggcaacaagagcaaaactcttgtctcatgactaaaacaccaaaagcaatggcaacaaaagccaaaattgacaaatgggatctaattaaactaaagaacttctgcagaggaaaagaaactatcctcagagtgaacaggcaaactacagaatgggagaacatgttttgcaatctatccatctgacaaagggctaatatccagaatctacaaagaacttaaacaaatttaaatgaaaaaaaacaaccccatcaaaaagttgccgaaggatatgaacaggcacttctcaaaagaagacatttatgcagccaacaaacatatgaaaaaagctcatcatcactggtcattagagaaatgcaaatcaaaaccaaaatgagataccatcccacgccagttagaatggtcatcattaaaaagtcaggaaacaacacatgctagagaggatgtggagaaacaggaacacttttacactgttggtgggagtgtaaattacttcgaacattgtggaagacagtgtggcaattcctcaaggacctagaaccagaaatccagaaatacgatttgacccagcaatctcattactgggtatatatccaaaggaatataaatcattctactataaagacacatgcacacatatatttattgtgacactattcacaatagcaaagactcggaaccaacccaaatgcccatagtgatagactggataaagaaaatgtggcacatatacaccatgcaatgctatgcagctgtataaaaggatgagttcatgtcctttgcagggacatggatgaagctggaaaccatcattctcagcaaactaacacaagaacagaaaaccaaacaccacatgttctcactcttaagtgggagttgaaaaatgagaacacatggacacagggaggggaacatcacacactggggcctgtcagtgggtggggggctaggggagggatagcattaagagaaatatgtaatgtagatgacgggttgatgggtgcagcaaaccaccatggcgcatgtatacctatgtaacaaacctgcacattctgcacttgtaccccagaacttaaagtataataataataaaaaaaatcttgaactttgttttgaaatatcttttattttatatagtgacagcattaatagataataatttatttgtttattgtttttaatgtccatacttggcaaaatgaagttggcaaccatttgttgcttcacgtcccccatcccccactttttatttttattttttattttttctgagacagggtctggctctgttgtccaggctggactgcagtggcatgaactcagctcactgcaaccttcttcctcagcctcccaagtcacttggactacaggctcatgccaccacatccagctaatttaaaaaacaatttttttttctagagacagggttttgccatgttgcccaagctggtctcaaaatcctgacctcaagagatctgcctgcctcagccttacaaagtactgggattacaggcgtgagccatggcacctagctgccaccccgaactttttaaattttacaaatccatgaaatccaaaatctgaaagctactcatttcataaatgagaaaatttaaaaaagaaagattaaatgacttacctaaggccatacttatactgggaatgctgtattacaaatgttaatattagcttcaagtctttaccataaatttcaaagtcctctgtacttaaatcccagtatgcatttgcgtctctattatcagcatatcttaaaagaaaacctagttctagatccctgaggaatcaccacactgacttccacaatggttgaactagtttacagtcccaccaacagtgtaaaagtgttcctatttctccacatcctctccagcacctgttgtttcctgactttttaatgatcgccattctaactggtgtgaggtggtatctcattgtggttttgatttgcatttctctgatggccagtggtgatgagcattttttcatgtgtcttttggctgcataaatgtcttcttttgagaagtgtctgttcatatccttcgcccacttgttgatggggttgtttgtttctttcttgtaaatttgtttgagttcattgtagattctggatattagccctttgtcagatgagtagattgcaaaaattttctcccattctgtaggttgcctgttcactctgatggtagtttcttttgctgtgcagaagctctttagtttaattagatcccatttgtcaattttggcttttgttgccattgcttttggtgtttttgtcatgaagtccttgcccatgcctatgtcctgaatggtattgcctaggttttcttctagggtttttatggttttaggtctaacatttaagtctttaatccatcttgaattaatttttgtataaggtgtaaggaagggatccagtttcagctttctacatgtggctagccagttttcaagcaccatttattaaatagggaatcctttccccatttcttgtttttgtcaggtttgtcaaagatcagatagttgtagatacgcggcattatttctgagggctctgttctgttccattggtctatatatctgtttaggtaccagtaccatgctgttttggttactgtaggcttgtagtatagtttgaagtcaggtagtgtgatgcctccagctttgttcttttggcttagaattgacttggcaacgcgggctcttttttggttccatatgaactttaaagtagtttttttccaattctgtgaagaaagtcattggaagcttgatggggatagcattgaatctataaattaccttgggcagtatggccattttcacgatattgcttcttcctatccatgagcatggaatgttcttccatttgtttgtatcctcttttatttcattgagcagtggtttgtggatctccttgaagaggtccttcacatcccttgtaagctggattcctaggtattttattctctttgaagcaattgtgaatgggagttcactcatgatttggctctgtgtttgtctgttattggtgtataagaatgcttgtgatttttgcacattgattttgtatcctaagactttactgaagttgcctatcagcttaaggagattttgggctgaggcgatggggttttctagatacacaatcatgtcatctgcaaacagggacaatttgacttcctcttttcctaattgaatactctttatttccttctcctgcctgattgccctggccagaacttccaacactatgttgaataggagtggtgagagaggacatccctgtcttgtgccagttttcaaagggaatgcttccagtttttgcccattcagtatgatattggctgtgggtttgtcatagatagctcttattattttgaggtatgtcccatcaatacctaaaaataccatttgacccagccatcccattactgggtatatacccaaaggattataaatcatgctgctataaagacacatgcacacgtatgtttattgcagcagtattcacaatagcaaagacttggaaccaacccaaatgtccaacaatgatagactggattaagaaaatgtggcacatatacaccatggaatactatgcagccataaaaaatgatgagttcatgtcctttgtagggacatggatgaagctggaaaccatcattctcagcaaactatcccaaggacaaaaaaccaaacactgcatgttctcactcataggtgggaattgaacagtgagaacacatggacacaggaaggggaacatcacacaccagtgcctgttgtggggtggggggagggggaaggatagcattaggagatatagctaatgttaaatgacgagttgatgggtgcagcacaccaacacggcacatgtgtacatatgtaacaaacctgcacattgtgcacatgtaccctaaaacttaaagtataatacaaaaaaagaaaacctatattctaaacagtcatgatcattttccattccttaaatgtgccttgcagttgttctttaccctacctattctcctaaaatcccacccagctcaagtgctgactctattaccatacctcaatgtcagaagggatcctttgcttttctgtgcttccatatgtggatgctacttatcagcatattatgtcttgttcaacctgtcatcgtctgtggactattccccctcctatgctctccatttcagtaaatgacattaccctctacccaattgctcaagctggaggccttgaagtcattcctttctgttccctataccaatattgagttaatcacaaagccctgtcatctttagctccccaatttatcctgtatatgtccactttaattcttccactgaactgctacacagatcaccctgtgtctccttgttccaccatgcaatccattttttacctaccggccgcttttagatctggtactgctccttgtaaaatcctttggtggttttccatagccctcagattaaagcctagaatgtcaacatgttaatacaagatatgtggtacccatgcccacttctccagcctcatctcttcctactttttaatttgcgtcctttgctttagctgtactggatttcagttccttgaatgcatctgtctcactattgcatgcttttgcttgccgattttaattgcctctcacttctctggatcttcacacatgctatggagtgaagcctacactgcctgcaatactcttccttctaggaaacataccttaaggctctaagtttcagtttgggtgcgccgtagcagagtacctttcctttaccatagcactcaccacattatattgcaatttcttgtttaactgatttcctttctaactagactatatgaaccatgaggccatggatcatctttatgttgctcaccattgcattcaaactgtcagctctggcacatagtaggtactcaataaatgtaatctgtatgaatcaaaatatcatactacatttcctcttatactgttgagactttcatatttgtggtatttccttgattctattacaaattcctataagtggaaggcagtcttttataattactaccattttatagcaccacacacataggctgctggtaaatatttgataaatagatgaataatctatttttttcttacagggtcgcgggtaagaattagagtgcatatttgtaataaacatagaatgcagcacaacaaaataggctatacaatctaagaagtttggactaatactagtattgattgtttatagcctaaaaggtgccccccaccaccgtaaaatacctgctttaaattgggaaatactctatggtttcatcaaggttaaatacgattttacaaatagggattctgatacatttcaagggtaataaaaaatgtaaaaatcttaaaatgacttgtgatgccttgactgctgtggggtgtgtgtgtatgtgtgtgtgtatgtgtgtgtgtgtgtgtgtgtggtttgtttcttgggggctgaactcagctggagtttccatgaagttatgggtagggtgatagatttacattgaaatatttcactttatccaaaagttagttcagtttttcttaatgggagattttttcaattgagaatatatttttgcacttcatgtttattgattctctttccaacatccagaacatacagcaatatcatcagtcatagatagttcatattgcacataatgggctctaatatcagtctgtttgtatatatcataatacctgaattgttcaacaaaatatctcataaggcaggaagcttcttttctgttttctgtttttgatagactcaacctaaatggataatgttctttgtaaaaggtgagcaaaacatcagcactggtgatatttattttacaggatgtgccacaagcctggctcactcctcttacttagaagggcattacctgctgagaccatttggatttgttgagtccagtgcaaactgaaacagtgacctatgtgaatgacagccaggtaaatgtcagaggacaatgccaaaaagacatattaagttcaggagttgaaattgtggtaagcattagtgcccatcctcaaagaagtcttctctgactttcctgtgcaaggcagtttcctcgctccccaatttatgatgctatatcaaactcaacaaaccttggtaatggattgaatgatgtgggtgaaggaacagaaggaagaatcaagaatgtcttggccctaggattattatctggctcacggtaagctctaaataaatatctgttgaaagaaaaaatagctgggaataatacacattttgtcaccctcagccacactatgcagactataaaattgatgcttgtttacatcattaggtggccatatttacattaaaaccacagttttaagagccaaaaaatcctgggttcaaatcctgacttcaccatttgagctatgagacattaggagagttacttaactgagtctttctttctcttcttataaaaaggaaatcatctcataccaccctcacaagatgatggtgaagattagatgagataatacatttatcgtacttagaagaatacctggcagaaagtattcgtagagggtagttatcattgttgtcagaatgtaatgtacttaagtgtcttgaaaatagtaaatattcaataattgttatctaaaagtattataattatcactaccataatagttttatagtaaattattttcagtagaatgcttatggtgacaaaaattacactttttcatattattgcacacaaatttttagtcttaatttcagtaattgttatttcttaaaatatttggtatagacatgggatatctttttatttaaatcaataaagggaatggttgttgctcttataatttatgcaaattgttcataaatgaataaattaaagcatttatttgtactaactctggtagtttgctaaaaaaaaaatcaggacaggctaaaagaagatatggatataacggctgcattgtttttgctttttttgataaaccatatttcaaattcattcacagacattttcgctttcatgaatccaagatatcttctctagtttctaaaagtatatatacacatatacacacacaaggtatacatatactcacacattcacaatattaaaatgtttgggctaggtgtggtggctcatacctgtaattccagtaatttgggaggccaaggcatgaggagctagaggaggctgagttgataggattgcttgagcccaagagtttgaggctgcagtgagctatgattgcaccactgcactccagcacctggatgacagagcaatatcctatttctaaaaaaaaaaaaaaaaaaaaaaaaaaaaagtttgctgcctgctgctgcctaggaccacaatggagaatggagaatagttgaagaaagtgcagtacagaagtttaggcaagtggtaattgttgttggtatccatagattgagccaatgcaaatttgcaggctttagaaagatacctctgctgttctccagatttattttctaatttcaccttatatgttttttttcctacacgtttttcttttactgtctcataaattttatgtcagtatgctatgactggatatttaggaggaaacaaaattgcattgttaaaaagttcagtctttttttttttttttcttgaaaatgagctgctaactgggcacagtggctcacgcctgtaatcccagcactctggaaggccgaggcaggcaggtcacttgagctcaggagttcaagaccagcatggtgaacatagtaaaaccttatctctacaaaaaatacaaaaattagcttggcattttcccacatgcctgtagtcacagctactcaagacgatgaggtggaaggactgcttgagctgggtggtcgaggctgcagtgagctgtgttcacaccactgcactccagcctgggcaatagagtgagaccctgtctcaaaaaaaaaaaacacaacaacaaacaaaaaaaaaaaaagaaaaagaaaatgggttgctttttaatgctatggttagtggttagcaaaccaatagcatcaatccagaatcttcatcgaataactatggtgtgtcgcattctaagggagtaaatggagtaagtatgagactttggctctgtaaggaagtaagaaaagtgaaagacaaaattgagcagaagtagaagctgaccgataatgtagttgctacggcctcagcagatcttacagggagatctggagttaggatgggtctctggatgattatcccaaattgaaacaagggggctaggcttttgaattccttcatcaggcagtctttggccatacgccactccctgctaaggtgttacctttgggcatacagctccttatagccaaggacaattcccattgttgtggctctagctgcaaggattggtaacttgatattctcaacagttgtgggataggtgcattggcccctaaagaacctacccttgaccaagcaccagagcatttactataaggcattgcaacttgaactgccctttaaaggctggatagaatttaagtagatgtagaggagaattgacatatatgcattcctgggtggggaatggtatgggaaaggacaggctgtactggagacagcaaataaatcagattttaattcagcttatatttattgaattactactttgtaaaggtactatgttgtgctgggaattttcataatgtggtacctcatttaattgttataaccctttgatttaaatattatttccattttatatatgaggaaaatgtatctcagcatggttatgaattgcccaaagtcacccatgaaaacagtattagagctggcactcaaatccaagtttcctagctctaaagactctgctttttctgctacaccatgttcatatgtctaaaaatggaaaattacacttacaaatggtggcagtagattatggagagtctataggatacattctggttcttggtcccatactttattgttttggtctctagttgtctcagaaattaactgtaatttaataataataataatacatttagtaatagtagttttaattaccattggttatcgttcaccaatactatgttaaatttactcactctttctctgtggattattgcattgagtctttactgtaaatctgaaaaaggtagtattgtttttattttatgtatgaggtaactgaaacttagaaattgtccacgatcacatagcaagaatgtgacagagctgacattagaacccaggtctctctgactcctaaagtccatgattttaagcactacattttaagcctacctctttgtatgttttatagtcctttatacatcaccgagcacatggttttgtgctattactatacttaactattacttatcaccttagcaacttgggataagtaattttgtctgtctgcttcagtgtctaaaatttttactcaagtgaagcaatacctacccatggctaatgggaatactatatgagaccagagagtgaagcagtgaactcaaaaaaatgggcttatacctgatttctttcaggctctaggcctatgtcaattggattgattttattcattgtttcatgcctactcttcatccatcctttattacaacaaatatttattgagtcttactgtgtgcctgtcactgttctagatggtgaaaaaaaggcaaagtcctgtcctcatagagtgtacgttctagagagtgagacagttgattcactactaaatatataaataaataataactcaagatagtaataggtgctctggaaaaaaattaaagcctggaagagaatgggaagtggcatagggtggggaagggggctgataatttagatagggtggtcaggagaggctttttgataagatgatataaaagtagagacctgtgggaagaaaagtaagccatacagatattttgaggaatagtgttataggcagagaaagtgaataacaagtgtgaaagcccaggggtaggagcttgactggcatgtttgagagccaccaagatccaattaatgatatgttattataatattttgccaaatgactcaccagtgatataaaagatttaaaagccgtttccaaagtatttccctgtagagcagatttggaatgtgatgaaagagggaacaggaccaatgggaaaatattaaagtgtttgaagccaactcatcaggatgaaataaatgagatgggctatttaatgattatctatagcagttccatataaggtttttataaagaagcagtggaatagccttctaaagactaagctcttccctttctcttaggaggtaggtacgaattagaaaattaatcaagagagaatgtggcctctgatgacatgagagttgtttgaaggtggcaggaggcaggagggtggttgcattcagtcaatagttgagcaatttacaaaaataaatagaattgagcaaattcagaacagatttaatctccattttattttcaagctaaacaaaagatgctgatataagggggaaattactccaaaaatccagctttactgacatattttgagtcatttgcatgaataaaatggtcctagagacaagtgcgaacttgactttaaagtgaataggcctggaagtgttttctgacggagaattagtttggtgcattcattcaatatttattgatataatatttatattcatgttattccaaaaaagagttgaagcagattgcaaagctatgtatataatccacaatacaaaaactaagagatgaaatcaggaggaaataataagaataggagaaataagataaggtcaagtttgggtaaaataaatgtctaaactgtatgtcgtagttagagacaggccacacacatttagctctgagatttctagaaacaactgaaagagtcctggaaactgagataatagacttgtattgtgttaagccactaaactctctttcaaaccattccttagttctcaagggaagacatgaggatgggataaacctccaggggaattggggtactaactttcataaagatttttacttcttgaagaggacttaatttcaagtctatgtagaagcagaataaatgggttatgtgattgtttaaggttgctgaaagatctttccttatatgtagaaacctgtattggcttttgagctacttgaatgtagcaaactaaatattctggaataggatctgtcatcctctacatgggacgctcttttgtatgatacccatccactcttttgcactttgaacatttcaggcctttactgagtatgtaattactgactgctaaacaattatgtcatttgctgaattcctttatcaccagacacataatcatcagttcaaaaacaattaggcaagattctcattgatcttcagaatgtccttaaagcttttcaacttataattaacacatatacttgtcttctttcctttagcacacgtgaaacagaatagtgttcctgctgtaggattttcatcatttgccaatcttcactgtaatccttgaaaatgtgaaggtggatggatgcattttactttacaattcagtgtgataaaacccacagctgctgttcaaagttctatttaatttagaagggaaaggactacttttatcgtgcaggagattgattgaattatataattctctcaaataaggtagataataaaattttaagatatattttacaatttcactattatatactacctagaaggctagctatttttattccttcacagcctgagggggtaggaagttttataaactccacgcccgccccccaaagactacaggttctatcctcaacaataaaggaccctacagtgttatcagtgagagaaattattctgactaagcaggtctgttatttcactaaaatatcgcttatgccttctaatctcaacattccagaaaatgtatttaaaaaacaggcaggctatcagtaaaaaagaaaaccaaaaataaatctaaatattttgttcagttaatgatcagtgtgatttatttatttttattgtatatatttgtagggaataatgtgatattttgatctatgtgtatattgtagaaagagtctatcaagttaacatatccattttatgtttttgtggtgagaatgttaacaatctattgttttagtaactttagaatatacattattattaactgtggttatcatgcagtgcaatagatcaataaaacttatctttccagtctaacagaaactttgtaccctttgagcaacatctccctttgtcttatcccttttcctcccctctcctttaccctctggtaaccacctttctattctctgtttctatgagattagcttttttagatttcacatatgagtgagggcatgcagtatttgtctttttgtgtctggcttatttcacttagaataataccctccagattaatctatgttgtcacaaatgacagaatatcctcattttttaaggctgtatagtattgcattatgtatatgtgtgtataaatgttatatacatgtgtttatatatatgtgtgtatatatatataatatatatatatatatataatatatatatatatatatatattcttcattcattcattgatgaacacttaggttgcttccatatcattgctattataaataatgcagcaatgaacaagggaatgcagatatcgctttgacatactgattacaattttttttggaggtatgcccagaagtgagattgttgtatcatatggtaattctagtttagttttttgaggaacctctatgctactttccaaaatggctgtaataatttacattcccaccaacagtataaaagggttcttttttctccatatctttgccaacacttgttagcattcatctttttgataatagccattctaacagttgtgaagtgatacctcattatgaatttaatttttatttctctgataattagaaattttgagcatattttttatatatctcttggccattcatatctcttcttttaagaaatatatatttagatcctttgcccaattttttaaacctggtgatttgtttccttgctattgagttatttgggttccttatatgtttttgatattagccccttatcagatgtattgtttgcaaatattttctcccaatccatgggttatcacttcactctgtttcttttgctgtgcaaattctttttagtttgatgcaatctaatatatttttgctcttgttgcctatgcttttgtagttctattcaagaaatcattggagcttttccctgtgttttcttatagcggctttacagttacaggtcttacgtttaagtcttttatccattttgatttgatttttgtttatgatggaagataggggtccaatttcgttcttctacctgtggctattcagttttcccaacacaatttattgaagagactattcttccccgttgtatgttcttggcacctatatcaaaaattaattcactataaatacttgattttatttctgtgctttctgtccttttccattggtcaatgtatctctttttatgccagtacaatgctgttttgattacaatagctttatagtatattttgaaatcaggcagcatgatgcctccagattttttctttatgctagagattgctttggctctttggggtttttttctggttccatatgaattttaggattgttttttctatttttgtgaaaaaatgatgttagaaatttgatagggattacactgaatctttagatcactttgggtattacaggtgttttaataatattccttcaatctgtacagggtatatttttccatttatttgtgtctccctcaattttttaatcaatgttttacaattttcagtgtgcagatacttcacctccttggataaatttactcctaattacttttttgatgttcttgtaaatgacgttttaaaaaaaatcagatagctcattgttaatgtacagaaatgctacttattttgtatgttgatttggttatgtgcaactttactgaatttctttattgattctaatagttttttgtggaatctttagggtttttctacgtataacatcatgtcatcagcaaacagagacagtttcactttttccttacctatatggatgcattttatttctttttcttgcctaattgctttagctaggacttccagtactatgtagaatataaaaggcaagagtgtacatccttgtcttgttcctgctcatcaaagaaaagattttaacctttcttgttgagtatgatgttagctataggcttgacatatatggcctttattgtgttgaggtacattccttctataccaatttttctgagggtttttattatgaacagatgttgagtgttattgcaggctttttctgcatctattgagatgatcatgtggtttttgtccttcattttgttaatataatatatcacatttattgatttacatatgttgatgtatccttgcattcttaggatagatcctgcttgatcatggtgagtggtctttttaatgtgctgttcagttcaatttgctactacattgttcaggctttttgcttctatgttcattaggaatattggcctgtagttttgttttcttgtgtccttgtctggctttgaaatcagggtgatggtgttcttataaaataactttgggagtattccctcctcttaaatttttttgggggagagtttgagaaagattggtattagttatctaaatatttggtagaattcagcagcaaaaccaacagactcttggcttttctttaatgggagattttttattagtgattcaatatccgtactcagtaatgatctttttagatattctgtttcttcttgatatggtcttagcagggtacatgattctaggaaatcatccagtctttttaggttatctaatttgttgatgtatagtttgtcatagtagtttattatcttcctttttattttgtggtatcaattgtaatgtctcctcttttatttaggattttgtttgtattttctcttttttaattcttttttgagacagtattgctctgtcacccaggctggagtgcagtggcatgatcttgactcattgcagtctctgcctcctgggttcaagcgattctcgtgcttcagcctcttgagtagctgggactacaggtgcacaccaccagacctggctaatttctttctttttttttttttgaaacagagtttcactcttgttgcccaggctggagtgcaatggcacagtctcgcctcactgcaacctccacctcctgggttcaagcaatccgcctgcctcagcttcctaagtaactgggattacaggcgcctgccatcacgcctggctaatttttgtatttttagtgagatggggttttataatattgtccaggctggtctcgaactcctaacctcaagtgatctgcccacctcagcctcctaaagtacagggattacgggcatgagtcagtgtgcccggcctgtgtcttctcttttttctttgttagtctagctaaagttatgtcagttttgtttatcttttcaaaaacacaacttttagtattgttggtctctttttctagtttcttattttttttccttctctgatctttattattttcttctttctgctaagtttgggcttagtgtatgattttttctaatttcataggttgtttatttaaaatttttatttttttaagtcaggtttttgtcactttgaacttccctcttaaaactgcttttgctgcattccataaagcttgctgtgttgttttcattttctttatctcaagatattttttatttttatttttatttcttcttcaacccattggttgttcagaagtatgttgtctaatttccacatatgtgtgcattttctaagattcatccttttattgatttctagttttatgccattgtagtcggaaaagatactcaatatgatttcagtcttcttaaatttgttaaaatttgttttatggcctaacagattatctgtcctggaatgcttcgtgtgtacttgagaggaatgtgtattttgttcctgttgggtgaactagtctgtaaatatctattaggtgtttttgtctaaagtctagttcaaatccaatgttttcttattgattatctgtctagatgatctgtccaaaattgaaactggggtgcttaagtcttctgctattattgaattataatttatctctccatttagttctatatttgcttgattagttgccctgatgttggacatatatatacttgcaattgttatgacttcttgatgaatttacccctttattattatttaatgaccttctttatctctttttacagattttgacttaacatccacattatctaatataaatatagttaccctgctcccctttgctttttatttctatggaatatcttttcagtaccttcactttgagtctatatgtgtctttagagataaagtgagtgtcttgtaggcagcatgtagttagttcttgttttttatatccattcagtcacatagtgtcttttgattggagaatttaattcatttaaacttaagtccttacctatcaataattacctattactatttacttacctattggcatttgttaattgttttcttgttaatttgcagatcctttgttctttttttcctctcttgatatcttcctttgtggtttaatgattttctttaatggtttaccttgaatcatttctttttgcattttgtgtatctactaagaatttttcattatggctaacatggggcttatataaataatcttaaaacatgttatactaataacagaatattttaagctggtgacaacttaactttgaacacttgcacacactctacgttttatgccttcccacactttgtttttcatgacacattttgtatcttttatagtttatatcccttaacaaatgattgtatctatggttgtttataatagttttatcttttaactttcatagtagatataattgattttcacaccatcatttcagtataagaatgttcttagtttgactatgtatttacttttaccagtcagttttattttttcatatattttcatgttgctacttagcaacattttccattggcttgaaggaattcttttagtatttcttatgaggtggtctagtggtgataaattatcttagcttttgattgtctgagaaagtttttttttaatctccccttcatttttgaaggacaagattgcagggtgctatggtttgagtttgtctcctctgaaacttgtgttgaaatttgatccctaatgtgttggtgttgagaaataaggcccagtgggaggtttttgggtcgtggggacacatccctcttaaataaattaatgtccttctctggcaggaatttctcactctcataggagtagattagttcctaagagagaaggttatttaaaaaaatctggcttccttggtttctctctcttgcatcctgtcttgccatatgatctctttgcatgtgtctattttatttctgctttctgccataagtggaagcagcctgaggcccttaccaaattcaacaacccaattctggacttcctaagcaccaaaattgtgaaccaaataaacttactttcttcataaattacccagtctcaggttatagcaacactaaatagattaagacactgggtatagtattgttagttggcatattttttctttcagctttatgaatatatcattctattccctctggcctgcaggggttctgttgaaaaaatctgctggtaatcttagagaagtttctctgtatataacaattcactttttctttgcagctttcaatattctacctttgtctttaacctttgacagtttaattattaagtgttttggtgtgagtttctttgaattcatcctattatagatgactgttaagcttactgaatctgaatttctattttcttcctcacacttgggaagttttctgccatgatttctttgaatatatttttctgttcctttctctcctccttcgggtacactgaaaatgtgtatcatattctgtatgatggtgtcccataaatcccttgggctgtctttaatcttttttattcttttccctttttgcttctcagattggatatttaccagtgacctgtcttcctgtcttcttctgcttgatcaagtctgatgttgaacctcttgttggattgtttcatttagttaatatattcttttgctcaattattcatgtttgatactttttaatattttctgtcactttgttaaagttctcaatttgatcatgcattgctctccttaattcagtgagcatctttatgatgatccttttgattttcctgtcaggtaaatcacatatctccatttcattaaggtctacttttggagatatatcttgttcattaatttgaaaaacatctctctatttcttcattttacttgactctctgatactttctgtgaattagataaaaattctcctctctcagtcttattagactggtctcatggaggagatatttctcaccaatcagcccacccagagattcttagtgcctctaaattccttgtgcttgtccaacctgctgttattcttcttattggattcccccaaattagacagtgtcaagtcatgttattgccttgagtaaggtgagattgaagccagtcctttgagatacagctggagaggttggggtgttagatgtgtgttccagcttttcctttccttgcagagaagctgggggctagattttatctcacatttattctgccgtaaccaaagtggagggtctgagacatatgactgtattcttgatcagactgctcattttgaacctggggagatagctgctgaatgtttgtaattttaaaagtcatctttttgttttctgtagtttaggagactcaggactgcacagacccaacaacttctagagctatttgatttaggagtgagttgctggtaagggctataaaagttgagatgctctatctgtgccaaatctacttccatggagagtctgaaaacctggatttattgctggagcaagccagggaagaatgtgtggggcatgaccactctcctgttagagcaagcagaatattcatttcaaaagtggtaaactgaccatatacaggtccatatatctattctgttttaaaattttcactagttgccatcatttaagcagctaagactaacataaaaatctgtttagcttcactttaattcccttataccaataacatctagaactgagtagcaaccatgccttttcaaaagggaatatattttccaggttatgcaagtcactactcttccctattttcttacaccttggcccattcatttaattatattgccagcctgacttctatagcagataagttggggaactcttgttattttgcaagagataaatatttattttatcttattttttagacttttaggttcaggggtgcacatgcaaatttgttacataggcaaattgcatatcatgggggtttggtgtacagattattttgtcacccaggttatgagcatagtacccaatacgtactttttctatcctaaccctcctcccaccctccaccatcaaataggccctggtgtctattgttccctttttttgtgtccatgtgtacaaatttttagctccatcttgtaagtgagaacatgtggtatttggttttcttttcttgtattaatttacttaggataatggcctccagccccatccatgttcctgcaaatgacatgatataattcttttttcatgggtgcgtagtattctatggtgtatatgtaacacattttctttacctagtctaccattgataggtacttaggttgattccatgtctttgctcttgtgaacagtgctgcaatgaacatatacatgcatgtgtctttatggcagaatgatttatatttctttaggtatatacccaataatgggattgctgggtcaaatggtagttctcttttaagttatttgagaaatcaccaaactgctttccacatggctgaacatggctttccacgtgggatttacattcccaccagcagagtataagtgttccctcttcactgcagccttgcaagcacctgttgttttttgactttttaataatagtcattctgactggtgtgagatgttatcttattgtggttttgatgtacatttatctaatgactagtgatattgatcatcttttatgtttgttggctgcatgtatgtcttcttttgaaaaatgtctgttcatgtcttttgcccactttttaatgggcttgttttttgttaatttattcaagttctttatagattctggacattagacctttgtcagatgcacagtttgcaaatacttcctcccattatgtaggttgtctctttattgtattgacaatttcttttgctgtgaagaagttctttagtttagttaagtcccatttgtcaaattttatcttcattgcaattgcttttgatgtcttcatcatgaaatctttgcaagggctgatgtccagaatggtatttcctaggttttcttctatagtttttatagttttatgatgttacatttaaatctttaatccatctcgagttgatttttatatatcgtaaaaggaatgggtccagtttcaatccactgcataaggctagccagttatccctattttgaaaaaattagaagacaaaagtaaggaacaaaaaattaccatctatagacctaccactcagagtcagccaaacttcatatttggtatatatttttcagttcattctttcagatagatcagtaggtaggtatgtaaacagccagccaaccagatatgtttagaatatttttatgctaatgatgatagatcaatattatttattatttttcttatttcaatgaagacagattgttcagagaatgaggttttaagttacttttatagtaaactgagagatgaacacaaacaccatttgttttaatgctttgcatggaaagatccttcaaatatgccattataatttttggtgcaataaaccagtgatgaagattcaagtagactagtctagactaggatatttaaaatccttatggtccttgatatctgagatgatatcccgttcagggaatggaagtagttgaggaaggtataatagattggtactgaattcaggatgacccctaaatcttgaagcttcacataaattcatttctcttcatgcctcctgagctggaattctctccatagcatcattttcacaggtttttaagttcatacttgaatgcctctaacaacagaagacttattacctcttaagctacaacctgtcctttttaaccaactattaaaaaggtcttttaggttaggcacagtggctcacgactgtaatcccagcactttgggaggccgaggtgggcagatcacttgagtccaggagtttgggaccagcctggccaacgtggtgaaaccccatctctactaaaaatataaaaattagccaggcatggtggtgcatgcctgtaatcccagctactttagagaccgaggcaggagaattgcttgaacccaggaggcggaggttgcagtgagccaagattgcaccactgcactccagcctaggcgacagagtgagaccctatctcaaaaaaaaaaaaaaagtcttttaatcagcttaaatgtgggttcctaaaactttttaatgtttaagttcaggggtacatgtgcagttttgttaataggtaaacttgtgtcatggggtttgttgtacggattatttcttcacccaggtattaagcctaatatccattggtcatttttcctgatcctttccatgctcccaacctccaccctccggtaggccccagcatctgttgttcccctccacatgtccatgtattctcattatttagctcccacttataagtgagaacatgtggtatttggttttcagttcctgcattagtttgctaaggataatggcctccagctccatccatgttcctgtaaagcatgatttcattcttttttatggctgcatagtattccatgatatatatgtaccataatatggctgcatagtattccatgatatatatgtaccacatttgctttatcccttctaccattgatgggcatttaggtttattccatttctgtgctattgcaaatagtgctgcaattaacatatgtttgcatgtgtctttatgatagaacaatttatattcctttgggtatatacccagtaatgggattgctgcgatgaatggtagttctgtttttaggtctttgagtaagtgtcacactgttttccacaacagctaaactaatttacattcccaccaatggtgtataagcattcctttttcttcataatcttgccagcatctgttattttttgactttttaatagtagacattctaactggtatgagatgaaatcacattgtggttttgacctgcatttctctaatgatcagtgatactgagcttttttttcatacagttgttggctgcatgtatgtctttggagaagtgtctgtccatgtcctttgcccactttttaatggggttgcttgtttttttcttgcagatttgtttaagttccttatagatgctggatattagccttttctttgatacacagtttgcaaaaattttctcccattccttaggttgtctgtttactctgttgatagtttctttcactgtgaagaagctctttagtttaattagatctcatttgtcaattttttcttttggtgcaattacttttggcatctttgtcatgaaatctttgctcgtttctgtgtccagaatggtattgcctaagttgtcttccatggttttcatagttttaggttttctatttaagtctttaacccatcttgagttgatttttgtatatagtataaggaaggggtccagttttaatattctgcatatggcttgccggttatcccagcaccatttgtcaacaataaatgagtagggagtcctttccccattgcttgcttttgtcagctttgttaaagaacagatggctggtctgggcgcagtggctcactcctataatcccagcacattgggaggctgaggtgggcagatcacttgaggccaggagttcaagaccagcctggccatcctggtgaaaccccgtctctactaaaaatagaaaaattagccaggcatagtagcacacacctgtaatcccagctacttgggaggctgaggtatgagaattgcttgaacccaggaggcagaggttgcagttaaccaagatcacaccactgcactttagactgggcaacaagagcaagactgtcaaaaaaaaaaaaaaaaaaaaagaaagaaagagcagatggctgtaggtgtgtggcctctattctgtttcactggtctatgtgtctcgttttgtactagtaccatgctgttttggttactgtagtcctgtagtatagtttgaagtcaagtagtgtgatgtctccagctttgttctttttgtttaggatttccttggctattcgggcccttttttggtttcgtatgagttttaaaatagtttttttattctaattctgtgaagaatatcattggtagtttgatagaaatagcattgactctgtagattgctttgggcaggatggccattttaatgatattgattcttcctatccgtgaacatggaatgttttccattttttttgtgtcatccctgatttgtttgagtagtattttgcagttctcattatagagatcttacacctccctggatagctgtatccctaggtattttattcttttgaggcaattgtcaatgagattgtattcctgatttggcttttggcttggttgttgttggagtataagaattctaggccaggcacggtggcttatgcctgtaatgccagcactttgggaggccaaggcgggtggatcacgaggtcaggagatcgagaccatcctggctaacacggtgaaaccctgtctctactaaaaatacaaaaaattagccgggcgcggtggtgggcacctgtagtcccagctacttgggaggctgaggcaggagaatggcgtgaacccggtagacggagcttgcagcgagcctagatggcgccactgcactccagcctgggtgacagcgagactccatctcaaaaaaaaaaaaaaaaaaaaagaattctagtgattttttaccctgagacttcactgaagttatcagcctaaggagcttttgggctaagtgtataaggttttctagatataaaatcataccacctgcaaacagggagagttcaacttcctctcttcctatttggatgctctttatttctttctcttgcctaattgctctgccctataaaagtactccatcttgacagagtcagagtccctaggccagtcagacttttgccaggtatcctaaagaacaacaatctgagctgggcatggtggctcatacctgtaatcccagcactttgggaggctgaggcagctggatcacgaggtcaggagatcaagaccagcctggccaacatggtgaaaccccgtctctactaaaaacacaaaaaattagctggacgtggtggcacgtgcctgtagtcccagctgctcaggaggctgaggcaggagaatcacttgaatctgggaggcggaggttgcagtgagccgagattgcgccactgcactccagcatgggcgacagagcgagacctgtctcaaaaacaaacaaacaaacaatcaacaacaacaaaaaaaccctgtacctgctatatttttcaggctgtttcagaaaaaggcaaaagtaataattcattacttgaaactagacttgactttctgggaattggttaacttgtttgaagaaaatatattaaacatttattgcctcattgcttgctttcaagatatttttctatgccttcatttatgagaagctggctcagtttgttgaaatccatcaatgatttgaactataacattcataatgttctttataacccagaacttgattacataatggtatttattgttctctagttttttcatgtgcacaagtcttgtcctgccaactgtttcgtaagtttttcaaaaccaaagctcatgtcttctacttatttcatggttttcctttcctcacaatatctagtacagtaagcacttaataattatttcttaacaaaacaagatctgcatgtgggctgtgtagcttggctcaattcttacattccagtttgtgccattaaccccaactagctttctaggaagacttgtcacatggggcctgggcaacgaagattagatgattaagaaaagccaggcttcattgctgcacagaaaaactgaaggtcctatgctactgctcagatgtgagtatctcagttcatacagatgatatacttattgaggctagttggtcccagtaaatttagagttctgcatgtatccttaacatgctctttgtgaaccattgacaaggcattcacaaattaggccaagtgctcccccaagtcatggtttacatgtttgctttgagagatttacttttccttctggcaagtattcttccctcttcctcctgtaagaaatatgaaacttgtctctggtcatgaaggttttatattaacctattttttaatacttactggggaaaatccctttttctgctgctgctgctttgattggctgaaaaatggcagctaccttactctggagcttctaagtctgcttctcagcatttctcaaatatctgagactttgttgttcttcatagtaaaagataaacccttagactctttttttatttttcagaaattatcactattctaaaagagccactgagttcctagtctggatattttaaataaatatgtatttctgttattcttttccaagtcatgtcagcataataggagtaggtgtatgcaaggaaaactagttattgattaaagaggattttgaagtggtctaattgtcctttttaatgatatcaacctataggaaattcctaaagtgaaatttgaagtaattttgtcttattgaacaatctgtatgttgattgtcaatcagtggacaaaattaccaaatcagctatgccattcatcatttgacacattaatttattacttttttcagttaaacagctttataaattcaaaaacaaatgcatatatacagtgaataaaatgtttgagcagcataaacattgcaggtaacaaaagtaattccatcttctgccccacactgtcagtcctgctttgagaggcaaccactcttaacagattttttgtataaactttccccaaatttctatagttacacaagcttagaggatgtgtctgtgttgtctatacattttttcttttacacaaatgggggcaaacttgatattaagttctacattttgtgttttctcctcttcgtaatgtgttttagagatttcatattagcatagattgatctaatcatttcttcaaattgctgcctgtaatttcattacatgggtattccataatttatttttgtcagacccttccccaaattgatgaatatttaggggtatgtgtgcatgtgtgtgtgtctgtgtgtgtgtgtgtgtgtgtgtgtatgtgtgtgtgtgagagagagagagagatgaatactgagataatcttaagtatttaattgctctatacctaaatttgccaaacagactggatttcctgtttgttaatctgatctttttcttggtatttgaaagtcatgctagttagaaaaaaaatcagtaattttaattctgtacatatttatgaaggtttatgctgcatccagcactttgctagatactattggatataagaaagttataagacaaagtttctgcccatacatatttttctctgtagtttagaagaccaggtttactcatgtaaaataattagtgaatcatatgagatagagtaccatgaaaaagaaactccaatgtgaacttacttaggtactcattataaataggcaggctcccatcatagcagtaaactgtgtgtgtaggccagttgaagaataccacacttggaaaatagactgctttggggagatatttgaggtttaacctaaactcaaacttgaagaccatttgaagactatgaaaacgctttcctcccagataaatgactataaaaagtaagcaaatctggaattaaaatcttacaaattgaaataatatttctctataacaaggccattttgccatcaaaaaatggaataacagtctctccaaagtgtgcatatatgagcttatctacactgtatagatacagtagcataactactctaattagttttcaaaaggacattctccttgtttcatggaaactattggatgataacaaatagtctgtacttcagagaagcaaaggagaaaaaaatagcagaataggctgatgtcagttaattgttaatatatgaggtttgaggtagaaggtagattcttgaagtttgaaatattttacatgaaaactgagagggtaaaagtttgagagacatagatcaccattttcactttatgaagaatgctgtcttttatttacgcctttcagcttatatttctaagctagcaatttaaggacttatgaaagatggaagaggtatagattagaatccaatattttggtgggtcataggcttgtatgattcttccttgtgctaatacaatcatttaagcagaatgatatggtgataaaagctaataaaatacatttagggaaaagcatgctgtgttggatattcagaatttgaggaaatgtgttgtgataacagaatgagtgagcagctttcatagagtacatgcagttaagatgaaagcagggattgagaaaaaaatgttttttctgaaacagattttgtacctaaactgaaaaacatttagtgacgtacacttttccttccaaataaatatttcagtcagccatttaccttctattctctgtaacatgttcactaactaggagcatgttctctcacatttaataaagtaaaaaatgcatcagcttttcaatgttttccccaactttctattctatttaacaaatatttcttgaatagctactatgtgcggagcatcacaatagacattgtatgggatgcaaagtcaagagtgaggccactggtcttagaatcaggaaacttgccttctaatcctatttttgccagttacttgtatgacctagagattcacttctcattttagagccaaagtcctggatttaatgatgtctgaggtctttttcagctatattgtaatccaacctaatgagtaaaaccatttgtttcccctaaaactttacagtattctatggggggtcgaaactattacagaaataactatgaaagaaagcagaatgttatcggtaatttcaagagagagttacaaagtgatgtaggccattaatagcttcatggagggagtgaccttgagggattaggttttgataggcagaaataggggtcataagaacaactctgttcctattgtgggctttctccatcctggatattactcagaatttgtcagtggcaaaacaaaagtagtagaaagttagcctttgaaggatttttatcagtctgtttccgaactagccaatgagtgtagattggagctgtaagcaatgaagtaaaagtaaaagagatgaacatgaaacatagggaggggtcatagaaatggaatttcttcacaaatgctaatagcaactatcccttacatttgtataatggttaaaaatccaggatatgagggtatgacagagctgttaagagcatggccgaatatgctcctaacatggactaaaccagacctgggtttctatccctgctctgacatttaccagtggtagaaccttgtacagtcacttagcctgttgcacctcagtttcatcatttgtaaagtggagataacaactactccatgagatggctgtaagattaaaataagattgtgtatttaaagcagttatcaaaaggactgacacatagaacttactcaaaaagggtagctaggaggtagtatgtcaggtattgttctttcctttcaacagaaagtcaaaactggggctctgagattctgaatcatttattagaatccagtattctttctattacaagagtgactcctaacctgagttttctgcccacaccctatccctggggggcatctgtgaaggtaataatgagaatctatgagttattttcaatatttgaaagaagcctaacagagagcattaatttactcgtgataaattacacaacctgactaatatgtcaagtttctttgcttttgcctgaaattatatcaactcattttggtaatactggctatctcatgctgatgggaaactgattggcagctatatatgcctttgatgaatagaaatgaggaaaacgaattttatatcataaatgcagttgatctgggagatattcttttcagcttgggagaacatagagaaaaataaaatgctcctttgttgctgaaactattgagaagcactgtattttacaccatgctttctgattcaagggaaaagggggtttaaggggcttagaaagataggcagttgtggtcagagagaatttcagactttgagagcttatgggtaaattgttttcatataacatacctgattgaaaggaggatatgacgtgtttttcttctgtgagaaagagatgaggcaactgaggcctaaagagggataatgaatcagccaagttaaaaaagcagcttgtaacagaaccaatatttcaacccagtcttgtgactctgttccatagctctctctactctgaatcaaagaaatatagtcatcttgtcttgattttgccacaatgtccaaaaaaacattttctcaggtctgattttaatattgactttttctagtgaaagagagaaaacactgttagaagatgaatgaaaatgaagttagggacttacagacagctgacatacaaaggtctcctttgtattgattggcttctttattgatttgacaatatagatcaatatctcttcctctgaggctgtagtgttatagtgtgaattctctgggttccatttcactctgcagaattgatacaaatacaacaggtgcagaggtaatagggggatgaattatcatattagctattatttactatgtgcccactatggccaggaatgttattcaggcatctatatttattgagtgcttgctgtgggcgaaatgctagtctaggaagtgacagagtaatgaacaagacagagaaaagtccctacccccatagagctcatattttatcattctaagtatttttgtatggattaccttacaacaaccctgtaagtttggtactgttagtactctcaatttacaaatgagaaagtggagacagagttagtaagttacttgcacagggtcacacagctaggaatattaaatttggaagttgatgtaagatctgtctgactcctaaatgtacatttttctattattcttttcaagttttattccccactgtgctacttcatcagacagcttctttctgccattcttctcaacactctcttcctctcgtatctatctttccttttggttataatgctgaaaacatgcagttattaaaccaaagacagagaggcaaaatacattcatgtggataaagtaaaatgtacgtaggcttgctcacacactaaacagagagggcactatgcagaagctgtttgctttggggagattagataggagatgttatacgataatagacaaaatttattgactgcttattatgtgttagccagtatactttttcatatttaatttgtatgtgtatataatagctgtacatatttatggggtataagtgatattttgatacaagtgtgtaatgatcaaatcagaggaattgggatatacatcatctcaaatacttatcatttctttgtattgggaacattccaaatccattcttctgattattttgaaatatacaacaatatattgttaactatagttaccgcatatctacaaccatctgatctttgacaaacctgacaaaaacaagaaatggggaaaggattccctatttaataaatggtgctgggaaaactggctagccacatgtagaaagctgaaactggatcccttccttacaccttatacaaaaattaattcaagatggattaaagacttaaatgttagacctaaaaccataaaaaccctagaagaaaacttaggcaataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaatctactcatctgacaaagggctaatatccagaatctacaatgaactcaaacaaatttacaagaaagaaacaaacaaccccatcaacaagtgggcgaaggatatgaacagacacttctcaaaagaagacatttatgcagccaaaagacacgtgaaaaaatgctcatcatcactggccatcagagaaatgcaaatcaaaaccacaatgagataccacttcacaccagttagaatggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataaatcatgctgctataaagacacatgcacacatatgtttattgcggcactattcacaatagcaaagacttggaaccaacccaaatgtccaacaatgatagactggattaagaaaatgtgcacataaacaccatggaatactatgcagccataaaaaatgatgagttcatgtcctttgtagggacatggatgaagctggaaaccatcattctcagcaaactatcgtaagaacaaaaaaccaaacaccgcatgttctcactcataggtgggaattgaacaatgagaacacatgggcacagaaaggggaacatcacacactggggcctgttgtggggtggggggaggggggagggatagcatttgaagatacacctaatgttaaatgaagagttcctgggtgcagcacacgaacatggcacatgtatacatatgtaacaaacctgcacgttgtgcacatgtacccttaaacttaaagtataataaaaaaaaagaaaatcacatgaacgcaaaaataaaaaaaaaaactatagttactctatttttgtaccaaacactagatcttattcctactatctaactatatttttgtacccattaaccaacccctctttattctcccctcccactacccttctgagcctctggtaaccatcattctattctctatctacatgaaatcatgttttaacctccatatatgagtgagaacgtacaatatttgtctttcttttcctggcttatttcacttcacataatgtcttccagttctattcattttgttacaaatgacagaatctcattcattttatagttgaataatattccattttgaatatataccacattatctactcatcttctattcatctgttgatagacacttaggttgattccatagcttggctattgagaaaagtgctgcaataaacatgggaatatacaggtatttctttgatatgctgatgtcctttcttttgaatatctgcccagtaatgagattgctagatcatatggtagctctatttttagtttttgcaggaactgccgtactgttttccataatggctgaactaatttacattcctaccaacagtatagaagcgttgccctttctccacattctcaccagcatctattattgtcttttttataaagcccattttaactgcagtgagatcatatctcattgtggttttaatttgcatttatctaatgattggtgatgtggaaaatttttttcatatacccactggccatttatatgtcttcttttgaaatatgtctattaggatttttttgcccatttatagattggattatttgtgttttttgctattgagttgctcgagtcctttatatagtctgattattaattcctattcagttgaatagtttacattttttttccattttgtaggttgtctctttacattgtcaattgtttcttttgctgtgcagaagcttcttagtgtaatataatctcattcatccattttttgctttggttgcctgtgtttttgaggtcttactcaggaattcctttcccagaccaatgtcctgaagcatttccccaaagttttcttctagcagttgtatagtttcaggtcccacatttgtctttaatttgtttttgatttggtttttgtatttggctagagatagggacctagttttattattttgcatatggatatccagttttgccagcaccattttttgagtagacgatcctttccccaatgtctatttttggtgcctttgtttgaaataagttgcctgtagctgtgtcaatttatttctggtttccctattctgttattttagtctatgtgtctatttttatgccagtagcatgctgttttggttactatagttttgtagtataatttgaagtcaaggactatgatacctctagctttgctcattttactcaggactgctttgactattctgggtcttttgtggttccatataaattttaggatttttttttctatttctgtgaagaatatcattggtaatttgatagagattatattgaatctgtagactgctttgggtagtatggacactttaacacattcattcctctaatccatgaacatggggtagctgtccattttttgtgtgtgctttttaaattttttatcaatttttcatagctttcattgtaaagatctttcacttctttggttaaatttattcttaggtaattattttgtagctattgtaaataggattgcttccttggtttatttttcagattgtttactgttggcatacagaaatgctactgaatttgtatgttgattttgtttcccacaactttactgaatttgtttatcagttctaatagattttttggtagagtctttagggattttttttaatataaggtcatataatttaaaaacaagaataatttgacttcttcctttcaaatgtgaatgtcctttatttctttctattttctaattggtctggcttggacttctatagctatgttgaataaaagtggtaaaagtctgcatccttatcgtattccaaatcttaaagggaaggcactcagttttcccccatttagtatgatttagttagctgtgggtttgttgtatatggcctgtatcatgtagtcagtatactctttacgcattcaattcttagaacaaccttataagataggcactgttattattattgtcttcattatttatatgggagaaactagggtacagagtggttaattaacttgccaagaatcctctgtttataaggggcagaactgagattaaagttcaggcagacagtatccagagtttgttgtcataatcaccaggacagtacttacaacatagtacatcataccataagtaattgattatttttaaaaatccaggtatgagaaaataaatgtataaactatagtagtaacaatgagaacagaaaaaaggctatgaatgcaataggcattttagagaaaggggcaacaacatttactaaatctcagatttgaatgacaaggaaagtgattatagcagtgacattaaaaaaaatctaaagagatcaaagtcttgggaggggaaatagtttggtttctgacattctgatattaagttgatggtaagatgtccaagtagaggaactattaagtaagtgaaatatgggactgaactcaaatttgaagacaaatcccttcagactctttgtccagagtctgcaggccatagagaggtatgaagagagaggatagaacgtagaaggagcaaaggctttcaccacgtagacatttcctcctttctttttccagtaatattattattgaaatacaattcaaccttagttttaactttttccaggctaggatgtttctttgcttcctcatacttttctccaccaacatcaaaatataataggatgcagtccattcagaaaagaaaccagttaacaaattatgccttcaaaggaagaaaatttcctgtgatccccgattgtggtctaaattatgtttattatacgttttataaaattctgaacaggtattgaactattttaaatttcttggatttattgcttttatacaaaaacaaacttacaaatgaaatataaataaaaccacaaaactaataaatctaaaattaattttaattatatttgtcttactgaaaaaaatcactgtttggaatgtgactatgtactactgaaaagtgcaggtttgtttgagttgtacatggctggatttctgtgtgctacgaggtgcttttaagtctccaccacttagattgcagtgtgctatgatgtatttttgttctcatgtgacatgaaggcatcatttatatacatttatatgtatacatttatatacagtactactttgtgacaatataatcataaacgaatatgtaaaagctggcacttaaataatgcaatagtatcatcatgaggtgatcacctagaatacccaaaatctattttcttaatttattttaattcaaacataaagtttgaaacatatacacacaaaaatattatagaaaagtcctaccctcccgaaactctagtttgaaaaatattaatctgaaggcaggagataaatatactgtcttgttgtggctttataaatttgtacattttcctagcatgactaaatttaatcctgcctatgtgttcatataatgaatgtgggatttaggagacatgagatctcaaactggctctgccattattctattatagaatctcaaggaaagtgttttacctccctggacctcatttttctcgtgtataaaatggaaattggagaggaagaaacaggatgaaccacatgatctctaattaggactccttgtgattttcaagtcaaccatacatttgaatttcagaatggatgatacacatttcactatatatgtatatgcacttatgtgcacttactgatataatgtttacttaacaccatggatattagttcatttgccaaggaagagtgttactcaaaattcatgataaagaatttttttttttttgctgctcttttggacctgtaataagatattgttaacctacatgtacttcataaaaactttccctatgtgcattttctttttttttttttttgagacggagtcttactctgttgcctaggctggagtgcagtggtgcaatctcgactcactgcaacctccacctccctggttcaagtgattctcctgcctcagcctcctgagtagctgggattacaggtgcacaccaccacgcccggctaatttttgtatttttagtagagacggggtttcaccatgttggtcaggctggtctcgaactcttgacctggtgatccacccgcctcggcctcccaaagtgctgggattacaggcatgagccaccgcgcctggcctccctatgtgcattttctaaaaaatgtatctaacttaatgattatgagtagacagttctgttgaattttatttatgcaatcacatgaccatttctttactatgaaacatataaaattgtactgtaagtgaaacaagtagttccattgtgtaattgtttcatcattacatataatttaataaatacttcttttcaaattagggaataacagacttggcatttatatactttaaacacttaagactccttcagcttctaaagaatttaggttaatttacaaaacagaaagtgattggcttacattatgctttgcgtctgtagaaaatgggtaattgggccgggcgcagtggctcacacctgtaatcccagcactttgggagaccgaggcgggtggatcacctgaggtcaggagttcgagaccagcgtgaccaacatggagaaacaccgtctctactaaaaatacaaaattagctgggcatggtggcacatgcctgtgatcccaactactagggaggctgaggcaggagaattgcttgaacccagaaggcagaggttgcagtgagcagagatctcgccattgcactccagcctgggcaacaagagcgaaactccatctcaaaaaaaaaaaaaaaaaaaaaaaaaaaaaaaaaaaaaaaaggataattgaataaaataaaccgttctatgaaagtgtgaattagtaactctgactatgtcggcagccacaattttgcctccctaagcaaagcatatagagtatacatgatcacattaagaaatacagcaagatgttttgggtcaaaccaaatattttaccaaagcagatttttttttttttttttttttttttttttactaatgatgattcaacactaataccatgaacaagacaaaatgaattgttgtgagcacaaattttctgcaaacattattttaaaacttggcatatttatgcctattagtgaatacatctttataatttacagcttaacctcttcaggtttataagaacaagccagtttgaccattggaaaagaaaaaggagagacagagcaataaccacagtctgtgaagaggcctactcagtaacggtctagtttatgcttaaaaatactggaaggcttgcatccctcaatctctcagtcaattactttagttctttgaaatcaccccattaattaggacaaatcctgcgttttcttatgtctagatttatcaggggttttttgcatctctctcttatccacagtttagttttatataatacaacctgatagcatcttgttatcattttgccttgatttgctttgtgtcttattacataaaaggggtactaatctttgggaattcactccttattagagtcaattgagatttgtaacttgagatgcaagcttatatttttattataaataattgcctacaaaggaattcctagcatgatatgttatcagcataaattactatgttttaattgtaatgtattttttaaatatgcccacaggaaaggtttttctcctacttagttttgtagaagattattttgtgtcttcccacttcattcctagtatggattccaaatatatcacttgcttgatggtagtataattttataattatattgttattggcaattcagaaaatgatttctatagtttctttgacataaagtggataaccagaatgagttgattttcatttatctttgaagccaattataattttagtaccaaccaacagttggcacttaatttgcctggtctacagataaccaagaaaagatattgccattcattggtctcctcactctcttctataaccagaagctaggctgtaaattgccattttctgtaaaagttggcccatttgactccctctcttaattaccgaacgctactggttgtgatggttttaacttgattatgtacagttgttaggcaaatgccagttaggagttgtgaatgttttagaaacatttcctcagaataattgtgctcagtttttaaggataggaactggaggctagtcagatatacatttgataaacaaccaattactcatctcatgttgttctttactgggggtatttctggttttctagggtggaataaatacagaggatggttcactttgctctgtctggatgagaagctttgatctccaggatagttcttttttaaatgagatgaatgaattttcacctttaagtagggtgcttatataatttattattcaaatgagaaaacttttgagaacaaaagaggttattgctaactgttatgctgggagaactggcatgaattggggatttatgccaggcaaactgtattacatggtctgtcactttgggacaacatggagatttgcctccccaccacttctcccaaccctgtccctctccatccactcacaccccagcctaagaaaatgttctgtgagacatatatagctcaggggatctttgaacatactgatgtgtgttcctctgcagggattacttaaaaaataaaaatccccctactcatctatcttcaaatcagtcaaaacaaggtttttcattatgtttccatgtctccctcctctgctgttgtatccctttaacagtcagactctcagacaaaagataagataccatgctctttctaaaatgtaaatctaatcatatcactctactctgtaacacacttcagtgggtttccattactatggactttgtgatccagcccctgcctcaaatcccaccattctctacctccctcctattgccaatcgagaatctctttctgttcacaaagtagcattccaaagacatagaaatattcatattgttatatcctagctagtaagaaatgtacctacacatgaaaattgccccatcatctagcacggtgcctgacgtataattggcatttaataaatgttgaataaaggaatgaatgaagagttaaatgccctgagagaaattttatttaaggcaatctatttaaaatatgaatgagtatatagcagcaattatcctcttgatctgcttagttaagagttaactatattgttgggctcttttttttttaggcaaagcatagagatattgctttataacataacattccccccactgtcttaaggacctttaatatgcttaagggaagttaatgtattaataatagccatttcctagggcctaattagccatatttcaatctttgtaattccgtatgagaaaaatatcctcacagagttcaagtatctgcggcatacgttttggcctcttatatatctagggtgaaaagctaacctggtaaatatgcattccagatggctttcatcagataaatctagtgaataagaggcccactgataaaaatggaagttataaaaattaataagaaaatggatgttggaataaagacctgggataaccatcacagatctcacaatgatgctttacattatagcatgcaaaacacttttacagacattttcttcatttaattcttggaattgtggggagagactctgtaaagtaggtaaggcaaggtagttgtttttatccatgtttcgcatatgatgaaactagcttatgatattttgttcgtttatttcagccagtgtaactaggcttcacttatttatgagacttcagaatgaataataatcatgttatagggtgcctgaagaaattaatgatatctaaggaatcgcagtccttagcataactttggtttatttaaaatgtgctgatctgtaaaaccaaaccactagggtttgaagaagactggctgtatctaaagattagcaagataaagatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaatgccatttgacccagcaatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagaacacatggacacaggaaggggaacatcacactctggggactgttgtggggtggggggagggggaagggatagctttaggagatatacctaatgctaaatgacgagttaatgggtgcagcacaccagcatagcacatgtatacatatgtaactaacctgcatgttgtgcacatgtaccctaaaacttaaagtataataataataaaataaaaaaataaaaaataaaaaaaaaagattagccaggtcctgttggcaacttattctgaatacttaataggctcaattggaagctagtgaagttttaatcagttgtccatttaggacccctcatcagcaccagttcatagggcctgtctgaaatattcttaggtagcagaggttgtacagaaagatctttgtgttactcttccctcctaagcacaaaacaccaaaatgaataaatgaataaatcaataaattatacactctaatcttgacctcagtgcataaaagttaagtcgagctctagaccaggtataatcacctggcacttcaacagtatttgaattactgaattgtcaccaaaatatatatcaagtattttttcacgtttaagacattgtacaacatgccatagagctcaggagaagatgaggaactttgacagtgacatttttttaaggtgcaagtggcatatttgtgagttatgagccttattctctgtagtcctaataatacatttatccctcatagaaaaagggtttcataaatcagccatggcaatgtgcaatattctcaaattcaggtatggagatatatgtataaatttagtattctcactggttgtgctgaagtgttgttgaatgtgtgagtgtgtatgtgtgttttctccagattctgactttgatacaaacattcaaaatctttaatagacccccttttcagggttagcaaatcttagtaaatgtctgttggctctactctttaagtctatgattcttttttgcatccattttaaaattgggataactgctagaaaataattagaactaatgtactagcgtaatcaaccaatgagttctttctgcctgctgcacagacaaaatcaattcactaggactgcagcaatgcagtaaagaaagtttaattgacacaaggctggccacacgggagaagaagttcttgctcaaatcagtccccctgaaggctcagaggttaaggtttttcaaggataatttggtgggcagggagctagggaatgggtgctgctgattggttgggaatgcaatcataggagtgtggaaaatggtcctcatgcactgagtcgtcttctgggtgggaggccacaaaaacagttgagtcctgagtcatgattctacctctgggtgggatcagtcatttgccagaatgcaaaagtctgaaaaatatttcagaagacccatgataggttctacaaaagtgatattatctacaggagtaattggggaagttacaaatcttgtgaccttcagaacaatggcttgttgttgtttaaccacacctatatcttagcagaattcaggtccctcttataagcctaacctgtggccttttgttagttttacaaaggtggtttagttttgggaagggctgttatcatccttgctttaaggttaatctataaactaaattactttcaaagttagcttcatctacacccaggaataaccaaaagcagcttggacattagaagcaagattgagtaaactatgtcatatttctcttactgtcataattttgtaaagatggtttccctagttaagagaaattttctaagattctggtgatcccatgaagacctcaaatcaataaatacttttgagtgtaaaaaaatacatattactatgctaggcactttgacatatctcttctcatttaatgtacatgactacactccgagggcattatcagcctccctatttcataagtgaggaaactgaggcacagataattaaaatgacctatcttaatcaaaggtctttaacaagtcattgaataattttcttctttcctagaaagtaagtataaccagattcacagttgatcattttagcaattgagatgatgtttgtgaaatggctttggatactctgaactgtcatgagaagtttgtttgttgtctagttttaccagtagtgctggattgcctaatgggcaggctaatcatgcatttatggcattagcaatgcagcatatctataagtcttggtgaatctttttaaagcatgaaagtagccattagaaaaagatctttttggatttgctaaaacttattttatattttagagttgtgtttactttgaattacctgtttgggcatatgatcttttcagaactgaaggcctctaaatgtcttaatctggctccttattgcattttgaatgtttgagaactcatttattcattcaatcatttaccatttctaaaatctacaaagaactgacttttcctttcttctcatattcttagagaatcagtcacccttctttgagagtcaactggcattatattagtttaggccctcattatctcttacttgggccattgtagcagcctagtaactactctcccatgttcagtctttctcttcttctaacctatttaattgctacttataaatttaccttaccaaaactctccttctttcatcaggaacctgtaaaggatctctattgtttaccatatcaagaccaacccctctgcagtattttcaagatcttcaaatactgactcctatccacctatttagtctctttttcactgtgtccctagtcttctgttctgcttaacctgattttctcattgttttctacagaagctatgctcattcctacatccaagattttgctcttggtattgctctgacatgtgatgttttttctccttttctccatgtatccaaattttcaccaaccaccaacattcagctcaagttctgaatcctctgtgaagtcctctctgctacttcaggtgatgctcaactctccttcctctggttaccctattataattgtggcatatattttagtaactaattgccttctaattattttatatgtgttggttttacctctgtaaccaaactgtaactccccagaaagtatagcagaatactacctagtaaatactaaataaataaatatttttattggtttattagccaagtagtatagagactctatgaattttaaattacctaatgtgactaaatggaattaggaatagtgattagaatgctttgtgtctttttaaaattcataaatatatatataggctttattcaaacactcagagtttgaaaccggaaaccacttctcaaaccagtctgccccctctgaggctgaaagggttctcacatatatcctcatggagccatcataaagaaaaagagatattcttaattttttttaattaaaaaaaaagaaaagaagagatattcttaaactcattttagagatgagtagaggctgagaagagtataatgaggaagagatgatttatttcgtaagaaagaaaggtgagaaacaaagacattccagatgtatagagccctggaaaagagacatcatatatcttcagtacattcagtgttgtataaatagtacaatatggctggaacctcaagttgattcaaggcaagtgaatgtagggaaataaaagatgtggtttgaaaaaaatctcagtgtgtccgaaattgagctcatcacatttgtcatccccttcccaaatatttttatcttccttctcagtgattgttccaccacccacccagttttttaagtcaaaaattcagatgtcatccttgactttctcttttttcttctcttctctatacagccaaatgctaggttctgctaagtatgcatctaaattaacctgggaaattgttagaaatgcaaattctaaagttcaacaccagctactaaatcagaagccctggggttgatgcccagctctctgttttatcaagtcctccaggggatttttttgcatgagaaagtttgaaagccattgctgctggcaatgaggagtcattgagaggcttgaagcaggaaaatgacctagtagaatatgcattttagaaaggtcattctggtatttgtatggaagatagatggtaagggagcaaaattaaaggtaacagaactagttagtagaatacaaaaaataagataataaaagacatagaggaaaagataaatttgtgaggtattaaagagctaaaattgatcaatttatgttaccattcggatgcacagggtaaagaagagggagtgataggtgtctggtcttgcacactaagtaaatataatgatcagggtttggggaacaatcatcaatgccccttccctccttcctttttttaataaagttgagatgactttacggtaatcaggtataaatatttttttaaacagttgtctccttgagtctggaccttgggagagaggtcaggcttatcgataaggattttggagtcaacagtatactagctggtaatagctactgtctgaatggattaaataacgtaaaagacaaatcttttcctctatgtcttttatgttatttaatccattcagacagtagctattaccagctagtatactgttgactccaaaatccttatctacaggcctgacctctctcccaaggaaggaagcatttcagggtgagaagagaaccaaggatgaagtccttgataagaccaatacttaagggaggtctccagggaatcctgagtaatggttaaagagtaagggagagaaccagaaaattgatatcatgctggtagaggaggatagaatttcaatgagactaatagtgttgaatgccgtagataggtcaagtaagatagctaattagttatattagttagtacataagttccaaacccctgggtcatgtaccagtatcagaaccaggccacacaacaggaggtgagtgacaggtgagtgagcgaagcttcatctgtatttacagctgctccccatcactcatgttactgcctgaactctgcctcctgtcagatcagcagcagcattagattttcgtagcagcacaaaccctattgtgaactgtacatgtgagggatctaggttgcatgctccttatgagaatctaatgcctgatgatctgtcactgtctcccatcacccccagatgggaccatctacttgcaggaaaataagctcagggattccactgattctacattatgatgggttgtgtaattatttcattacatattataatgtaataataatagaaataaactacctaataaatgtaatacacttgagtcattctgaaacctgccacctccccagtccatagaaaaactggcttccatgaaaccagttccttgtgccaaaaaggttggggtcattgagttaggggatcactgtctttagcaattacaacttcaaggaagttttgagaacagaaggtggcagtacattaaggagtaaattggaataaataaatggaatttttagctattactagtttatgaaaggaaggaaagaaagagggagtgacagctagattgagacaaaacatcaatggaattttcttttattgaccaagataattgtgtatgtttacaatctgaaagaaaaagtgaattgggaagaaaaatttgaagatacatagagaaacagagaacttgatggaataagatctcaaagaataagtgaggggataagatccacagcagagtaggaggtatttgctttaaatattgtatttttattgtctcttaatgcattggcctctcccaagtaaattgagaacccctcaaatgaatagacacagtctttttcagtccctagtttagggctcaaaaaattttttgctgaatgaattaagatcatttcttgatttactttgatgcttcttctctcccccacttactctttttttttccccaattttccatccttagctctcttctcttgtcactgtattcagttgctccaggagatctcaaaaatgcctaaagtttctttttctgagacaggagaggttgagatgtgactagaccttttatactcagagtaatgctgaatcattaattataccgtcccttcctgtttgccttcccatggagccacactaagtagaattggattggatttgagggttgttttccaacatgctgcagacacttgatatacaaccttttatttttttatttttatttttggcaggccccttcttaaccctacaacctcagaaactttccatttttgtacctgctcagttcttccagtagaaagtaacccttgatgcatagcttcttggactgggaaggtcattagagttttttgatgatgattccaaatgcaacagagtagcttgcctgtttcaatagattttcctttgttttgactttgttgacctatcatttgctgaatgatataagcagcttcacaataaaagagggtatattatacacaggttgaagcagggtaagtatttttgtcctgagagaaaaatccgatctaaagatatatttgatttttttgtgtgtgtgtgtatgtaattaggaatgaccatttgaagtagaagcagagatgtctgagagcccaattttcaaagtaataatttgctatatttatttcaaagtaaggctctatggctaattttaggaaaggccttggaaatgaaccaacatgctttaggaagattcagatgtttagttttaaacctttccatacatgctttaaaacattctaatagttatctgtgaaagaaatgcattttaaatataagaaaaaaatgctatttccttttcagtgcctttctacagcaactgaaagttaaattagaatgccagctgttataaggagcatgttaatcttcctctagggcaagactgttcttctgatcttctcctgttttctctacagtgcccaacacagtgcagagaaaccagcggaaacttagtccatacttgttgacttgacagtttacagaaacattttgtcctctacaacctccttcagactatccctgtcgaccctatatttagaaaatgggttcttgtctaagtctggagacaaggttatatctgtggaacagatgctcattatagttcacatgcatattgaacaaaaattcagaaaagcaatgaggtgaattttataatcttcagaaatccccttgaaagggccacaagaataggaagctggtgcatatcatcctcataatttgtctgctctctaattggcaccaccaatgttttgggttccaattcattgacccatttttttattcctctgctttttcaaaaaagtatataaactttaaaagacactctgttactatttactaatgccacttgactggttactttttgtacttgtccttataagcagtgtataggtcaaaatcaatgtaaacattacctatacctctcaagcagtctctccccttaccatccctatccttcttagaggtcgcttccttaatactccaaacatatgcttctctctatcatagaactgatcaccctatattgtaattgcctattatgtttgtctgtgtcccccatattgaaccacaggcagaaactatcttccatttttgtatctcctgtacctgacacaaagtctggcatataataaaatattcaatatatatttgttggatgaatgaatgtatgatgctccaatataggcaaatttgccagtctacttttaaggccttcattaatctgatgctattttaatttttcaacttcatttatttatgagcacctattatgttccaagcactgtagatataatggtaaaaaaatagaaattatccctacttctataaaactaatagttcagtggaggaggcagacatattatcacacaaataagtataaaattacacctgtggtgtcttgaatgagaggtacacagtgctgtaaaggctaataatggggcagggtgggaagttttcctaatttaggaggaagtgatacttaatctgggatctgaaagacaattagcattagttaagtagaaatcaaaagaaaatattctgggaagtgagaacagtctcctgtgcagtagaatcccaggcagcagaagggagagatgaagctggagaagtaagcaggtgctaaatcgtgtattaccttacaaaccatgttaatgagcttttgtctttattctaaaagcaacagaaaacatatcctacaacattcttggtctttctgttctttttcaaaaccacaaatcttagtctttgtacttctaatcatactatcctctacttgtattatagtcaccacccttttccactgattcaaatcttgttttttgttcaggtatagttcaagtcttatgtccttcaagatgactcctttattagttcagtctagacagaataacctttcatattgtatagcacaaatttatactgtttatatacttattgtgcgggctcttatatcatcctaccttatacttttatgatgatttcatacatggcttttcactcaagagactgtgtaatatttgttttctgaatccctcttaaatatccatagcccagtacttgattcacactggattcccaagatatactgagccatgaaacttgatataaaccaaatcttagaatatattaagggaaatactttgatcctaatgctgttggtgatgacacaagtgcatgcatttgaaaaataaaaaatgcagttatattacctggttttattggctacatcatagcaactacttcactaagttaacttgtcttttcactgcacttatcaatctgcattttactcattcaataaaaatatactgaatgtagattttgaagcagctaccgtgtaagtaaggactgggaattaaaaactgaatacaatatggtcttgactattatcttactctgttttgtgctgctataacagaatatctgagactgggcaatttataatgaacagaaatgtattggctcacaattctggaggctggaaatctgatactgaggtaccaccaggtttggtaattctgattccaacatggtgccttcagcactgtgtcctccagaggggaggaacaattaatattcacatggcagaaggcagaagatcaaagagataagaagaggacaaactcattcctttataatggcgttaatctcactcatgagggtgaaaccttcatagcctaatcacatcttgaaggtcccacactttcatattgttaaaattgtaattacattccagtatgagttttggaggggctgaacattcaaaatatagcaatcatcacagagctaaaaatatggtgtccaaagctattaaaaatcacatttctattgccaaaaggttatatgagattggttgacactcaggatccttaagcagagtacaaatgatatatttcattttcacaggaaatgtagcctcaccataagtttatggatacaaagtctggatattgtggaatgtgctcagcattaaagtaatacaacaaaaataatttcctctgtgagtattatagtctttgatattgaacctttaggcactgtacaggtaatgctctgtgaaaagcagagttttatagggataacaattcatctatacttttcagtaaggctaggtaaaatttcttccaactgggaggcagtccagagctaggactcccttaggttggtgattttctttatgaagccattaagaagttatgaaggtatctagagatagagatcatcaatcagtgattgattattagcttttttaaaagaaagactttggccaagtatatgaaattctgattatttactctaattcttatgaaatcttagggtaactgttaatataaagtaattgacattaaaacattaatataaattcttaataatttagttaactctttgagttaaccaaaacctgactaaaatctttgtcctattagaggagacacagaaaactacttattctattaattagcatacattttaaagtatcctgaaggtaactagcaaagtttaggtgcttgaaaaaaattgtcactttcctaatctgccatttgaagaaaaatgctcctaaaattaaactattactatgttttgttcatgggacatgttacatcaggggatgtttcctaaaggtttcatagaggagtagtcaatacaactttcaaaaatgaaaataaaatttaaaaataacctaatattaattttgactccttttttaaaatcttcagttatttcatctgaagtaatacagagttgcaaggcattatcactcaatcataaggatctttcaaaaattataccaccctgctatgaaagactcaatttcaaaatattaatgattacaagccagagcttctgtaaacatacatctcaactttgaatactggcaacactttcagcaagataaggatgacaagaaaatgtactttcctagcctgttttcaaagcacatacacatttttaaaaggtcaaggggagggactttgtaagaatgtattattatagctttttactgaactgatttgttttaggtatctttttgttcatatcttttatgtctccatcatagtaattgtattcttatatgatgaaaataggatgaaacaaaaccactgagaatacacacactgtctttgttcctgaaggacaaacggtgacccaagtcatgggctgctttggctttgattaaaattaaaatcttgtacagattccagttctgaacatatgtctcatactctatgtgctcacattagggtgcgttaaaaatattttatgctaacagattacagtaggtaacagtatgcctttgtttcctacaaaagaatgagtcagtaaattgttctacttaatggataaaagactagctcaagatgcaaatatatcccaatagctctaaatcccactgtaattcttcctaatttaaggcatttattaactcataacagaggctcaagctattcatatttctagcttattttatttatctttctcttattacctgttctactctaagctttgcaaatcttgaaaatcctaaaaatgtcaaaggagagacttcaccaattaaagtgtgctgcaacatagtggagagaatggaaccattgtgtggttcatattgaactgcatgatttatatgagttttctttccttcccatgatttgttgtagcaaccaacttcacatagtcatgtaaaaattagagggttctaagttcttccaattggctctgtatttcaaagtacctgttgaactaggcaaacagaatagcatcattttttttaataatcagtgatttggtgaaacaggtggaagatacatttttgtttccaaatgctttctaagaatgactataaatgcacagtttattaaagagattcaacaatgccatttccctggtgcttctctaccaagtaaatgacattttgaaatattattttttttctaaagtataaaagacccacccagccattatataaaatgagggaacacttcttgttgtgttaacatcttgaatctagtctcagggaagctgttttatgagatttactggtgcaatttggttgcagatgctcatgatttatagaaaagctcatggaaacagacagaatctgtataaagaaccaaaataaaaacaaaaacattaggtaactcacatgaggtggatgtcacattaatcatgtttttgtcattttggtttaatgttcatgtcttggggagtatttgagagtgatgctatgtgaccttcagatccctgtagagtggttcaggttcaaactcctggaaggctcacatgtgataaggtttgggctactacctttctcagcctgtgaaatttgagactttccccacattttcccctaaccaatttatccaaacctccacacctccaaacggccattaaattttgaactcctactgctcttattctctttcttccctcttttgttaacgtaataatttatcaaccagtttttctttaggaaacaaaaatgtattgctgcctactctgatgtttgcacagtgttttagaaggcaaacttcttatagatggtatacagcctggtgcttctcccttccaaagtgccttatacagtgctagttataaagttgatgttcatcattggcttattaattgattgatccttgtgtcctgtccctcaactagtcttagacattgtgtttagaagataaatagagcagggaatttttcatctggcctcattgttcctccaaccacagagatgtgagcccacctagtgacaaagtactagaaaagagagcaaactgtcagcttcatccttgtctgtcagagcatgagactggtttagatgactttgcctagttgatgttaagcacattctcatttcccatgttaagccttacagatcaactagactagagtagtgctgtgatatgttctcacctcttttcccagcccctaggttacctcatcacaccaccatggattagactgttagtatttgttgcttttattacagatgatttctaatatgtaattcattttcattaaaggatgatgctttattcttccttgaaattttctgttctccctcccctttttttcctattctgttcagggacaggagggatgaggcacatttattcccaaaaaggagagcagatgtagtggttggtagggatggcaggttctcctgaacttacaattccatattttgcatatttatattcaaatggttcaacaaatatataggaaaggatcctgcaggaccctacagtttccagaactgatgatttgtcatctgaaaaggtatttttcttcatagcttgagaagaagttaaagcaaggctcttagtatacattcaatctaaaattcaacaaaagattcttctcatttacagaatgaaataaatgcatattatttcgccatactttcacaagattttatttgctactacatagacacctaggttatatgctaccctaaccaataaatattctatgaccaagtttatgtatttcctatacaggcagattttttgtatgttttgaaacattctaagacagtagtgtttattctcacatatggttatatacatatatatagagagagagacttgtttttgataagtgatgtatggttcatgtaagtgtctttacaatgtattatatttaaggtttgattttgtagacatgtttagtttgatttttggagtttcaaagcttatgaaaatcattttggttcagaataataaaataagttagataatgaaatttatatgcattttcatatgtctgtacagaacttgatataaatactcaaacattcttcctttatatacctttaggtttaactttgatttgatttggtaacataagattaacagtgatataaattttggttcctctagagaaagaaatacttgagaccactaaaattaaaaatcttgcattaacatcctataattgtatgaaaatttaataagcttcagaaaatataatatatttggagccttttataacatagtgtagcatttgcttggaacatggaatgaaaattaagagtgaatcccaggttttagccaagggcaggaaggtggcaaagggaggcgaatccgagtgggtggagggaggggaagggcgagaggagaaaaaggtgggaggaggaccaggtgggagggtggcggctccctcaggacccagcgggggcagcgcgatgaggcgggtgaccctgttcctgaaaggcagccctaagaacggaaagagtaagagacttaaatgaatatgactgattgtcacacaaaagtgtgtcctacttcaacactcagcattcaagaaatatttatcaaagacctgctgtaagccaggtggttgctgtatatggaactttatctgatttgctttctgtggccagcagtaaactcggcataaaagccaccagtgtgtataatgggaaaggtggactgattgatgatattgctttgatcagggatgatgatgttttgtttgtttgtgaaggagaatcatttattgatcctcagacagattctaagcctcctgagggattgttaggattccacacagactggctgacattaaatgttggagggcggtactttacaactacacgcattactcctaccaggttgtagcatgcatctttttgagagagcagctgggatcgagtatactcttgacttaaatgtgtttgtttataaagacaaatggagaaatcaatttgtttccctgaattctaaggagcactttagtgaataaagaacctgacagtatgctggcccacatgtttaaggacaaaagtgtctggggaaataagcaatatcatagaggcgctttcttaattgaccgaagtcctgagtactttgaacccattttgaactccttgcgtcatggacagctcattgtaaatgatggcattaatttattgggtgtgttagaagaagcaagattttttggtattgtctcattgatctaacacctggaagtggcaataaagaattctcaaccaccggaggatcattcaccaatatcccgaaaggaatttgtccgattttttgctagcaactccaaccaagtcagaactgcgatgccaggatttgaacttcagtggtgctgatctttctcgtttggaccttcgatacattaacttcaaaatggccaatttaagccgctgtaatcttgcacaggcaaatctttgctgtgcaaatcttgaatgagctgatctctggatcagtacttaactgtgcaaatctccagggagtcaagatgctctgttctaatgcagaaggagcatccctgaaactgtgtaattttgaggatccttctggtcttaaagccaatttagaaggtgctaatctgaaaggtgtggatatggaaggaagtcagatgacaggaattaacctgagagtggctaccttaaaagatgcaaagttgaagaactgtaacctcagaggagcaactctggcaggaactgatttagagaattgtgatctatctgggtgcgatcttcaagaagccaacctgagagggtccaacgtgaagggagctgtgtttgaagagatgctgacaccactacacatgtcacaaagtgtcagatgagaattttagaggctggaggaagatgtacaagatgaaaatgttttccttatcacttttctttctccactcactcagttgtctagaagaaataacactgtaaggaaattaaaaaaaaaaaaacacatttagaggattatgcttgttctgagcggtgcataagggaaaaaactgactttttttccatattctgatttttaacagaaaagcactcatttaatagatgtagggaaactagatattgctgccttttgaacggggtaggggggtttacctggttttatgaccaggaatagtatctattatatttgcttttaaataggaatgatgtggaaataccatcttggtttgagatgcatttgaggattttaatttatggaaagtacaacatatgcaattatatttattgaatacctagatgcagtatggatatttaaattgttaaaactttatgaaaacttggaaaaggttgttcaggtttataaatagctttagtgacgcctcccctctttaaatacctgtcataccatatgaatatggtgagattagactccctaagactcttttcaggttcatttttataatgtttactttttaggttaggacaaaacagtagctaaattaaagtaatatccagttcttactgattgagacagagtggaaagaaagacatcgttgtacttcactgtcattccaaaggtacagtggaactccggatggaggaataacttacctatcactacaacacttataaatgagaatttctcagaatttcattctaggcaagttccactcaacaccagaccaagcaattctatctatttacactattagcttagttttctcatacaatcatcacaagcataggaagatacttcaaaaccaaaaaaccaaggtgcatcattaatattcatttaattcaaataccaaatagtttacatagggccagcttagaaatagatactaaatccagagctactgcaatcaaagcttatatgagtgaatatggtagagttgcctgctaaaaggcaatgtaatataattgcagctagaaccctacagtggagaatgaggaattttaaacacacattttattatagccaccaaaaaacagatgtaaagtaaaaataaaggcatttggctggtccaagatgtaataccaatcagtcagcacctgtgattcttttacttatattttttgtgtttttttaaacaaattttagcccaattttcttgagtcattatctctctgcagcagcagaggaagggcctgtacctccctaccaatgacctggtgtccttattttctaccccaagagcagggatattagctgtgtccaaatgggttctgaattctacagactcatcaacatgaggcaaggaatcattgaaaaccacctgtgtctcctttgggagaatgacatatctttagtatttacgtagcttattcttctatatctacatatgcaaagctttccttaacagtaaagggtacatatgcatagtgggaggagatcagacctttacaagtgaaggaaagcaacttcagaaatgaattattttctttgctttgttatttttaccaagacagagaagtattgtattgagagataatctattttcataatcaatatatgcctaaattatatttaaatcatttcactctgtactatattttcaggaattatagaatgtgttattcattcacttaaaggtacctctgtagaaataacctaaaactgcagaaggatctgaaagatctaaacatggtgtgcttagaaactgcagattttagatctaatgtatacagcattaataaatgatataaagtgttgaaaaaaaaaaaagagtgaaacccaggttttagatatacctctaccagttacttgctatatgattttgggaaaactatttttttgtctctgagctttaatgccattatctgtaaaatgcagtgttacaatagatcattgtaagttatagccaatatcaaaatttttcttatggctgataggaggtttatttcccaaatctctctctttagaaatgcttaggtatgtctacaagcatatagcttaatatttcaaacaaaacattgatgtttacctttattaaattttttcacagctttaatttttgagtacctatgcctccaaaccagtcaaatcaatttttccaaacctatgcctccaaaccagtcaaaataacttctatatattgaagtttttgaaagcacatgtaaaattcaggataaattaccattgccatgaaaaatgctataggttaggtgttctttaaaaaaattatatacatctaacaattatttattggagacactactatgttctaggcattgtcttagaagcaggtgatacaaaagtgacagatagcatctctgctctcacaaagattatactcttttgggagagagaaagtgaagaagaaaacaaaacatacaaaaattatcagctagtggtaagtgccacccagatgaacaacatatgtgatgtggtagaaattgaggagatggaatggaccaggtagtaagggaaagcagagatctgaatgccatgaaggagccaaccacatgaagatgagtggggaaaaaattccaggctcatattatgtgaaggcccaaagcaaaaatgaactcagcatgtttaagaaattgaaagattagtgagactgaagcttagtgggagaagtagagaatggtaggaaatgaggtcagaaaggtaggcagggaccaaattggctttgatttatagatagatagatagatagatagatagatagatagatagacagacagacagacagacagatagatagagtgtggggggggggttggaaaacatattttaaacaaacagtatagatttggggtatgcttaagatttagagtcaacagcacctgttagtgagatgaatatgaacagtaaaggaaagagaaattggaaaaacacctagaggtttggtttgagcacctggataaatggaggtgccattaattaagatagcggaagacttgagggaaaatcaagtgtagggtgcaaagaagtaaacatcaacaactctatttagtcttattaagtttgatatattaattagccatccatataaagatgttaggtagatagttacatagagaagcctgagtttctgggtagaagtcaaggcagtagatccatatatgggagtcatcagtatctatatgttatataaagtcatgaagcagaggaggagaagttagcaaatagaagtattggttggtgaggtaggaaaaaaataaagagagactataggaggaggcaacaccaagagaaagagagcatttaaagtgggagggattagtaaactatgccaaatgttactgagaagataatgaggatgagagctgagaaatggctatcagactgcgcaaagtggagactattgagtggtggtaaaggaagcctaattaatgttgattgagaagaggatatagagtgaggaaatgaaatttcttcacactatttcccctcctgggataggcttggtacttataggccaggagagaattggaagagatactcaaagtacttaaagaaaaaataaatcagccaagaatactatatccagcaaagtaagttatccttcagaaatgaagtaggaataaaaaccccctgagagaaggaaagactgagaaaattaaccaccacaatactggctttgcaagaaatgcttaagggattcatacatctggaagtgaaaggatgacatctaccaatgtgaaaacatgtgaaagtataaaacccatcagtatagataattccaaaatcacactcagaataccccagtgctgtaatgttgctatgtaagtatttcagtcctctagtatgaaagtttaaagttaaaagtgtcaaaagcatcaacagctataattagtggctaaggtagaaacaaagataaagttataaattaaggcaataaaatacaaattatgtgggaggagagaaaaatctagagcatttttatgcaaccaaagttaagttgttatcagcttaaaatagtctattgtaattctaagattcattatgttagttccatgataaccacaaacaaagaaatcacagcagatgcagaaataataaagagaaagaaaacaaaacttaacaccacagaaaaccaccaaaccataaaggtaaacaacaagagaggaagaaaggagcaaatgatctataaaacaaccagaaaacaataaactggcagaagtaagttcgtacctatcaataataaccttgaatgtaaatagattaaattccttagtgaaagatatagagtagatgaatgcattaaagaaaaccacaaaacccaactatgtgctgcctacaaaaggctcacctcactattaaagacaaacatagactgaaagtgaaagaatggaaaacaatattccatgcaaatggaaaccaaaagtaagccggaatagccatactcatatcagataaaatagactgtaagtcaaaaacagtaaaaagagaccaaaagattattgtataatgataaagggatcaattcaacaagatgatataacaattgtaaatatatatgcacccagcaccagagcacccaaatacgtaaagaaaatattattagatctaaagggaaagatagactgcaaaacaataatagtaggggacttcaacaccccactttcaacaatagaaagaaagtcaacaaagaaacgttgaacttaaactatatcgtagaccaaatgtatctaacaaacatttacagaacattccaataaacaactgcagaatacacattcttctcaatttcacatggaacatcctccaggatagatcatgtgttaggccacaaaacaaatattgacaaatttaggaagaaaaagagcacatcaagtatctcttcttatcaaaatgctataaaactagaaatcaataaaaagaaaaactttggcaatcttacaaatacatgggaattaaacaacatagtcctaagtaaccagtgagtcaatgaagaaattaaaaagaaaacttaaaaattcattgggacaaatgacaatggaaaacacatcatacaaaaacctgtgggacacaacaaaagcagttctaagagggaagttcatagtaataaatgcctacatcaaaaaagaagaagtatctgactccaatatttattgtagcactatttacaatagccaagatatagaatcaacccacatgtccaacgcagatgagtgataagaaaaatgtagtatatatatatatatatatatatatatatatatacaatggaatactattcagccataaaaaagaatgaaatcctgtcatttacagcaacttggttggacctgggggacactatgttaagtgaagccagccagactcagaaagacacataccataccatctcactcatatgtggtatctaaaaaaagaaagttgatatcatagaagagtagagtagaacaacggtaataagggaaacagagactgaggcagaggtgggagaaagaaggaaggatgtggcgaagttggtcaatgcatgctaagatacaattagaaggaagaagttctggtgacaatgcttatcagtaaggtatagtgtattacaaaagagctaggagagagcttttgaatgttctcactgcaaagaattataaacacatgatgtgatgaatatgctaagactatgatttgattattatacaacatttatgcatctaaacattgatttgtactccataagtatgtacaactacaatatgtcaataaaaaataaaaattattctgatgaagaaaaatatatttggagtttagcaatttcttctaattgactttgatttttgttaaattcaaggaaaattactgaaagtaatgcatttattcaaaatataatatggaatgttaccctattttttaaaattatttttctttccaattttctatctatatctctacatagatggctggaatgatgtttaataaatgttaataatgaatgtttcagtgtggtaagattctgtattacagtatatgtaatttattttctgtgcttttctatattttatgaatttctgtcataagaacgtattgtttttataaaatatcaaattgattattttaaaacattgtgctaatgtcgataacatgggtttttttccccatgtggtaaacagaataatgtccccctcaaaaatattcacattataatcactggaacatatcagtatgttatgttatatggaaatgggaggagtaaggctattaattagctgaccttgagatagggtgattatcctatactatccaggtgggcccagtgtaatcagaaaggtccttataagaagaagaaggcagaaatgacagaatcagagagatgacagcaggagagggagtcagtccagctctactggctttgaagatggagccatgggaccatgagccatggaatgtgggtagcttctagaagctggaaaaggcaaaggaatggattttttcctagagtctccagaaggaatgcaaccttacttacaatttcatttttagctcatcaggactcatgctggaattctaatctatagaactgtaggaatacattcttgttattttaaatcattacgtttgtggtaatttgttaagtagtcataggaaacaaatacactcacttccacttaactattatctaatttattctctactcagcagccacaacaaacgttataggcctgcattgtccagtataatagccattagccacatgtgctaaatgagcacataaaatgtggctggtctgaaatgagatgtgctgtatatgtaaaatacacactggattttgaagacttagtatgataaatgtaaaatagctcattaataatttttaatattgacttcatgccaaagtgataatatttgggctatgtttggttaaataaaatacaatactaaaatttattttccctgtttcatgttacttttaaaatatttgtctacaggaaagcttaaagctacttatatggcttacattgtatttctattacacagtgctgatatagaaggcaaataagacactatcattttcttttttttttgagacagagtctcgctgtgtcacctaggctggagtgcagtggcgcgatctcggctcactgcaaccgccacctcccggattgaagcgattcttctgcctcagcctcccgagtagccgggactataggtgcccaccaccatgcccagctaatgtttgtatttttagtagagacggggtttcaccatataggcccggctggtctcacactcctgaccttgtgatctgcctgcctcagcctcccaaagtgctgggattacaggcatgagccactgcgccaggccaacactatcattttcttattaaaggccttcaatgtcttcccactatacatgcaatattcttcaaactccttaacttgaatttataagatcttgcatcatctggcttctggtacctgtttagcctcatcttttgcctcttatactccattctagtgggccaagcttgtttctgcacaggggctttccatgtgaggttcagtagacccaggaaactcttcatttcactattcatttgattgaaaagctctcatccttccctctcagctcaagtgtcactcaggtataccttctctggaatcccaatgtaggtacattttgctgcctcattcatagcatgctgttatttttgttaatggcacttttcacaacatgtaatgataaagtttttgtttatttctaaaattctctttgaaaatgataagctcagtgtatgctttatgtattaggcaaagcacagatgctcagtaaatattaaattaatgtagaataatcaaataagataatgtttatgtgaacacattataagctataatttactgtacagatgtaataatagtaatagtcatagaaagagaaggaggaagataagggggaggaagaaggtaagaaattaaagtctttgctttgcatcaatttttaatagatttttttccagtctcttatgtctttaaacatttgggaataagtaacacaataagtagctatattccattgctttaaaataaaagatctattttcaaagacatatcccaatttcttcttaaaggaagttttctaaattgtttgctggtgactcgggttcccttctctaaggcataatatgtatatccacagtagtgaacacaatgggaatggagtgtggtggagtaggtgttggagaaagcaaagcaaaaccagcattaggatggttatatataataggaatggttatcatataataggaagtcagactgtgcaaatatttgttactgctatacctactctcttaaatatgggagtagcattatttgtgttctaggtgaagctgtccagagctatatgtctatttgagattgttagtttttgcaacaggaacatgaaatttgtgtccctaattgtaatgctcaacagtcttgctataaataagtataattgcactgtactttctttatatttttttctaattagaaatttatttttccctgtcaaagtcagagcttaagcacggcctttcttaaatgatcttaaagtaaattttcctacttatgtgccttttctacaatcatttctgacttaaagttaaccttataattagcattttaatagcccaaaagccttccttgtacttagtagcacattacgatctgcattgaaataggaatgttataaaagaacaaaataaaaaaattacttatgttagaaaagttgtttttctaggttttgtttttgtgttttccttatggcatatcctctctatatattagacaaagattaaaacatctctttttgaagttactgaatttattattggggaaagttatcaaaaccaatcctctacctttaataaaaatgccttaatgtgatattttaaaaataatacccaggaaatgatgctttcaaaattaagattgatctactcatttccaatttggagaaccaaaggcaaactaaaaccttttggcttatatttgttagttatagatagatatggatatggatgtaggtatagatatagataaaatcagacttgagacagcattgaaaaattgaagtgtgccattattataagataccatttaataagccacaataaaaaaaatcttattacgtgattcctgtatatgtgacactgtttgccttagatacatctctatcttttgctgctatttccccatccactcatacacacatacttattttatcaatgtctcaacacctgaagtactcccacttctgcctctgtgccttgtctaatcatcgcatctccaatcagattgcctgagttcaaatgttcttttcacgacattatttgctgtgtagccttggtaagttacctaacgtctctgtccttcagtatttgtatctgtaaagcaggaaaaatgatggtacttcttcatagaattgttatgaaaatgaaaagtaatgcatgtaaagtattttggcataatcttggcaataaatgtaaactattatttttactcctttaaattatacgattaatactactgctactattttctctactgccagccctctatatactctatatttattaaatcagttcttaaataatccttctctccgtagccttcctgtattaaagaggaaagataagagctcttttctcaccccacctttgcttctgtttcgcttgcttctcattgtcttaagaaagagacttgcggggttaacagcagcatctctggctgatgtaatccaaacctcaaaagcaacatattaaaaataaagcagaacatcaaagctggttctttaataagtcctctgtttccttcgggtcccacacctaggcgacagtattttttcatactttgttcttgtcccctattccatgtcttgcagatctagctcagttttgtaaattgcaaccttttctcctttcttctgtagttagttcatttcatttgaaataaagcatttaatgatcatctagccctgtgctagggagtcaggatatgagggagagttcttaaagaaacaaaatcgtgagatactgcctcttctttcaccaaacaggaaattagatttgtataagatttatatgaagtaggccgggcgcagtggctcccgcctgtaatcccagcattttgggaggccaaggcaggtggattacctgaagtcaggagttcaagacagcctggccgacatggtgaaaccccatctctactaaaaatacaaaaattagctgggtgtggtggcgtgtgcctgtaatcccagctacttgggaggctgaggcaggagaatcacttcaactagggaggcagaggttgcagcgagccaagatcacactgttgcacttcagcctgggcaacagaacgagccttcgtctcaaaaaataaattatgtgatttatatgaaattattagaaaatcctgaaagaaagagtattcatttggtcagcattcatcacatgtactaaaattatttgtttttacatttttctccattaccatagtatgagttcccttggggaaaagtcagtgcctcagtaatactgtttatctgctcaagttcctgtcttgtaggaggcattgaagatattttttgaatgagtaaatggcaggatgaaaagatgagacctagatcttatcctcaagaagcttctagtctgttagaaaggatcacttgtgtacataagtagtagtaatccttattctagcctacatttatagactcttctctcctctacttcccaatgtacccagtccatagagaatatgacacgtatgcttacacctctctttcataatttcttctgctgagaataccctttcctctttttccacttatgaacttgtattcatttatcaaggtacaactcttaatagtatcttatcagtaaagtcttctctgagtcttttccccatgtagaacaaatccctctctcctctgcccacttacagcatttttcatatacctcgcttagctcttagtacattaaatcataattacttatcattttttcagctttaatgtgaactccaaaaagagtgagaccttatctaattgatctttgtaattctagggcctacaaccgtgtctggcttatagttagtgctcaacacatagttgactgaaaaaaaaaatgaatgaatggatcaatgactcaatgaataattgtgacaaataccctaaaagaagtgggaaaaaaactgatatatgattgttattttgtatagtagggtcccaagagccaaattcaaattccccctttttggttaaagctctccctgcctcagtctcactccttttttttcagttcctataccttctgtctgttcttgactttgccataaccgttgcctgttatgacagattccgtgagcatccagcacagatgtatgtataaaaacaagtaagattaaccataggtgagattttgtcacttgaaacataataatatcatgtataactaattgttgcatgttctaattaattgcatattttgattaattctttggcagggaataatcctggactaattttcacagaattagaaggcagtaaaatatactcaccactgcaattatactaaacatagttgaatggagaagattggtttgaatctacactaatcccaagatgtacatgggaatttgttctttaaaaaaatacccagcatacttgtcatttatcatattgttataaaactcaagaagagaaaagaccccaattacttttgctttccagttgtttggagatctgataaaaggaggtattttgaaaatggctcaacaacaactgacaaaagtccctaatggatcatatgctttgtcatcctcagtagcatcactggtttactctgcaaacattagcagtttccttaatctccacagtcattggcttgagagtgaaaacactgcatcacctagttagaaccacaaaaactagattggttttatatttaagtgctttgaaaatttagaataacacctggtaacttataacaattgtccagggaacatctataacgtgcaattgctcagggagtgtttcggtaaaatttatcctgaaacaagttggccagcagccacatcttgaaaacatctatgttataaagaaaaatttcatcatactggtacatttttccatagagtttggcatgtattatcaatccactattactttagaagtataatcttaataatattttttgaaaccacaaggtttacatttatattttcctgattttctaggaaaattagatggacctgtgatagaagtagcattcggtataataagtatattttacagtcaccacatacacagttactttgaatatctgtcttcattctatatctaccaaggattccacgtctcactatttccagaaggctttttcaaagcacgaattctactgaattgagaatggggatgttgtttgttgttttccagaaatagacttgcatgctactatattttgagcaaatgatcacaaacacatccgcatgagaaggcaacagatgtaaagaaaaaacttctatatttattacaaaccaagggagcaatgcaagtatcacagcaaatttgtaccaacaattatatatattcttttgctgacagcttggtctgcaaagctgctagagtgcagaatcagcaagtctaacccagaggcaactccaatctgatggataatatttgattcagtaaatgaagtcaagtaggagtttaaaaaccagttacatcttctttcatcagacattgcttcatcttgtcagtctttttttgtagactgtaaattgaataatacaaaatgttatctgcaaaaaatttttcagcttgttataaagtgagaccatttgtgaaaggatgaaatagttacaaatgcgtatttgttactgataaatgatggcatgtatgatccagtgttttgaactttcctccacattaaaaaaaaatgttggagataagaaaactaacccaggtttttttttttcttctgagtacaacagataaaaggaaaagttagcctgggagggatttttgaagttctttggttcactgattttctaacctgctttcacattataaagcacctaaagtactttttgaaaatatagtgttaggctccactctgaaattttgattcaggaaatctgaaactacctactaagtactgtcaccacaacaagtctatgcacttattcagaactactgatctaattcaactccttactcaatgcggaatcctctttacaaaaaccttaaaatgtggctgttcactgactcaaggcagcatagtccattgttggacaattctagttcagagaaagtttttatgtattaaccccaaatcctagaaacttctccccaatattgtgtgtccagcaacttcacatgacccttccatggtcacacatgtgcttggttcatcagggactccttattttgcttagccaattctgtctcagggcctaaggagtgtgcgtatcaaaaaacaaaattgcattaaaagttacatttatattgatgaaacaaaatatccacaggtttatgtccctcaattagtagctatgctggattgagctgttcactcagaaatggcttctaataacttaaatgttggctgagtatttaagattaagatttgccacttaaatgacagcaacacttcattcagtattgggaagtgtgagaaatttgactgacaagccccactagcctatttacaggtatcagggttacagttgaatttaaccttacactcaggcttctccagaccaaaagagccccatcttctgaacttcctcaaaaagcgaaagacagatctgagaaacctgtgccaagacaatcacatcactgggaataagaatagtactgtgaaccccagaaatctaagacaggtctcagttaatttagaaagtttattttgccaaggttgagaatgcacacctgtgacacagccttagcgtgtcctgatgacatgtgcccatggtggtcagagcacagtttggttttatacattttagagacatgtgagacatcaatcaacatatgcaagatgaacattggttcggttcagaaaggtgggggacaactagaagcaaagacaggacaactcaaagtggggagtgggcttccaggtcaaaggtagataagggacaaaagatttcattcttttgagtttctgattttcctctccaaatgaggcaatcagatatgcatttgtctcagtgagcagaggggtaactgaatcaaacaggacgcagatttgccctaagcagttcccagtttgacttttccctttagcttagtgattttggggccccaatatttattttcctgtcacacattcccccttctcattttaaaaatcttttggagaaagcattttagaagaaaataagtctatgatctcaggtttcgtctgatagatcatggctagaatggtttattcctagatgggtaggtcctgagttattaggaaagttcatttttagcaaattgtgaagtctcatgtttatgaagagaaaatagggggaagaggggagaaaaacaacaacaaaccaaaggatgagtctttactcatcctggaaaatcaatataaggcacattactctgaagtccatacatcagtaggcagctatgaaaatggtttatgtaggtaaataggttgctgttattttcttctgaagtttaagttgtctagcttcagttcacagggctttacaaaagcacagcttagttttcagtgactccaagttagaaaaatgtggggaaagagaaggagaaataactgaaaacattattttgaagacttacagccaagaaaaattagaattcattccaaactatagaaaataataaaaattgaaaaacattaggcaagactagaatctaacaacacgtttactacagttttttaaacatattttttctctctccagttttccatttttactaaagacaaattatggtaggactgatttgttttattatacttggcctgattatttgtatacagtgcagcaagaataacattttttacagaagcttttaaattggctttgatggaattttgtttcataggagtctcagataagacttttaaagctgagcccagccttggatttataccatcaaatgcctatgatttgggtgaattcctcttctcttgaggttccaagataaacctgggggctcctggtcctgtcagaaagtgacattctttacttaccccgggttaggacccctgtacagggaatgtgtagacaaggtataaagtcagttttcccaaggggcttttattggctccacaattcaagtttgattccttaaaggaaagcacaccattccagtcaaagccttagtaaaataaccagtttctccaattgcgtcctgttatagaggaaaacagattgttatttcacttgtgcaaataacaaatattaagaatactcataaatagcttccaaatactggagaattcaggtagagagaaacaaatatattctaaattttgttcatagaagtataataaattgttaaaagctgccaatagctcaaaagaaaagtttccttgactctggaaaaacagaacaaaggatcagcaacgttttaagcaaaaagtcaaaaagattacttccgtcttctactagttcagtccatgtagttaattcctgttctgcttgatattcatgaacatttcagttctccatgagttctaaaagttttacttctgttctgatgttacaatcttcaaagttatcagaaacttgtattcaagagcacctgtgggagttttatagctgattataaaaccaccttctaaagaggaccaaaacaagacaacaattgtctgcagatgacaaaaagttttagggcagccagagtcaaggacacaattgacaaggaaatttgttgcctttgttgcacacaaaaaattatgttaataatttaacataacaattataattattactgataatgtccactaagtcatatcagaattataggagtttcccattattttggaacacatagcaataacatatgtatacaaacacggtgcaaagaaaactaaaagccatttcatatttgacagtgttttctgtataattttcataccgaataaaccaaattgtcatttttggacttcaggaaacctaatatcttaaaggattaattaggtcagaaaaagacataatttataatttgattttggtaagtttgtcaaatatccaaaagttagaacacatgatatcacaggtcattgtaaaataagtcattcatttggccaaagtgataactcaaggatttcaaacaaaaagtgagaaccttcactctttgagagatttctttttcctttctcttttgcagctgtgaggaattttggccatattagagagactttgttacccataatttggaattctcactcagatttgacccagtcaggtagagttggtcaaatctgatgggagaaagaatggaacaaacaacaacaacaacaaaaacccaacaatatgatcactgagcactctaatggtaaggagaaattaagacaagttagttgttaaactttagccaaggcaaaaccccaattcagctacttacctagggatggttctcaggctgaagatggctttctaccattctagaagcaggagaaaaaatcctcaaactcatcttccctactgggagcgaactcaaactccataaaggagttacctaccttccatcatcatggaaacaggaaatcttgccttccttgttggaaacaagtaaaaaaaaaaaaaagggtgttgacagcaaaataaactttagatcttgaccaaatttggggagatcagggattatctggagggggtgctcctagacctaagcaaattttcctattggtttgagccataaagttagttcatacttgtaccaagcaccagtaggagatttgtcaaaaggaaggggcatctttattcagaatcccttcatggttaccaaaatgtgaaccccaaaaatctgaaacaggcctcagttaatttagaaagtttattttgccaaggttgaggatgcacacccgtgacacagcttcaggaggtcctgatgacatgtgcctaaggtggtcagaacacagtttggttttatacattttagagagacatgagacataaatcaacatatgtaagatgaaaattggttcggtctggaaaggcaggacaactcaaagtggagaatggtcttccaggtcataggtagataagagagaaatggtggcattcttttgagtttctgattagcctctccaaaggaggcaatcagatatccatttatctcggtgagcagaggggtgactttgaatagaatgggaggcagatttgccctaagtagttcccagcttgacttttctctttagcttagtgattttggggccccaagatttattttcctttcgcagtactcaaatggagcaggaagtggaatgatacagaggacgtacattgaatctggggatgggggtactgtggagaagctagttaaacagtaaacagtcccagctactctggaggctgaggcaggagaatcgcctgaacccgggaggaggaggttgcagtgagtggagatcattccattgcactccagcctgggtgacaagagtgaaactatgtctcaaaaaaataaatgaataaaataaaaaataaaaattaaaaaaaaacagtgaacaaagggattaagtgtgtactgataatccttttctttccaccttgtcttccttcttggtggtaagcttagctcttgcttagctcagttcacacctctgccatgccttgtaattctgtgggacatcacccgggggagtcctattttggttgccagctgggcttggaagtacaggctctttactctgggtctccatccaactgagccaccagagcagggtcagacttgaaagaaatccagggcagctactgtcctgacagataacccagcatctttcattccagagaacagtcaaattagaggagagagatttaaatcttaccttgctgagaagaggctgtcacaacccagaccgctcactgagaacagcattctgactaaaccttggaagggtatggacatagtaaaggagattacttgggtttgaggtcaacaactctctgcactgaatgcaatgagggtgccaaatgtcatcttctaaattaaggacctggccaacttaatgcaaagacaggcaggggaagaaaaagaaaaatacggaggaggaaacaaagacgatgagagtaaagtcaggaaaagggaaattgagtatacaggaaaaaggaaaggaatttgattaaggtgaatgggaacatctccttccccacccccacctcaggaattgttaggactgcagctgctcttttaactttttttttttcctgaagtcaatttttatgcataggactcaggaagtttaaaattaaatgacacttgccagttttttgactcagtgtaacttccctctcatgttatcctttttttttcctttgctgattcgtgtaagcaaacccattatctgaacaaaggggagctgacagagtgtcctgaccttatcttttccaactcctaattattttcacaaggtactgaaatgaagttttggatttattttttaagttggggaactagaaaataaaggagtgaaattgtgctatctctgatgacaccaacaattttccagatttaatttagtttattttaaaaaaatgctacaaaaaaccccatcctaacaccaacaaaaagaacatcaacaaaccagcctgactaagcccagacccctgtcaggaaatgaaattgattaaaggtgccccctcttcctgttactgtctgtaacacttgtctatttctgccaaaacatgtatcaaaatctgtaattttcttgtttattttttctgtttttttttttttttatgttttgcctgtctccctcccagtagaatgtcagatccattagggcagggattgattaattaattgttttgctccctaccatatatatttctgaactaggaaagtacccagacatagcaggcactcaataaacattgattgattgattgaatgaatgaatgaatggtgaggctcactgaacagacagaacaagcctttaggagagatccaaaccactagtctgtaaagtactatgtcatctgacccctgcctaccacagcaacttcataatttactctccctctgacctttgaactcctctcacacactatattctacctacctcagggtgtgatacatgagatttcatttacctgggattttgggatgctcttactggcttggcaacttctcatctttctgatctcattataaaggcacctacatgaaaacttcttggccatcccaagtagccaagtagcctctccttagcccctattctactccttgttattctctctcattttacattgttcctttccttcaagggattattttttgtaatttataattctatatttatttacttctttattgcctgccccctcccattgttatattcataacgactgggattatgttttttttttcttaactctgtatccccaacatctaatacaatcattggtacagagtagataattaaatatttgctgattaaatgagtaagtaaatgaataaatgaattgctaatgttccttctcccacacctcattgtgcagacatgccatcctgaggtctggtgtttttatacttttggcatggccatgtaccctcagaccccaccagagaaaaccttgggctaggaaagcctggatagtcccaattacacttcaatgatttgaaattaaggttatatgaataatttattttgaaaggaagaaatataaagaagggaaacatttttgttttcatttcttatgctcaaagtggtttgggttcaaagttggatttttgttgtaaatacaccacacttgcagcaatacaatataccatgttatttttgtcacaaacagcagatttcctaatgggagctagagagtcctttgggaacttggccaaccaggcctagtaagccattttgatcatgtcatcttggattaattgctatttgggctccatgctttctttgcctggattaggggacagggcttgtgcaagctcctgatcaggcctcctgctgccagcacaatactgtctcccactctcctcaaattctttatcttcacctgttctggaactctctaacaccctatgacttcagcagctgttgtctctgcccctgaatcagacatgtgttcaatagaggggtttatataactaggccctgagaaggatttttccaaatggaactaccccatatattttatttactttaggatatattgcttctgtctctgtatccttcctagtaaatatcatgtctcttaactttctggagtcatgtttataaatgcagcagatttgtgtactatgtacagaccttgctgatttgcagctcctagcaccaatccttgtgtttagtagacattcagtaattattgtttaatcaaattggatcaaatctgaaagcgtattgatgccattagaggaagaagaatccaaaaagactgtcttcctaggaaggaaacttcttcatctctttgacattttgagaactccttgtgtgagggcaacatgtgtagatgagatttagattatggtttaagactaactactaactgctggcctctatcagtaacaggaagggacagttagcaaaatggtgattgagtttctgattcagtttctattgaaaggatctaaaataatatgtatacaattcattgtaactagatgttggaggtttgaaatattccgaaaaggattctaatttaaaatattgaaaaatatgctttgaatatatacaaattcaaaacactatatgggaaaaatgaaaataaaatagaaattgtgaataaaatatattaatgttacaaaagaaagtaaaattgaatcatatagtaacatctagctttattttcagaaagtattatcaaatgaagaaaacactaatatctaaaacaaaaaactacaaaatatttgatgcaccaaataaattgaactatcaagtatttccaaaggcctaagatttcttacatatagacagtactaatataaaatttgtgtgagttgtaaaaactgcccagttccagactccaagggatacaaacaaatatagtagctttctttttctctgttgaaactaaattttactaactcctggacttattctcatttccaggtcaagattttgttaactcagactttatacttcgtccaaatgacatttgcattgacaatctcagaaaccatttttgtcagagttcccgacaacatccaactctgtctgagattccccctaaatctctaggggtcatctgagcccaccttcaccctgcatctcctgctccttttattcacttctgcgaaaagagggagttgtgttcaccttctttttgcatttagcaaatgaaaacaatcaatggtatttacaatttccaacatacataattaagagacaaggcagaaaagatttaaagcagactttcaagatttagtcaatactaaacctgtggtacatttgtatagtttgctgatctggatgctttgaggatataatgtccctcctatagaactaatcattcatgctgcttagccctcatttattttctgactcctaagagcaccatgctttacgtaaaatgagtgcacaaaggtcaggtggcttgagaatttgtatttagttcagagacttgaaaatttggtaggctatgcttgtatttttttcccctaaatctgaaaaacctgtgattttcctttccccagaggcagtctgctggattagatggagacacgttctgccccaaagacagaaactaaataatatccggaaatatcttgatctgaagcaaaagccatgccaaacgttactgaagaaagctttgaaatataaaaataagattagaataagaatcccagtgtcctacactaaatattttaacaaagaaatcgttcaccacttagcactttgtgtaatactgtacagattctaaataaaaatgggattacataattagtacattgatcaaaaattgtgaaaattagcttcaagttcttaataagtcatagctgaacctcagcatgggcaaactgctgaatgttcaagggatgaaaaatagaatttctgttatgtagctctaggagcatcatgaaaatattcaatcaatctggcagattaaagatactgcaggcatcctttattgtcagagatttgattcataatctatacttatcaaatttggtgacattaaacagtggttttcaaaatttaatatgcttcagaatcaactgtcatgcttgattaaatgcagattctttggctaatacaaaaaacagtctcattcaatggattggtgttgacccaagaatctgcactttaacaaacaaggcaggtaattataaaactagttgaccacagactatgtttggcaaacaatgctctagtaacccaggggtcagcggacattttctgtaaagggtcagatagtaaaatattttctgctttgtgaaccaaatgatctgtcacagctactcaactctgcccttgtagcatgaaaacaacaatagacaatatgtaaacgaatgggagtgactgtattccaatcacattttatatgcaaaaagaagccttagcttgagtttaacccgtgggctatagatagcatacttttcagaaccttggtataaagaattaactcttgttacacacctaataccttcaatctcaggtttttctttttgtatctggtttatagtagagaggagcatctgttggtcaactgtgattttagagtctggctccatttgctattgtaaataccaaataaaatagagaacaaaattttttgagctgtctacacaaaataaagggaaattctcatgacctattttccagaaaatcttcttggattaaccaagccctgtctgtagttaaccaacacattctcctgctcatgttttctctacaattcgcattaatgattcttaaccccagtatgacaataatatggggcaggaagattgagcaagctcttttgatagaacaaggacaaaacatacctggcatttgtgctgccatttcaattcacaacacccatagtagacattgccaatcaccggtagtactctttccttctgagtgcctatatggccacaaagtatttctcaagaattccaggtactcattaccatcagactagagttgtcatgtgagataaaaattatgtgtcatcccttaataagctagccttactatatagaatttttattatctggggttattctatttggaggcacatagtattatttctactatatcttaatccatataattatgagccttgcttaatagagttacataatacacattttaattggttgtcattttctgttagaatattagtatcaaatttgaggactgtgactagtttatcatgttataccctgagatcattcgagaaacacttgttgccaggtttgtatatcatcttttctcattaaaatttctatattcatcatgtctatattcatcatgactatgatagtatactgaaaacttctgctaatagttacctaactaaagggcatttgaaaccatataaactgacattattggcaatctgtaaattgaattgacctatagtttcttttctggaaagatatcattgcaactatagcatatctttgaagtagcattttagatctatttgggttaatatttactgttaaagaattgtttggctgcataattaaaatgttcacttactaagcacaatgtagtttctagcattaaatggactctcttgcacagcatgctaccgactctgcaaactcatgaagtcatatgctagctatttcagtaaaacttatttagtaaaacttgaagaaaaattagcatttaatgaagcaaagcaattttcaaagcatttacaattccatcctggcacataaagttcatgtgtaatatgactttatctaaatatttactgaggtggtagcaagtgttttactgttggcaggattggttatgaaggatttgacctgaaactcaaattgaataggatgaaaagttaagtacagagagcgaatacggtctaactaggtggcttgccacaaagtttctagcataggcaagctggcatgtgatctgagaggccatctccattagacacccagcttttcacctagcaaatttgatagaaactcaaacaccaaaatgaagcagatggatagtggcaaccttctgtatctagtactggtgtttcagcaccataacctcccttataggtattctccaggcttttcctatagacttctgttatgccttggggaacatgatctgacctctgatatttccaaatctccataacaggatctgagtttgtttatttttaaccaagcttcttcccttaaaacattaaaaatctcttctagctgctcaacaaaactttcgacggctttaggcaaagagagagcatttgttagaggttctaggaagacccaactccagaaataatatgttccccatccttatagttctgatgtctgtctttgagacacataagaaactgtttactctagatattctctatacttgacatttatcaagaagatatgggaaataaagaggggttataagtgaatctatgagaatgaagcacatgcaactcgtgcaaatttcagagagagaagagagacagtggaacagaaatgttggtgcaaagggggccttgcaaaagaaagtggggttgagaaatctgtaatggacgctttgaatactgcaggaaatgagatccaggtgggttttggacatgttctggccaaaattgtgaccaggtttatcaactattgacaagcttagtttaccaaaccaagaaccttcttgttctaagatttcagtacacaggactaagcttccagaaaatttgggtagtagattcagtgtcttcaatttgcctttttttttttttttttttttttcacttttctcactctggaattttcccaccacaacaatcacatcttgtgcttaatatcctccctaggcattcagccactctctttggaatatcaaaacatctggaaaatgttgggtgagctcatttgctctaaggtgttaatgatgggtgaaaagcttaatatgttgcctttcccatgtgagtgtgtcttgggtccaaaaaatgactaatgagagctattctgaacattcttcagtatgggagaggtataggtgatatagaaggttttcttactgtcactgaaatcacagtcctgtaggccactgatcactcataaagtcttccctgtggttggctgtggaaatacagataggaaaaatgtggctggttctctcagtgtttgatctagaactatcattaagccccccctttttttgcttttgtttggttcaatttgcttttagttttttgaaatcaggctctgataagaatgctagaaaattctgaaagactcatctcaagactttctagacaaacaatgtatattttattttttgtacaaggttatttggggagtgggataagggagaattcagagagttcagggcaaaccctaggatacagataccaatttcagagtgccagccaggccttagaaaatctacttaccatacccagggaacccattgctaatttgaatgaccaatttgttgtttttaacccaaagttttctctcatcaagtcattgtctctatttaaacaattatttgccagtctgtataataattgatttttttgtcttggtggcagatgggaaactaacacttgtaatgttatagaccatgtctgagcatgaatctttagatcaacttgaattttaatatacaaggttatttttgtctttaataaatgacttgctcattggtatagaagatacacttttattatccttttattactttccatgtagttcaaagtttaatatgctagtctagctatgattggttaagaaattgacacacatggctattattgagcacaatatagtgactatcaatatgtgttttttcccggagtgggaaaaaaccccacatttctcacatttgtacactttgagagttggaaatcatcaaatatttagctagttccattgatcttagcttattaaaacttcttgtcaaatggtaggaattcttagtttattttactgaagcaaaataaacctaaatgaattaaatggttctgttagttgcggcatctataaaattaggaaattgggtgagatgaatataaggtgccatagctatgtcctctaatattccttcaagcaaacatctatgaatccatgtttagatttggctccataacaataatgccttatatgtgatagcactctctaatttacttatgtgagcttaattgacttgcaactaccctattcctttacatatttactaagttcctactaattgtccacagtgtcattaggctttgaaaatataaagctgaggtagacagtcccgtgattattgtccccattttagaaagaggggatcacagactcaaagatgtttagtgaccagagattacagttgtggagctgggacagaattccaagcaatttgacttaacctgttcatactcaccttctacctcttgtgtgcaagtagatggaccagacagaaatgcaaaagttaatgatatggatatgtcaccaaaagcatgatccataaaagaaaaaaaatgataaattacacttcatcaaatttaaaactttgctctgtgaaagacactggtctttcatgaaataaagaaagacaagtcacagactaggaggaaatatgtgcaaattgcagatctaacaaactcgaatttataatatttaaagaactcttagactcaataataagaaaaccaacaacacaatgaaaaatagattgaacagatagttgaccaaagaagatatacagatgctaaataagcgcatgaaaagatgttaaatatttctagtcattagagaaaagcaagttaagaccacaatgtgctaccattaacattcattaaaatagttaacattaaaaaatactgacaataccaagtgctgacaaggatgtgaagcaactagagccctcatacattcctggtagaaatgcaagatgatacagtgctctggaaaatggtttggcaggttcttataaagttaaacgtgtacttgtcatattgaccagcaatctcagaatgaaaactcacatttgcgtaaaaatatatacatgactgtttacggcagcagtattcataattgccaaaaactgggaacagactaaatgctgttcaacatgtgaatgaatttaaaaaattgtggtgcatccacacaatgaagtgccacttgacaatgaaaaggaagaaatctttgtccactttgtgatgggattgtttttttcttgtaaatttgtttaagttccttccaaattctggatattagacctttgtcagatgggtagattgcaaaaattttctcacattctgtaggttgcctgttcgctgtgatgatagtttcctttgctctgcagaagctctttagtttaattagatcccatttgtcaatttagcttttgttgcaattgcttttggtgattttatcataaaatctttgcccatgcctatgtcctgaatggtattgcctaggttttcttctagggtttttatggttttgggtttcacatttaagcctttaatccatcttgagttaatttttgtatgaggtgtaaggaaggggtccagtttcagttttctgcatatgactagccaattttcccagcaccatttattaaacgggtaatagttttcccattgcttatttttgtcaggtttgttgaagttcagatggttgtagatgtgtggtcttatttctgaggtctctattctgttccattgatctatatgtctgttttggttccaataccatgctgttttggttactgtagccttgtagtatagtttgaagttaggtagcatgatgctccagctttgttcttttggcttaggattgtcttggctatgtggacacttttatggttccatatgaaatttaaagtagttttttctaattctgtgcagaatgtcaatggtagtttggtgggaacaacaaacatatgaaaaaaagctcaacatcactgattgttagagaaatgcaaatcaaaaccacaatgagataccatctcatgccagtcagaatggtgattattaaaaagtcaagaaacaacagatgctggcaaggctgtggagaaataggaatgcttttacagtattggtgggaaagtaaattagttcagccattgtggcagatggtgtggtgattcctcaaggatctagaaccagcaatcccatttgacccagcaatcccattactgggtctatacacaaagggatataaatcattctattataaaaatacatgcacacatatgtttactgcagcattattcacaatagcaaagacctagaaccaacccaaatgtccatcaatgatagactggataaagaaaatgtggtacatatacaccagggaatactgtgcagccacaaaaaggaatgagatcatgtcctttgcagttacgtggatgaagctggaagccatcatcctcagcaaactaagacaggaacagaaaaccaaacactgcatgttctcactcataagtggcaattgaacaattagaatacgtggacacagggaggggaacaacacataccggggcctgtcagagtgggggcaagggcagagagagcatcaggacaaatagctaatgcatgcggggcttaatacctgggtaatgggttgataggtgcagcaaaccaccgtggcacatgtatacctatgtaacaaacctacacgtctgcacatgtatcccagaacttaaaataaaaataaataaataagaaaaggaacaaaccactgatacatgcaacagtatggatgaatctcaaatgcacaatgctgaatgaaaaaagccagacccaaaaagttacatactttattttttccactaagatgacattctggaaacagcaaaactatatggagagagaagagatcagtgattaccaaggggttaagggagagagactgacttcagaggccagcatgagggcaatcatgctggggtgttataactgtcctatatcctgtttgtggtgatcattgcagtcatctatgcatatgttaaaactcgtagaaatatatatccaaaaattgtaataaaataattattacacattaatcctgacagttaaaattggttctagccaaaatttaaaaataagtgaggtttgaatttagcaataaatgcttcctttacttttttgttattagagacacttttctatgtattgtctttcctcagttctttctctcagttttcaggatatgatttaataaccaattcacagaaaagtttaaatgactgataatagctacatgtgtttcctctagtagggccatattcatttgagcaggttaccaaaatcttaaattaaaataacgcatttccaacagtaggtgggatgccaagcaacagccaaaggataaaggagttggtagggataaagagtcagaacagcctccattacattactgaaatgaagatatatttgctttgaaattttaattttggaggttgtataagaatatcacttagtctatatggtactatagacaaatatatagaaatgtagataacactcccaaatactgatgaatgtgctcagaccaggaagggaaatcttacatggaacaataaaaataagtgtcttgaaatcttaacttcttaataaatcatttagttgattgatttttacatcaaaattctgaaactaaactcattgtaaaaatataaacgtatatatatatatatatatatataccatatttattgtcactttctgagagctgagcaactatagttgcatataaatcactttaaaacttatgtaatagtgagaattcatttgtaaattatagtatttttaaagcaaaatgtcacccagtactttatttttacctacatttacatgtcaggtttccttaaagtgaggtatacctgcacaagaatggggaagttttgagcactatagaatttgcttacttcttttttattcttattaatatcaaatacaggtaaaccagactttacaagcaatgctacaaacagtgtagaaagtgtctctacatctatcatataaattcatgtttattagatctcagtgagagtaataaagagtttcaaaataaattggagctgcagttcttttcaaagtgaccccggtaacaatgtgtctgaattggaatactttatctatattgatttttattttcatgtcaagtttgaaaaatatgtcaggtgtactttgaggatacataaagcatatattcctaattgtatttatttttttgctactgtctatgtcaggtgtactagaaacatagggattattaaaattaactaaaacatggcattattacccatttagaaacaggtgctaggaactctcaatcttgggttctatgtacccagtttcaatcttactggtcaattctgtttaaaagcaatccaaaccagaattttctctgaggagaacaacagtaaaatataaagtgttaccatgggttaaaaaaaatagttgagtggatgaatatttagtcacagccattaacctttaattttaatggttttgattgaggaagaagtttttgtttttagcatgacacttaagtaaatgaatggtttgatcaaaatttactgttataggctaaaagtatgagattaataatagaatatcagagatgccagtcaagccactgaagaaatggattcaacctaataaagagcataactcatcaaacttaaccatgacaagcctaaatattcccatttcatcaaaataaaatggctataattaagtgttttaaaattaatgttatcagctcttcattcatccagtcattctaggccctgcttcccaactctgaacaacttccacctctgcctgttccctctaactagggaaatgtatcagactgagtgaagatttgagcaatggcacagaggttgatgacgtgagaaataatgacctggttaagtaccagataatgggtatgtgccaaagattaaggggagcctttggctagaaacaaggggatgtttgaattagcctaacatataagatcccgaagcacccagctccagataaaaagaatcagggatattaaatcaggagggaaatagtagaaggaggtaaaagaccaaacttgataacccaaagtattataaaactctgttttggggttacattagaagatgacttagggatgtggtatatgaatacatcagggagtagtggcgtgttggacaaaaagaaccacggaaatatagaatctctttttgtgcccataatttagactaagctgacatcattgtggctttcgcttctgttagatgggctcgtctgtgatgaggcccaacagatttggctttacttaaaattgagttcttcaagacttcagagtggcaagattacagggtatttatgtggcatccctcctctcccattagtcttcacaacctcaaggagaagacaagtaactgagcataaggaattgatgcagtcctcaggttcatgtagaggtccctctttcctgttgattagtaacctgcttgtatgtttgacattgcttggctgtgtgtgcccacccaaatctcatgtggaattggaatcctcagctgtcagggagggacctggtggaaggttattcgatcatgggggcggtttcccccacgctgttttagtggtagtgagggagttctcacaatattgatggcttaaaagtggcagtttccctggcactccctctctctcctgctgccaggtaagacatgccttgcttccccttcaccttctgccatgattgtaagtttcctgaggcctttgcagccatgtggaactgtgagtcagttaaaccattttgtttataaattacccattgccatgtagtatctttatagcagtgtgaaaatggactaatatagtgttcctaccctgttgccatttgtgagcttgaactttatctcttctgactgtgatcttggcttggctgttggctcagctcttgtgtatttatgatttacttcctttttgctgcatgtgctttacttcagatcctgattgatcctgtatgtttgagcctaaaagtacaactacaagtccaaattgccccttgggcaaatgtttggcattttttttagactctactatgattcttgttaatcctactatattggctcaatcagaagtgcccaagaccgttccctttacaatataacttttgctgtacaaaaaaaaaaaaaaaaaaaaaatggggtaaggaaaaggatggaagaaaaaatgatactaaggagacattaagttaggagaacctccttaacattttgtctattctacaggaaccatcttctcttataaaatattttttggtacaggccagagaaaaacacattgcactgcatgggatggataatttctctggcccagagcgatgttttgtatgtgtatgtctggaaaggagccaggctcaataaggacagaaaatatcaatgagaatgggataggaagttgaatttgaagattatttcgggtaatgaaaaacatctgatgaccttggccgactactaaattaaatctgagttaaaagatagtttggggctttaggaacaagagtccgcaggtatatttctctgttgataactatttgtgatggaagaaatgaggtgaggaatgcctaggtgaatgtctttcacagctaaattgaaacatacagactcagacagaaatggtcatggaggtttacttttaaaaataaattcatataccagctcagaaaacatcccacaaaatgacagtatgtgaagggttatcctcttggaaaaggaattcaattttgaattatccatactacagaccttgggagtctttagtcacttcatccaatgaaaaatggagatgtttgacttagtgacagatgatctgctcaacaatgttttctttcttctattgctgcttcaattgtatatttagtgaattagttgtgattgatgatagcattttaagcacttgatatttttttctggtgaaaagatggcataatttaactatattaatagttttaggtttaagtgaagcacaatatatttttataatccttcaatagtgaagtcacaatttatacaagtggattcattctgtctttagaccacggaactctgacaaaaggatgtcatttaaagtaatgttgctcatccttcagagatgcaaaactgaaggctacattgctctgatatgaaataactttggagttttgaatgcctggcaaaatttgtatatgccactaacagtaacttaagtggtttgtacagctggagccaaatatgctctgcagagaaaaatatcaccaactgctgtaattttcacataagtaataggactaaagaaacagttttgttcagaaacaacaccttctctaaaatctgggcatgaaatgttcaatcggtgatatggattgtctgtgtctccaccaaaatttcaccttgaattataataattcccacatgtcaagggtggggccaggtggagataattgaatcatggggggtggtttcccccatactgttcttgtggtagtgaataagtctcagcagatctgatggttttataaatgggagttcccctgcacaagctctcttgtctaccaccatgtaagatgtgtctggcttcccctttgccttctgccatgattgtgaggcctccccagccatgtggaactgtgagtccattaaacctctttttctttagaaattactcagtctagggtatttctttattagcggcatgagaacagactaatacaatcagtgtcaatgtttattattaataacataattatggacaacgtaaagtgctagtaattacaacagattagagagctgctattttacctcaggtggtattatttggagtctggtatatatcagatttagggtgattaccttaaaaccttagaagaaatgatattaactaaatgttattttctacttagtctgttacttcctgcagaataatagtttatgctcttacttagtaaatgtcacagtaggggagaaaatataagagcatgcccatatacccacacagtctcctttggtgtaactaccacatcacagtatcttagtgctacctgaatgccaatagctaagttttgtaaatggagatgaaagagaactagggaaattaattgatgtgattatctttcagtagtgctgtataatgacgtatttacctaagcttgtaggcctttaagtggactctcaacatttctaatattgaatgaacccagacctctcttaaaacatgccagttcatacatattatgcttataagattcaaacgttctctcatactgatagccttcaactgagatatatttagattatcaatgtcaaattaagacatgacaagttcccaaagacatataaacatgaccctgacaaatgaatgtgctggaagctggatcttatgtagaagtaatagcttccattctgttccagatctggggtgtatgtgtatgtgtgaagttgactgtataaatgtaaaaatttatccaaatctttggtatgagtttctgtgggacctttggatggtacctcatcataccatgtctgaatggtatgtcaggaacataccgttctgacataggtttgaagactagtcttaatactaaagcatttccccacgaataattttatttatagtattcataagtaataactacaaaaaggctcattattatgaattgggttcttctttattttttattttattttattttattttttttggagtctcactctgttgcccaggctggagtgcagtggtgcgatctcggctcactgcaagctctgcctcctgggttcacgccattctcccgcctcagcctcccaagtagctgggactacaggtgcccaccaccatgcccagctaatttcgtttttgtatttttagtagagacggggtttcactgtgttagctaggatggtcttggctagtcttgatctcctgaactcgtgatccacccgcctcagcctcccaaagtgctgggattacaggtgtgagccaccgtgcccggccatgaattgggttcttattacctaccaggggtataaaaatgtgcagtcttctgatcctagctctaggcaaacaaattcataaggtgcaaacattgtgtaatcccttcaatactgctctctgtcactattcacaaatgttagctccctattatccccaaactttgtggcacgtttttaaaatcagtccctagcctgtaaaggccccaaatgataccaacctcccatctcttgcatgcttatattttatacttctgacagaggacatgtaaagctctgcctacatttctattatttacacccgaatctttgtagcatttcataccccaagccccttaataatgtgcagtagaagctctgtgcccaaactgtattggcatatgccacatgctggatcccttctactttgagtgaggacaaagagtcttcatacaggctgggcatggtggctcacacctgtaacctcagcactttgggaggctgaggccggcagatcacttgaggacgggagttcaagaccagcctgaccaacatggtgaaaccccatctctactaaaaatacaaaaagtagcccagcgtggtggtgggcacctgtaatcccagctactcaggaggctgaggcaggagaactgcttgaatccaggaggcagaggttgcagtgaggtgaaattgcaccactgcactccagcctgggcaacagagcaagactccatctcaaatcaattaatcaataaaataaaaacagtcttcatacaaagggtagattataacctatggtactttattggtagtgtcttcattggattgataatttaagtttcaattgatttctttttaaaatgttttaatttttaattattgtgggtacatagtagctgtatatacttatgggtacatgagatatttaggtatagacaagcaatttgttataatcacatcatggaaaattggatatccacccctccagcatttactatttgtgttacaaacaatccagttatactttttttagttattttaagatgtacaattaaattattattgactatagtttctgtgttgtgctatcaaatactaggtcttattcatcctttctatttcttttatacccattaattttccccacctctcccacaatcccccactacctttcctagcctctcgtaaccatactttattctctatcaccacgaatttaaatgttttgatttttagatcccacaaatgagtggaacatatggtgtttgtgtttctctatctggtttatttgacttaacataatgatctcaaattccatccatgtttttgcgaatgacagtgtctcaatcattttatggctgaatagtactccattgtgtataagtacatttatccattcatctgctgatggacacttaggttgtttccaaatcttggcaattgtaaacagtgctgcacaagcataggagtgtagatgtctccttcatatactgatttcctttttggggggtatgtacacagcagtgggatcgctggatcatatggtaattctatttttagttttttgaggaaactccaaactgttctccatatttgttgtactaatttacatttccaccaacagtgaacaagggttcccttttctccacgtccttgccagcatttggtattgcctgtcttttggatgaaagccattttaactggggtgagagtatatcttattgtagttttgatttgcatatctctgatgatcagtgatattaagcaacttttcgtatgcctgtttgccatttgtatgtcttcttttgagaaatgtctattcaaatctttggccaacttttaatcagattcttagatttttttcctatagagctgttgaacaccttatatattctggttatgaatcccttgtcagatgggtaatttgcaaatattttctcccatcctgtggattgtcttttcaccttgttgattttttcctttgctgtgcagaagctttttaacttgatgtgatgacatttgttcatttttgcgttggttcctgtgcttgtggggtgttactcaggaaacttttgcccagaccaatgtcctggagactttccccaatgttttcttatagttgcttcatagtctgaggttttagacataaatctttaattcattttgatttgatttttgtatatggtgagaggcatcatgtttcattcttctgcatattttttaataatgccaaaagtataattcattattaatatataataattacaaatatctgtaggtaaaataatattgttttatttatatgtatttattttttaattttaagttacaggatacaagtgcagaatgtgtaggtttgttacataggtatacctgtgccatggtggtttgctgcacctatcaacccatcatctaggttttaagcccagcatgcattagctattggtcctaatgctctcccaccctgttgaggatttttgcatcaatatttatcatatatattggcctgcaggtttttttattctcatgtgtctttgtctggttttggtgtcacagtaaaactaaccttatagaatgagtttgaaagtattcccttatcctctattatttggaatagtttcagaaagattggtattagttcttcaaatgtttggtagaatacagcagtgaagccatcagttcccaggcttttcttttctgggagactttctattatggctttgaccttgttacttattcttggtctgttcaggttttggatttcttcatggttcaatcttgatagtttgtatgtgtcgaggaatttatcagattattctagattttccaattaattggcataacttactcatagtagccactaatgattatttgaatttctgcagtatcagttataatgtctttttttatctgttatttatttgggtcttctctcttttcttcttagttgggccaaagacttgtcgactttatctttacaaaaaaacaaatttttgtttccttgatcgtttttatttccttgatcgtttttattattttcttcatttcagattcatttatttctgctctggtctttattatttcttttcctctactaatattgagtttggtttgctctcacttttgtagttcttttagatgtatcattgggctatgtatttgaagtttttctttttttgatgtagggacttacaaatttttctcataatactgcttttgctatatcccataggttttgtatgttgtgttttcattatcatgtgttttaagagcatttccaattttcttcttaatttcttcattgaccctctgcttattcaggagaatattctttaatttccatggattttacagtttccaagattcttcttgtttattgacttctagttttattgcaattgtagtcagagaagatgcttgatattattccagtttttttgaatgttttaagacttattttgtggcccagcagcatatggtcttctttggtttatccatgtgctgaggaaaataatgtgtatttttcaggtgttagatgaattattctacaaatttctattagatcagtttggtctctagtgcagattaagtctgatgtttctttgttgattttctgtctggaagctatgtccagtgctgaaagtgaagtgtgtaattcccctgctattattatattaggatttatctctctcattagctgtaatactatttgctttatatatctgggtgctccaatgtcaagtgcttatatatttaaaattgttatatccttttgcagaattgccccctttatcattgtataatgaccttctctgcctcttcttacactttttgtgttaaaatctattttgtctgatattggtgtagctattcctactcttttctggtttccattgccgtgggatatctttttccatccctttattttcagcctacatgtatctttctaggcaaagtgtgtttttgtaggtaacagatcatagagtcttatttttccatctattcagctactctacatcttttgattggagagtttaatccacctacatacaatgttattattgacacataaggacttattcctcccattttggtattggtttctggttgttttgtgtcctcctcttccttttttccttccttcatgtcttccttttagcaaaggtgattttctctgctggtataatttaatttcttgatttttgttttttgtgtatctgttgtatgtttttaaatttgagattacgatgaggcctgcaaacactatcttataacccattattttaaactgatgacaacttaacactgattgcataaacaaagaaaccagcatgcaggaaaattaataagaaatccacactttaactttgtctctccattgtttctctttatgtcttattgttctatatatttgaaagttgttgtagttattatttttgattcgttcatcatttagtctttctacttaagtgaagagtagttcacacaccaccaattaccatgttatactattctgtgtttttctgtgcatttactatcaccagtgagttttgtaccttcaggtaatttcttcttgctcatcaatgtccttttccctcagattgaggaactccctttaacatttattatagggtagggctggtgttgatgaaatcctttaccttttatttgtctgcgaaggtcttcatttctccgtcatgcttcatacatgcttagaatagtatatctggttaaaattatatatatatatatatatatatatatatatatatataaatatattatacatataaatatataaatatatataaatatattatacatataaatatataaatatatataaatatattatacatataaatatataaatatatataaatatgttaaaaatataaatatataaatatattaaaatatgttaaaaatataaatatatataaatatattaaaaatataaatatataaatatataattttaaccagatatactattctacggtaaaaggttttttttcttcagcactttaaatatgtcatttcaaatgtctcctggcttgtgtggtttccactgaaaagtctgctgccatatatattgaagatccattatatgttatttgcttcttttctcttattgtttttaggatccttttatcctttacttttgggagtttaattattaaattcctgaggtagacatctttgggttaagtgtgctgggtgttctataaccttcttgtacttgaatgctgatattttcctctaggttttggaggttctctgatattatccctttgaataaactttctctccatatctctttgtctacctcctctttaaggccaataacttttttttttttttgatacgttgttttgctcttgttgcccagctagagtgcgatggtgcaatcttgccttactgcaatctccgcctcccgggttcaggtgatccccctgcctcagcctcctcagtagctgacattacaggtgcccaccaccatgcccggctaatttttgtatttttagtagagacggggtttcaccatgttggccaggctggtctcaaactgctgaccttaggtgatccaccctccttggcctcccaatgtgctgggattacaggtgtgagccttcatgcccggcctaaggtcaataactcttatatttgccctttccaggcttttttctctagatcctgtaggtgtgcttctttgtttttttcttttgtctcatcggattgtgtattttcaaatagcctgtcttcaagctcaccagttctttcttctgcttgatcagtcctgctattaaaagattctgatgcattcttcagcatgccaattttattttcatctctagaaattctgcttcattttaaaaaattatttcaatttctttgttaaatttatctgatagaattctgaattccttatctgtgttatatttaatttctttgagtttcctctaaacagctattttgagttctctgtctgaaaggtcacatatttctgtttcttcaggattggtccctggtgtcttatttagtttatttggtgaggtcatgttttcctggatggtgttaatgcttgtaaatgtttgtaagtgtctgggcaatgaagattaagtatttattgtaatcttcacagtctgggctttttttgtgtctgtcttgggaaggctttctaggtattcaaagggtcctgggccccaagctcaatggcactgtggtttgtgcagacttacagaggtactgctttggtggtcttggataagatccagatgtatggctgggtgcggtggctcacgcctgtaatctcagccctttgggaggctgaggtgggcagatcacgatgtcaggagatcgagaccatcctggctaacacggtgaaaccccgcctctactaaaaatacaaaaaattagccgggcatggtggcgggctcctgtagtcccagctactcgggaggctgaggcaggagaatggcgtgaacccgggaggcggagcttgcagtgagccgagatcgcgccactgcactccagcctgggcaacagagagagactccgtctcaaaaaaaaaaaaaattagctgggcgtggtggtgtgcacctgtagtcccagctactcaggaggctgaggcaggagaatcgcttgaaccagagagtcagaggttgcagtgagccaagattgcgccactgcactccagcttggtgacagagtgagattccgtcaaaaaaaaaacaaaaaacaaaaaacagaagtattctctggattactgggcagagactcgttccttttccttactttatcccaaacaaatggtgtctttctctctgtgctgagctccctagaattgagagtgtggtgctgcaagcacccctatggccatcaccactgggattgcaatgggtcagatctgaagccagcagagcactgggcctcatccaaggcccttccctttagtgcagtgagttccccaaggacctaggcatgtccagagatgctatttgggagccagagatttggagtcaaaaaccttagcagttcacctgatgttctattctactgtttcatccattgggatgggcgattcccctctggctatgggtagtccaaatgctccctccattcacagtcactggctaagcccaacatggctttattcttcatggtgacagggcagcgctgagttcaatgtaaagtccccaagtcactgcactcgccctctgggagatgggggagtggtggcataggcaaatcgagattaccttttctgccctcctcaatacctcttttggtgatattaagttaccaccaggtactgtgattgtccacctgatttttggttcttgtgacagtgcttctctgtgtgcagatagtagttaaaatttcatgtttcagcattggggaggaatggtgtaggcttctattctgtcatcttgctctgccatccttgattgtttctaattcagtctaacagccaatcaacaactatttaaatccattaaaccagtaataaatttagactttgcttgtctgaggctagcctcagcctctcagttgtcctcattgagcatgtaataaatagttccagtgaagaactctgggaggaaggagtacaactatttgtattgaagtcttcagtatgtatttctggggatttttcaagagttgatgtttgcaagaaaatcaactttgagtaatatagaataataatctctttcattttagtaaatctctacagagaacattgacacatactggtggatttgatttctacaacaactttgcgaggaaagtagatgttactatttctattttccaaatgaagaaacttaatgaactttgtcaacagagatgtaaataacgaagaccacaactcagtcttaggtccgagtgtgtgtgtgtgtgtgtgtgtgtgtgtgtgtgtggtttactgctctgttagaattatgattgttagtgttgatatgagggttttttcccccagtgagatggattaattaatggcattgctaatttatatctccttatagtttcacagtatactctcatgtccagaatgttctctcccttttctcctaggcttatctcctccatgaaaaactctgatattttctatggatatcttctctctcagaacttctagagcacttctagtttattctctaaaatacagcacttatttctcttatattttgtttatagtgaactgttagaatgaaatagaaactgctctcattgtacgagtggctttaaacatcgctatctcttgacctctccttttattcccatggacttttctaatggcctgcttagacttatccctcctccaagaaagtgtcagatttatatttcttttagttttcttgtctgccagttggagataataattactatttcaaaggactgtgaggattgaatgataattacttcagaagtgcctggcattgtttctggtacacaataaatggtagcttttgtgtataagacagatattaaagtgttaaagagaatgagaaaaaggaaagatagagttgtaagtatctcttagccttcttagtaattccccttggctttaggcatgcctcaagtttcaccatttcttccatgaacatctgtgctttgattacataaacattcttgtttcccagattagtctatccataataacatctgtgaaaagatgaggtatgtgtgcaagcataatatctataaagagaagttaaaatcacttctgcatacatattgtttgcaggtatccatgtcattaagtactaattaatgctgccttttgcatgtgtgctgaatggaagatacaaagaaatttggtgaattacccattaaccacattcaacagagagagaggtagagttttttccctacttataattatgaacttatagacactatctcccgattgccctttgaaaagtcctccaatatataattactaatataaatatagtcacgtggcctaaaaaaccctctataacacttttaaatgcttcctacatttccaattgtacctctttctataggagatactaaaaaactgcttcatccctggcaaaatctccagtgttgagtcctctcttttattgtaaatattaccattgaaaaagttttgcatcatctagtgatgatctaaacttatgtgcacattaaaatgaagggtggaaaaacctgttcatatacaaaagaagaaacccctgcaattttgaccaattttagaaccaaataaaactatgtattatttttgagaccgtttatcttttttaacttctttttttctagtgatgaggtaaaaacagaatacagttatcagaaataataactgcagattcaagaaagtttcagaggtgatcctatctgttttcctgcccaaactagtgaataaaattgcacaactaataatttaggaacactgcctatggaagccatagtgaagtcatagtaaaaacatgaattttcagcaattgacatttcatataacaaatcatattttgaccttttgtatgccagtcataaaaagatacttgtgggaatgacctggtattgttgatgtatctgaaatattttttgtacttttattgggctctatctttgttgctgctgggagagtgagaactctctttttcacttacatccaatagataaaaggggggggacattgattgtcttaaagattcttattattatgaataataatcttaagctctcaaagaaccagaattctcaattaaagatttttctatattcaactctacctgtcatgtgtagcttgcatgtaccagttgcccatcccacaaaagaatgaaaaatgagaatcctgacagatttggtgttggattttagactttaatgcctttagccctgcaatgggcattttactggcattttgaagatatttctttttaatctgcaaaataaagatttgaagtgacttgacaatgatagtaagatgattagtggtgcacattcactataaaaatacaatttgaccattgtagaaagtctttaaatggtattgatacttgcctttcaggagtaacactgagatattcaatgtaccctacctccactgggaagtgaaactggaaaataatttaagtgtgtgtttagaatctctccaccccactccccgtatctatttttggtgaacgtccatcaatcaaaggtcttataccttcacattgacacaacagcacacacagaatcttccacatctttgacacagggtaaactcttggtaaatattggctaatggtaaggataaaggtttctttggcctaattttagtcatattctcccatgtgcaaggctacatttgtccagagttctacatttaggattccaaaataagttaaactttgtatacttcatgtcaaatcagtcatctgagattcatttattttttctgaccattgacacagtatataatgcaaaccacttgttcagtcccatttaattatgaagtcaaatcacatggtatacccaaaattttcatcccagtgattttgtatttccaaaaaatcaaatctgatagactttttttgcaatgcaatgtattgcttaaccattgactggtaaacattcaatccagccaggagtaaagatacaggcttatgcaaattaataataagtgccttttcatcttacattctcccaattcccttcctctagggcaaggaaaatagtcatatcctggatattttctttcatgctgctgtttaccttcatggtgtgtatatatgatactcctccagtaattgctctgaagtgggcaaaattagcatggaaagaaacaaatgctaaatacagtataagttgtttaggattagatattgtaaaaatataaactatacatccaggagagatgtcatcaggatgcctgactagaggtgctcaacactcatcttcttcacaaaggaggaccagaacaatgaataaataagtgcgattcaagtagagtgtctatggaagaacactggaattcagcaaggaagggacaaaattttctgaagcacagaaacttgggatgtcagcatacgaagcaaagcacccaactgggatcagctcagaaccaagagagactccccattaggataaaaaagtaagcaggagatctccagcagccccccgttactaatgcagatgcctgaaaccctatctacaagagaaccccacagtccttgcaggccctgatcccagtaaagggagttgtctagagttaatgcagctgtattgctccagagacagaactaatgctgtgtttcccactccttgggacataacttgcaacaatatggtgtcattttgagaacaaagtcatgctggagtacatcctgccttgaggccgaagagcccctgtatctccatatcccttggtcccacctgtcattccaccatgccaacacaaaaggctataatgtcacaaccccagatagacccaagagtacagttatgacaccaacacttgagcctacacagtaccctacacctcaaaaaacaggcagtccagcacagagtataggcttctccccaaaccaaaggagccaacatgtttgttctccagggcatgagaaccacctactcaatgccctctaccgctggtgaccttgtacccttaaccaacagagctggttatcttatctaacttatatagcttatataaacagatctaaccagagctgctgtacactgtgcatgcaaccagaggccaggggctgacccacccagtacaagctgcccctggcaatgctgtctgtctctgtaactagtagagctgccacaactggtgccctacccccaagtacttcagaactggcctacacagcaacccctatccccagcaacccctatccccagcaaagccatgctacagtcttaaaaactgcccacagcccagactactgaagcactagcggataccactgacattaattacagatgaataaatcacaacaaagactccactagtgggactcacccagaattaaagccaaagcaccctgccctactcatactttaagatacatatataggaaaaagtacaataattatcctgtaacagacctcaaagcaaagtaaatatataaactgcctgaaaaggaatttaaaataataatcctaaggaaatatcagtgagacacaagagaatacaggtatattgatacaattcaactaatttaggaaaataatttatggtctgaatgagattgcatagtttgcaaaaattgtctcccattctgtaggttgtctgttcactctgttggtaatttccttctttgtgcagaagctctctaatttaattaaacctgtttgttgatttttgctttcattgcagttgcttttggcattctcatcatgaaatctttgcctattcctgtgtctaagatggtattgcctaggttgtcttccagggtttttatagttttaggttttacatttaagtcttcaatccaccttgtgtctatatttgtatatggtgaaaggtaggggtccagtttcagtcttctgcatatggatagcccattatcccagcatcatttgttgaacagggaatcttttccccattgcttgtttttgtcaggtttgtcaaagatccgatagttgtaggtgtgtggccttatttctgcgttctctgttctgttccattggtctatgtgtctgttcttgtacccgtaccatcctgttttggttgctgtagctctgtagtatagtttgaagtcagttaacatgatgcctccagctttgttctttttgcttaggattgccttgactattcagtctcttttttgcttccatatgaattttaaaatactttcatctagttctgtgaagaatgtcattggtaatttaatagaaatagcactgaatctgtaaattgctttgggcagtgtgatcattttaatgatattgattcttcctatctatgagcatggaatgtttcccatttgtttgtgtcatctctgatttctttgagcagtgttttgtagctatcattatagaaatattttacttctctggttagctgtattcctaggtattgtattctttttgtggcaattgtgaatgggattgcattcctgatttggttctcagcctgtttgttgttggtgtatagaaatgttagtgatttttgtacattgattttgtatcctgagaatttgatgaagtggtttttcaggtcaagaagcctttgggctaaggctatgagattttctacatataagaccatgtcatctgcaaacacggatagtttgacttcctgtcttcctgtttggtgctctttatttctttctcttaccagattgccctggctaggctttccaacatcatgttgaatagtagtggtgacagagggcatccttgtctagtgccggttttcaaggggaatgcctccagcttttgcccattcagtatgatgttggctgtgggtttgtcatagatggctcttattattttgaggtatgttcccttaatacctagtttattgatagtttttaacatgaagaggtgtcgaatttcatcaaaagccttttctgcatctattgaggtaatcatgtggtttttctctttagtcctgtttatgctgctcttttctttctactttcttgaagtaagaccttggattattgatttcagattttctcttgattctaatataagcatttagtgctataattttccatcctagtatttctttagctacatcccatctattgatatgttgtatgtttatttatattctgttctttgtatttttaattctttttctttctagtttgattctactatgactagataacagaatatgtaagatttcaattatttttaattttagacatttgtactatggtgaaagatatggtctgtctcattttaaagtatcctttacatactttaaaattgtgtattctaaggttggtggagtattctgtagatttcacttaaaaagattgattgataatattttcagttttcctgtataattgctggttatttatctaaagttatacacacacacacacacacacacacacacacacacacacacacacacagagctgctgaaagaggctagagcagtttcaatctacttaaaagaactggaaccacagcctgcctagacccaccctgttgcacatggaagaaatgtcatgaatatcacatttatatttaaggtaatcattaattgtattatttgttgctatttatatggtggtaaatatacataacataatattcatcattttaactatttataaatgcacaattcagtggcactaagtgtattcacaatgttgtgtatccatcactgctatctataccacaaatttttaaccatctccaacatgaactctgcacccattagataataacttgtaattttccattccccctcagcctcttgtatcctctagtctactttttgtctgtgtacatttgcctattctgggtacctcatataagtgtaatcatacaatatttgtctttatgtgtctggcttacttcacttagcatgatattttcaagctccatcatgttatagcatatataaaaatttaattgctttttatagctgaaaaatattctattgtgtatatgcatgtatatatatgtatgttttatatatatatgtatgttttatatatatgttatatatatgtatatatataaaacattttggctttacattcatctgttaatggattcttgaattgttccatcttttggctattgtaaataatgctgctatagacattggtgcagaaatatctccttgagtttctttccagttcttttggacatatgcttaggagtggaattactgggtcatatggtaattctatgtttaactttttgagaaaccaccaaatggttttccacagtggctgcacagtttacattcccaccaacaatgcacaaaattttcagtttcttcacatccttgccaatatttaatttctgggctttttctttaaattataaccaatctaatgggtatgaagtagtatctcattgtgggtttgatttgcatttccctaatgactaatgatgttgaacatcttttcatgtgcttattggccatttttatatcttctttggataaatgtctatcgaatttctttgcccatctcttgaattgggttgtattttaatgtttttgttcatctgtaggagtatttttaaatatatctggatattaccattaccaggtttgcaaatattttctcccattctctaattgtctttttgatttcttgatagtgtttattgatgcacggaagttcttaatttgtagtttttcttttattgcctattctttcagtgctatatcagagaaattgtagcaaatccaataccactacaatggcatattattcagtaataaaagaagaatgaagcaaattcatagataaaccttaaaatattatgctaatgtattatgttcacagagttatgcaaccatcaccagaatcaattttggaatactttcattacctcaaaaagaaatccatacccattagtaaatcttctaaggtctcttctgggccaagtatacagttttgctcatgtgtttgaccttctaaatgtttaaagcttttcaaagccctctatggccatctcattacccagtttttcctttttacgtttttcagtcagcctcttatcaattcccattgatggtgtcacccgaggcatctgtgaagtcaaacaattgacactgatcgtttttgactaattctctgtgaataaaactgttcacctggtcatagaaatcatgccctgagaatgtagcttttcaataagctttcagacaggtcgaatagagacaattttctgtgtatgaggcttctggattgctctaaatccattctgcttcctccaatggctgctaggctataggattttataccacagtagtgaggctattggctgttaaggataccagggagctggggattagggccaattaaaacaccacgaagctcattgttcttactgaaattcagccacttttcttgaataaacattccttgtatcgttgcaagcctttagtttgtttccagagttctgaaaaagttgactttggcagatttttgccaatgttctcgttgcttttatggaagagttgatttttgaagtccttactccaacattccagaagtgccctcttggatgaatgatcttaaacactttagttcaacatagaataaatgtgtgtttgtgtgcatgtgtgtgtgtgtgtctctgtgtgcatgtgcgtccatctgcctgtttatctgtctgcctatctgtgtctgtgtattaatatttctctcatatgtacacattttttattgtgttcatctactttgactgtaaaccttctgtctgtgtgttggttcttgaatatttatttcaaagaaatgttatttttacaacattgttcttgttctcctttaaaggtcagctacctttttccttatattttcatccatacatctgtgtttggcttttattaagtagcagcagtgcaatattcctggttttatctttctggcttaagcatgtgagcaagacacaaaggataataatacaacatactttaagagacaaaacaggttgctataataatagaagatctatttaaatatatttagcatctctttatgtagaaactaaaacaaatccaatattaatagcattaagcatttggggcatgtgtgtgagaatatgttttctgttcaaaaataaatttttattatccaagtcctttaaatttattttttccaatttgctttgctaccctagctgggatcattatccaaaccaagcatcaaaattcacaattatatgaaaaataaatatatactaactacatttccacggggaaaaaattagttggcaaaattggtactagcctaaatatgactataccaacttaccaatataatccggtacttcaattattttggctatgctaaatcaggatgccacaattcctcctggaatattaaataatcctttgccagcagattgtccaacagccagtcatacttgctcagcacctatcttgacaaaattgtgaagcaggcaaagttatgtcttcagcacctgcccatcccctaatttagttccttttgtttcttctttcataataaatggacaagcaggcgactcacctctttacaaggctctccatgtgaccacaaaaatgttttaagaatagactaccttatttaatgaaggagacaaaaactgtaagaggaagtacatccccaatttgaaaaatcttatcgtatgtcttattgtaaaacagtgcctcctgatgctttcatgtctccttccttctttccttctcactcttcttctctctctacatctctctctcctttattcttccttctccccattcttttctttctttctctaccctgttcttcccccctctcatccttctttccttccaggcacatgtgaaccacttctttttacattgggtctctcaaatatggagtattaatcacataagcacgtaaataatggcatgctgttcatctgggaatttttccaagtaatggtggttagcaagctgtgtaatgagcttcttgtaaccctttctcttccctcactctgaaattaaaggtcagggatctctcactagaatattacaatgctaaacataccaaaagtatctgaaaatgtttagttaccaataggcaagaaaagttttctagtcctttcattttcatttaaaaaatatctcttgggaaacctatttcagatcacgaagttttacacaaatgtatagctaaaacagtcacctatcgatccaaatacctattaacagataaacaacagacaatgattcactcattcacccaggataaagccatgtctgtgtacacacaaggacaatgtagttaaaatgggtgactttagtttgttgctagagatatgattgaaggaacacagacacttgagtcagacagacatgagcttaagtctattctctcttatgtatttgctagttttttatgtagaaaatgtgaatttcctatgttacgttgaggtgattgaggagaagaagattaaatgaaatgataaatgcaaagtatcaaacactgcctggcacatagtaagcactcagtgattactgctgactgctgctgacattcaaggagtttccagtgtctcaagtcctgtagatgcccaaatgagtcactccacactttgcagattctttctgtagtatcagttgcccttagtgccttctaggaagagaagaacattagtccccttcagctcaactgtgtatatagataggataagggacttgggcaagaggaagctagtgctagtgactttctcccatgaacacttttcctttaagtctttttatcatcaccaaaatctatttggtttagagtttctgtcttactaaatgttaccctagtggcttgaaagggttagtgccatttccaaattgagtatattctgccctaaaaaaaatctgaacacaaatccctacacatatgcatacattaatttcagcctgcttttcttccccgcccaaaggctcaggctgtctgaagagtaagcttctagcttctcttaggcaatctgtattttaaaaaatcactgatccttccatcagaattacttcctttcatttcagagaacaatcctatcctgtcaaaaatacactgcaatagaaataaagaggaataatagcagagtataatttaatagaaagaaaggagggtgaggtaaactataggcaagaggtatgcaaatgcttaatgtgacacacagaagaaagaagccatacgtaggtatatgtgtgttgtgtgtgtagagtagtgtgtgtaaatgtgtataggagcatgtttgtatgtgtgtgggggcatataatttgtaaattggtatagtgcataggaatgaagcactatgtatcttgttaaagatactgcttttttggttcttgaataaggaggatgctggaaaacatccaccattatctgtactcttggtttgcacaatccttcctccctgctatcccctgccaccatgcaaaactttcatactgcgtcattaattcttccagcctggggatagtccccaaattctctcattactgggctgcttagtgccatcaaaatttggattattaaggagctgcatgaggccttgtttccttataatgaaagcacaatgaccatctagatagagattaatatctcacttggggttatgtaatattttctttattccattctagttgcagtccctcttcctaatttttcaaaatgccactgaagcccatttcatgaaattgcaaagtaatctgatggtgatgaatcacttttagaaggaaaaaaatttgccgaagctatggatttgcattccccatgtcattttagttaaaatgaggaatgcttggaatttatatataaacagcattgtgttttggccttatttattacaaaagacacttgagagagctgcttgtttcaattatactttgccattgtgtgaagagagaaaaaaagtgtcttcttttacttacatatttgctatcagtttaggacttttaaggaatagtttgttaaaatggctattgaaaaatttggggtcctaatgtttgttctcagagacaaatctatgaatttattttctacctgataattcatcaaatctgggcctctgtgaaaggcaacccagttgtttttaacatcaatgctctccctcactatcttcccatctttcttttctaatataattcttctgccccaaatcaaaattagaggttaaattcttcttccccagcacacatggtcttttgcccaactcacttcacactactcatctttggttcaaatcccaacaacagtcttctaatctccatctgcagtccttacccccattttctcttccctctaataggtgctagaaagacaagttcagttttctgtctgatatcatgaaacccctaccatgaaatcactgaataatctacttacctgaatgattaattctgtgaagtttgattctttaatataacaacagataagaatcttattaatttgatattttcgggatcacagaaagtttcactagtttttttctttagaaacattgtttgccttctatggaatgggtgagtccatggatttttcaccattgctgaatcaagccatgaagttttccctttattaataagtatttattgagcccttagtatgccatttatccaatgaataataaggagtgggagagtggattgagacaaaggatgcaaacagtgtggaccctgctcataaagacaaggataagctcttgccttcgtttgaaggaattgtattattgatttgataatcttcccaggacctagagaggtgctaatagttagagttcagggttctaattctggtttgctagtaatcaagtatttgatttaggcaaagtctctttataactctttaggttcctgtttatgtgaaaacaggggattgggctagatacacttctctctctctgtctgtctctctgtctctctctctctcccacacacacacacacacacacacacacacacatgcacgcatacacttgtgcccacgtggaagacatataaagcaagtagtcagcagtgagaataatgagtcaaagaaagctccttctaggaggtaagatttaaattttatttcatcacttatgtgtacagagtaatggttctgctgagtaatgttatcttaccttaagtttcagtttaaactaaacatatgatgaaattactttcaacacgatcttagtatctgtcctcccactttggttttgcatacagaaagtaattttggatgtttgatattctagtacttggcatatcctactcattatagattaagtatttctggcttctgccagatgccatttataaccttttgccaaaacttgtttacatactcaaaatttgactatccactccttgaaggcagagacttcaaaatcttctatttatttatagtgcctagcacaatgccaggcacataatattctctcataatcttctgacaaagatgtctttgggaaattatattgagagatgacaccaatgtttgggcattcctatttgaattttgtaaacattataaattggaccaacagaatatgatatggcaataaaatcacatcagcttcaatttatcaagttcttactatgtgccaggcattttacatatgttatctcatttaattcttataacaacactataagataaatgctattattctcacttacttagggggaaactgaggcacagagtggttaaatagtttccataaggtcatatagctaataagcacaataagtcttcacttaatgtcatcaataggttcttggaaactgtgactttaagtgaaacaacatagaatgaaaccaattttaccataggctaatcctaaacaagaatttcaacagcatatttctggtcacaaaaacatcatcaaacttctaaatgaatacaaaaacacttctaatattaaacgttgaaataaatgcgagctatacatacatttaagaaacattagtaaaaacaagtaaaataattattaaccccaaaatccaaaattcctttctgtatataaaaccaaagtgggaggacagatactaagatcgtgttgaaaatgatttaatcacaaatgttagtttaaactgaaacttaaggtaaggtaaaatttctcaacatgacacttattccagagtcatgggtaactggagcctatcctggcagctcagggcacaaagcagggaccagccctggacaagacatgattgcatcatatggcacactcacacactcatacactaactcagactaagacaatttagacaccccagttaacctaatgtgcacatctttgggatatgggggaaaatcagagtacccagagaaaacccacacagacatggggagaatgtgtaaactccacatagacagtggtcctgaccggaaattgattatttttcctcatcaacatcataaaacaattttgaacaaaacaacattatttgaagaccttctgtaatgaagcttggaattgaaaacctgtctagctagaaaccctttaaccactattgtattgactacttggcattaaagcaaaatcattttctgtgaactaatccatagtctaattccacagtcttcagttcccctctcatctagaaagaagacaacatagcatttgcttccttttccatcttcgaccttgaaagatatctatgtttttcctctttgaaattgactctaagaaaagtcttctttcctgagaaagtgaagtgaacttagtatcaagaatctctttgaatggagaagacgcattctcattttgtactatcaagtcatagaaatgtgtaattttagattttgagagccagatcctttaataatagattattagaaactattgttgatttattttcctctgttattatttaaagacagacttgcttttaccttaaaggcattgaaataaatgtactaggatgttaatattcttctcaaatttcaactttgtatagaaacagaccctggatttgttggcagctaatcaattcattctggttaggactgcttcacttacccctgaattttaacctgaatctgaatactcaggaagcaaatttaaggactaagaaaataataattttcccacttggtagattggtagcccaccaaagaaggggctgttaacattttagagtgggaaaattaacctgacttttctgtgcaaggggctttctctctttgttcaaggacaataggcctttatgcaaatacttctctgtctcactccagtttaaaagttcttctggctgcttgttagctgtcagtaagtattgttctctagttttcctatcttttaagggcataagatcccttgagcaggcttggcgggcatacattatccctgacattattgttgcacgtatatcttctaaaccatcccaattggcatattccaagaattctcaagggatagaggtgacaccagtgaaagcaagaactgatggtccaagttgcccagtcaagtggtgattttgtttcttgaatgagaaatcagaactctgtaagtccccttccatggtatggtttataggaagctaacatttgtggaattagaccccttggtgatacgacctttcagaatacctaatctcaaataatttcaaccttttttttttttggctgcttttcattgttaagacatattcagtcaaaatatttttggaaaacatatgtttttagcataaatgaatattatattgactcaaattggttggaaatcacaagttaaaactgctctgtcttctgtagctaataattcttggcactgggattatgtttcaggatggcagaacagtctgcatgagtgctctgattggttatagaatattaattggctgctgaggtagtgtttagagctccaatttaaggttgacaagaatgatagctttcatttgtatgcaaaaacttcaactgtcccttcaagaaagatgatcacatcctacttcatctgtcactctttctttactttttaatagaggaaaaagaaaggagaatgaaagaacctttatcaaacatgattttcaagattgccttgatgcaaatgaagtgtctcaatgatcttgttgcttcactaaagcatacttatttactctttgttggtaccttagtccattttctgttgctataaccgaatatctgagactgggtaattaaaaaagaaaagacatttatttcttacatttctggaggctggtaagcccaaggtctagaggccacatctggcgcgggcctttttgttgatgaggaaacaaggtggtgcagggcatcccatgactagggagctcacaaaagacagccaaacccattttttttaacagacccactatcacgataactaattcactgtcttaagccattaatccataaatggattaatttattcatgatagcagagccctcataacccaatcttctcccaaaggtctcacctctcaacactactgtattggggactgagttcctaacacatgaacttttgtgggacacattcaataccatagcaatcagattaagaagtacatgaactggaataaggtgaagctttcattcactgaaaaatatcaactacagggtattgtctctgagattttcaaactttaacagtgatttgtttggcattctgtgagacatttcttattagccaaagataaataacaatctgatttgaggtactagcaaaatgaagtactgacttccatcatctccatcatgccactcaattgcttatacaaagttgctcagggaagacctggttctatgtgaaagcagagaccaactgtcagcttaaggaaatatatataatggaccctgaaagaataccatattccaacataattcactgtgattttggattagattctactacatataacagaaaaccctgcttatagttgttcaaacatacacgtattgattctctcaagcaaaaagaaacagaaattaggcagtccagggttggtatagtgacttcaagaagtcatcagggatctacacttttactttcttactgctcctctattgtttgcatctgatttccatcccaaatttacgagatggcctatggagctctagacataaagtctgtactctatggaacggattaaagacatgtggtaagtgtcaccttggaaacaggaaccaggaggaaatagaacatagggcagggggcattgtaatagggaaaataacatggaaagaaaaatatagagcaagtcctcaaactcgccttatcatcagaactagctgtgggagggcttattaaaaacacagatttctactctccattccagatccactggattatattgtctagtagcggtacctagaaatgagaatttcaactagccttctaggtaattctggtaataaggcaatgtattatctagagtgatgatagcagctgtagtaagcaaaccgaaagatgtagaatggttgagatatgacagaaatttattttttctcatacaaaacgctagcacgtgttcctaatttaaggatctgggttccttcattcttaaagtttcatcatctttagcatatatcttccaaggtcaccattatcacctgtatcaagctggtggaagagaaaatggtatgaaacatcttgtgtggaagatttttatgggtcaagcctgaaaggggtgcatatcatttccacttacattgcactgactaaaactcagacttatgatcacacctaactgcaagggaggctggcaaatgtgtagtataggtatgtgctcagaaagaaaggagacaagttttactgaaaagccagcagtttctgtatagtaaagtttgggaacagggctggcctcagggcatgtgacctatgcagctacacaggttcctgaacttagaagggcctcaagtttggttgaatgccctgatgttactctcttaaatttcttaataatttttgaacaaggggccatgtttttcattttgcactggaccctacaaactggaccctatttaactggtacagcttaggaaagaatgacccagagtgtgaggcagagccagaggaatatggcacagttcaggactttgggcagccagcaggtactgtacttcagaagtgttcattaatgaaccaatgttcttggccaccagagagccttctctcagagtgctatcctgttctgcattttttatctgtgacttagatgacatataaatgatatttatcacattttcagatgagaggaagttgggagggacagttaatactttggagcacatatttcttttcaaaaatatctcagtagtttggaatgatgggttgaaactaaccagattacatttaataggaaaaaaatgtaaagcttttcattcaggtccaaaactccaactgcaaaagcacagtcttagaattttatttggctgagagcacaagcagtgggactagattgccaaaaattctaatttagtcttagtctgcatcacagaaaggtagggtccagaacaatagaagtattggtttaattgcactttagatgacatcagaaattatgtgttcagtttattgtaccatatctaagaaacccattgatagattagattgtgtccaaaaaagattgtctaggatggaaaagggttttggaaaacatgtcacctgaaagacagtgggcaattgaggaaactaagtgtttagcctgaaaggggaagagcttttagaagggaagggggtgaaagagatcaagaaatctgtctgcaaatgttttaagcattggtatatagaaggtgtattgggtttattctgtgttgttccagagaccagaaataggaccaagaggtataacatacaaagaaacaaactacagctgaacataaagaagaaattttaataaagttattccaaaattgaaatgattgatgtcaagaggcagtgagcctattgcagaaaagttatcaagcaaagactgaatactgggaactgtggagggaactcatgtattaggtaggaagactagagtctttgtaattatgactgtctaagactaagtactattgaaatgatgcaaattgatcaggatcttgttagtcttatattttaaaaggactatgaagccagactgcctaaattcaaacttcagctttgtttcttattacctatgtaatcttgggtaggtcacctaatttcttaatgcctcagttttttcctataaaatggagataataatagtatataccccatacataaagttattgaaagcattaaatgaattaatactggtgaagtccttatagtaagcattttgtaaatgttatatattattattttccagaaatatagttggtgataattcttctatctcttcttcaatgaatgtagcctttagtacaattagattaatttacactagacataaaatagaatgctatggtgacaaaatcctttaaaacaccaaaacaaacaaacaaaaaactgaagtggtcctgtagatattcttcacaggcaccctgagaatggcataagatagctatatctctgggatgcaatgttggaagttgtgactttaggaggacatttccagctttccagcttatatatttagagattttataaaaacctcatagggctttttatatttcttaggtcacttgatcctcatattaactataaaactacacagggcagttaccatatccattttgaagttgaggaacctaagcaatagaaaagttagaaaaggtaacagaattgttcaaggttacactataaatttttagtggagccaggatcagaacccatgtatcttaagttctagctcagagctcagagataaaccaaatgggtagtaagttgcttttagactatctagtctgtggaagaaatttcataaggctgatgaagtggcttctattattttgccagtaacttgcctgtttgctttgcagcaaaattgacatcagcctgaaaacccagccacccagcttaatttcctttttggctttgcataggttagggggagtcaataaaatcagtgacttatgctgagtgtattatccacacagacactatggaaatatacttgccagctcaatccattttttatgcattattatagatgattttgaagcttgtggagaatatgtggtcctcttaccaaggcagaagctggctatgtgagttttagatctgtatctatttgtacaagtactgtgatagcacgtggtattgcagaatcgaatttttgaagtgagtgagtcttgctttggtgatcctgatgctctgtatctctatctaccctactctcacttcttcccttcggtacctggcccttgtcctttcaaccttcctctcattggtgtacctattaggttggtgcgaaagttattgtgaaattacttttgcaccaacctaaatatttacagccattcatttactgtggggtaattaattgggttccatccctaggagaatatacagctcgatgttctctttaattggcaaatcaatgtttgctaccatttattgagaactaaactatgtaccaggcctctgcctagcactttagaagcatgatcttatttgatcctcataataatcctaaaaaatgggtactattattatccacagttatgcatcaaggaaatggagtcccagaggagcttaggaatcatgaccaaggtcacaaagtaagtgctagagccagaactaagactcaggtgttaacacagaacctatgctttcaactacaacatcttagagttctgtgatctagatagtgggtggcagatgtttttgaaagttgagaaaggcttttcctataaaataataaacataagcaaccatttgctctgaattagactgagatcagcctgatgctaatgaacatcacagacatttccaaggtctagatacacataagacaggtggggatgaggagcttctgctgtcccaggaactgaattcttttctcacgtactatgcagtgccttttttttttttctcccaagctctctgagattaaatggatatatgctagtgagcactggctgtcaggctgatgctaaagcactaatgggtcattagcccatagacaaagatcctaaagggttgggttttggtcagacaagtaactagccttcatgttaaaagcatagcagtagacactgagtcacctaacacagcaagatctatttgcagggttttccctgatttgtaacctcaggtaataacccccacaagagtttcctgaaaagccttttgttctctcacaaatgacctgaccactttttgactaaagatactctcagagaaagtgcatatttgctgtagaaacatccagtggcactagatcaatttgtcataagctcagagcagttttcacacctgggtttccatctgtacttgaatgttctgcagaggaagtgtcagtccagactagggaataatgggatgaggttggggaagtgaggggtgggatggaggggtggtggtggtacagacccttaggtgaattagactatacttggaagctgcttcatttaaaccagtacagaaaacactatggtggaatttgattcccctgtcaaagaattagcttgccttatggtatttcaaagacgtattatttagagggtcaggatatcctttgaacatcgaacccaatttcttgacaaagttatatcaggagatgaatgataatcacagctgactaaatgcttattctatcagagaaaatggggccatcaaagctccacagttaactggcaagtttactcaaaaagttgattcaaaaaggcaagtcaccctttttcatgagatttggatcctactttgaaaaattcccaagatttcctatctcagtttctggagacaacaattcttgctttcctagtctccgagttggacttaatgagataatcatgggaaagagaaagtgctttgtaaattcagttaatttttttcctttctcaattcttctgtatccagtaatcacatcttgaaatcacctagcttatattttttccttggaactatgagcagtcataattggctccatttgaaaatcaatttcaacatcatagatcatcagcttatatttgattaattaaattagttctcatcggtgttacgaagacagggaacaagcttggaaacctcccagagagctgccatcatgtgggaaattaatcaagatttctaagagccaggtcctgacttcagtgatggaaatggaaagtaaaactactttattttcagagactgctctagtatgatttagttcatttgaaatattattacatattcatccttgaatgattctgggggaagatctcagctttaaagccaaacagacatagatttgaatgatagctctgccatctttgctagcaaggtaaccttggtcaagtgacctaacccctttggcctttaatttcctcaaccacaacaacaaaaaatggaaatagtggtactcatctcataggaatgttgtgaggattaaatgagactgggagactacagaataggagtcaggaaattaggatttacattttggttctggctcttagtagccagaggttagtccttaggagagtaaattaacctgtctgaacctcagtttcctcatctgcaaagtggaaataacaccctgcactttatagatttttgatgaccatgcatttggcttgttgtcatgtaaacaaataggttactcacaatcatggaaagttctctggtaatgtaaagctgacatggaggaggataaagtgataatgccttgtgatttacactttattttctacctcagatcccaaactaagtaagtctttatgttagaatggttctcttctttctgagctctaaatatcacatcacaaataatgtttaccaaacaaatattctgtgaattagaaaattatccctgtcatgaaacttttgattttttgaaaaatgcttatttaatatccggttgtcatcctcattacggactgttagcacatccaaacaactgaacttaagtgatattttgcttttccttattcttttgtattgcaaaacatcatgttaacaagttatgaatgcctaattagtttgaaaaccataagtaaataaaccattagactgaaaacagaagtatcaatacctgcccaatctagtcaaataattgcctttatgaactttggtttgaaatgcaaagattatgttcaaaaactgatttggctgaaatgagaccagtaaaaaagttattttcataaaaatacaatacagacaatatgttattccatatgacagccgcaatgtcatattctgcttctttaaattttatctatattttatttgattacttcttgtggcatggtagtaggcagaataatgccctccaccccaaagatgtccataatctaatctgttaggaatatggtaggttctatagcaaagtcaaattaaggttgtaagtagaattatggttgctaatcccctgacctcaaaatagggaaatcatcatggattatccaggtaagctcaatgaaatcacaggtttccttaaaaatagaagaggtaggtagaaaagaaagaataatataatgtcacaaggattcaacctgcccttgctggctttgaagatgaaaaatggccaagcaccaatgaatgcagacagactctagaaggtagaaaaggaaaaggaattgattttctcccagggcctccagaaaggtatgcagccctgctgacaccttaattttaatccagtgagacccacattagacttctcacttcccaaacaataagataatagtaaatatgttgttttaaactactaagtgtgtgatagcttaccagcagcaataaaagttaaaacagtcaattaccactttttgtcagttactacagccattttatacctccgtttcttctactagattaagccttttgatctgactctgtgtattcttcaaatttatactttactgcccccaacgaagatatacacactagttggtagagtacctttctgtaatagaactacaaacatttgttaactgattataagaatgaattacaccaagtaatccaaaatcgaattttcatcccattctttgacctgtggaattttgtggatacagctaaaggaggtattcagtcaattaatccccaaagctcatcagtttagtgaagtgtttaggtttctttctttctttcctttttatttatttatttattttttttggtgatgcttatatggagatattttggatgtattttgaacacacacacaaaaaaacagtcttaaaaaaaaacacggaagaaatatgacagtatagagtagtggctatgaccttggactcaagggtgagatagactttggttgaatcttggacccaaaatgtatttaccagcaatgtgactttggacaaataatttaaactcattgagcctcagttttcttatctgtcaaatgttgataatagtaggacctactttatacattgtcatgaggatttaatgagagaataaatgtaaaagggcttggcatgaaatccctgcttaatcaatgttagccatggtgcagtagcaagaatattgaacttttaattcaagaaacttgggtttgggtcttctgttttattattaatttgcagtatgatattgagtacattcctccttttctgcctttcagtttcttcatctgtcaaaatagccagatgaattagatctctaagggtttgtctagctctaaaattatccatccttgggtatcatattatatttttagacatcactatctaggccaaatttctagatcctgacagatcagtcatcacagagccaaatgatgatctttaagcaaggtaaaaattcacccatctcccatgtttaacctttcatacttattttaatactaactatatcccaagttctgtgtgaaacctggaagtatactatcttgtgaaatttctttgataataactatatgtggaatttgtttgacatcaacaatataagggtccagggagtactattttagagagagaaagaaaaatcttacttgaggggaaaaaggcaacagtgaagaaaaagcaggaactgtgaagaaaaaaaaaaaaacaaaactaccatcataaccactgtttaagtttccatttcccccaaggttgttttcttttcaaatttgaagaagttgctttatgtctgggcagatttgtgctgaataaacattgttctctccagagaagggccttgtgtcaaatggcattgagaagaaattgccctgccttatacttaagctttcccaaagctcatgcactgctcaaaactcaaatattagtggaaataaatgtgggatctagagaaaagggcaactcagggcaacttcacagcagccctgaccattcactaccctcagggcacatccactgaattgcaaggcaggacacaggctctgagccagttgctagggaggccctaagctttgcaggggcaatggtcaggtaagttgcccagcactttcccagcagtttaacctctatttggtaaaggatcacttatttattaaagacaataactgactttaagttctatgctaataaaaggcaaatacttcaatggctttaaataatggaagggatatttttagtgaaactggaatgtgttttaaaagcaatgtaatcctctgaatataaactttcatgtgtttgactctcagcagttctcaataattttatcttccaaatatacatgtgaggaacatgaaccattgtcatcagtaacagtgacttaatgaagcgaattatttttaaagggttgtagtaggtagggagatgagggagatacatgtaaaagtatctgaagttggagccatcagtgatttgaaaacaaattttcaaataattctggggatcactggttctgttttttgtggtgagcctatcacaaatgttctattatagctgggacacctagagaatatatcttctctctagattgagttaataaacagtccatgctgatctgtttcctcctgttacaaataagacagacaatattataattttggtagagaaaatgattataaaatattaattgctacagtggttagttgatggaagtaataacaagctgaaataaaaacaaagcttgattattaatgaacattgattttttaatttaacatatgcctgggctcttttcctaagatgttattatgaactagaagattcactcatagtaatgctggttagaatcttgaggaaaacagctttacttgtcttcatcggcttctgcagaaggccaccctgtttgttggctaacatcaatgtgaagatagtaagtcaagaaaggggccctggtgcccaatgtgtgcctacaatggactaaagtctttcattccacatttagagacaatccttcaaaagcagctagccttatgagagaaggtacaagtgtcttaagttcacattaaggtttaaatggcagatgcttttttgcagcaggttttgatcagagtcacaactttgtgtgcctaaaagcaggatggagaagaaatttctctaaaatagagatcacaaaattaggaatattagggcaaaggagatatattgtaaccaaggctggtcctgcttgaatttacaggtttggaacattaaggatgatattgaataatcatgatttttctatactttttcctggataatcatctaaattacgggactctcagcctggtaattctagaaataaaatatttttatcgtatggagctttagattaagtggccagtaaattgtgtacatcataatacaggattaggaagactatgtagttaattgagaaagagagattccttgcctcaagcaattatcagctaatcacaataaaaaaatgacaagtattccaaagaataatagctcttatgatgtgttcagagctcagcaatttctgcattcattctgtgttcaatttatgaaatcttcaaactagtcaactacctaggctaagcttggcaaatctccattcatgattacaggaaatttttaaggtattaacaggatctctggctctccgtaaatctgatttgctaagtaaggacctccattttgtcttctcacatgaaagctattcccaagtctttcttcccaaaatcctcaattccctcagaacaataggcagtctgtaatacttgtacatctgcgcactttcggacaaagagccataaggctgctattgctctcttttggaattagctcatgagcttaggtgatttggaagaggaaagagcccatggaatggttgctacccattgacaaaatccagtgactatttcagaacttgagaagtatttggcataaaatattattgttttaattaataaaattgtgttttattaatggatgtgtgtgatcaatgtcacttctttgcacaacttcagggcatcccattaatattatatgctcccaggaatgccattcacatggaaactgatgtaagtgtgcccctggagttgggcaatgagatggtattgcctgttacctttggccatctagtatttatttctttttctaacacaacctaagttttctttaggacagtggttattaagcaggtacaatgttattgccctcattacattttgccaatatcttgagacatttctagtttcacaactgggggaaggtcctactggcatctttgggtagaggccagggaagctgctaaacatccaacaatgcatgggacagtcacctacaacaaagaatttgctgttagtgaatgttatctcgctgaggttgaaaaaaactgcttttaggagattcttctcttcttcatgatttgcatataatctttcctaggcctggagctcaaaacttgttcattcagcctgtcattctgggattttgaatcttgatcaaagtgaaacaaggacaaaacatttaaccaagatacaacacaataaaagaaaacatattaaaaaaaaacaacaaaaccagttcaattcaatgagggggtcaagatgaaattattgtatagtctcttttgcttgcatacctagacctcgcctggtttcttttctgttattaaacctagttccccaaacttcctggccatccttgagatatacttctgataaattcccttttggctttaattagcaaaagtttgattctgttccttgcaatctaagaatgctatgggaagcacagttttttagagaaagaataccaccgggaagttaatttggagattgtgtttatttgttccccaatgtcacatactatcttctttgctgaattatatgagacatgatctttatcctccaggagcttaaaaatatagttaggaagacaagacatacccatgtaatgtgaggtttaatttgtattcaaagtagtacatgtcatgaaccaaatgggtggttcaaaggagtagtcaatgctttaggatttaagagaggagaaagattagcttggactgttattaaggaaggctttctggaggattcaagacttaaacaagtttttggaggatagctaggacttgggatgaaaaaaagaaagggggaggtcttagagtattgtgggcctggtgaaatcagacagaactcaattcaggtcccttctttagattcaagaagaagctgcttgactttgggcaagttatttgtaaaatgtaatataaaaagtcttgaaacagcctagaacagtagatattaagtaaatcataactatggtagctgtttttgtttgttaccaaacttagaggaagagtttaagccaagatgcatagttggaaattaatgcgatgtgaatgaggaaagtaagttgtctatagcatcaataaaatagaagataggtgggtaaaaaggcaggaaaggctgggcaccgtggctcacacctgtaatcccagcactttggaaggccgaggcgggtggattacctgaggtcgggagttcgagaccagcctgaccaacatggagaaaccctgtctctactaaaaatacaaaattagccgggcgtggtggtgcatgcctgtaatcccagctactccagaggctgaggcaggagaatcgcttcaacccaggaggcggagattaaggtgagctgagattctgccattgcactccagcctgggcaacaagagtgaaactacatctcaaaaaataaataaaataataaaataaaataaaataaaataaaatataaaataaataaaataaaataatgacaggaaagttattaaggctagactatgactgcctttatgttcccaggtgacaagttcagagtttatcctcctgtaaatgtaggaaacattggtaggttttgaatggttaaatgttatgacgaaaatagtgatgttagaatgtgattttagtgctgctatgctgaatggatttgggaggatccatttcattgaccataacatacaaattccaaaatagcttcattcacagaaattaatgagtttctgtccttctactccctcccacttggtctttctggccaatctaattaaacaggtaagtcaacaacaaaagaggacaatgaaagttgtcataacagtaggtaacacttgggcaatgtagtcaaattcatttattcaattaaacaaatgagtctacttattttttaaactaagttcatggaaattgaccaatcatttcagtcaaaccagttgatctggttgtacatatagataaaatcattgcctatcatggaaaagaacaagttattttgagcattcttctcaggaaagttagtgtcaaacatataaaacctagttttaggaagaagaaggcagtaatagtagtagcttcactaacacgttaagactagtgtcatggtatacacagtagagcaattatatttaaggataattaaatataagcagctactgaggaaagtgcattggtgaaattgtacattgaaacgttagtaacaaaatgtatcctttgctcccattctttcaatcaaagcatgaagcttaagcagcaaattcaaagattagctcagaccccaattagtcccccttgaggtccaggataaaattcctaataaaattgtaaatctctgccctgttgtttaggggacttggtattgacagttctttctttcctttcacaattagtaactgagtttcagatgagatttaaaaataaaaatgaacaagaaatgagcttgcctccctgtggcagcatgcactctagctaatctgcaaatgctataattatgcaaggtgctgatagatttgtctctgggctggtggtcaggatccaattgaactgctgcagttgctgctttatcatcacaaatgttctgcacttcttagcaattctcaggcctaaacatgatattggaatttaaagaggcaccatagccttatatcccattgagatgtgctgggttaagtgccagttcatctctttccattcacaggtttagggggaaaaggtgtatatgtgtggggtgtcctacagggatcatgtttcaactggctgtttgccacaaagccattcccattggactaggaaccctagtgtaattatcgtagagtcaaagaggctaaaaccactgactcagtactgagctctttacctgtctactgcctacaacttatatcctgttttcctattcatcttgcaagtgggggcttttggtcccaaggggacaccaaataagacaatataagcttcatttaacttcatatctaaattggccacatttgtaactgtcttctttaccttacaaggtcatcatgaagataatatgagctaatgtatctgaaagcactttgaaacttatgaaccacctataaatgtaagatgcttaaaattatcattaatattagtgaatgtcacttcagcaattgatatttaacaataataaaattagggtaaatacatccatagtccatggcggaagataagggaaggggaaaacaatgaccccaaactcatcctgctgaaagcagagcaagattgtcatttccatacatgaaatacattccttacaattgcttcccacctatcacattccagttaatttatttggaagaaggaaatattttaaaataagattgcccaagaatagtttccagcaaactaaatgtctataatttggatgtgtaaggtaaattgacaataattctataaagaaatcaaaatgggttttttattaataaaatgaaaaatggctggatttaattttatttatgttttgaatacatagcatatggggatggttcaaaatataaaggcatatagtgaagattaaatcttccttctgcctgcccatgacaccctttccttacccaccacagttactcagccatccactccctctcttcagaggacaccactgttaccagttgcacatgtatccatctagaaatatttcatacatatacaaacatttatatatgcatatgtatgttttatactcaaaatagcatgctgcgcatactatttgggaccttgtttttttcattaaacagtatgtcttggaaatattttcatatctaatctacagatttacctaattattttaaacagcagtatcataatatgtcattatatgaaatcaccacaattgtaacaaggctcctactattagaaattgaggttgtttccaatattttactattacaaataatagcaaactacaacaaaattgaacatctgatataactggattttaaattcaaacatattcattttttttaaagtagatccctcatgtttccaataatatttaaaaatcagattattaagagtaactgtagtatttatgaaatgaagactagacattatattagtaggtctaaattatgccaaagtcaattaaaacaaaaatgttgttcaattccataaggacaatacatattgtatgtcatcttgaatgatgtgttggaaaaatgaaggcaattaattcactgaaatttttccacttcaggcagctcaggtattaggaagagaaagctaatgtgccataaagctctttcctaagtatatttctggtgcatttgtttattatcaacaactattttgggaatctctccaaatttgtatagttccctaaccttacctgtcctgtaatcaacttttatttctctctttcgcttctaaatattcttcaaatagtatgagatcttctctcatgttggcagggaattcctaagctagtcaattaatggtggcttaatcattatagcacaatcctatgctattcctcctgtgaattataaagaagtataaaacatttctttttagtaggtaagagttcagttggatacttgaagcaagacataaatacagaatcagttaaagggaattcaggatataaacaatagtttgatataagtaagggttgttttatgacaacaatacacatgacattatgtatctgcatactgagtcctctcatttctttcttccaggtgcctctcagatttgtcctctcattaaaaaaaaaaaaaaattccccaaactccaacctggtgtgactgctcaccaccacccatccccacacactgcagcattgtttcctcaacctcttagtttttgttcttctctcagcccattccacatatcaagccaatcatcattagacatcacttcctttgagtcattttttgtttcaagatctacaatgacactccagcctagaacatcatgtccaaattcctctgcctgttactcagagtcctccagaattcagccccatccaatctatctagtttcatttttaattcatggtgctcacaaaaccccttctcatcaggctcattttcctcaaagcatattatgcttgtgaagttctacttttgtgccttggtttatgttgttaatctttcctgataatcttttgaaaatctttttgagaatcttctgagaatcttttcttctttactctctgcctttccaaatcttctccactctctgcctttccaaattttctccatcccttaagtttcgtatggagatccattctcttcataaaactttccccaaaccttccagcgaatattaacctctcctttctccatttctttaccacctatatatagccttatagctcaaatgctacattctatgttccattctctattatggtgtgctagtcctgtgttcatagtcctgtgttataaattgagggcaaagataaagactttactttctttccctttagtagctagcacaagacttggagtacaaaagatgcttaattggtatttttgatcaattatcccaatgaagatatcattgctttattatattgttttggaggttgcagtggagagtgggggataattcagaggtttagaagattcatgtcactaaaaatgtccgttagggtaatatttcattgagaataccactacaaagcatatatgaggatttactatttctcaattatacttttaaaatatatatttctttatacttacaaatttataaaaaccacccaaaatagtccatttgtttcatcttgttggaaaatgtagttgtcaaaatggcctatttacagtgaatcaatggtgctctaaatgtgctgggaaatggatattgtatggatagagtaacaacccaagtaggaagtaggaacactgtctaataaatgtttacacaccatcaagtctacaaacattaaatatcatacatgatagaatctttctcatcctgtaatttatctcaatttttccattactttctttcattttctcttctagctttactcacagacaagcctcccaagccattgttccccatggagaatcagccaagtgttatagatgtccagctgggtaagtcccctccttggaataacacttcctaaacttgccctctgttaacagatggggaaaattgcatgaaccaggaaaggtttattgccactgttattacatgcaaatcaatttgtgttctgctcatttataaccctggagttcagtgcgatagcagtttaaggaaatgagtttgtattgcatcaaaaaatggtaatactaattagttacactgggtattaagtgtgctgtatgacagagctttttaattctgtgattgatagattcatgagtgtcttgcattggtgattggtacagaaaacttttcatacatgtcagccaaaatttttatttggacagcattaactcctggagaccaagcacttcttaaaataaaatacaggcttcggtttcgcctttaaaatgatttgataatattattttcaatatcacaatccagggtcatttaaaacttgtttttaggttgggatcctgaatatttatgaatcatatgatgttgggaaaagtggcaagttgacttatgagtgctattgtctttttacacactcaaataagaacacaaggtgttacacctctttttagagctcctactgctaatccttgtaattttaagtactgtaagctaaaaactcagaggcctgctaggatctctttcaaattgtggcctttaatttaaatcatgccctttaacatttgcgagatttcatctgtcttggatttcattctagtattctaaatttcttcaattctaaatagaagaaccacaagagaactgagtaaatatgcttgaaatgtattgggcttacactgaatatatgatttgttgatatttgtgaccattgtggtctatatccattatacagccagggaagacaaattgatcccaattttcactcatttagaaaggtttttctttttgtttaatttttaattattgtgggtacctagtaggtgtgtatatttatagagtacatgaaatattttgatacaggtatacaatgtacaataatcacatcagggtaaatggggtgtccatcacctgaaacatttattctttctttgtgttacaagcagtccggttataatattttagttattttaagatgtacaataaattactgttgactgtagtcaccctgttgtgctattaaatactagatcttactgattctaactatatttgcatgcccattaaccattcctacttccaccacacccaaaacccttcctagcctctggtagctatcattctactctctatctccatgagttcaattgttttaattttttagttccccaaaataagtgagaacgtgtgaaattcgtctttctgtgcatggttcatttcacttaatgtaatggcctccagtttcatccatgttgttgcaaatcactggacctcgttcttttttatgactgaatagtattccattgtgtatatgtaccacattttctttatccatctgtctgttgatggacacttaggttgcttccaaatcttggctattgtgaatagtgctgtaataaacatgggagtacagatatctttttgatataatgatttcctttcttttgggtatatgcctagctgtgggattgctggatcatatggtagctctatttttagtttactgaggaacctccaaaccattctccacagtggttgtactaatttacattcccactaacagtggacatttgggttccctttgctccatatcctctccagcatttgttattgcctctcttttggatgaaagccattttaactagggtgagatgatacctccttgtagtttttggaagttttgactcaacttttgatctttataattcagttgggattgttgaaagcttatttatatcttgaaaataagagacagaaaattatattcctaatgttcacttttccaaaatgaaatatagcaaatagtagtttttaaataagcctagcaatgtgagtaccaaagttaagcattttaaacaaaacaaaaagaaattaataaacatgttatcaagagtggactgtgcaaatggtaaatatttggaaataatgaagtattagactgtggctcttcttatgtcccctatattgttttgcagtcattatattttgttagagccaaatctagatatgctgatacccttactgactgtatgatacattttacttacatttctctaccttgaactgggataaaaatattccaagggaactttgtggttccaggggttacatggagccatatgacggtctcgtatcattagtttacatggaaattcaagtggataaattgatttcatttggtatgaaaacaatttatccacatatatatctatatatctatatctatctatctatctatctatctatctatctatatgtagaaagcaacatttgcatgataaaatgtacatgataagcccaggccctgtggctcatgcttgtaatcccagcactttgggaggccgaggagggcagatcacaaggtcaggagatcgagaccatcctgattaacacggtgaaaccccgtctctactaaaaatacaaaaaagcagccaggcatggtggtaggcacctgtattcccagctactcgggaggctgaggcaggagaatggtgtgaaccctggaggtggagcttgcagtgagctgagatcatgccactgcactccagcctgggtgacagagcaagactccatctcaaaaaaaaaaaaaaaaaaaaatagtacttgataagatacacaaataaaatgtgagtaaattttatgtttgtggtccctggaggaataccttctgtactctcctctgctattaggcacacaacagcaaagtttgaaaagtattgatccaaagcaaggagaaggaccattgtagaagatacattccattcagattcactgggtgtaacacctgtatgtactgttcaggacatctacaagatgtgcactttgtataaacctgtattctaacatagatatatatgccaaaataccctaccaagtactaccatcctataagattactaaaataatttacttccaatttacattagatgtaaggctgaacttttcgggttttagtttgtaacacaattggaaacaactttattgacagaaagatggagacctgcttatttttcatcccagaaaggctgttactctgagatgttaaacaaccatataattcagagaaagaaaagcaaaatcagtcaaaccagatctttggtgtttcaaggagcacatgactgattaattttaagtgattttaactctttcacggatttatttagtaccatttattcacaattggaaatccttttgtaagttgctctcatacctcaatagtcagatgacattatgagcactataaatgtcaaagagctcctccgtgtgagtgggagttctgcagtcagaatcatgaggcattagaaaacaccatgtgtaaaaaagagatagagaaagataactgggactactggatatctctgtctatgtctggaaaacttgaagaattcagtaaggtaatgaaaactggaaattgttttccttcagtttctgaagtttatcaaacacattcaattctggacatcctcaagctagaactaaaattagagctgccaagaaatacgaaaatccaatccatatggctaaacacattatcaactttgggtttcccaaatcacattacttaaaattttagacaacatcatggtagattaaaggtggccatagatttttggctactcctaatatctaaacttgatttttcattcttctcccgttgaatctgggttggccgtcgggacacacttgaccaatagggtgtggcaaaagtgatgttctgaaattttagaggctgaatcaaaagaaacttgcaacttctgtcccagtgttttggtccactctgaaaccaccatgctgtttgaagtttaagccacatagagaggcactagaggatgagacacaatatggtgggagagagaggtcaactagcaccaagacaccaatataagtgaagaagatatcttggaagtggatcctccagccctagcttccctggcttatgccatgtagatcacagacaaaccactgagctgaactcttctcaaatttatgaccccaaaattcatgagcaaagtaaagtgattgtcatttgccattaagttaggggtagtttgttaagtaattagtagataacctgaacaaacattaatcagtttatctagagcattattaattttatttttcccatggacaagaatttcatgcagcaattttatgcaaaatgagacacgttttaggaaatacttgagtatcagcttcaaggtagttttaggaaacatggtctggaataagtgtttatgtgttcatttgagggttacactctgttctcagttctgaatatttctaaaaggaattcattaaatgaaaaatttcagtagaaataaatacttttcatgcatggagttggcatcagtacagatattttgttatgtctctagagaaaaataaacatcttgactttttcctatagtggaagccattagtcatctgcaaagttctagaaatttagatacgtttttgctgatttagtgatgacagtttggttgttgctaaattgtgttcacattgtaatactgaaagaagatgaatctttaccaaataaccatatattttgagatgataaacacattcttaacaaaataatctgaaaactattgctctcacaaaacaagtctatgcaactaacgttccctgtggtaatgtatgatatataaaagataaaacaatgtacaacacgtacgtgcaaaattccaatttggtcctgttatcctttattttttctctctctgaaggtaaatttagctttaaattcgagaaataaaccttgactataccagggccaattcttttctcagcagttgaaaaaaaaatattttcaataattttttctaagtaaaacaacactgtattacaatatataaacttattttacacctttaatacaaatttattaaaatattgtaaggacatgtgccccatttgaaatatattcatgctagatagaccctttttcataaactacttcttttcatgagacccaaatgcatgctttacaaactgtaacacactcctggaagctttgaaaaagtcatgaacaaatttgcatgaaagatttgagatctgctatctaattttaattaaaggtgagtttcaaaatgtgctctgttcttctgactgatgatgataattttcttttccttccttcctttctttctttctttctctttctttttctttctttctttctttttctttccttccttccttccttctttctttctctctctctctctctttctttctttctctttctttctttcttttctttctctctttctctctctctctctctctctctctctctctctctttctttttctttctttttttcttgagatgaagccttgctctgtcacacggggtagagtgcagtggcatgatctcgactcactgcaacctccgcctcccgggttcaagtgattctcctgtctcagcctcccaagcagctggaatcacagtcaggtgccaccacgcccagataatttttgtatttttagtagacattgggtttcgctgtgttggccaggctggtctcaaactcctgaactcaggtgatccaccagcctcggcctcccaaagtgctgggattacaggcatgagccatcgagcctggccgataattttcttcttggaagttttttaaaacttgaaataagctagacagcattatgcagaaaatacatataaacatttactttctctttctgtgtgaatcaaaaaggaggcctggggggcctaaggtagatcagaaaaacccagacaagtagaacatccaagctaattgggttacttttgatgtttcaaaaagccaatagttcatttctagacaaatctgatccagtataaaagattctttttcttttctattctcattcagaatttattttatttttacaggctattcaaattcatatttcatgagtgtgttatatgctattggctcaaactgtctctatatatgtaagaagtgttaatcttcatcagaaatcgatttccctagcatatcagtttctactgaaaattatatcagatcccttaagagaccagtgtaaaagactctacaagagaatatatcaaaatataacatttaattcaatactcaggactagaaggcaaacaaatacccagtttaatcccaaattaggaaataagctattcaactaaatttatgttttttataaaacattatttacctaaaaacatttattgagttcttactggatgccagcatattagctcctgaaaatacagaggtgaattaaatgaatttcttggccttaaggagttctcaatctagtggggaaacagatgtgcataagtagaattgcatcgcaatatgagaactgccaaaagagggaaaaaggaaaatgatttttcttgtggcaggacctcatgttctatatgcttaggctttcactaaaaacaatgacaaaactctgtagcttcaacccaattactagatttatctgaaaataattaagaattaccaagaatagaaccttttgaaatcataaattgtccaccatttgctttaatgtggcaaatactaaaaatggaaatttatgatacccttgaatcaattaagtttaacaaaattaatcaactccttctaaagttgaaataaaatgaacaatccaaagcaagtcaacaactgagctaaatgtcaaactagaattattgtattttttatttttttatttttatttttttttatactttaagaagaaaatgtggcacatatacaccatggaatactatgcagccataaaaaaggatgagttcatgtcctttgtagggacatggatgaagtagaattattgttaatgcaaatagtaatacatggttatttcattagctggagtcataacttggtatatgcattgtgtgtataatggtggaagcaagggattttttaaattttttatatcatattcttaccctcttagtttcaaataactccttaaaaacttttatgtaatcttgaataactgaacactatggagactttggagagtaagaaggagggtattatgaactaactcagttttcttggcacacgtaatgggagctagttcatggcagaatttcctcacccttgtagacattctagggttagtgagttgtttccaaaagacctatttattcaggataacacgcacaagcttagcgtgagctaccccaaactgaaaaccattctattgcccagatcatataccatgtgcattatttacagctttggaaaatctggaccaagccttttccttaagagttggctgcagtattgagtgagactgaaactggttcccttactttgtctaagtttctataacagctgtgcttgttttgagatttttaagaatgaaatgggaaaaaagttaacagtttactaaatagtgtctgttataatctaacaatgtgattacgaacatctcttaaatagcatgattgttaaccagtcctctatgcatacattggtgtttgggggcattgcttaggcttatgtcttattgagatactgatacaagtttgatggtgtttcatcatatttttaaaaagccaaaaccattatttcatatatttgaaaccaaaattatttgagaatttactaggtactaggcactaaaatgggtatttgcacatacagtgtcttattactcataagagctcaaagtagtagtagatattgttgaattattttgcagatgaggaaacgtaaccacagacaggtgaaatagcttacatgatgttacataattagtaagtgacaaagatgggatttcaacaagatctgtttcactccgaagttttttctttttattatagcacactgggtatggtaacattatctagaccccaaactctatcctaggaaaaaactatcattctaataaggacagctaaataatattaacaactatagtaattattatttaataacagctctactattacaaataataatgttattactctacttagtataatttaataacatttctagtactgctaagaatagcaattattattataatcttatttaataataattctactactaataataattattattatttgtagtgataatatcagtagtagtagtagtggcagtggtggtggtggtggagctgtcacttattgattgcttacagggtactaggcactatattaaatactttatatagcttattttatttaattttcccagcaactctttgtgataaacccaactacttgcctcattttaacagttttattattatattagtcatataccgtacaattggcaatttaaaacatccatttcaatgatttttggtctattcacgatgttgtgcaagcatcaccagaatttcataacattttcaacaccccagaaagaaactctgtacccattgacagtcactcctcagtccctcagcctcaccccatcctcagctttaggtagttattaatcaactatctgtaactatagatttgcctattctggatatttaatatgaataaaatatgtaacatgtggtcttttgtgataggcttcttacatttagcatagtgttatcaaggttcagtcattgttattgcatgtataagtacttcactccttttcattgctaaataataatcgaccacattttatttattcattagttagttgactgacattttgatcatttgtattctgtggctcttatgaacaatgctgctgtgagcattcatgtacaaatttatgtgtggacatatgtttccatttctcttgtgtatacctaggagtagaattgctgggtcattcggtcattctatgtctaaccttttgaggaactatcagactgctttccaaagagactgtaccattttacattcctatcagtaatgcagaggttccaatttctctacattcttgaaagcacttgttatttttttatttttaacataattattctaatgtgtatgtagtactattgtggttgaaattgtgttttttatttatatttccctaatggttaactatattgagcatcttttcatgtgcttgttggccatttgtatgtctttggaaaaatgtctatggccccttttttaaatgaggaaaatgggctcggagaatttatacaacttgtcccagctagtaagcagcttgaaagtagtgaagctaaagttgtcactcttaaaccttgccgtattcctactaatattagtagtattgtttacaaggtcctcttgtacttctgctctttcctaaaatagatttttggacagaaggtgagtgatcatgtatatggaagttaaaggggtgtctagtgtgaattgattcagtgagaaaatagaaattattaagagcattgctttaactttaaatctttgtaactcaagccacaactcctttttaaataccaaactaatttgtaagcagtacatatgcctgaaaactagctgtgaagcacaagacaatataagaaagttttctggagggatttacagtatacttaaatggccaaaaattgtatgtaacccagtatctgaacagagatcaagaaactaatttgtatcattcaacaataggaagtatagattaaagagactttaaaaataagttagagaactctccactgtttgaatttattaggaataagtgtcaactgagtgcactgttccccaaaagcatatgatgtctgtgttgatatcaataccatcagctttgcagcacttctcagcagcttcatcttctaacccatcttattcagtgggttatagatgctttttaaagatctggaaaagaaaaaaaaataacgctacaaattttgactatgtctaaaatgccacatgaactgggaaaaaatagaattatttatgatctcttttaattcaaatattttatataattttatgtaaataaaggcagattttatggatgaacttgtagaaaattgagtaagctattatcttgcttattcataattgaggtagaagggtattctcataattgaggtagaagggtagctttgtatcatttagacaattccattaattgtcctctatacttcatttaaataaatttggcttaaactttggaagatcttttgctcctttaataatagctctttccagaaattacttagatatatcagagtgggatataaattttggtccctttttggggggtcagggtctcgctctgtcacccaggctagagtgcagtggcatgattctggctcactgcagccgcaaactcctgggctcaagtgatcctcctgtctcagcttcctaagtagctgggactacagggacacatcactatgcctggtgaagtattttttaacatttttcattgagacagagtctacacagaataaggacaaggcaggagatctgggaaaaaatactcagagatctgtgaaactacagctagtagtttatgttcaaagtagtaacttggagtttggaagcttacaggttgcagaagccccggcaaggtggtaagcaaagaagtcacgtcagaaaaaaaactgatcttgggtttctagcaaggtggaaaagtcaaaggctgaaagccatcacaaatcaggcaacaaatggatactgaaagatcaaagacaatggtactaaacctgtaagagtttgctcgattcccacaagagaaaggtattgtcactgtgaacatagccactgaaaagtaaagtttgaaagaactgggtcttagagtgatgcaaaagagggcacacctggcaattaagatcagttaaagcaagtcctttggctgaaaaaaggaactccttcaaaaagagtataatataaaataaacttggcctgataccagttctaatgaaaagtctagtctttaccaatatctgaatttcaaaaaaactgaagtaatagtatattcatcaagtccacaaaaaagctttgattttgtttacaaatgcaatattaacctaggaatagagcctatgtatattgaaatgtggtgtacatttgtaagacacttattttccaagaacaagaggagctctgactcactgagggcctgtatcaatttcatttattttccttagttgtgaaggtgttgactgtatatctgttactatagtgatgattttacatttgttgtcaagttgtttgatgaaattgtaacttggtgagatgataatcatggtgtgtcttaaggctgattgttggcaaaagaacaaaaataatgtgaacatgtgatggagagggggcctacaacaaaggagagggaaaattgtgtcaaggtacaatttgaaaactgctgtaaaccaaaaataaaattctaggcgtctctccccgccacaaccatctgagtggactcctcctctcggccagggcgttccaaagttagcatgaaaaactggttcaggccatgacaggaagggaggactggacatgtttcattatactctactcccttttagaattcaggaaaagctgaccagcatttaacatcaacacagaccttaagtctgataagaaacatatacaatctattctctctgaagcttgcttcctggaggcttcatctgcatgataaaaccttgatctccatagccccttattgcgacccacacattctttgtgattgataataactttcaaccagttgccaatcagaacattttaaaatctacctataaactggaagtcccctgcttcgagttatcctgccattccagaacaaaccagtgtgtatcttacatgattgatatctcatgtcttcctaaaatgtataaaggttgtgccctgacccaccttgggcacatgttctcaggatttcctgagggctgtgtcacaggccattggtcacttacatttggctcagaataaatctcttcaaatgttttacagagtttgattctttgtgttgacactctcttagctcaattatgggaaaatgaaagttcttgagaaagaaagagaatcatgctaactttacataagataattaaggaaagtgaagggttaactttaacaatagtacctcatatttatgcagtatgtatttccaaggcattcaaagcatgttttcaggcatcatttaattaatttctttggtagttctgtaaagtatgatgagtataagatatcattcattaagcattgacacgtgtagtgattaaggttctttgtgacacccacaggcagtttaattgagcatgctagtgaggaatcagctagatcaatagtgaataaatgattgttagcctgatcattattagtcagatcagaatttctgtaactctactattatgtatgtacacatatgactgctattatatatatgtaaaatttatagcagggatgatgtgtgtactcacttctgtgtgtgtttccacttcctttctcagtcaagtggtttgcttattaacctaataatagccattctcatgagtgaccactttgtatataaagtagctcttaaactttacagattactactctgcttgcatttactttttggttctcaatgttgattcctgtgattttagtttttatattcttttgatgtacaaagaattcttaaatatatttattgggtatatatgacatttaaaaccatataatctatagtgatcagatgaaggcaattagccagtgaaatgtaaatcaaaatcacaataaagtatcatatcatctcagttaggatggctattattagcaggacaaaaaataacaaatgctggtgaggattagaagatactattatgaacaattataaaaactgaagaactttgtcaacaaattcgaaaacctagaggagagggataaattcctagatacatacaacctaccaacctatcattgaaccagaaagatgtagaaaacttgaacagacaaataatgagtaaggatattgaatcagtaataaaaccccccaacaaagaagatcccaggaccagatggcattactggataattctactaagaactaattgacaatactaataataaatgttaattaaattcattaacaataactaaagaagaattaattccaacttctcttaaactcttccagaaaattgacgaggagggaattctttcaaactcattcagcattaccttaatactaaggccagacaaagacactaaaagaaaagaaaactacaggctaataactctgatcaatgtaaatgccaaagtcttcaacaaaatactagcaaactgaattcgacaccacattaaaaggatcatacatcatgaccaagtgcgatttaaccccagaatgcaaggaagtttcaacatatgaaaatcaatcaatgtgatataccacattagcagaacaaaagataaaaatctttagaacacatgaatatctcaatagatacatacaaagcatgtgacaaaattcaacaacctttcatgataaaaacactcaacagaatgaaagccatatatgaaaatagtccacagctaacatcatatttgatgatgaaaaatcgaaagcttttcctgtaagttgaaggacaaggcaagtgtgcccactcttgtcacttctattcaacttagtaatggaagtcattgccagagcgatcaggcaagaaaaagaaaaaaaggcattcaaatcagaaataaagaagtgaaagtatcactgctcacaaatggcataatcttgtaggtagaaaaacctaccaattccaccaaaagttagaactaataaattcaacaaattgcagaatacaaaatcaatattcaaagatcatatgcatctttatagactaagaataaatgatccacaaataaaattgagaaaacaatgccatttataatagtacggaaaagaataaattacttaggaataaacttaactaaggaggtgaacgatctgtataataaaaaccacaaaacattgctgagataaagaaggcacaaataaatgaaaagacacctcacatttatggattagaagtcttagtattgttacaatgtccatgattacccaaagtgatcttcagattcaagacaatccctatcaaaattccagtgacatatttttttgcagtagataaatcaatcctaaaattcatatggaaacacaaaggtccccaaatagccaaaacaatttaaagaaagaacaacaaagctgaggcctcaaactttctgacttcaaaacatactacaaagctacagtaatcaaagcagtgtgatactagcataaggacagatatgtagaacaacggaacaaaattaaaaaaacaatagaaataaacccatgtatatttgatcaaattaccttcaacaaatgtaccaggactaaacaatgaggaaaggataatcccttaaaccaagggtccccgatccctggggccacagaacagtaccagtctgtggccttttgggaactgagctgcaaagcaggaggtgagtggcgggcaagcaagcattactgcctgaggtctgcctcttgtcagatcagtggcacattagattctcataggagcatgaaccctattacgaactgtgcatgtgagggatctaggctgcgtgctccttatgagaatctaactaatgtctgatgatctgaggtggaagagtttgatcctgaaacaatccccccgatactgtccctgttcatggaaaaattgtcttccacaaaactggttcctggttccaaaaatgttggggatacagatgatcttgggaaaactggatatcaatatgaaaaataatgaaatcaggccccttctcttataccatacacaaaaatcaacccaaaatgcattaaagaattaaacataaaacctgaaactatacaactcctaaaagaaaacacaggggaaaatcataacactggtcttggcagtgacctttttttaatgtgacaccaaaagtataggcaacagaagcaaaaaatagacaagtgggactacagaaaactgaaacgcttctatgcagcaaaggaaataatcagcagaatgaaaagacaacctacaaaatagaagaaaatatttgcaagccatatatttaacaaaagtctaatatctaaaatatctgagtaactcctacaactcaataacaaataacctgcaaaaataaactgattgactacagataaaaactttgcatagacatttctcaaagaagacatacaaatagtcaacaggtatgtgagaagatgatcaatatcactaatcatcaaggaaataaaagtaaaccataatgagctatcacctcatacctgttaagatggctattattataaaaagcaaaacaaaaggagagaaaataagcgctggtaaggatatggcaaaatcagaaagcttgtgcaccattggtgggaatgtaaaatggtgcagcctcaatgggaaacagtatggcaatccttaaaaaattaaaaataaaactaccatatcatccagcaatttcacttctgaatatttgccaagatgtggaaacaacctaaacatccatcagcagattaatggataaataaaacgtggtctatacataccatggaatatcattcacatttgaaaaagaaggacatcctgtcctatgcgacaacatgaatgaaccttgaagacattatgcttagtgaaataagccggtcacagaaagacctatactgcatgattctgtttacatgaggtttttaaagtagtgaaactcttagaagcagaatgtagaatggtagttgccaggcactggtagaagtagaaattggaagttgctgttcaatgggtatagagtttcagtcatgctagatgaaaaagctctagaggtctgctgtacaacaatggatatatagataataatactgtatacttacacatttgttaagagggtagacttcatgttatatgttagttactacaatgaaaaaaaaaaaccaaaaatacaaaacagttggtgagaagtgttctaacagagatctattaactcagaaacctaaggcttaaagtatattcttccctctaccttgtcttatataatgtgccaacaatgcttagagatcttcctgcttagactgttctatattattgctttagtaacttcaaattaggatcccatatttttgctggggcaagtattacaatcaattccaaattggtctctttgcctcctctttctcatctttaataaattctcatcactataaccagaaaaaaaatctatgttaaaatgtaaatcttatgcatctttcctgatttaatctcttacataactctcccttacttgcccaaaagagaaaatactaattccttacattgattactggttgccatctacttcttcagtctcatcattcttgctatgccaaattgttttatttttgttcacacaggaactcatatcccttctcactcacaacctcctggcaaacattttttatacaccaatgttgagtttatcatcacttcccaatgatacctttcctgatccctgagctgcaatcccaggaagaaaatatgtatcccttttatgtctctactataccttatgaattatcctgtcccagcatgtatagtttttaattatatcttcatttgttgatatgtatgtatctcttactagactgtaaaactgatagtatttgcttcaatatttcttttccagcaataagcactgtgcctgatgctcaggaaatgtctattttatgtatgtgtgcacagtcgtatgtatgaacaaatttacagatatgtgaaggaatgaaaaaacaagtgaataaatttctatgataactaaatttcagatggttggcaacttccttcactgcagccctcccattaatttcattatattttacaaatccaactttactttagaaaacaaccttgtgatttaatttagtgctatctagaaccataagatcttagccttgtacgatggctcatgcctgtaatcctagcactttgagaggctgaagtgggcagattgtgtgtggccaggtgtttacgaccagcctgagcaacatggtgaaacccccactctacaaaaaatacaaaaattagctgggcatggtagtgtgtgcctgtgatcccagctactcaggagactgagctgagaggatcacttgagtcctggaggtcaaggctgcagtgacccttactcgcatcactgcaatccagcctagatgacgaagtgagaccctctttcaaacaacaacaacaacaacaacaacgacaaacccatagagtcttaaaattgcaaggaaactccagccaatataataaataaccacaaaatcacagtggcttaacgtaagaaaagtttacttcttgctaatacaaaatctagttgggtattcatatgacttcctatgcagttcaagctttttctacctagtggctttgccattctgctggatcccccacacttatctagccaagagagagaatgtggagggttgcaatgttgtttttaggttccagaacagaaagtagcgcacattacttccaaccatatcttattcagagttcaccacatgaccaacctaattacaaggaaggttgcataatatagaggaacacatggatatgggtgagcactggctgtcccaatagcatttatctattcctacttgatgttgctcctctgggagcatctctaagaatattgtctaaaacaaaagcattctatgacaatggagaacacattatctccacaaggcagcctattcaattattgtataattcttgtaatcagaaagttccctttatgctgaactataatctcactcttgtggcaagacagagtaaacctatttttcttccatatagtccttcaaatatttgaataaactagcaggatcccccagcctcttatattctttaggataaatatttacaattcttgaaaatttcttataggaactatacactattatggctaccctcttctggatatacttaatgaagagtgttaatgtacttcttaaaatatgagaccatataccagatgtggcctaactcatacagaataggatattgacttcctgtattctaatcactatgtaaaatgagatcatctgtgtgaaggcactttttacaatatgaagcaacacactcatggaaggtatcgttattattataaatgtaatttgagattgtgtgagcttattcagcagccacatcacactgttggctagtgttttaaacttgtggtcagctaaccccccaaacctttttcataggaattactgcatgaaagagccccataatcatttcttccatggtcagtgaaaaatacattctttttttttttgtttgtttgcctctgagaaaataggcttaatggtgtctagatttctggggctaagtaataatttaaaattcttgacaagttttaggtcctatccacctacacaaaccactttgaccaaaatcagtgctttaaaaaaaaatgcaaatgtagttagctaagcgtatttttttttgtctgcatgacaacaaatacctgatttaaaggcttttaaatcagtttgtggcattggtgtggggatggccttaaacttttgatttcctctttagtagctaatggtttcgtttcattaagtgctctctgtggttaagaactgcacatttttcttggaattttgcaaacagaatgagcaatttaaattatgcagaagcacagaaaccataaataatagcagccttaagattgtatgattagtacaattaaagcagagatatggaaaaacataacttttccatcatattattctccctctctaggaacattctggatcaattactactcaagcccataagtcaaagcaatctcttaaatccaggattagcagtccgtaatgaaaggagcagaatttttgtgaatgcagttattttcttagcctatttgtactccccaaaagttcccagttaattaactggactactttaatcagtgaatggctaccacattacacaatgtttgatttatattaatgcgctttggtcttggtagaccagaatttccagttctctaaataagagaaaaaagaaggaagctggctttcttattggacagtgaaaagtacacagcagttttgattaaactgaaataaaatatctctctaaatatttacctcaaggagacagtggtgtactctaaagaggtggatgactacaacataccctcccttaccacatccatgagtgtcctagggctgctgtaacaaagtgccacaaatgggtagcttaaaacaaatttattgtatcactgttccagaaactagaaatctgaaatcaatttgtcagcagtactgtttccttctggaggcaaaaagggagaatctgttccatgtttctcttctagcttctggtagttgccagcagtccttgatgtgccttgactggtagatgcatcactcagatcttcgtcatcacatggcattttctccttgtgtctccttttgtcttcaaatttcactcttcatgtaaggtcaccaatcattggattatagggctcaccctaatccagtatcatctcattgtaactctgcaaaggccctatttccaaataaagtcaattcacaggtatctggagtttaggtacatacattttggagggaactcagttcaagtcatagcaccatacctacttacatcaagatctgtatgacagtgaacatctggattagaagtaaaaccttcagtctcaaaataagaagtttgctgagctaaaatctgaatgcctggatatttaagttttcatatcattggagttcctggaaagatacactattagacaaacacataggcaggtttcatgcagatcttaaaagggaagtcctatataaaaataggctgtaacctgtgtattgaatctacaagtctcacttaccaagtgcaagagaggaaatccctgcatataaatgaagcttctttcaaaattgggccttatttgaagtattattattttttctttcctatcttaagtccatagggcttactcattttatgacagaaatatttactcatcatctggacaattctgagatcctgatgtgtttgtggagtttgtattgatgcagcaacatcagtttatagatcagaaaaaaaatgaataaaattctttcattataacacaataccgaggagagcaaaatctggtcaatataatcttaagggtatatgtacaaatctcagaagtggtatagtaagcaagtacaatttcagggttatatttctttcttaccttagccaaacaaattgtgaagaaaataagtagtttgggaagtagagcaaaatagctgacatgtatctattgttttcttgtacatagattatagataattataaatttagtttctagattcttcctgcataagggtgatgccaccaggatttctttaagtctatgcatataatgcaacccatgtcctcctagcatctaatccatggcagtgaagattccatgtatagtcactataaataataggcagttcagataatagacaatcaaaaaatactgaataaatcagtgtaatgttaccatgccccagtaaatagaggtgtagcatacaagtctattgtaattcctatatccttagtgctggtatggtaatgtgggatggtttagttcttgttctgtctagagccataaaatgaccctaccctcccttccttacctgagtatgctccctcatgtccacaaatatggcctttaccaatgtacactaatctccgtaaattttaaatagtacttcatacgcacagataatttaagcaaaggtccatgagatttaactgatttaacaaacacttatcaagtgctagtgatgtaccaggcaccattataaacactgaaatttaagacagacatggtttcttctctcatggtgattactgtctagcaggggagacagagattaaataaattaacctaccattttacataaatataaaattacaaattgttgttaagtgttatgaatgaaaataagagagaacatctattacattgtggatgagtagaaatgaatagttttagaaagttcataaggtaaaagttaaaagatgaggaggaggcaccatgttaaaattaagaaaaaatgtgcctcaattaggcagaatagcatatattaaggtcttgcagaaagaaaaaaatgttgagaatatttgagatacttcatttaagtccagtatagctaaacattgccatctgtgaagatggagataggagtggtgtgaagtgacatcagagaggtaaggagtagtcttatcatgccaaacatcacaggagggttctaattaaagaagtttcatgatgtaatttatgtacatttatactttctaacttttaatcttgaaataattgtagacttacagaaatgttgccaaagtaacacagagatgtcctatataccttttcacccaaccaatttttatgaggatcctggttaaaaggatactgcagtatttcaggcaaaagctgaaggcaattcagtctaaggtattggtggagatggaaagtgattgtttgagatgaagtaagattaatagtacttccctgaaattaacctactatacctcggacactctattgagagctggaaatgcagtagtgagccaaaaagacatgtttcttgtctttaagaagcttgtagtctagcagacttggcaatggattggatacaggtaggtgagaaagagagtaggtgtaagaaagtctttcaggtcactgagcaactgagtgagtaaagaacacttactaaagtggttatttcagttacctattactctataataccctctccccaaatggtggcttaaaagaacaatgatttattatttctcatgatgccatgggtgtccaggtggttctcttgctgcacatgattttgactgtggccactcatgcggttccattcagctgagagcttggctgggcctggaacaacccataactcacattcttgggccttgatgctgacctttgacagaagcagttaattttttctccatgtggcttctctctccacacaatattttattatgcactcttctggtacaagcttctttacttcatttctctcttctaagacagtgagaagattccaggcctcttaaagactaggcctggaatgagtgtcactttcactgcattctgttggtaaaagtgagtcacagtaccagcccaaatttaaggagaagtgaaattggttccacctctgaaaaggaggagataaatgcatataatggttgttggcaatttttggaaacaatacatcaccatggaaaagtctgaaaggagacggagattataagtcgtaagatcaaatgagacgtcagaatatttcaaactgaggagctcttaagagagcttctggtccatcgacattgtttttcacatgagaaaactcaagcccagagagaaaaacatgacctatttaagatcatacatctgctttgtacatagtatcccaggtacagtaatcccaaatcagctagtgtttttcagactacatttctgctccctctttatgtaacaaaatgtaatctattcttgaatttccctctttctttcaacattttcaagctaacatttcaatgaaatataactcatttccagggaacctcatgggtttcttacgcctgtagaagaataagtaaatggagcaccatcttaggaaaccaagacagaaattgggctctggctatgttttatttctagtgtctttttcccaaatagattcatgttgtgccattttatgttattcttactctgtcaagagaatgagttgtttgaatttgaatgcctcatatattctgtaaattacaaatagcaacatttggctatactattttgaccttttcgacaacgtataattttcagggtatgccattgcacgtctcttgtttacggcctcagtgaactgtggaaaagaggtggcgtggccatcaagtcaaaatatacaatactgagaaggtcaaaataatgtatcataagactatttttcaaagcaaggattaaaattaggataaatctgtcttattactcccttccccctcccatcatacacgcacaagcaaatgtgatttaaaagactgtgcataagatgatgcagaaattaataatataatggctaaagttgtactattttttttacttcattttgagaaggaattatactacgtataggcagactctagatccaccttacaaataggtttgatagtgctacatttatcaatcctactcttgaaactttctcagggatctcagggatctctgattatctctaattatccaaaattttaactgcaaatttaattttaatttattttgatgttaatattgaaaaaccacttagcatatgcttaggagaggaatggtttatatccagaaatcaaaataattgtagggtttaaactttaccaaagttaaaaatcattacctatttcagtggctttctccttttagtagtggagccatgtctacaaaagcaaattaaaaccaaagccctatatgaaaacacattgaggggaaacagctttagcgaaggagaaaatccctaatgagatccccatcctattaggccccagccactgcaatagatctcctaaagctctgcagagtggcttttgaaaacctctgttccattgcaatgtatagctgcctaaaagagcaactgaccctctaccaagtaaacctttgttattttgtcccaaggaagaatgaaacccaggatctccctgagcacaaaagagagttattattattattatttaaaatttcttctaaacccactatagcaaccttgacaatactaggcccatgggttagattccattcagtacttcagtctacttacaaacctcactcttcaatattgggatccttttaagagatcatattgctaaaattagcataaataactggtttcggaaacagtaaccaaagctcatggccataagttatagatgtatggatagattattcaaatcacttagccttaatcattaaattctttccctttttatcaaatcaatacataactgtttgaatttcacattgcctccatactgctacttgaatatcataaggtttacctcaagtagttaatatttgccagctctgaaaaaaaaatagtcctcaggtgatgcacttaaggcatcagaagttggaaagaacagttgtgaagccacccacagaaggcccttcagaagctggcagaaaagaaaaaaaaaatgaaagcttttttttttttcctgatgacttctgaaaaggaagaaatgtgaacttatccattcctctctatgttcaacactgggagccttatgcattgatcaagcattgacatttacagattcattctcaaagcagtgggggaagtattgaccagtaactatgaattaaatcacagtaaaaccacagaaaaataattagcaaattaccttcttaaagcaaagaatacttccctaagtgtcaggagacaaacaataagatccctgcttgtcacaaagagggttggtgatactggcaagtaatttacctctgtaactcagctttttctttctaatccataaaatagggattcattcatttaacagatatttattgaccacttgatatgtgttaggcacaattctaggcattggaggtatagcatttagaaagactgataaagtttgccctcacagaccttacattttacttgagagacaattattaccacaaacaaatatataaaatgttcacggactctaataaagttctatgaagaaaaagctaaattatatgatagaaaataactgggtgaggctatttcatataagatcatcagagaacatcttactaaagacatcacattgaggctgagaactagggtaggaatgagccaacattggaaaaagcttgaggaacttacgagaaaggtcgactttcattggccaataaggccaatattacagactaggacaaatgtgggcataaacttgagagaagatgattggcctttataacaactggacccatgaaattggcttcattggtagcctctggctaccagaaaataaacagaagcttaccacgagttaaaatgttttaaaatttaaaaattatgttcagtttcataaggcaagagatgttaagtgcatatatgtatgctaggtccttcccatagtgagcattgagcaagtaaccagtgaaaaacattgcaaaggggagatcaatgattagatgtaggttgtagccacagaatagaccaattggactattatccacttgaccttattagcactggtctctaaaagcaaccaaaactaggtggcaaaaaccttagggtagtgtttccctctaatccagcaagacacacttagaagcaagagttttattatcaactaaatttaggaaagggcttacaccctctcttcatcttagacatttatattgaatgttggtccatccaaatctctgcagccaggcatggtggttcatgcctgtaatcctagcattttgggaggccaagatggaggatcatttaaggccaggagttggagaacagtttgggcaaattagtaagacccctatctctacaaaaaaaaataaataaataaaattagcttggtgtcatgatgtgtacctgtagtttcagctacttgggaggctgaggaggggaatgcttaagcccaggagtttgaggctgcagtcagctgtgatggtgccactctagcctgggtgacagaatgagaccctgtctctaaaaaaatttaaatttaaatttaaaacagcctccgcaatatcatataataaagaaactggttgaacattgtttaattcatcatttctgtatttcaacatggaatactttacatggtaatgtgtatgtgtgtgtgtgtgtgtacatgtgcttgtgtatatgtgtctgtaggggtggcatgcatgtatgtatgtactgtatccatgtttgttatattcaccaacatctcactgagcacactgtatgaaaagctaggtatgagttttggtaatgtgtgtgaaaaccaaatggattctgtctttggtagcactgaactttaccccatgtggtggatacagtaatgcctcctcaaaaaatgtccacagtctaatccctggaacctgtgagtatatcaccttcacggcaaaggtgaattaacattgcagctggaattaccttgtgttatctgagtgggcatggattataagggtacttaaaagtgaaagagagaggcagaagaataggtcagagtgatatgatgtcatgtcagaaggactgaacttactgatgctgactttgaagatggtggaaggggtcactagccaaggattgtggcagctaccggaagctggataaaacaagaaaacagattgttacctagagtatcgagaaagggatacagtcctgccaacacttgattttcgccccagacttgtgacgtacagaactgtgaaacaataaacttgtgttgttttgccacaaactttgtgataacttgcacagcaatagataactaatagacttcatcttatgagtaggaatgcactgcactgaaagaggaaccaacaccatatagagagtccatttagtggattactttgttgatatgacaaaggaaatgtagtttcctcagctacattgactgagatacactagtgaagttgaccactcacatttacattatgaatgcaaatcaagatctaactaagctttattaggcaggcaaatcatttcacttatcaggattttcatattttttactgattctgtttaaccagctcttatgattcgagaaaaggtcattggtcatgttgacataacaattttcctatcacatcagttttggagctccacaaggacatcataagtatgaataatgtctatttttactcatttcatttctgcagcaagtattcttgggtcctgcttcttgaaagctggaaggaattttctaggaagtctctttcctgtaggctattttgtgctgtcctatatatatatacaaaaagagctcttatagacctagccccagtatgacatgtactttgagtttttttctagccacaaagaattttctctgatttacccacccacccacatgtgtcctctccataataaatagctggcatttcattggtcagcataagatgacagactgggacaatgactttggccatggaccagaaagaagctgaatggcctttataacaactggacccgtgaacttggcctcattagtagccagatgaactaagaggaaaaacaaatatttctactttaactttgagaatgactgtcttagcatcttctagttagcacaatattgagcaggagactatctctcccatttatcaaacatcttgaaataaacaccaagtggatgagactctgttaatatctaatgctcaactgaatgttttaaaaagaaaatattttgtgttttttaaattgaacacctctctatttatatattaggaactacgtttatacaggtccttttacaagtggttggctccttgagtaatacctaagagagactaaaaacttgagtaagccaaacttaaaatactttgtgtgatacgaatacttaacgactcgaatttcaaactgttaatgtcttttctctctaatttcagtcctctctaatttcagttctctctaatttcacccagaaatatggcatttctgggtgaaaaactgtcacaagcagcttttgtttttatggattattaatatgttccaattgaacaataattaaaataggtattgtaattggacacaggcccttcaactctcctccggggtttcttattgaactctggtcagtggtgagaactagctctagaatctattggtgaattctgttccaacagagctggctctctgagtcataagatgacatttctctggtgttttcctgtagataggaaacctttttctatatcttttggaaacatggagaacaaagtggtacttcaactgtggcttttcttttatttgcctcataaaatcccatgaagtattagtaaccatatttcttgaactaaaaattagaatgattacctaaattgtcttttccctaatttgtgaatttatttgtctagaaatcttacaaaggtgtaaaaattaaatcgcattttgttatatatttaacatatcacatttactgaaaagaaaaaattcatgagatgagggcagttcaagaaaaattcaagtaataagagtaattaattcttcaaaggagtgtcagacaatatctgcaaataattacgagagaaataatccagcaatgccagatttctttttctgtataataacatatagtcaaaagaaccagatgactatatatatttttatactttaagttctggggtacaagtgcagaacatgcagttttttttacataggtatacatgtgccatggtggtttgctgcacacatcaacccatcacctacattaggtatttctcctaatgctacccctcccctaggcccccaacccccaacatgccctggtgtgtgatgttccttccctgcatccatgtgttctcattgttcaactcccacttacgagtgagatcatgcagcatttggttttctgttcttgtgatagtttgctgggaatcatgatttccagcttgatccatgtccctgcaaaggacatgaactcatccttttttatggctgcatagtattccatggtgtatatgtgccacattttctttatccagtctatcattgatggacatttgggttggttccaagtctttgctattgtgaataatgccgcaataaacatacgtgtgcatgtgtctttatagtagaattatttataatcctttgggtatatacccagtaatgggattgctgggtcaaatggtatttctagttctagatccttgaggaattgccacactgtcttccacaatgattgaactaatttacactcccaccaacagcataaaagcgttcctatttctccacatcctctctagcatctgttgtttcctgactttttaatgatcggcattctaactggcgtgagatggtacctcattgtagttttgatttgcatttctctaacgaccagtgatgatgagcagtttttcatatgtttgttggctgtataaatgtcttcttttgagaagtgtctgttcatatcttttgcccagtttttgatggggttgtttgtttttttcttgtaaatttgtataagttctttgtagattcaggatattagccctttgtcagatggatagattgcaaaaattttatctcattctatgggctgcctgttcactctgatactagtttcttttgctgtgcagaagctttttagtttaattagatcccatttgtcaattttggcttttgttgtcattgcttttggtgttttagacatgaaatatttgcccgtgcctatgtcctgaatggtatttcctaggttttcttctaggatttttatggttttaagtcttacgtttaagtcttcaatccatcttgagttgattttcgtacaaggtgtaatgaaggggtcttgtttcagttttctgcaaactaatttagtttttctatcaaatcatgtgaaatggcagcagaatggggaaggcttgtgttcactaagtacaagtctgtgtgttgtcagaaaaatgatgagtcaaaaacagcctgcttttaacaaatgtcagtctactattaatgggtattttctaagaaaaattggtgtctggctaattttctaccttcagtgtttggccaactaaccaaagactgtctcactagattacaacctgaaaagctacctatcccagtttcagatttacaagcaataagcgttggaaccctgatgttgagtttatcaagtacaggagaagcagcatgatccaatgtaatctagacatgggtggggcatcaagaaactgcatgtttctcaccctgctgaatcttcagcaagttgccacatccttctgtgtcttagtttatacttttaccaaatgggggcaggaggaatgcctgttagggcatggctaaaaacaagcaaacaaacaaaacaaaacaaaaaataaaaaactaaaaccttatatgtggtagaatactttgaagcagatacaacaaaagtccagagacatagactgttatttataaataagcattacgttacaactcacgatactaagtgtagctaagatatatgagcagaaatttcccagaggtatacaggtagcccaagaagcaaaagcggacagtaaaaggaggcacatgaggagaaactactgtggcccagtgggatggagacagcaacaaagggaagcaaagagttaatagaggttttgctttacagttctacttaaccaactttctaaggaccagcagcatcagtaagccactgtaaacaaaggttctactttctttaatttgtttaaaacattaacttttgtcagccttcagggctgatccagctagatcaaatcaattgaatcagggttgaaaaggggagctgagagaggaaaaaaaacaacaaaaaacattaaaacaggaataaaggtggtgcgtaagaagaactttgtaaattgtctagcactatgaacatgtcaggaagaaaataaatagtaatgataataatgctactcctaggctctgatcacagagtttcttttctttagggacatccatgagtttgtagccatttccatcttcacagcccctgggaagtcagagaggaagtgtgttcactgatcacaacatctatttgctgaagacagaaccacagaccaagacttttctgataaggtcaaaagacactcatactacagttcttaatcatctggcaatcacagatccttttgagaatctaatggtaactaaagaaactctgtagataaaataaaatccataaactgaaaactgcatgtaatttcgggtgattcatgatatcttgaatctcaggctgcaaacctgtttatcactgccctatgctcatatcttcttatatgctaatttcccagcttcaccattgaggaggaggatcagtgaagatactaaagttttgtactttttttttctgacatagacacttagaccttaaaaaaaaaatttaccaactgtcaggtcagggattggcaacataggacacaactggaatgcaactgatgataagtgttttgggagctcactgggggctaaagtggttgaggaattttcagtgagtctcaaggatctgagctgggctcctaatatttgaatcagaagagatggaagacaatactttctcattttattacataagactatcttgactaggcaaagataggggtgtggtgggaaagaaaaccacgaacctgtgactagggagtgttgagggtggaacagctatgacctgaatcccttgacatctgctttgtggctttgcagcaggaaaatagatctagattatgagtaaaattaaaagagaaaatactgtataaacctgtaagaagtgcacctttatccttgtgacttgcttcaatatgtaatgagaagattctgggctgtgcttgaattcacagaaaatttattcctgaagaagttgtatggctgtcagaagggtttagaagtttgtaaggtgcaaaaatgggtttctgagagaagaacaaaggcaacaagtcaggagaaggaaggagaaggggatatgaataaataaaagaccagctcaaacatttccttttgaatgtataattcagtctctggaaacagctggttgtgatggttttccccagccaaccatgttttcaccaggtgcatattgttttcttagacagcaaataaacctgcacagcagtaattcagcaaaaaggaactttattcttcttgcattggacagggaattttcatttaatccatcattctgaacttgctgcactgttttaaaaagtcacagcaagttattcagggttgcctttgacagcagcctcaaaacacagggaagaatttgcccatgattacaagatggcatgacatctggagaaatcaggtgtcatccaggtattgggtatccaggatgtcaaacacgtggatgcaatgaactacttttagaaggtcagtgaaagcacctgcttagaaatggtttggttgaccttttcagtttgcatatatatttttgtgcaggtcacatccctaataaatgaaaatctctttgaaaacagaatccatttgataccccactataccaattagagtgtcatgcacataggagacaacaaataaatacaagagtgagtggtgatatttaggacagactttgaaacaatcattcctacagtcactaaaacactttttatcacctactgtgtgccagccacatgccttgggttacacaaataaatttcatagacgttttttgcaaggagctcacatccaagtagatgatacagacaaataaataaagtgcatagtgagtaactgtgtgataaggatgtgcactgtcctaaacgattttagaggaggagcagctaacttggattggaggactgaacaggagtgaaggcagagatcagatgttgtgggactagctaggatagtattagtaagaaacttaaaatcaggccccagattttgagaacagggtgtgtttccactagatgcaaggatatgttgtgtaagtttatagaaatcaaaagacaggtgtgttttgaaaggcaatgttgccagtaattaagtaggcattatttgttcctttattgactccaaggtaccacactaagtggaatggagtagataatcaacatgaagtgtccacagatcattctctcaagaaactcactgtctagtgttagtagaaaagacaatcatacaaataacaattagatatgctactgtaaacacagtgatgaagtttttccctaatttcaaatttatgtatgcagctccttactggatgtttaaacttggtggtcctgctagtatctctagttcaagtatagtcaaaattctcatggctagcactcagaacctcccaaaatctcattgaacattgctactactcttttcaggcatttattcattctataatgcaaatttgaatgcttgctgttttctgcacttgctctatcatttcacaccaatgtgtctgtgttcatcctgtttcctctattaggacaccttttctaccatttctacatatccaaatcctatcccagacttcaaggaaccactaaaaagccaggacatttctgattcccactctgtcattcaaaaaaaacaaaaacaaaaacaaacaaacctggaagtgactgctacttcactcgagctttcatagcatttttttctgtacttctctcatactagaaagacaaatttgggtctcattcatacagagataacaactgaaaccttacactaaaattaaattgctaaaaggcaagatagagagatataacagaagaatcaaagtcagaggttaggaaaacacacttagggggttgaggagaaaaggagccagggaagaggacagatagatagcaaagaactgaaaaataaagaacaaggagaaagggatgcctaatggtgatgaataaggcagaaacatcaagaaagagaaatgcacaaataatgaatatctgttgaatgaatgaaataatgaagaaggaatgaacaagtgaaagaagtcatgaatggagaggccattggatttatcggataggaggtctttggtggggaaagagtgttgacttggagaaattttgagggtagaagaaaatatagagaattagaatctgaacatatagactagactcctgggtcttctactgtgtagctttaagcaaataacctctatgaaactctttttctgttctaaaaatgagagaaacacctacaattacctccttcacctatatcctggggataagaatacaagcaaaagaccctagcaaaaataaagtgctatacaaatgtaaaatagtataattagcaacatttaaaagagctccacaaatgagaaggcattcaatcatcagtccaaagaaatattagtaacaatgagtttgcagagatccagtttacagatgtcatgacttgctgtgcatctgctggaattgagctcagtaccaggtatcattatgtattggattttgttttcagctagtatcccattagacagctttgcagcatatcttgctttagaaactcaattattacatttagtaaaagaagaaaagagatttatcttctgcgagtctctttaggattggtgtagcttttctcaccactacttgtagaaatcatagtcatagaaccaaagtgtttcagaccagcatttctcagcttccaggttaccatatactaatgacacatttcaagtacttggttactagtaaaaagttgtaagtagattcaagtataaccctatgataacatcatccactggcttatatttttatctaaattcttgaatgggagagaaaggttagtatgtcaggaatcatttataacttgccttacctatgctaccacccaagcatctatacaactttcaccatgagtgccctggtagaaaaaagataaagaatcaactgtatcttcagagatcatctagtcttatactatcatttataggtgaggaaagtaaggcccagaaaaagggagggattttcccaagaacccacaagtagttagaagcaggggcagagttggaacacagatcttctcatcctagtccaaagtcctttccaccatataaccttttctcaaagtgtgtgaatgtgcaaggtgctatacacacatacacatattcatgtatgcatatatacacgtgtatattggggaataatcaaataaatctagaccataaaagatcctataccatcctcttgaagattctgtcaagaagtctccccagatatctccaacacaacttgtagataagacaaagcagagtttattgcttcaccacctcctcgaagctttgacagtgcttcagaggggggatggtaagaatataatttattaagaattggaaatttgatgtaaggcaggtgtttcagtgcagggtctggactgggattgggtggcaatcatgataaaatagctcaggactgatggaagcagcaaagtgaggattttgaagggtggattcaaagaatcttagggctcaagcagtctgtgaacactctccattgaagagttgatgggtcttttgggaatctcctgtaatgagcaatgaaaccattggtttgggtaggacagtttgggaagagtaaagaaacgctaatgaaagcagggaaatagcaaagtcatgttagtatagacactaaggtatggttttggttctcagtgtccaggctgagtgtagaagttgacaatgtggggactcaattcacaatgtatattaaagccttagagaagtcctatattagttacatttgtttaactctatttaactcaggcattttcaacacctatctgactacagaaccctattttttactttaaacacagtctgaaaaactctgcattctattttgttctctttataagaggtagttctttggaacctattcagaagttgatcagttgtgaattatctaaaaacattaaatggaagctaccaaacattaaattggaagctacccaacgacagtagctgttctgatgactgccctaactagtctgacaaggctcttttgattgtatgctatgtaagtgttacttgacctgataagaacggctcaagttgtgaagcttttagttgagaacccattaatcccattagtgctgcaagaattaagtgttgggaatggatcattccaattaccttcctatcactttatacccagagtaatctttctttgtatctatattgcttatacctaatttgtcaataaactggtgccatcatttgcattttgagatacacatactcaggtgattttcaaatatttcttttctgctatgttttaaaatactttttgaaattgtttttcaaagcattttaattacgacttatcatagattaatcacctgtcaaatttaatttataaaaatgagatcattttaagttctgtcagctgcataagaaaactatcccaagccttaattcctttttatccagttttaaactacacagtcaagactgtgaatttttcctcttcttgacttaaaattgtgccatatatttttttcttcttcaagcaaccgtttatggcccacccaatttcaaaaattcttcatttatatatagatagtgagttaccaagtcatgcagaactttaactgagaaaagacttaatgagtccaaaggtaattgtgtatgcataaatgaattaaagggaaactcacaagtcagggatatggctgtgatacgtggcttgctaaaactgcaactgcttatactcctccattagattagatttagttgatttcatgatgttaagccagatattttttctattatagctatttttacacctgatcttagccaaaaggcttagaagcaatattatagctatttctttctttctttttttttttttttttttttttttttttgtgagacagagtcttgctatggcgcccaggctggagtgcagtgccgcgattttggcactgcaagctccacctccttggttcacgccattctcctgcctcagcctcccgagtagctgggactacaggcgcctgccaccaagcccggctaattttttttttttttttgtatttttagtagagacggggtttcaccgtgtgaaccaggatggtcacgatctcctgacctcgtgatctgcctgcctcagcctgccaaagtgctgagattacaggcatgagccaccgcgcccggcctgctatagctatttctaagaacatggggattcaagtttggggcatctgaattttgcaagctgcattaaatgggtcatgtactcacatggggatctggagagaaaaacaacaacagtgacaatgaaatgagatcagggtaaaacaaatagattgtgacttttattaatgtcattttcaagcaatctctaagtaaaattatatgacaccaagacattcagagaaaacagccagtcatctgatgtttagatatatgtgataaagctacacttgtcttggtgattgatatggtttggctctgttttcccacccaaatttcaccatgaattttaataatccccatgtttcatgggagggacctggtgagaggtaattgaatcatgggggcttccccctttgtttggcacttctctctcctgccaccatgtgaagaaggacatgtgtgctttcccttccaccatgattgtacatttcctgaggcttccccagccctgcggaactgtgagtcatttaaacctctgtcctttataaattacctagtcttgggcagttctttataccagtatgagaatggactaataccgtgatgtaaataatccttaccgccaagaaacataagagaccctgtctgtataactactacccactggtccacagaatacatacatggcttgggaaaattttattaaatctattttaatttttaatgttttctggcattatgaaccagcaattccatatatattattttggttgatcctctcaataactctgtcacttggttgttacatacagccttccctaacatatattaaagcagatgtcaataatttggtacacgttgagccatcagtgaattttaattgaatccaaccctggacctcaagagttggaggctttattctgtgactatggtaagcttataggcagcattatcaaacttttaccctttggaattatttagtttgagggaggtgatttgacataaagtatatctgcatcaatataatgataaatttcatggctatgttagtacttttatgtatcagcacagctaagaaaaaaatcacattttatttagttatcagaatgaatttcctgtatgagatctatcatctagatgttgagaaccatgtatcaatgaaatttagccccatctgggatttgtcattatttagaaacaagtaaaatgacatgcttgtgcatgtacattattgtaacatttaaagttgagaccagtaattacattcctgtagtttcaaacccaccccagcttctttgatactttctctgcctacatagggacctataaagatttcaagttgttctgtgacttggtgtctagttcagtggttctaaattttggctacacattataatcaatggggagctttaaaaggtattcttgacttgatcttacatccataggttctgatgtaattggtttggaatataacctggacatcaggatattttaaaagtttacgtattttatttctagtgtgaaggcaaagttaagaaccatgatcttgttgatttacctgctggtacaatgctgcccatggtatctcagtgcttcttcaataatcagtatcctgtttgggaaacattccccagaggttttcaatgactgggtccctgaaacttatttctctcatatcaatcaccttcctacttggattcctaccaattttttgttcttaaaactcaatcacttgcttcatctgaccctgcttggctagaaacagcaggacttagaatctgattctttgttttccagtctgctattttccagaataccatatcttttcaccatgttctaatctctgtctttgaccaaatctagggttctaactagactttcagtcctgatcttgtttagtcttccccaacctaccacttaaaacttcatgtacaacatcagtatctagatgattgtggattgcttttttcttattccacaaatattttggcatcctgcttctaaaaatgattagcatggtagttagcattgcaagttctgttagtgtgtctgaattgaaatcctggttccaccatttactagttttgtgaccttggatcacataagtaacctctctcagcctcagttttcacatctataaaatggaggtaaagatgataatttttagggctatgagcattaagtgaaataattcctgtagcatgtttttcacagagcctggtacatactaagtgttcaaatccacattagaaacacatctgtgtttaaataataataaatttggcaggtaataattggtatttgttttaaaatcaacaaacaatgatttgacaattgaaacaaattgtttcatccatcccatttgctattcatacaccagacctcctcatatttacatatcttttgaacagtgaatttgccttggaaatactaaatttcttcagagaaaagtctataggggtccaccactgatgcataagaaggccattgcgtttgatatcatagataaacgctaggatacatattttataattgctttattgccaggagttttcaatgaagccataaaagaaaaaaaaatgatcagcctaattgcctcgagatggatatgtaatgcataagtctcttgttaaatggatctagtaataggccacctgtttcccctgcctcctacccagttcagtatatgaatgaacagtgctttctgaaatgagcaaaccaagacttttaagtgcagttatgttgtaatttaatgacagctcatctcaggtttgaatcttacctaatcagataattctagagtttaagaacagatttgtatcttgcttatcatttttattgcacagtcattgagatatcctctaggtagaagttctcggctcaaaggcctcacttaaaagatgagcaagaaatagaggaaaggagatataggtaggcaggtgctggggcatttggttgatttattcaagaccaaattcatggtatgttaccataactgaatttaatattcggtcaagctgctcatcattcatttcccaccatttgacttcattattcaatctatcacaacatttgaagtctgcaatacatgatattatccaaaataagtataaattaagtctaaatgagcctagccactttgtacatgtcagagatttaggctccaataattcagaatttgtgacgactcatattactctgaaaaaagctgggggtgcagttattctcggcagattaacaggtttagcagatataggaaggtgtgtttaagctacttaaaacacatcattttcaagcacctaagaacttatttactgcaaatactagatatgataattacaaaacatcatgactagcctaatgaaacctgtcactgtgtttacagtgaagatgtttttttgaggatgttgttcattatttgctctacaaaaacctatggaatatatattttcttctggtctcattattttaaaatgttgcacttaccaggaaaagagacaatattaattagagatttaaatgtggtttttttaatcaggactacctgtggttaaattccaattctgtcacttcctggctatgtggcctttggcaagtcagttacttaccttctatgaatgtcagttttttcacctgtaaattgagggtaaagtagtccctgtggtgagaatccagtgaatttatatatgaaaagtgcttagaaatatgcctgaaacacttgataaatgcttagcaaatattagctgtaatagtatcatgagttttttccttgtaattagtttatttttttccaaataaacattctaggatattttcttgttgctgctagtttgggttcacattgtgacccacttgatacaagggcaaagactttatcacttgcatgttgtgattctctcttatgcttctattatttttaattttatttgattttgttaattgtctgaatgtatcaatcctttttagagtaagggatatattagtcaaccaaacaaatgatacaatataaggcaaaactagtttagtttcagctgctatgaaggatcaaaggtaaaaatagttcatttcaaaatatgttgtttttcagatttttttctgatttaaattagcgttttctcattactctgaattggtaaaaaaaaaatctaaccttttagtataaggctttgaaaatatacagaaaaacaaaaagaataatataatgaatgtccaaatatctagtacctagattgtacaactgtgaacattttgccgtgtttactccctctttatttttccagatttacgttaaggtaattacaaataacatgatgtttcacccctaaatacttcagcgtttatgtctaaaagatagcaacattttcttttgtaatcacagtattaattaaggataatgactcatttcactctttatataaatgattggcacagatatgggtatatgtgcttggtgcatctttgtgagttgactagtcagttaattacttgatgcagttttattgtatttgcttagttcttccccctggagcacaaaagatagaaaacacttctctccttctcttattccctcttccctgcctcttcccaagttagcaagagggaaaagaatataaggaaattaatttcctctactttgtaaactcatacaagttgcccctgtcccatggcaccctgcatctgcaggcaagttaataactttctttctctactggcaaaaactgctgactttactcctctcacaaaaggtagataatgtttgttagacattttgagattcatacatggaagctgcactttatactcaaagctttcttaatcccacagttgaaatggattgtattaatagtaattaaaataactactgtatcaactctatcagcagctgtggttctaaaagaagtaatattaaatactagccccaatcttttctcaattttcccacagagtaactttatctgtttcctttgtgttttcttatttttcatagttttagaaaatgtttaataattctgaatatgatatgtaacttccttgaatttttatcaggtatgatcagtgtgttgcccatttaaggcttggctattgtttttaagaaatacatgatttaatcacctcaatctcctctgggagaactcagattaaaactctgccattgagaagatcagacttgtcaaattgttttaccatacagaaaatgcacctaattatttaataacagctttcatcaacatttctcccaatttgttcttccttgattgtgttctcccatgtatcaaagatcaaatcttgagtcaaatatttaatattgaacaaagcatcacatttagaaatagtatgaattccatcatgcctagacaagcactgttcctgtgttggtggttattgacaggactgctgtcactgtttgctattatgggcttcattaatgctgccaggaaaaaaggactctggcattttggcagttactctttgccaggctctaaatttaattttcttctaagctttacaacttggctacacagaaattttaggagtgcgattagacatcttggctgttgatttagtcataaatgaaaaatacactaagttgtctttgtattgtctggttctttttctggtttagtgctttctgggcaggagacatgtatttcgtgtatatcaaagtttgatgcaaaataataatgtttacattttatactatggattatcttgaatgaatttctggatttgattaccataataacaataaggttgagcaagatgtattaggttcattttacagataaggaagctaagaaaattattattttaattttctaagttcacaaagtccaggaagaaaactctcttgaattctggacaagtgcaatatgctgcctcctagtctgtttaacgtggttattctattaacgagaatttgacaaagagcacctaaccacaatccaaaagactagtttctagagtgagttgtaagaattgaatgaatgaatgacagaagacataatttaaaataagattgatcagtagccattatttgtaagatggtacaattgaatggacctatatttctaggtctctactatttatgtctctatgtgaatcagtgtctctaccaagtaaataatggccagttgtggatcataagtcacaaatgtggcttgctcctcaaagcctacaggataaaaaggacatgcagtatatgtgagagtgtgttgtgtgtgtgtgtgtgtgtgtgtgtgtgtgtgtgtttcctttccgaaatagtttagggattttaatgttgttgttgttttaccaaaagttacccttagggcaactatggtacaatttgtgtgccaaggatatgaaatcaataattgagtcttgccccatgctatgattattgaaacagaattgatttgtgtatttccaaatactgtatatgagatatcgacctttgaatcatttttttaccactaaatacatggcaaattggtagcagtggttctagtgaaaaatcagaacacctcaagaagatagatatctttaggtgacagtggcaggactttctggtcctctcccttaaaatgtatcaagtagtatctttgtgaccctgccacctttccttcctctttccttctacaagcctccctttgcccaccatcttctctgattacacttgatttaacaagaactcctaccactgattcaaatggaaaatatgcagaactgctgcccagaaagcaggcatgtaggagaatcctcttggacgccactggtctcattcattgctaatgatagcctgcaagggctatcaatcatttcagggaatacccatgtcataggatacaggaattacagaagcaaaggggtgaatttataccattgaaaatgtgcaaatcaatacttgtgagtttccaacaatggatttggtagtggccattgtaaaagtattctaagattgataataacaatataagtgttctgaatttgaatagcacttttccccttgtcagtgtacttttttatctgttatctcatttaatccctacaacagccccataaagtaaacatggcaaggaggtattatcaccccttatttgacccatgagaaaactcaaataaaatgacaagttaatgatagaacttggactagaatttagagcatttgactccaagctatttatctagccatccagccattcctttcttccttcaaatatatcagcttcagtcccagaatattagatgcctttaggtgagactgaatatttttaaagatttttattttatttttcacaacattattttatttggaaaaattttaaacccacagaataattgcaagaaaattacaatgaacacttatatgccttttacctagattaaccagttgttaacattataccacatttgtactatgtctacatacacgggtatgtctgtatttttttctaaaccacttgagagtctgttgcagatatgataattcacccctaaattagttagcatgtgtttcataagaatcaagaccttctcctacataaccaaaatataactatcatgttcaaaaagtttaacattgataagatactatgtctaacacatatactatattgaaattttcccaattatcccagtgatatccttaataatatttttctgatccggaatccaagcaaagatcatgcattccatttattttcacattatattttcatgttgcctttaattagaacagtttccaagcccttttattttatttgtacttattttttccagctttattgaggacaattaacaaataaaaatttgtataaattcaaggtaatttaagtttattttaaattgatttcatgacattgacatttttgaaataaccagactagttattgtgtaaaattatcttcaatttgaattcatctgtttgctcataattagattcacattatacatttttgacaggaatatgatttgggtgatcctgtgtctttttcagtgaggcacatgatttctgttttttccttttattggttattcttagtttgactatttgcttaatgagatatctgacagattaaatcactataaaagcatttttttatcctttataaataaaattaataatctgttggcaatgctttgagactatttgaatactctgttcctcaaaatatttcactgatgcttctttccagaaccagtgattatgatgatggttgcaacctggtcattttaaactcattccacacatataagttggtattcttatatgaaaaggaattaccccctccttcattagtattactatagactcctagactctttctttttcatcaaatgtgtccattttgaaatgtacaaatcttaagtgtacagctcagtgaattattaccattttaaccattttaagtatacaattcagtggcattaaaaacattcacatttttgtgcaaccatcactaccatccatctctagaatttttcttcccaaactgaaactgtaccaattaaacagtaaagcttcattccgcctgtctctattccatggaaaccaccattctactttctatctttatactttttgacaattctagatatggaaccatacaacatgtccttttgtggctgattttacttaggatgtcttcaaggttcatccacattgcagcatgtgtgagaatttccttcccttttaaggctgaattgtgtggatataccacatattgtttatccattcattcttcagtggacacttggaatgcttccatgttttagctatggtaaatagtgctgctatgaacatggaaagctgttatgaacattggtgtgcaaatatctattctagtccctgcttttaattctcttgggtatatacatgaaaatggaatgggggaacatatggtacatatatatttattttttgaagaaccacttaactgttttccacagtggctgaactgttataatccttaccagcaatgcacatgggtgccaatttattcacatcctcacaaatacttgttatttacttttttaaatttttgttcctaatggtaagaatgtgtatgaagtgggtgtgtcattgtgattttgctttccatttatctaattattagtgatgttaagcatcttttcatgtgattattggccatttgtataccttctttgtagaaatatctattcaactcctttctccattttattttttatttatatttatttacttttaattttttaatttttaatttttgtgtggatacatagtaggtgtatacatctatggggtacatgagatgctttgatacaggaatgtaatatgtaataatcacatcatggataatgggttgtccatttcctcaagcatttatcctttgtgtcataaacaatttatttacactcttagatattttaaaatatacaattaagttattgactatagtcaccttgttatgctatcatatagtaggtcttattcattctttctatcttttgtacacattagccatcccttcccccccgcccccaccccactacccttcccagcctctggtaactatccttgtactctctatgtacatgagtgcaattgcttgaatttttagatcccacaaataagtgagaacatgggatgtttgtcgttctgtgtctggcttatttcacttaacataatgatattcagttccatccatgttgttacaaatgacaggatctcattctttttgatggctgaatagttctctattgtttatatgtaccatattttctttatccattcatctgttgatggatacttcttccaaatcttagctattgtgaacagtgctgcaacaagcacgggagtgcagatatctcttcaatatactggtttcctttcttttgagtttattcccagcagtgggattgctggatcatatggtagcttgagttttagttttttgaggtgcctaatttacgttaccaccaacactgtatgagggttcccttttctccaaatcattgccaacatttcctattatctgtattttggatataagccattttaactggggtcagatgacatctcattgcagttttgatttgcatttctctgataatcaatgatgttgagcaccttttcatatacctgttttccatttgtatgtcttcttttgagtaatgtccattcaaatattctgcccattttttgattgaattaataggtttttccccatagaattgtttgagctccctgtatattttggttattaatcccttgccagatgggtagcatgtaaatattttctcccattctatgggttgtctcttcactttgttggttatattttttttggccatgcagaagctttttaacttgatgtgatcccacttgtccatttttgcattggttgcctgtgcttgtggggtattgctcaagaaatttttaactataccaatgtcctggtgatttttcccaattttttcttgaagtagtttcatagtttgaggtcttagatttaaatacttaatccattttgattttatttttgtatatggtgacagatagggatctaatttcattctcctacatatggatatccagttttcccagcacgatttattgaagacactggcttttccccagtgtttgttcttggcatcttttccagcaacaggttcactgtaggtgtctagattgctttctgggttctctattctgttccattggacaatgtgtctgtttttgtgccagtaccatgctgtttgggtgactatagctctgtagtataatttaaagacaggtatgtgattcctccagttttttgaaattcctccattagttgttgaacactttcttactttctggaacacagtgtttcagactcactgtgtactctacttgtctcagccctggaaggagctctggctcattttagtggaaaacagtattttgaaaccatgggatatgggcaacagctttgctcattgctaatttggtgtcattgattctagactttttcagcaggtaaatgagtttatattgatacttctaaatctaatctaacaccacaatttgtttctctcttcctgcattttatatttgcacctcccttcacccaaagtgtgaaccctgaatctctaaagcaccaatatatctaattgttcactcctacatatagacaaaacagttttggaatttctgtacccataccaatatcaacaacaaactgtttaaagttaaaattttattatcatttacctttatccttagaatatactcacagagtatgttgtttaaaatttactttgattttttttttcatttgtggggttatctatttgatgtacagttagatatatgagtttctgattgtattcaattttaaagtttcccccattttttaaatgtatgtatttaaatatgtaaaataacataatttaaaaaatcaatactttgtaaaatagtaaattcagaaaagttttatacctttccttatccctttcacctcatgcctgtctacttcctttatataaacaatttcatttatttctctgccttactattgctttgttacattttgaaaaaaataaacatgtgttacatatttttccaatttcttactttttgtttcatgaaaggtattacaaggtatttcatatatacatacacctctagatatacatatatatattagattaattcttttttgtacccttttaaatttgctaccaggtgcggtggctcacacctgtaatcccagcactttgggaggccgaggcgggtggatcacgaggtcaggatttcgagaccagcctggccaatatggtgaaactccatctctactaaaaatacaaaaattagccaggcgtggtggtgcgtgcctgtagtcccagctacttgggaggctgaggcagaagaattgcttgaacctgggaggcggaggttgcagtgagcagagagcatgccactgcactccagcctgggcgacagcgcaagactccatctcaaaaaaataaaaaaataaaaaataaataaatttgccaatatttctgggaaatcaccacagataaattcatggagaacctaattgtttaaatttttattttgaaatcattatagatttatagaaggttgcaaagaaatgtataagaaagtcctatgtaccctttccccagcctcctctaaggttaatatcttacacaaccacagtacaatataaatcccaggaaatttgacattggaacaatccgcagaattattctgactttaccagttgtgtgtgtaccatttgtgttcatgtgtgtgcagcttttgccattttatcacatgtatagccttgtgtaactaccaccacaatcaaggtattcaactatagcatcaacacgaggctccctcaaagaccctctttatagccatactcatcttctccttcactatccctaatccgtgacaaccactgttatgttctttgtatctataattatttgacaaatgttacatacatggagtcacacagtatgtatacctttgagataagatttttttcactcagaaaattttttgaggtttatctaaattgttgcatatattaatagtttgttcctttttgttactgagcagtattctgtggaatggatgtgctacagtttatttaaccattcacccactggaagacatttaggtagtttctggttttcagccaaaaagaataaagctgctatgacaagttcctccatcctcattcatttttacagccacatagaacttcattgtgcagttttcctatgtatagagatatagattatggctaacattttgttattagtaaaaattattcagtgatcatttgtttatatgtatttttgtattatcaaagatataccttcaaagtaaattcccaaaagtgaaagtgttgggtcggaataaacatgtatttagtttttcagctatttcagtggcgtgctaaagctgactcatactggctttcaaaattcaattgttacactcttaggaattttgcaagctggttgttatacataaccattagtaagaattaaatcacataaacttacaatttaaaaatttatatttctaattaaggtaatgccaaaaagcagaaagaatgaataatacttagtaattgatagcataagggggtcattatagtcaaaataatttaactgtatattttaaaataactaaaagagtattattgtattgtttaagacaaaggataaatgcttgagtggatggatacctcattttctatgatgtaattgttacacattgcatgcctgtatcaaaatatctcatgtacctcataaatatatacacccaccatgtaccccacaaaaattaaaaataaaaaaatacccaaaatttttgaaaaaatgggaagaatcacgctactgaactttaagacttactctacagcaatagttatcaagacggtgttgtattggcaaagggatacatagatcaattaacggagtcaaaagtctggaaatagactatataattatggctagctgatttttgataaaagtgcaaaggcaattctatgtagaaaggataatatttttcacatatggccttgggacagttggacatccatatgcaaaaaacaacaacaataaaaaatgaaccttgacctaaacctcataccttatacagtagttaattcaaaatggatcatagacctaaatataaaaacaaaaacataaaagtgtcaaaattttagaagaaacataggagaaaatattcatgacctgggaataggcaaagagttcttaaacatgccatcagaagcacaatctataaaaggaaaaatagacaagttgacgtcatcaaaattcatgtttgctctgcaaaagacactgttaagagaataaaaggacaggctataaactgtatgaaaatattcacaaatcacatcccacaaaggactttatccagaaagacttctcagaattcaacaataagaaaacgacataaagaaggcataaagaagagttcaatatgttcactataattagccatcagggaaatgcacattaaagtgatcgcgagacccacgactcacctagtagaatggcaagactgaaaaagaaaactgacaatactgagtgctagtgagaatgcagcaggactagaaccctcatttattgcagatggacatgcaaaatgttacagccattctggaaaaaagtttggcagattctcttaaagttaaacatacacttgtcataggactctaccatcccactgtgaggtatttactgtagagaaataaaaccttaggttcacacataaacacacatgaatgttcatagcagctctattcataatctccgaaaactggaaatgtccttcaacaggtgaatggataaataaaccatggtacatccatactacttggcaacgaaaaggagcaaaatatagaaacaagcaacaacctgcattcatcttataggcactagactgagtgaaagaagccagtctcaaaaagttatgtacttccatttccacggcattctcaaaaatataaattgatggtgataaaaagcagacaagccactgccagaggttaggagtgaggggagggtgtgactacaaagcagtagcatgaaggaatgtttttaaggtgatagaactcttcttatcctgattgtggtggtggttatgctaatttttatgtgttaaaattcatacaactttacaccaaaaaaggcagcttactgtattttaattcagtaaattaaaaaatttacagtaaattaaaaattcacttaatttaaaaacaaaattaaaaaatacaaaaccctaaaaagatcagtgtagaatagtaatagctaccaatatatagttctttttttacaaatatatagttctgataagaacttaatatgtgaggtttttaaataaaaatatttcccttattataaaaacatgttcattataaaaaattaaaccagtttcccagagataaccactgctgttatcttggtgaatataacttcagacctctatcttgccttgttttcagaaagaatggcattctgtacttataatctgggaatctgctttttcatgttacaatatgtcattaaatagtcttcttaaaataataaaagttacaaaattaaggtaagaaataaaatcattacttcttaattctttttatctacatttttctattatctgttttcttgaagttattaatgttaattgattttatatggtaaaaaaaaaaaaaaaggaaaaaacctatacaatagtgtgctaatgtgcatctcttcccaaaatgtgttcagtgacttcaccttcgtagcttgaaattggccatggtggtactatttcacaaagaaaatcagtaaatgccacacatcaggactttttgggtgtggttttgattttttcttttctggagaaccagttgtcaaacatttaccagcacaacatagtacatttttaaattccccttgaaggaatcatattattttgcactcttaccagcaacacatgagagtttctatttcaccacagcctcagcaacagtgtattagcaaacttttaagtgttttcaaactgatgtatgaaaaatcatatttcagtgcagttttgatttgcatttatcttataagtaaagttgtacatcttttttaacatatgtaaggagtaactgcatatatttttaaactatctgttcatgtgtttcacctatttttctaacacagttttgatcttttattttccctgtattttgaagagtatagatctatatatattagggatattagcccttttatgatacacgttgcaaataacatttttgtttatcatgttgtgactttttgctttgcttatggtagattttttttgccatgtagaaatttttaggcagtcaaatgtatcaatcttttattgcatctaaagtttgaatcatagttagaaggtcttttcctttagagaatgaatatttttaacaagcctctctcatatgattttatttgggaacaatagatcaaacaaatgcagttaaacagacattaggtgcctattatttgtagaatgctctggtgaatacacagacaagagctggtgtatctatctttcatttccaggaacccataatttaatggggaacgttgacctatacatggcttttctgaaccttctgctaatcacagctgactggcttctgtttcaattaaggtctcaaaactaaaataggaatgaaacactacccagtaattctactatattcctctttaggctcaccttccgacttataaaaatgattattctatatgttttctttcctcatccaagtttttctacctttgcttatatctgattaccatacctcatcaaataagcagtgtatgtttagaagtatgaacattcaatcaatactgcttgagtgtgaattccagctcaactacctaccagcagtaggacctttagcaaatttctcaacctttatgtgtttcagtttcttaatttgtaaaatggagataatagcatttacctgatagttttgagtaaattttgtgtatgtgtatgtgtaatgggtgacaaataataagtagttttaagtgttttctatcatcatcatcattgtcatctagaaactcctctatctccctgtcctcaaatctacaatcctatctttatctgcatacatattcttcccctttcttacagtttccaaaggagggtatatccatctccccttttattaaaggaaaacccttcatctactcacaatttgcatcctctttctcctcttcaaaaattgtgcctcttcagttagcttctcccttttctgcaatgctaattttcccttcttttttttttttttttttttttgagacggagtctggctctgtcgcccaggctggagtgcagtggcgcaatctcggctcactgcaagctccgcctcctgggttcacgccattctcctgcctcagtctcccgagtagctgggactacgggcacccgccaccacgcccggctaattttttgtatttttagtagagacagggtttcaccgtgttaaccaggatgatctcgatctcctgacctcgtgatctgcccacctcggcctcccaaagtgctgggattacaggcatgagccactgcgcccggccaattttcccttgtttattggatcattcccatcaacattaacctgccttagtattttccagtcacccattttataaaaagaaaaaaaaaacctttctgttacttttctaatacattttacagaaagacacaaactttctacaaccacatctactgcaatgatcactccacttctctgctgaaaagaaaatttgaaaggcaagttcattttaagatatattcacattaccttctttcctttgtgagcttccatttacccttcaaacctcttcaggctgatttcattttcctgaacttaactgaaaatattgcagataaagttaacaacaacttccatgatgggaagtcctagccagagtaatcaggcaagagaaagaaatactaggcgccgaaataggaaaagaagaagtgaaactctctctcttcactgacaatataattttattcccagaaaaccctaaagactccaccaaaagacttctggaactgataaacagcttcagtaaactttcagaatacaaaatcaatgtacaaaaatcagtagcattactacacaccaataatgttgaagttgagagccaaatcaagaactcaatcccatttacaatatccataaaaagaataaaatacctaggaatacagataaccaaggaggtgaaagatctctataagaactacagaacactgctgaaaaaaaatcagagatgacacaaacaaatggaaaaatattccatgctcatggactggaagaatcattatcattaaaacagccatactccccagagcaaagtacagatgcagtgctattcctatcaaactaccaatgttatttttcacagaaaaatgttccaaaattcatatggaaccaaaaaagagcccaaacatccaaagcaatcctaaacaaaaagaacaaaccctgaggcgtcacattacctgacttcaaactatactgtatggctacagtaacaaaaataggatggtataggtacaaaaacagacccatagaccaatgcaacagaatagagaacccagaaaatcatactgacagcatctgatattcgacaaagtagacaaaaataagcaatggggaaaggacctcttattcaataaatggcgctgggatagctggctagccacatacagaagaatgaaactggataccttccttacaccatatacaaaaattaactcaagatggattaaagatttaaatttaagaccttaaacagtaagaatcgtagaagaaaacctaggaaataccattctggacataggtcctggcaaagattttatgacaaaggttccaaaagcaattgcaacaaaaccaaaaattgacaagtggtatctaattaaactaaagagctctgcacagcaaaagaaactattaacagtaaacagaaaatctacacaatgggagaaaatatttgcaaactatacctctgaaaaagttctaatatccagaatgtgtgatgaacttaaacaattgtacaagcaaaaaacaaaaaatcccattaaaaagtggacaaaagacatgaacagacacttctcaaaagaagacacacaagcagtcaacaaacatgaaaacatgctcagcatcactaatcattagagaaatgcaaatcaaaaccacaataccactgtgagataccatctcacactagtcagaatggctattattatagtcattctgccagccaaaaaacaacagatgctggcaaggccacagagaaaagggaatgcttatatactgttagttggaatgtaaattaatttagccactgtggaaagcaattttgaatttctcaataaacttaaaacagaactaccatttgacccagcaatcctgttatcaggtatatattcaaaagaaaataaatcattctaccaaaaagacacatgcactcataggtaatcacagcattatttacaatagcaatgacatggaatccacctaggtgcctatcaacagtggatcgaataaataaaatgtggcatatatacgccatggaatagtatgcagccataaagaatgaaatcatgtcatttgcagcaacattgatgcagctggaggccattatcctaagtgaaagcaggagcagaaaaccaattactgcatgttctcacaagtgggagctgaatattgggtactcgtggacataaagatggcaagaatagacactggggactactagagggaagagggagattctctctctaagcaatctcatgtagtcccatgactttgattatcattttattccattgattccaaaatatttttctccacctcattctgctccgttgaatttctgactcatatctaactgcccactaacatcttcattttgtgtataaataggtatctcaaaataaaaattaaactccttacctttgcttttccaaatctacctcctacatgagtagtctgcttcttggaatatatatatatatatataatataaatatattagttatataatatatacatatattatatatgatatataatacatacatatattatatatgatatataatacatacatatattatatatgatatataatacatacatatattatatatgatatataatatatacatatattatatatgatatataaatatagattatatgttagattatatatatatatataaaatcagccctcttttcttcatatatattgccatttgcttagtcaggtcaccatcatctcttgcttgaactagggcaatagcttcctacctggtcttgattcaacattcctatacctagtttacccaaagagcaatagaaatggttgtttaaaaatgtaaatcaaatcatattactctgctgcttaaaagtcttaagtggatttctactgaacttggagaaaaagctgaagtatttaccatgtcccacaaagcgtaagtggatgaacagaggagcgagaagttaattatggctggaggagagtcaggaacatttgatggaagagatggcacttgaggtggacttttaagggtaggttagatttgtatatttggagataaggagagtaagtggaaaagtacagatagattatccttgaagaaaaggagagtaagtggaaaagtacagattgtctttgaagaaaagaatgtgatccagtgcagtttggagaatgaggcatatgacatgcttagggaaaggtaaatctggacaaagtagttggggcagattgtagagagcattgaatactgagctgtgtcctagcctgagaagaggagggatgtaagagattatcaaatcctcctttctgcttcctcctgaaatttctcttgggtctgcccctactttgcattccccacttcctcttccctggttctagcccaagttacctcttgcctggacgattaaacaacctcctaattagtcttttctttcccttcccttctctcaacctttttctacaccagcttaatctttctaaagcacagctctgatcacaccatatccttctccaaaaaccttcagtcattctgttacccacaggatgaaatccaaactttatagtagggtagttcaagccactatcattcccaccacccccacaccaggaaatttaacctgcgtttgctgtctttgtatcctttagctccctcttgatgagtcatacctccctgcacactctttcctctgcacatccactgattcttctttctctttgccgttgtacattcagttgcctcctcttgtactactttcacccagcttcatatctctccaactggacatgtctcaatgctgcacagttccaccatcttctctaccaagcttcaatgcttttccacctgctcaagttgttagtaatttctctcctctgaatttccgtaatattgtatctgtacttctcttgtggagagcattgtaagagagcattgtattagccactgaggatagaaaggtgaataacacacagctttatactattttatatatgatgctacatttaaagatcaataatgtagggctgtgtggcacaatcaataactgtagactgtgtgacacagcctgttgtagtcagccagactagttatctctcttcaaagaacgtagaataaacccccctcttggcttctatggaaaacagactatacaaattgctttcaatgtttagttttaagaagctagactatataccatctctataccaccaataacactgtgaaaatctctttgcagttttttgtcctttcttcccctttcccagaggtgtagtggaagagaaagggtgggatcactaacatttgtttaacatttcctatttgtcatttaatcctcacaacaatcctataaaatagattctcttttttttttattttttatattttttatttatttatttatttatttatttatttatttatttaatttattattttttttttttgagacggagtctcgctctgtcgcccaggctggagtgcagtggcgggatctcggctcactgcaagctccgcctcccgggttcacgccataaaatagattctcttatatgcctcttttataaatgaggtaactgaagcatagagtgagtagagaactcaggatttaaattcaatctaggaattggagaagttgagattaaaatgcatgcaatctggctccatagtatcctctatttaactactatactacactacataactaccactgtttaatgaaataagtatattagttcactggggagagaaacatcttcagacttctgagaagaatttgtaacactgctctctctgtaagtaaatactgcccttttatagaaccatggcacagtagctccttttgtatatatgtttccaaggaagtggcctggcatcttatctcatgtaaaacctgtgaaaactcacctataaagttcaatcagtcaattaactactaaatcttgagtacatactgtatggcccagccctgtaagaaaccagagaaaataaatatggtcatttaaaaatatctacaactcaaaagcagtgcatcaaataggttgaaaaagtatttaaatgattcctatggagttggagaataaatctgaatatgaatgctgcttgtttttccctatacctcacacagtggcttcctcatccattcatagaacattggagtggtgaaatgcactgaatgtgagatacaatgaggtcctttacaagttcttttctagatggcattggttttcacataacctggagggctggctgaggctgtgaacttttctgcataatcagcctgagacatctgaagccaagaaagaccacagcagtgacagaacacctactgtgagttaagcaaagaatgggagattaacttttacacatgtctatagttcattttgagtgaatttttgtgcttcttgtggtaccttaatcaaaaattcactaaacataaatgtaaaggtttatttctggactctcatttctgttccattaaatctatgttttttcttgtgataatgccacactagggctttatagtaagttttgaaatcagaaagtgtgagtcctccaaaagtattctttttcaagattgttttggctattctgggtctctttcatttccgtataaattttagaatagacatgtcaatttctattaaaaagctcactgggattttgataaaggttgcgttgactttttaaatcattttggggaaaattgccattttgaaaatgttgagtcttctaattcatgagcatggagtgtgtttccatttgtatatattttctttaatttctctcaacaacattttgtagttttctaagtcatgtactacttttgatagatttatacctgagtattttattcttttgataatattatgaatggaattgttttcttaattttaattttggcttattcattgctattatttagatatacatttttctgtatattaatttttgcatcttacaacttaaaatgtatttattagttatagatatttttgtagattccatatctctttttagatttgtttatttgcagatgaaagacaaatttacctcttccttttcaatctgaatgtcttaagttttttccttctttctttcttttgattcttctctttttttttctttcttcttattgccttagctaggatctcttgtacagtgttcaatagaagtggcgaaagcagacaactttgcactgttctgtatctcagagtcagtatggttactggctgcatggtgtaccttttcagatccttttatattcaatctatttatgtctttgcatctaaggtgtcactcttgtaaacagcagatcattctatcttgcttttaaaaaacctaatatgataatatctgccttttaatttgggaatttagctaattcatgtttaagataatttctgatttggttggattaacatttcttattttactgtttttttatatgtctccttcctctttctttctttcttttttgattgttgtttctgtttcccttcactgcattcttttcagttaaatattttttgtgtgtgcaccaatttaattcccctgtagatatttagctaatttttagttattttcttaatggttgctctagggattacaatatgaatcttaattaacgagaacctccttcagattaatactaacataatttcagaaaaatatagcaatttagcaacagtaagttctccctcttttttgtattgttgctgtcatatatattgtatctatatatgaccaacctagaaatgctgtgttgtaattattgcttcatgtaatcttaatctttaaaaaaagtatagagtgttttattattaacctacgtatttaccttttccgttgctctacatttcttcccgtagttctggatctggtgtcatttcctttcagcattgaaggtcttcctttagtatttcttagaaggtagatttgctaacagcaaattctctcagtctttattaatctgggaacatccttatttagccttcatttttgaaggatagtttcactggatatagaattctgttttggtagttttgtaatgaaatgcaggtccagatgcttaccacttgcagagtgcaattaacaagagcaacatctggtagaaagaaagtgactattaaccaaaactagtaaacgggaagtagccagattcttatccaaattaatcactttgattttttgtgggagaggcaggggttttaaaaggaaaactttttaaggaagccatgcgagaattgggctgagtgcaatgtctatgtgtcttcttctgttggctaatttttttcttttatcgctttgaatatgtaattctagccttcattgtttattatgaagtcagccttaattatattgatgctcacctatatgttatgagtttttttctttctcttgttgcttttaagattttctctttgtattttgttttcagtgattggcttatgatatatctagatgtggattcctttttcttcaaagtgcaggctgtgcagactttactttcttctgggccctttcacatcttatcaaaatctgcttctgagaagtatgttaccatgtgtgcagcctcagggtttgccagaagtgtgtagctagcttgggcctccattccagagttatgtttatcccaaccatgactgcagcctctagttagtaaagctgttagattttcttactcaccttgtgtccaagatgatcacttccactgacaacacggttgggcatgggtgttgccagtgctcacttttccaaatcaggtgagccccctttgatagtggcagaacagcttccagttctcacggccttccacaccctaataaaatttatgccttggctgagatggggttgggggcgcagtgggaaagaataagaatggaagaagcaataccacagattcctactgcttttcatgtggtatttgttgaatgtaaagataatgatctaattaacatagtagtttacatttattccttcattcgggtaatttcttcagaacctaatatgtaccatctttcgatctaatatcccaagtaacattattcatacatcctcgagaattccatatttatttaggaaaacagacatgcaaataaacacaaacaatacaatgagatcattaaaatggagagaaggaggaaggaaaataagaaaggtatcactaggggttcctgctgtttaaagaaatcctatggtgatggtgatttttttaaagaaaataataatcaccacctattaatatatctatgggacaagtacagaattgggtgggcataatgggagggaggaatctggatgaattgtagtatatctaggaggatctgctgaaaactacaggtttgttgcctgacctttgaaggaggaaagactttagttatggcaaaaagaggagaaacatgccccatgagtaatggaattcatctttatcagatgcctagttatcgctagttacaaactacgtttgctatatattcataagattttcaaattatttgaagtctaacacccaatataatgagcaggattatactctcaccacttctattttctgaaatatattagttgattattgtcagtgaagttgaacgtatggtcctaaaatggctttaaatgattttatacattttctcttttattattatccatctgatactttgaaagaggcagcatacggcagttaattttctcctccagtccctcgtgcacaataataaaacaattcaaagcagtgcatatttcagctgccttttatagatgaattatacctcctgcagtctgtacatgaagacatagaacaggccatgaggcagattttagcataaatgttattttgcttgctaggaaggatttagagaatgtatttaaaataatgtgagctttaagtacaaatcaaatgctgaaatgcatctttaattcggaaatgtatagtaaatccaaacaaatgggtgaataacctctatcgtacatttttaatacaaagggacttgttagccatttcaaatgtcatttgagtgtttgaaaaagatgtgaattacaatcatagattctgaagattaaaagagccatttaagatcacctagtaaacccctttacttgttactagaagacccactacagcatcccctaattcagctgttactatctaaccaactttccaaaaatatagggcttaaaacatccagcacagttttgctcatgattctgtgggtcaccaatttgggccaagcttagctaggcagttcttctggattcacctgggctcactcatgtgactgcagtgatttggtggctctaccatcgagtaattgtctaatctgggctcattcatatgtcctgtggctagtactgactgttggctgcatcccttcccaagtggttctcattctcaaagaggttatttcaaacttcagatggtgggactgtgtttcaagagagggcaagtttcaatgtgcacatactttgtaagtctctacttgtcatgtttgttaatatctctttgcaaaacaaatcgcatgaccaagcctagcttcaagatggagaaacagattctatctcttgatgagagaagtggaaaagtcacaatgcatgcaaggatagggaaaatttgtggctattaagtaatctgtcacattctgttattgtggctatccatcttttgtttgaacatctctgatgaaaagaagtttagtgccttctaaattagcctattttatcagagttcaactctggcttctggtaacttgcattcattggtgacagtttttcatccaagcacacagctgtctacctggctagccagcaaacaagcacctactatgttaagcaccaaatagcatagaaaaacatagtgaataaaacagatgtgatccttgctgtcatgaaattcataatttactgtagggagacagacaataaataagaaaacaaacaaatacattttgaatatatatatattgaaattatatatatatgccttgaaggagtcaagggaaccatgaacacttataccaggaacatccaaactagtctggaggaggtaggtcagggaatgcttacttgaagaagtggcataaagattagacaggtgaagagtgaggaaaagaacatttcaggcagagtaaacagcatagacaaaagccttgaggtggaaagaactttatttgttccaagccagtatagctggagcaaagtgaacaaagtggaaggcattataaaatagtgttggagaaataggcagcaaaaagattgtgtaaggccttctggagttttgtcattttatttcttgaagtcatagagagcaaatccaaatccctctttgatgtgatagcagtataggatgtagctaagactgtaggctctggaatcagagcacctggataagtatccacactctaccacttactgtttgatctcggtcctgcttcttcataggtaaagtggggataataattgctacttcataggttgctatgtgagttatatagaataacatatgtaaatggattaacacggtcttagacacatagtaaatggcaaataaatggtagctattagcattatcaatcttttttacgtctcttcaccttattgtatcattcttttccaaatatattctaaacatatgggttttaactgagcgtcctcttttgatgatccagaatgattcaaatatgttgttaggaagatcatccataaattcaacttgagtttttcatgccgttatgtaaaataaactcaatgccttagatttggtcctttctgtgtatggtaaacacgcagttagtgtgctgtcttccaaatcccagtatgaagtatcatattatttatttcctgatgtgcacagatgaggtgtgtgtatgtgtatatgtgtttatcactaattgaatcatagtccccaagttaatagcaatgactggaatatttttatctgtcatatggcagttattctttcagcaacaaagattaattctttaaatgacccaatttgttatgaaatttgttatatgtcattattcttaaatcaacaagttgttaggaattatagaaaccttaaccttcatctaatttttccccctcatttccctgttgctgtgggcagagagatgtgctgcccagaaacctcttaaaggtagaacttgttggaccgtatatggaatgttgtgagcagacagcctcctgttgtcacctcccttcacggtttgtcttggctacagagaactgttgtacccatgggcttatccttcctatccaatgactaagtgtaatggtggtatagaggcccatccatctgagtccaatatgaaatgtgctgatgagccatatatactctagaactccatatgtggtttatctgcatggtagtttttctcaacttgttcactcctgctccctcccactacctttcataggtataaacatcctaaaaacccaggatgccaaatttcttcacagtatctactccacagaacctaacctgcaacatttcttaactcccgaagcccagaattactcagagacctgaacctagaatccgtctctaattctaaatcttaggctgcagtcattccggccaacttctttattaaatctttcttcataggttcagttttccatttcttcaattatttttattgcttttctagatgcttccctaaaatgtgggattctcttagtttccaaagtttgtgaaacttgccaggctttatactgagatatatttatatgttaggagtgattactgggtgtgggaatggcactgctttacaaagcaaaggctttttcactgcaccttctttccaggagataggacccgagaactctgaaattgccattaataaagagggagaggcaggtgaataggcagtagtcaggaagatgagcagataattccctggggtctgccttcctgagtgtcctccaccacaattagcttagccgttataaattccctcatgtcttatgttctgtattgtcacctggatcttcttcagtgtaatcttttctcagtgccacttattaaaaatgctgactttcaaagagctcaataaatttttttaaacatcccctgactcaataaaaagggatggaattgaacactaagtctatattccactgtctatctcccaagagtgttgagataaactatgaaataaatctttctgtcccatccaggtcatttcactagctttaatattatttacagccctatccatacaatccctgtcccttaccctgaagtcatcagtgtgttctctttctttttgttgcaaactcacagagtctttcaaactgaaaatagctgatgcctctagtactgataatgaaagaaatactcctctggttgcttgtaggtcgtttcccaaaatggaatgtaatttcaatgagcagaaaagagattttttaaatgcagatatggtcacagggcatactaaattgtcaaagattctaagagttagtatttaccatgggacaaaatgtctgggaggatataccacaaagagtggttgtctctataatgggattacagataatttttatttggcatcaccatattctatatattaaacatatcaattttgtgataaattttatactaaaagaagtaacatatgcattctagaaaaccctcatactacatttccatacatacataaatacatacatacatacatatgtgactaacatgattcagtatacttttcacattccgaaaccagagtgaagccagatgaaattaagtggcatgctgtccaggtttttacagtgaatagtggtagaacaggtctataataatttttctcctgatacccagcctaatgttctttctacaactctaaggtagttttaaagggcagcggagaaattgcctgaaggaagatttttactcaaaatttcaggatcccattatgtcttgaacatacttaccattaaaagtatcactgatgctaatggaatggaagagaatccatgcactttaccaaaaaaaaaaaaaacaacaacaacaaaaaaaacacattagtacccagtcttcacatacgcctcattcctttataatgaaggtaaatgaggcctttaactttaagaacctcagatgttccattcttgataagaacgattttattaaacttatgatgttatttttctttcacctgtggacatttcagtagaacaacttcccacccctagctgcctccatgtctctcaaagcagcagcctgaaaaaatctattcaggagctaatataaatttttattaaatgtacttaaaaatattgataaggcatataaagcagaatgttcagtgaatgttaaataagcaagaatttagtcctataaagtatataaagctgctgggctgcaaataaaaatgaccacaatgcagcaagaaagtgataaacattataagttatcttccccctaattatccaggttacatttcattaatatgcaatgaaaaatgttaactctcctgggctaaagcatagggaaatagtaaattagaagatttccctttggatgccaggagcggtggctcacgcctgtaatcccagcactttgggaggccgaggcgggcggatcacaaggtcaggagatcgagaccatcctggctaacacggtgaaaccccgtctctactaaaaatacaaaaaaattagctgggcgtggtggcgggcgcctgcagtcccagctactcgcgaggctgaggcaggagaatggcatgaacctgggaggcggagcttgtagtgagccgagatcgcgccactgcactccagcctgggcgacagagccagactccatttcaaaaaaaaaaaaaaaagatttccctttggagacaagattttgattccctatacttaactctcttgtaatatttatcattctgaatggcaaaaatcagcttatgtgtattttccttcattgtaccatgaaaagatgaaagatagtagattctagtttctctctaatttaatgcttaacaaactgcctggctcatagtaggcatttaataaatatatgttaagtcgtattcttaaacgtataacaagcatttcttggtaactaaccacacttgcattttccccaccaaaattataccttgtggcagagagagtctaattacacatcaaactctgttccctttttgcgttcgcaaatctagaatacacataactagaatgcactcttgagtctcccttaaacttaggtgtggccatatgactaatttttggccagtggaatgtgagtggaaatgatgtaagctacttccaggcatgacacataaaaacctcccacctaatcctgtcctctctgtcttcctccatctgctggctatatgctgaatcccagagtattcttggaacccatatgctgaaggtggcacagcctgggtctctgaataagtgcgaaatgcatttctattgtgttaagccgttgagatttcatgttttaacagctaccacagatacagttactttaacagatacgtgtctataatacttaatatcaacatattattgcacttgttcaataacaaaaaaaatttcaattacagttcacacaatttatttggaacatcatttaatttaaaagtcattttaagtttaaattgtgttaagtattctttatactctaataagttttattttccaatatcatattatcataatgctttgatatatgccaaattgttttctgaaaagttaacagtaagaaaaaaattgtaagaagaagttttaactagaatttcctagtagattttcctagactgtctgtggcagagcttagtgaataagtgatctttagctattgtgtgaaaaggaactctcactcaatctagagtctccttagagagggaataaaccatagtggggtggttgtaaagatagaaaaaatagataatcatagaaaaacatggcccaaaggattatgagtgactgcatgtttcaggagtttctttgtgattagttggcagcggctttgaagcagagagccatctatattaggccccagaaaccacctgaaggagggcatgttgggatctgcagtaagcaatcaagaggaaactcactaggacaactaacactgggaaaaggagaaagtagctaaaaggaattttaactctacaagtacaaatgactgacttagagtgggctgagctaatgcccagtgcttttttaaagttatgtattttcttcctggtatataaaagaaagtccaattaatcaaggtgattagtaatcactgtgtgtttaaatagcaaacgtagacaacatttgtctctaggtatatatatttattttaaaattaccttacatgatatctttacttaaattaagagttcagttaattaatatttatgctattatcttaataatttatttttataaaacaaaacgtttcatgtacagtatagagaaattcatttttttattgctctcttagtcttgaatacttgtagcagccccaaccagatggtttatattccataacccaaggtaccactgattacttgggggcaagatttggaaattttaggcttagtgcctaagggcaaataagcttatttttcctcaataggactgaccttacaaatctaactctgtaattgtacaggtcctttcccaattttgaaaagcattatcttcaacattgagccacccaaccaggacccctagcctaagataccacagtcattctgagtccagtcttaatagttgatacaacatgtctggtgttatgtcttacctctcctctttgtaacacattacttggagctgccccacactccagggcctattcatatttctgtaatctgtgccccactccatagggccctgccctacatcagatggcctatttctaaggaatcctgaaactcctccacaggacagtttgtactatataatgtgttctctcctcaagagtatttacattttaaccaaggattctagaaatacaatgcccctgcaggcaaggaaacttatttatccctctggctactataaaatttttctttttgctttttgcttataattttgattacaataatttttaatttatataattttgcttataattttgattataatatatcttggtgtggtattctttgtggttattctacatgggattcactgactctcaaatttgtgtttgatgcttttaatcaaatttggaaaactttaagccaatatgtcttcacataatttttcagtgttcccaccctccacatttttggagcttcaatgacatgtatattaagctgctggatattgttccacgggtcgctgataatctgtttaatttttttcagcttttttttcctcaatatctttcagttgtgatagtctgtattactcaatcttaaagttcattgttctcttcttctgccatattgaaatttatattgaccatccagtgaatttttaatcttttaaggtctagatatatttaatttttatatcttctatttatgtatctgttatgttcatattttcccttaaatccttgaacatagttataatagctgtttggaagttcttacatgataattctgtcatctctatcagatttctacatctgtttctattgactgattttttttcctaggtaagcatgacatttattactaagcatagacccttctacattctctactcattgccctgggcattcaaggaggcctctccactctggatgatcataactcaaacattttcaagccttgtgtaaagctttggggattgctcagtttacagctctctggtagttgtttttttttttttttttcttgccttgtagatttttaccctatgcaagtgcagtttaatattaagacaaagattaaggagtttcccaggcagatttatttctatttctctgagtaacttcgttttctccaccactctgctttgcatatctcaggtacctcagcctccccaaactttaatctctgtctcttcaagtcagcaaggcgaacatgctctatttgggttctcctgcactgctctgaagttcaaaaatgactccaggtggaaagctaaggtaactatcagggttgccttgcttatttcccttctttcagggatcaaagtcctgtgttgtctattgttcagtttgaaaaccattatttcatatctttcatccacttccctagttggttatggtgagagtccagtaccagttactctttcgtggctgtaagtggaagttctaagaagtccttctgaaaggtctcagtcattcctcagagttggcttccccctatgtcttaggataaaaatctagtttcttagcagtctcattttgatcaaagagaattccagacaataattgttccttgttagttgaaatccagataaactccaagtgtcttgcaatgtctttttgtacacaccaacccacatcattctatgaggttacctcagagctttagttttggagaaaagcttttgagattacagcttcaaatgagaggtatgttaggttgtcatcactgggcaactaaacatttgtgagttgtccttttgtctgaaagattattgggagtttcagacagagaacaagacctttttctccccttttaaagagcatgcctcagccctttgtgaacttgaaatgcaggtcttattttattcatctctcatttgcatgttgtgcctttagttgtcagtgatcagtaaaatcatttggacttcagaagcctttgaaaaagtgattaaacaggccaagattatgttagtcatttagtttatccttctttaatccagaggcattatttactgtccactctcaccctaatttaggattgtgccttacatgaaagagctaatgaaataaatgactatcactgtcaaattttgctgtgtcatagggggacagtacgagaagctttgtatacctcctattcccttggcctttctaaaattattttgtaaggcttttgatgcatacttgcaaagttttattttagtaattttattaaatgacttatttacccacaactacttggtagtaccaccatttaatgttattttcccacagggaaactgagatccaagaaataagacatttattcagagtcatccatcaaccacaaaatggaattagaacacaaaactccatcttttgagcctttaagccaaactgcttttttctcctgagattcttcatgaaaataacacagcctatactcaacaccatcataccatccccaacaccatcataccactgtcaataccatcataccatgtaagttgaatataaattactacattgccttagactcccttattacactggttaaatagtagtctctattgataaacactgtggcatacaaaaataattttaagtattaataataatctcaactgtggtttaaaattgaggacacatatgtgactggcttagtaatcagcattttctaggaaaggttctgtttttagttttaatttgctcaccacattttattaatgtttagtggaagatttaccctgttcttttatagatatcaaaaatatgtttgaaataatttagtcagtaactgaatattatagaaacaaatacaaaaaataaactaatataaggaaacatgagacagcaaaaatccttatttactagtaaatcattccttactttagaaaatctggaaaatacacaacatagtggtctgcttcatatggcttttctgctatattgctacaaagcatagggctataaatttccttttgatctctcatatggaaataagtttgtctattgtctggttgtttgaagtcgaaagtcttttcataacattttagaaaagcgaattatatcatactgtgcactatgggttagagaagattcagagagccatcctgcagatgttataactttggatccctctgttcacaatccccctctttctctgcatttctattagtggtgagatgtcatatttctcgaaagattagagaccattgccccaaagtctattaaatgaaataaagagagacacaggaataacacaatgtaatcctagccagtaactttttgtgtgtgtgtggagaatctaaaagaagtaatggtctttgacacaaatattacattctgccacaccctgaaagaaatacctcgaatctacatatttccaaataaaaacaaatgatagtagttttagagggaatgaaagcaagttcttgatacttatgtctccattaattcaaaaattatgtcttgtgagtaccatttaatttgggcaacaaattatactgttccttttcagtcttcatgcaattcactttccttgaaatagaaggggaccaatacaaaaaaatctcccttccttattccatcctggagcacaactccaaacattaacagtaattgcctctacttccatgtcattgaagcttatttaaattgtagctcgatgctgagtaagagggagagtcgccctccccaatccagagacaaaaaattctaattggcaattcatataattttgaatagttcatgacagtagaaaaaaaatgtgttatgttttcataggaaattgctgtgcattctagaaaactgttgacttgctaaaaatctgcactcctttattttgtcatttgtctcagaagttaagaatgaagcacgcataacaccttctttgggatgctttatattttatttaatacatatacttagtaaagggatttgctccttcaaaccggttaaaaaaaaaggcatttgctcattcaaactggtaattctgaatatttaagaactcatagcccaagtatacttgggtatattgaaagacagtatagtgtggtggtaaaatgtggattctggggtcaaactggctagattcaaggcacagttctttctatcacttgttggtcctgtgatcttaggcaagtaatgtgactttttgtgtctcaaaatcttttcgtgtctcaaaatcttttcgtgtaaaatggagataatagtagtacatatctttcagggttgttgtaacaagtaaacacattcaaagtccttagcatgagtggcacataagcgctactcagatgtaagcaatatactagaagtgccccacagcagaaggcacatatctcacaatcttcttttcctactatcttcattcccaaatgttgtttatgtgaagcaacttcttgattgtccagaagggaaggacttcctttagtccactctcatcttttagccccttttgttctttaaggcaaggaccaacttggttaaataattatttttctattctgaattctgtgaccatgtagacactcaataaatatttatctatctgaataaaaaggacaagctcaatttggtttcatgattttccagaaagtgacccaacttttgactcaaactttgtgtactttctaaaatctaaattaaaattttccttgcaaatcaagtaggaagtagttagcagtatctttcagaaattttctaatcatggtcttctatatactgaacacattttacatgtgtaatgagatttgtgtattagtgacatctgctactgcttaatcagctcctaagaataataacaaataatcacacaaaatagatttgggaagtttgtgttttaattaaatctgtttacctcaagttttgttacatttttcattcccttggcatagattccactctatgtcttggtacagttttaatccctgcccagagcagaaatttatctttaatttacattgcctcctctaagcctagggccattgactcagaaagtcttctaatttttattcgtaaaccaacttatttttatcatgttactgagacttttgggtttctagagttcagaaggaaactatttcccaggattatggccagttaattcagatggttggaacatattaatgaggccaatgctgcaggtgtgattctttatgtttttccactaggatagccacaaatgtatacttttgaccaaaagggagattcattgagagtttgtggatttttaatcagaaagccatctctattgctaaacaaacaaaaacatacaataaaataaacccactcatatacatatctgacaagttctgaatcaggagacttaacctttgttatacagtatgaatacctcagacttcctcaggctgtggttacaaataaggtcacattagctgtaaaaatgccaatatcactgtcttcttatttctactcatgttatttccactcacatatttcaagatcattttactctcttcccccaaagtgtcacccagttatataggggaatctctggaggtaccccacatgtgctcacaaacagtattcttatattcatctactttgggcctttgctgatgtcagtccacaagaagacacttgaaactatcacttggctgctgtcactgctgccatgccattttgggggactataatttcttgcttggggtaatcttttattgtactcttcaaagtaacataccttgtaaggagccaaaacaacacgatctttttaggtttcactgtgtcagtgccactctgggtaaaaatggggaggatgccattctgccccctatttatagcattttgtcacctgggcactgaagcagcattgcttgtgtcattgtctttctctattgctcttgtaaaaatagcttctttggcttctgccttcaactttgctctccatagggcttagatcccaatctttgagactgggtggagcaccagacaccgtcttgacctctccatctccctttattgcctcaggaacctttgaaaaaattagacaaaaacctctctcttccttcagccatcatgcaaactaactctaccaatgcaccatagccatcccaacttgcctgaactctagcagtggacataacaaggtgcaagctgagatctttactacacctttaaagaaggtaacctcctcaagggtctgtgtgaagactctgttgttctgagctaggccaacttagaagctcaaataagatatattctatggcaagatttcaagggaacagagagaatactaatgcctacttgtgggcgacatcttgcacccctctctttctttaactgttggctagatgcctggactttactcccaaagatatctcttttcatgtagggtttttatttatttatttatttttgtttagagggagtttcactcttgtcacccaggctgtagtgcagtggcgcaatcttggctcactggaacctctgccacccgggttcaagtgattctcctgactcagactcctgagtagctgggattacaggtgcctgccaccacgcccggctaactttttgtatttctagtagagatggggtttcgccatgttgggcaggctgttcccaaactcctacctcaggtgatccgcccacctcagcctcctcccaaagtgctggaattacaggcatgagtccctgtgcctgcctcatgtaggcttttataaaatttgtaattgacacataataattatacatatttatggagtacggtgacatattgtttatcaacaaatgaatggataaaaacttatatatatataatacatatatattttatatgtacattttatgtatatttaaaaatatgtttatattatatatacactggaatattttatatacatatatgtatatactggaatactattcaaccataaaaagaacaaattcctgtcgttcacagcaatgtgggtgaacatggaggatattacgttatgaaagttagtgcatcataatttgcttgagacaaagaatccatcattcctaaaccaagtcagttttagacattagaaagagattctattctttagaaaaatgtcagtagcagaatgtcttacccataaaatgacccacaacctggactcctagaacagttttggggtattgcagtactctgagagatgggacacacttataccataagttcactgagatgtggatgctaaccattaataaagatgttgccaaaaaattaatgctgacagctcaccttcagaagctagtaagtttccccttcaccttgggagctaggtctaaagtaaagaagcacttgaagaaatctttaaaaaaaaattattagcacctgtctgctgttgaactggcagaaatcttatttgatctatattttctttgaaagcccagacctagacttggtaagtgggtaagaacaggtattacctaagcagccatacatgctgagggccatgtaggctctaaataagtcacagctggtagttatcaaatctaaatgaacgtgagattcccaccagcacagaggaatcaatatttatcaacagaaaaagtgatattcattactgccatttgaaggtcatgcatataaagcatatatgagtaatgccaaacctcagagctgtttcctctcacaattaggtagatacagtgcctatgcttcattttgccactgcacaatagcctggcttattccctgagcaaatgtctaatccctccttgtctcttgacctttgctacaatatatttcttaaaaataatatggctatgcagaaaaaaagcagggaagctttgtggacagtgcagggttttgcatagaaaagggaaatagatttcacaaataccaagtggacaatacccagctaggtacaaagtcaacagaggatctcaggattagagtagaaaacaagctgactgtgaggagtagcacttcagtgttcctgtgatttacaagtagatatgggcaatgaagatacctggaggcacttggcttgaacccttcttgcttcccattcccattatacatagaattgttctgactgtcactgacccgtgttatatatgccttgatgttgattactaaaatggaacaggcaagatttgagagccagagttattgtattaaggtaataaaccacttaacaaatattttatgacctgaaaagaaaatttaaaggaagtaaaattgtaaaaaataaaaaatgcacagaaaatgctgttgcagagcatggtgactttagttaatataatacattacaatataatacattgttatgaaatacattattgtattatatatttcaaaatagctaaaagaatggacttcaaatgttctcaccacagggaaatgataagtatgtgaggtgatagatatattaactagtctgatttgatcattccaaaatgtatacacataccaaaacatcacattgtaccccatatatacaattatttgtgaattgaaaataaacacacacacacacacacacacacacacacacacacatacacacaccacataatatggaatgtcttagggaacttaattacaggtctcatagccagaatgctaggtaagcaggagtttaggcacatacttaagagaagtagtcaagtactgcagtcactcagagggcttgccagaaggcttagcttggctttcagaatgctctgcctagacagaggatcaatagacagtagggaggctcccatactcaagtaataacttccctcaatctgaaagatctgaagttctcctcccactggaatactttacacatagttaattcatccagtcaattaatatatatttagtgcctactttgtttcagattctattctgggtgttggggattatagaaaataaaagttcttgctttcatggaagtactgttctagtggtagaggaagcaagacaaaaataaccaagtacagataaatacacattttgtcagacagtagtaatcgttaagaataaaaatgaagcagggtaaggtaaaagacagtaagggtgatgactactgcttttaaatagggtagtcgtgggagatctctctgagaaggtaacatttgatttttaacaatacacatttattgagcgcctatcatgtgccagccatgtgaattaattcattttatcttcaccaaaatcctgtgaggtaggatcattattatgtttgttttacaaatggggaaattgggcacaagagaagttaacttgtccaaggaaacataactagtaagggaaagagctagagtttgaactcaactagtctagcatcaaatcccatccttgtagtcactataatacttggcatttttgattctgcttacaggcagggagatatgcacattttctctttagtcctgtgaggcactaacagacctatgcaaaaagaagcaatcattgaagcagagttatggaggtacctaacagaaagcccttagaaagggggatgaaatgactaatattcaagtactttctatatgtagctatgttacacatagagtctcatttaattctcccaacaaaaatatgaggtagtcagacagatagttattttgcagatgagaaaactgaggtaacaaagtggttacatgaattgcccaaagtctcatgggaacaaaggaccaatattatgaatttgagttagtctgtcaccaaagtttatgctctttctaatatgctgtgctgtctccagggagaagaaaaagaaagacaaggaaatccagagcaaaatacatggagaaaaaaatgaaaggagagacctcaaagtaaagacttaataggttcagagggccagaggactgatagtggcttaaatggcataaagaactttcaatggcaccttcatcctcaatctattctctgacactaatagtcttagtcgatttgggctgctataacagaaataatgtaaactgaatagctaataaacaacagaaatttctttcttatagttctagaggctgggaagtccaagatcaaggcaccaacagattgtttgggtaggggttgttctctgcttcatagatggtgcattctcacttcatcctcacagggcagaagaggcaaacaagttctctcaggcctattttataaggacactaatcccattcataagggctccatatcctaaaggctcctcctcttaatactattatattgaagattaggtttcaacatgtgaatttgagggggtacataaacatttagaccatagcaccaagttaggtggattcttgagaatttctgtgattttgtgatttcaggaattggcatgtgtagtttttcagtgagacctggtgtttacatgtgaatagcccttgagtagtgcatcatcttcttataactgctactgtctttgaatcagctactacagtaaagcaaggaacataaacttcgtaaagacatgaaagaaaatttatgaaccatttagtatttgaaggctagcatgtagttgtttgataacaaggatttttccccctcagaagcatagtttaaagctgtcagccttaatgaaataactttagatatgccttgcctgccaatttttccctttttaatagtatagtagtaacactgtgggattgtcaaaataatagtctgatgagaagtgttagcaaagaaagccaaatggcgcattgcttgtcttacactgtagcctctgtgtggtgtagaaaagccaggatgtggtcagatcactgtgggatgaggttgactcacccattcattattctggatgagcagaaaatatgcctctcaccccatgcctgctctgccttgccttgcctttccttttcattcccttcctttttcttcccacacatggtcaaaggctttgattttttctgaatattagacaacaaaacaaacaaagcagcaaagacacttacctgttctgtctttaacagagtgtttggtggctccctgcaaagggaagctaagagagacccagggtgggaggctagccagctccgtcatttgtattcttcaggtaactcgtttaaacctccatttttttcagctttaaaaatgctattacagtggctattgtttcattccaactttcaagaattcagtatacatctttgagaactaggtgtttggaaattcactaggtgttgggaaaattggtgttttaaaaggaaaatgtagtcttttttttagaatgctctctagaccatagaaatcattgaaattctcctttggctctatagagccaggagatagtcttataacccaatgtcttttgaaaactgaattacaactggaagttgaatagcaacaaaatattataaataaatttgattttaagggaggttttggcaagtacctaggctttgattacctagaaaccaataaattctattctaccatggattttctaatttttctataagcaactataaggtagatcacctctatgacatctaccaccagtggcccatttgtaaaatatgtgtagtgtcattttaacaataagccttcagagccactgtcttctaggaattctaattacaatttataaccaaagtacaaaataattgagttaactttcagtggactgacaggcaatggtcgcatagctgaatgctattttctccgtatcactttcccacaccgcacctccatctttagccctgtgtacctatgtagtcagtatggacaagcctactcttccatcaaagtctatacttggcaaataatagttaattgaagcacagattctgttgttttgtattgaattggtgccagattctctttccaagacaccactgaccacctgctgtcagcaaaggaaaggaaatggggcaaagaaataaggagaagaaaaggttgtagggtagtcaggagaaaaatgtgattgtggaacatgttccatgagttaagcaatctatggagagtaatttggctggtgaagatcttcagagtgtcatgtcagcttcagaatcagagagttgccgtcctaacttggcttatagtgattcacgaggggatggagggagggggagctagtatgggtgaaggccagatataaggaaaacaaaacaaagtgctttatttacagaaatctcctcagagaaataaaaccattgctaactccacaactggaacatgtgtattcttttcttattggcagcaacccaggaaaagagagagagagaaaaagagagagagaaaaaaagaaagagagagacagtgtgtgtgagagagagtcttacaagagttggtggaagaggactgaaggacttggtttctgagatatttaggagtgtaaatggcaggacttggtaactgatggcatgtgtagcatgaaggagaggaaggagtagaggctgatatccaggtttctgattttgactaatgggcgaatggtattgctggaaatgtatacaccctcccaagccatctgctctatttcttcaccttctttttcttcatcattggctgcccttcgtctcttactcaaataattactcgacaagaagtttgcagagaggtttgtgagatttagcacacaacacattaaggacgtctgaaaacccacacagcctgaggagctgtggcttggagagtgatcgagttgatgtcttcaagtataagaaagatattttgtaggagacttttaaacttttcatttatatctaggcagaagagtaaataagcacatgggataaaattttaataaagaacatttcagtggggcataggaaggcaattttaactgttctagggaaacagactagaatgcaaaactatacagaaactgaggaaatcttcaaggagagatatgacaatcctgagacctgaataatttagacaccaaccagaagggaggggccaggattagatgatacctctgagcatctgttctgcaaatgtccttttgttctgccccagatatccccagaggaactatggtctcattgatctggctgagcagatgcatttagggaaacggtacagcaggtcattgaacttatctaaccctgatggctctagaaatggagatagagatcagaaggaaaaaaattcttattttaattttgaatgtattttttatgtctttaaggccagttcctgttagaaaaagaaatgcatctaagagctagaacttagaacatacttgtttatccatccaagataaaagaagctaccaaagggagtgatacagacagatggcaaaacaatgaatcaaacagtttactaagcatgaatccagagaagtacactccctcaaggctaaggctgtagatttatggggaaagtagcttagatttgaggcccatggactgtgaaaggcatgaatgttctccatactctgacatacaagcagggaggtatttatatacaaacagtacacatatgttaattgctaaaccatagttctagcagagaatcagaataattttaatgaatgattagagatgagccagactattagtggagaattttgtcagatgagtataagaggaccagaggacttccagctacatgaaatagcattttaacaaaggcatagatctgtgattaatgagtcatccattttccctttcttctaaagagtccatttacatttaaattcttaattccattgcaatgtcattctgaattatctggtatcttcgaccataccattatttgtgggtggatctggaagactgatatataaaatcacatttgtcaatttgtcttggattttctggcctggaaaatttacggactttattaaatataatattattggtgccttagaaatttcacatgattttttgcaggaatttttgctaaatatgtctggcctgtggcatttatctagggatttgcagagagttttcttcaaaggaatataaagccctaaaaaggaaaaaaagcccagagagttgccttcatggagtcacttctcttttagtgctttcactcatttattagattttacaaagggtaccttctgccaccaggccccagagcatactaatataatttaaataggagagataattgaactgtcaaaactctatgtgtgtgcatgcaggtgtgtgtgtgtgtgtgtaagacagagatggagacagagtcaaagacgtgaaagacagaggcatacaaataacagccatcaacacagcagccacatcattttatgttagagctgactgctcagaaagaacagtcttgctcaaaaagatcttgagtggtgatactgctcttctttcttcaagcagtatcatcccctatcactacaacttggattttgtgatactctctgcttctcctagatgtaccacataacatggatttattttaaaaatcaggtatgtgaaatatatctctatctatctatctagagttatttcaaaaagaaaagaaaatcagaagacagttaacttccctttactttaacattcttatttagaaaattgtgacacttttagaggtaacggaaagcacccctggtgtagctgatgggaaatgaagggtgtcataaaacccagattaggctgtcctggcaatggggtatgacttatatgtatttgtaacaacactttatgcaatgtatccctgaagcttaacatgttgtaaagattggtggttacttggctccttcggagaaacaaggagagggaattttttgttctttccttgttaaactcttcatcccttttccaatacatctcattgtggaaaatatcaactgggtaagtttcaaatgaggccagttttaattgtggcaattcattgaattctcactttccattaccggattatgtggaatgctggctttaaaaaataagttagctgaatgtaagagtagttgcaacctttcttgaatgcacaaaataattgacatagcatctagagctcttgcagaacatagaccctgatttctggagtaccatcactcacaccagagatacactggcaccatttttattttttatgaaaggtcaaatatcacaccatctcaagaaagtaatgtgtatatacttttttataaatagtaatttattgctgaatggttgccattttacgaatgccgtcccaaatctccacaaattgaattattacatcctgccaacaaaagaaacagccatgcccatatttttagatttaaaagttcattataaagtatggataattaaaccattaccttttatttaattaatgatttatactttcccttaattattactttgattctcacaacaaaccattgtggaatattatgaggcccactgagtttgaatgctgtaggtcacatgtctaatggtaaaattaaaactgtaaccctggtctcatgacttgcagtcttacaccctgttgtagtcaataaggtattcacaactatttcagtttcccttgcagccatatgataggattatacttccctgcccctttaaagttagaggtagtcatatggcttgctttagccattgaaatgtgaacagaagtgactcctgtaatttcttgatgggagcatttaattgccagtgctcagctccagacttttgtttgtctttctgtagtgatatggaagcatatttcaaaatggatcctccctcaacttgggtctttgagtgattaccatagacagagcctccaaaccaatatcctacactgaacatgaaaactatacaagaagtaaacctttgttgttttaagccaatgaaattcacataatttttgttgttatggcataacctagcccattctgacttatagatacactctttctatgggaacaaccagtatattatcatttaagtatgtcttcctcatagcttcatatctgtaaaccttgttcctctggagtcagtaccatttttgcacagccacattagtaatactttgtgaccactctcagactgaagcagtttgaatttggtagctatcctgaaaggagtgtcagtggcctattctgtttcttttttaaattttatttcagtagtttttggagtacaggtagtttttggttacatggataagttctttagtggtgatttctgaaattttggtgtacccttcacctgagcagtgtacactgtacccaacttgtagtcttttatccctcgctcctctcccaccttcccctgagtccccaaagttcattataacattcttatgcctttgcatcctcatagcttagctctcacttataagtgagaacatacaatgtttgcttttccattcctgagttacttcctcagaataatggcctccatctccatccaaatggctgcaaaggccattattttgttccattttatggctaggtaatattccatgatgtatatccactcgttggttaataggcacttaggttggtccatatttttacatttgtgaattgtgctgctataaatacgtatgtgtatgtgactttttcatataatgacttcttttcctttgggtagatacccactagtgggacttctggattgaatggtagttctacttttatttatttaaggaatctccatactgttttccacagtggtttttctagtttacattcccaccagcagtataaagtgttcccttttcaccacatccacaccaacatctattttttgttatttttaaattatcagtggcctattctctttaagtgtagtagtgatagactaatcatagattcaaggcttgaagcaatgtcatgagaccaaccattctacctcccacttttaagcaggttagcactttctattccccctttatacatgtttgcatcagaaaggaagatatttgatatgaaagaggaagattgtgaattgaagtagaggagaagaacatggcagtgatcacaatgccatgcatttggagatggccttgccctattgagcttaagtgcacttcaggtatcatctatgaaagaggaaaagggaggagaatgtgtaggaattggggagggagaatacttatcttcagcaccactttagaaccaaaaattcactctgacaagatagaagtaaatgcaaaacccattctttttccttgattgatcttaccaaatcattcaaatccaaaaatacagaaaagcctatagaaccttagaatcataacctttatagatggaaggagctttagaaatcatgtggtttaattccctatcttatagatgaagaaactgagacccagtaagaagaagagaactggctcagtttatacataaccatctatatttcccagacatatacatatggatatctatttaataaaatcctaaaagtatttcatagccaagtttctaaattataagtctttttgatagcttgaaacataagctaggtcctttttatattgataaatgataatgatgattataaattattccaattagttatgacataggaggttgggctgtgataacaaagaaaactaaatacctagtgtcttaaacaagattgaaacatatatttcccctcatgttagtcaatatgtaagtagtccagagctgatacagtcaatccatgttgtgaaggatctaggctccttctcttcttgtggctccactgtcctctgttgccctcatccacatgagggtaataatctcatattatggttgataatctcatactgtggttgagatatgggtgataatggcttcatatgtgatcccttcttgataataatttatttttacttgacttattcttgaagaacattgccttagttcaaatggaatgttacctaaaataattaacacactaagcctatcagatctgtttctgtacatgagagcattgagagataagagcattgatgataaaacatgtctactaattggtaatttgatggtatggtaggggaggcctggaagaggcccacaagaactaatccaaagatacctactcaaaattatgtataggattaaaaccctgctttgcctctaattttctctcttctactaaagagaaaaaaaaagccttccttaatgatcagtgtctagatcagatttcaatgtcaggtttttgtaaattttacaactattaatagaaacgaagatgttccaaatatgtccattttcacttattcttcagagtaaagacactcagtctgtgtacctaattatataataggtaatagagatttagtgacatcaatttttccccgacatgtccaatatgtattaaattctgaatacccctccatgctctggaaccacaaacacccagaaacagatagaaaattatttacaagaaactttagcatcagggaaaagaaaaggtctgcaagagtgggtgaaactgtcaaatccaatgaagcaaagaattcctagaagattgtttattttctgagtgaaagtatagatttatggaatgcatacgaaagcctaaatcagttttgtggccaggaagatagttcatggatgaaaattaattactatttggttttagatccttctgaggatggtgatgacttttatatattatcttaagtacaggtataacttattttaagtaaactcaactttgaaaaattctaattgacacaagaaccaagattagtgcttagttctataaaaggattcaaagcagaattccttaacatagcatagtcttttagttcaagagtcagcaaatgatgacctaaggaaccagtatgatcagtctttgtttttgtaaataaagttttatttgaacacagttatgcacattcatctagtttatggattatttatggccatttttgcactacaatggcagtgttgtaacagttctgtttgtatgacctgcaaagtataaattatttactatttggccctttacaaaaaaagtgtgctgacctatactacagtgcatcaaaatgttattcatattacatcaatttatttagtttgcagtaattgaacatattttgatattgttgaagaaaagtttagatgtgaagaagtggtagagatgaacctagtggagtggagagaggtcatatcatgaagagatttgtacacttagctgagtttaaactttatcctgagagtagtgagaaaccatggaaggttggtttgtttgtctatttatttgtttgttttcgagacaaggtctcactcctgtcacccaggctggagtgcaatggtgtgatcacggctcactacagcctcaacttcctgggctcaagcaatcctcccaccgcagtctcatgagtagctgggaccacaggcatgcaccaacaaacccagctaatttttgtattttttgaagaagcagggtcttgccatgcttcctaggctggtttcaaattcctgggctcaagtgattcacctgcttcagcctcccaaagtgctgggattacaggtgtgaaccactgtacctgactggagggttttttaattcagtggacttacatgattccctctgatatcagtgtggcagatggattggacagagatcaattaggaaagtattgttatgcaggaaagaaattatgaatgtctgaatttagatggtaagaataaagaaagattgaagttgaaggaaactcatgcgaatgttaccaagaaagaagaagcaatgtgattttgtgaacgggtgaatggatgttggtagggaaggggaggagtgtgagatgactttcagatttctgacttaaaaaaccaaatgggtagtggtaccattctcagagagggggaatataggaaagggggaaaaattttagggaaataagattggttcagtttcatagctattgaatatgatatgcttgtgacacatccaagtagaaatattttttaggcaagtagaatacatatatctgaaacaaaattaagagttatgaggcaaggatatagacttgaaagttatcttatataactagcaatttaggctatgttttagaataaatcattcagaagaactctatagactaagaacaatagaaggcaaggatgagcacaggaggaacaccagtatttaaacaatagcagaggaagcccatgaagaagaatgggaagaccactaaggatattgaaaaggagttgcccttgagtaagttaaaaagaaaacaagttagaatcatcacgaaagctaagagaaaataaaattttaagagggaatgtcaaatgtctaagagagatcaagttataaagaaatatcatgacagattattcatcgggtttgtaaatactgagttcactcgtgaccttagtgaaagcagtgactggggaggatggcaaaggaaacagtaaatataagctaatctttcaagtaatatttctgtcaaagactggagaaggtactagttagaggaactcttaagggagtgtttcttgaggataggaaagaattgcttgtgtttattatgctaaggggagggaatctgcaggggagaggaagaagatataggaggagacccactgcagctccaggctatcaggccaagcaagctctgtatgggacagtcccatctttagtctctcaggtcactgtcagccaggctaatccaaaaagagctgacatttggactttagatgataatcacgtctgagaatatgattcacagctcaatgacactagctttcccagagctgtctttctttagtaggatcaactaagaggaacatgttttaattttcttttccatcaggcagaaatcactggaggtccagtgggaagctagatagcaagtggttttgtggagtgttgaatggtccttttgctgtctgtgacagcacttgaatacacaatcagctctatgttaatgctgtgtttagagaagtaagataatagtgttacgtagacttggtagaaacctgacctttttttttctctatagcagatggtatgattttgtgagattgcagcagtatacattgccagatatgtggtgggaaaaagcagcattctatacaacatgctaatgggtacaatttattaaaacattttctaactcttagagatattaagcaaatcacccattagtgaaaagttagaattaaagatatgtaagtaggtgaggaatcaatcaagcattactaaatcttctgaatatatatgccaaacttattttttgcaaaattatttatttgtgtcataagtcagtatattatttcatccaaaatattgtcatcacctgaaataaacctgcagttccaacagtaaaagctgtgagtctctcttcttacttttaattttttaatttccttttttaatttttatttttaatttcaggagtacaggtttgttatataggtaaacttgtgtcatgggggcttggtgtacagattattttgtcaccctggtattaagcctagtagtcattggttattttttcgatcctctccctcctcccaccctccaccttctaatgggttccattgtgtgttgttcacctctatgtgtccatgtgttctcatcatttagcttataagtgagaacatgcagtatttggttttctgtttctgtattaatttacttaggataatggcctccagctctgtccatgctcccacaaaagacatgatctcattctcctttatggctgcatagtattccatggtgtatatgtaccacattttctttgtccagtcagtcattgatgggcatttaggttaattccatgtctttgctattgtgaatagtgctgcagtgaacatacacatgcacgtgtctttatggtacagcaatttatattaccttgggtatatacccagtaatgggattgctaggtggaatggtagttctatttttagttatttgaggaattgctacattgttttccacaatgactgaactaatttacatttccaccagcagtgtataagtgtttccttttctccacaacctgctagtatctgctatttttgactttttaataatagccattctgatttgtgtgagatggtacctcgttgtggtttttgatttgcatttttcctaacgattagtgatattaagcttttttttcatgtttgttggccacatgtatgtcttctttagaaaagtatctgttcatgtcatttgcccactttttaatggggttgttttttgcttataaatttaagttccttatacatactggatattagacctctgtgagatccatagtttgcaaatattttatcttatattgaaggttgtcagtttactctgttgatagtttcttttgctgggcagaagctcttttagatcccattgtcagtttttgcttttgttgcaattgattttggcgccttcctcatgaaatctttgctcattcctatatctagaatggtattgtgtaggttgtcttctagggtttttattattttgggttttacatttaagtctttgatccatcttgagttgatttttgtgaatggtgtaaagaaggggtccagtttcaatcttctgcatatgcctagccagttatcccagcatcatttattgtatagggagtcctttacccattgcttatttttgttatctttgtcaatgatcagagggttgtaggtgtgcatgtgctgaacttctagtaagtcaataggtcagcagtatatagtgttctcatgctctacaagcacatccccatactggtcaccttgtgggtattcagaacgctttgcccagtcattttctttgaagaacttatattcttctagggagctaagacatagttatgtgaaagaacacttatgtgcaacacctacatgaccctactacctggtcagtgttagggctaataggaaaaactgcaggaatgctgcagaagtagcagatcatgtgaaaatattgcagaatatataagccaactatatgattagagaatacaactatcaaaaattcatttattcatcaaaattctatcaggtccctagtataggcagagcatttcatgtttccctcatgtaagtgtattttaggagttgaaaaatcaccataaagtttgcacttttttcttaaaagtgaaactaaagtcattggtatgacaagactgacatgaaaagttagttgcagggaaaaaaattactctattttatcattgatattcccaaatgtcaagtgttattgcaactagggagtaggactttttcccacaattaaaagcttatccacaagacatgcaagccaagtaaaaatcagacagctgacaataccaagagtccacctctaacattattcctgggagaagcggctgaatatttcagtagctgataatggatctgaaaactaaaaatttcaccatcttttaaaaatgggcctatatgatactaccggaaaattacttccagaaataattgccagtaaaagcattcctaaaatttaccttaatattgtcattgaatattgcttgttggagcaatttgtaaaaggattgaaccagataatttcttcccttataactctaaagtcacatctttgccctcgtgctaaatgataatggcactaacacagtatgttataagatttaccaaagactgtgtatgttctgccacctcatcaaggttatagttatatcaaagagaatctatctctttggctttctttttcctcccaattaatagaccctcaataatattgttgtgattaatttgattgatagcttagtttcttttttaaatattagacatattttccctcagccaaaattgacagcatattttccagactatactgatccatgagaaagcatgccctcaccctcctacaaccctcacccattaccctatattgaagaagtgtaaagtcctggaatataatagtttgtccccttacttaccacactttgccactcacctcaccaaatcccatctctttccctttctttggtagtacttacatggtcaaaaatgtggtttctattgctctgaagttatgtgagccttgaagagttcaagatgttcccatttgtaggaaaattttcactttctttttattattatactttaagttttagggtagatgtgtacaatgtgcaggttagttacatatgtatacatgtgccatgctggtgtgctacacccattaactcgtcatttagcattaggtatatctcctaatactatccctctcccctccccccaccccacaacagtccacagagtgtgatattccccttcctgtgtccatgtgttctcattgttcaattcccatctatgagtgagaacgtgcggtgtttggttttttgtccaatgcatactttataatcatttgtaacagcaaaaaggctgtaagttcttttgactagcttccatgcacatgcttatagatcaataaatatacagtattgtctcacattggggatagtttgtaaaacaaactgcagattttggaggagggggtcacttactgtgttcaaagttaagtgatatgtcaaacataagggttatataagacaaggatcatgactgctcagcttggtttgttattttaatatttaaattgacatttttctacaagtacctttaattatgctttaaatccctttaaatcactgtgactaatattttttctgaagaaatgcctcaatgggataggattatttactttttaaatttacctcctaaaactctgaataccaaagataaggagacagagaaaccaagaaaaccctgacgcaagtgtttttggagctcagtgtatggtaagatgcctttaaagctcttggccccttgaaagtgcaccactaataattacaaagggaacagactaaactctagtgccaatacttatcacacaagctcatactgttcctatcagtaggattaataagatacactgaaaatctattagtgatttccaaagtagatagactggacccctgccttaatgcttttctaaagccatgcgatcaataaatatttgttgaataaatgaataaaataatgagtctatgttgccctcaaggtccatgttgtgaagctatcttgtaattgagatccattttatgttgacagctttctttctcttcaggaattgaatcatattggatggaaactctagctactgaagtattcagccatctcccctgggaataatgttagaggtagacttggtattgctagattcctgacttttgtttggcttgcatgtcttgtgcatgagctttcctttgctggaaaaagttctactccctacttacatttacacttgacctttgggaatatcagtgctaaatagagtgatatttttccctgcaactaaatttttctgtctgtattgtcataccagtgactttagtttcactttcaagaaaaaaatatcaaccctatggtgattttgcaacctgtaaaattaaatttacatgaggaaaacaaaactttaaataaagatcatggttaaaagttttaaaagtgtcttaaattagaaaaatatataaaaccaagcatattttcttttatatgcaacatttttctttatatgcaatatataaacatatgcaacatattttctttatatgcaacattagcaagctgtgctctaccatgggttcagtaatctgtatttagtgatcactgatttatcaggctgagaataaataatactaaatttattgttgttattaataaacaataacaattctactactgcttttaccatttacactactactaacaaccactgagactttattatgagacagatactaagctaattgccttctattatcacatttattcttcacaagaaatctgtgcaataggtattcctactccatataatagataaagaactaaggcccaaagagtaacactaacttgctcaagatcacgtaagtatgaagatatgaagccagtactcaattctggctctatataataccacctattatccattagtccatattgccccagaacatcaacaagatgataaaatgcttcaaaacaaaatgttagactccctttctaagcccaagatacatgatttgggatggctgtggtatcccaacagacattggtagctaagaggccaagatagtccttgtagcccagttcttattcttttgtcttaccatgcacaccaatgaacaggacccgtattgctgtctctctgaaacactgtagcacaaattgctttcacaacttctttattgcgagtaaattgttcaggtaaaaccatctttacactccacactcagtagatgtgttggtagataaatctgtgatattgttaaggctattcagtggagcattgataacaaatcatcttgtgtgctttcctgccccaaatcgcacatttgcatccagtgaaatcaggctcaaagaaatggaaaagagattttaaatgggcagcctccgttatatataaagaaatagacttggagaaatatattcctaggccgtgtttatgccttggtgctagtgggaggaggaaggctgaaaactgatgttaagtgaaccccccgtgttttttttttttttttttgcatactttggtgaaggccacttcctttgtgtccaccagctgaatgactgtacagctgccaacaacatgtatcccccatttaccttaaccagggacccagggcagtcaccttgactcacttatcaaccctagggacagctggggattttgctaatgcaggatcatttacaacaataacagaatagcccgaattctaagagccagcagcagatttcacattagtacctaatggctctgcaggacaggacaaacaaacaaatctgtcaaaccaaagaattatcaaaccaagaccttgaggctcctccaggaaaggatgctcagagagtacagcagagaaagaatccctaggaggcattggcagctcttttaatttgattgctttagaatgaattctgcttggcctcactgggccaattttataaaacttaaaacactgtacggaaattttaaaaaataaatttagaaaatctcttaatttcccatgctgagtaggagggagaacagtaacataatttaaaggggcttaggcataattctaagtaatttacatttggcttggaaacacattctgtaatattttttttcttctgtggactcaccttagtttttgttcagactaatatctgaagtagttggaagtccctggatacacaccaactggcatagtgaagagaacctagaagcacgggcttaacccagaatctaggatgtaccatctgctgtagataaactataaaggggattaacttcacacagttattctgggcttgactgtattgctacactcatgcaatttctctttccacagcctaaatatcacactaaaaattaggttcatttctgcactttaaaaatgatattgatagttatgtatatgctaattataaaaatcacaagtgttctttatagaaaatttagaaggtatatcaataatgaagaagaaattaaaaattacctatgcttctagaatttaaagacaggagatgttaatatttcattatatttttggacagttttcatatgtaattataaatacagatcataaacgagatttaactgtatatttaatcttttattcctatttcatttaatagtttattatgaacattttccatgtagttaaacatccttcacaagcaaactggataatgtgtgttctttaaccacttgaatataccataatttatttaatctttccacttttcttggacatttaggctgtgtctaatttttcaataacataatgattattattgtaaataaatttcaaactacatctctgctatttccttgaagtagggtctaaaatatgaatattatgataataatgagagtatatttgttaagcctcttgatgacattgttatactgctttccagaaagtctgtataatcttacaaccatccaagcagtatataaaattgtttatctcaccatataatccaagatctagaacatacatgtatgtgaatattttaaattgaaaataggattccaattattatcattttatttatttgatttgggttaagatttagtttgataggatgatactggtgttttttcttgagttatctactcagttactttgccagcttttgatttggggtgttaatttttgcattattaatttatactatttctgtatatgtcaaggatataatcccttcatctgccatatttgttgcaaattttacgccagcttctttgaggaataatttacacacaataaaattcacgtatttaagtataaacttagataagttctgataatggtcagttgtgtaaccatcactaaaatcaatattgtcttgatgtaaatatcacactgtcttgaatgctgtaactttatagtgtatcttaaaatataatattttatgtcttccaatttatttcaaaattttgttttgctcttctaagtcttttgtatttcctacaaattctagaatcagcttgtcaatttctacaattaaaaaacctacttgaaatttggctggaattgcattgaatctatagatccatttggggagaattgacctgttaacagtaactcttccactccaagaacaagatatatttctccatttatttgaataatctttaattgctctcatgttttatagttttcagtatataaaataacatgttttattaaatatatttctaattattttatatttttatgctactgaaaatatcatttcttaggggagaagccttcagctttttactgtcaagtataaggttagctgtagattttttatatatgccatttatcaggttgaggaagtttcccagtttgctgagaggtgtttttttttttaaatcattagggtattaaattgtattaaatgactttatgtatatattgattttttaatatattttggtctgttcttatagtgaatttcttattgattttcacagtgttgtaataacactgcatggcataaatcccacgtggtcatgagatatcattttaatacacttttaattcattttgttaaattctgtgtgtatgatcataagcaatattgatatgtactttttatttcttgaaatatctccttctggatttgaaattcagtgatacggacttcataagttgggaagttctcatttctcttctatttttggaagaatttgaacataattggtattatttttccttaaattttagggaaattaaccaatggagccatattaggtatgaaggtttctttgtgggaaggttttaactaagaattcaattttttttgtttttttttttttgagacggagtgtcgctctgtcgcccaggctgtagtgcagtggtgtgatctcggctctctgcaacctccgtctcccaggttcaagcgattctcctgcctcagcctcccgagtagctgggactactggcgcgtgacatcactcccggctaattttttgcatttttagtagagacggggtttcaccgtgttagccaggatggtctcgatctcctcacctcgtgatccccctgcctcggcctcccaaagtgctaagattacaggcgtgagctacggcgcccggccaagaattcaattttttaaattgatgcaaggatactcaggttatctggtttttctgcataagccttgttagtttgcatctttcagagaatttgactattttatctaagttgttatttattagcataaagttgtttataacatcccatccttttagtgcctgttgactatgtagtgatatctcctctttcttgtttcatataaatcatgtttcttcttctttttccttttcagtatgtctagagttttatgaattacatttatcttttcaaaaatttgttttactaatttattttcttgatttctgtttcatttatttctgctctttattctctcattctttgttcttacttggggtttactttatttttcttttactagtttctcaagatggaagcttaaatcattgatttgagaactctgcataatataatcgtttaatatgtaaatttcactctaagtactgcttttgctgtatcatacaaaccttgacatgtttttcattttaattcaggtcaggtgaagatactctctaatttgtcttatgatttctcctttgccccatagattatttagaagtatgttgttacagttctaaatatggtccttttggtgactattccatctgcacttgaaaagaaggtgctgctgttgtgtggagaaattttaaaatatcagctggatgaagttagttgaatacgttgttcaagtcttctattttttttctgattttttgtctacttgttctattaattatctgagagaagagtgtgaaatctccatctgaaatggtggatttgtctatctctcttttccattctgttagtttttactttctgttttgtagctctattatttagtgaatgaaggttagacttgttatgttcccttaatgaaatgattatattatcatcatgaaatgccctcctttatcgctgataatattccttgctctgaaatctattttgtgtgatactaatattatcattgcagctttttcaaaatttgtgttttatggtatgtctcgtttcatccttttatttttaagctttatttctttatgtgtaacatgtttcctgaggacagtacatagttgtttctgtttttttttttcttgtctcacttgatatgttgtcgtttctgctttgtatagtcaattgtcttcaaaagcattaaataggaggaaagaaaacctggaatttatgcaaatatttaccattttgctgactataaaattctaggttgacagcctttttatcagcagctaaaatatgctctaccatattgtgtcttgcataatttctgaatattatgtcttttttatcttcttttgagagtcttgatcactggtgttcagcaatatgattaaaggttttgagaaatgtggaaatcttcaatcatcattttttttcaatgttttttgttctctcattctttcctcttctggagctccaattaaatgaaatgtatatagcattttttatatcatcacaccaacacatttacctttttcagtctttcgtccttctgtatgattccttttagatcactatttttttttcctttggagtgtttaatctactggtaaactcatcctaaataatacaatttcatttcagatattgtatttttaattcctggagattctgcttgtatctttttacatatctcctgtctttcctcatgttcatgttttatgattttaaatatattgaatatttttataataacagctttactgtccttgtgtgttaattctataatttggattttaatatgtttctattgattgatttttcttgtggttatgctcattttttttacttcttttgatgttgttgattgtgaattttatgttcctaggtactagagtttgttgtttcttttgcatgttgtcagactcagttgagggatgcagtttttttattactttttttttttaatttaagttctggactacatgtgcaggatgtgcaggtttgttacataggtaaacgtgtgccatggtggtttgctgcacctgtcaacccatcacctaagtattaagcccagcatgtgttagctcttttcctaatgctctcccccacctgctgtcccacaacagcccccagtatgtgttgttcccctccctgtgtccatgtgttctcattgttcaactcccacttataagtgagaaatgtggtgtttggcgttccattctggcattagtttgctgaggttaatagcttccagcttcatccatgtccctgcaaaagacatgatctcattccctttttatggctgcatagtattccatggtgtatatgttaccacattttctttacccagtctatcatttatgggcattttggttgattttatgtctttgctattgtgaatagtgctgcaatgaacatatgcatgtgtgtatctttataatagtatgatttatattcctttgggtatacacccagtaatgggattgctgggtagaaaatctttgcaataccattaaggacataagcattgagcaaagattttataatgaaatcgccaaaagcaattgcaacaaaaataaaaattaataaatgggatctaattaaactaaagagcttctgcacagcaaaagaaactaccatcaaagtgaacaaacaacatacagaatgggagaaaatttttgcattctacccatatgacaaaggtctaatatccagaatatacaagaaacttaagcaaatttataagaaaaaagcaaaccaccccattaaaaagtgggcaaaggacatgaacagacatttcccaaaagaagacatttatgtggccaacaaacagaaaaaaaagctcagcatcactgatcattagagaaatgcaaatataaaccacagtgagataccatctcacaccagtcagaatggcaatttttaaaaagtcaagaagcaataaatgctggggaggttacagagaaataggaacacttttacactgttggtgagaatgtaaattagcttaaccattgttgaagacagtatggggattcctcaaagatttagaagtagagggatgcagttttaacttggagtcagtacccttcttttcaggattaatcttgaaattttggtttatgcccagagaagcttttgcctaggtttaatctgtacctgtgattaaggcaataccctcctgagaactctatctgatgatacataggtgagcaggaatttccattctggctcataggaacacacactatatccagcctagtgtatgctgcaaagacttttctgcctgctccattttggtggttggttctttttttgcttcatatagtttccttccatgcatgcatagaccagtgcttggccaaaaacttgagaggaaccgcctacaaacttctagaattctgtgcatgtgcacatgtctttgtgtgtgcagctctctcttctctggtatttaaataaaaaattatatatgccttggcctcctcaaattctgaattctggttcctcaatttagagaaagtactgatctctcttggggttccctttccttgtttctcaacctggatgctctcctcaggcaggaagctggacaattataaggctcatctaatttcacttattttcccagagatcattaccctgttctgtctcttgtaaaatatatgaaaactctcagggcatatattttctatagtcctccctgtatttaaggcaggaagttaaatctggccctattactttatcatggacaatagtagtagtcctgtattccttcttgaatcaaaattaatatatacttttctataaatttttccatttcttctaatttattgataagctaattaataattttatctttatcttttaattctgcttttctatagttaggtctacttttctatttataagaaatatatatgtgactttttgttttccttgactattctttccaaagttctgtattgtttgttagactgttcaatgaaacaaatttgctttctttgagccttttatttgttttttctgtttacttgacttttctgttattgttactattttctaatattatttttactttcttcaatttttaatagtttactatcttctgctttctcttagtttattctgttgtttcttttctactttattagttgaactttaatgttcttcctttattatttttgtaatacaagcacttacactataaatttagattgaaatagagcttttactgaaccccacaaattttggtatgtgatgttgtcattatcacccaatttttagtatttttacaattccattataatttctaacttgatcctgaaaatatgttttttaaaaatttccaggccagacgtggaggctcacacctgtaatcccagcactttgggaggctgaggtgtgaggatggcttgagtctaggagtttgagaccagcctaggcaacagaatgagactctatctctacaaaaattttaaaaaatacctgggcacagtggcgcatgcctgtagtctcagctgctcaggaggctaaggcaagaggattgcttgagctcaggaggttgaagctgcattgggccgtccttacaccactgcactccagcctgagcaacagagtgagactgtctcaaaatattaattaattacaattttaaaaaagaaaaattccatatatatggatgatgttatacttatttattttatatcttatttattattctaattaatttatttcttcattattattttaatgttctgcatcttgattgtatcaatgttaatatccttgttgtagtattgtactatagtttctgcaagatgttaccatgggaggaaactgtgtagaaagtatacaagatcaccgtgtattattccttgcaattgcatgtgaatctatatctcaaaattaaaactgtgataaaaaactttaaaagttgattcttagataaagacaaaatatattttaatttttaattttaatttttgaacttttatttgaggttcagggatggatgtgcaggtttgttatccaggcaaattgcacatcaccggggtttggtgtactgattattttatcacccagctaatgagaatagtatctgatatgctgttctttcattttcatcctcctccccaacctgcaccctaaaaaatgcccagtttctattgttccctttttgtgtccatgtgtagtcaatgtttacctcttatatgtaagtgagaacatgcagtattttgttttctgttcctgtgttaattcatttaggatgatggcatctagctccatccatgttgctgcaaatgacatgatctcattttttcttatggctgcataatattccatggtatatatgtaccacattttttaaatccagtctactattgatgagcatttaggttgattccatgtctttgctattgtgaatagtgttgcaatgaacatgcgtacatgtgtctttatagtagaacaatttatatacctttgggtattaatacccaataataggattgctgtgtcaaattgtagttctgttttaagttctttgagatatcacaaaactgctttccacagagattgaatttacattcccaccagcagtgcataagtgttcttttttctccacaaccttgccaacatctgttaatttttgactttttgataatagccattccaagtggagtgagatgatatctcattgtggttttgatttgcatttctctaattattagtgatgttgagcattttttcatatatttgttggccatatgtatgttttcttttgaaaagtatctgttcatgtcctttgctcactttttaatggggtaattttttttcttgtaaatttgtttaagttccttatagatgttagatattagacctttgtcagtttcttagttggcaaaaattttctcctatcctgtaggttgtctgtttattctattgatggtttcttttgctgtgcagaagctccttagtttaattaggcaccacttgtcaatttttgtttttgttgcaattgcttttgtcatgaaattgttgccagggcctacattcagaatggtattttttaggttttatcctagggtttttcgtagttttgggttttatatttaagtctttaatccatttttagttgaaattttttatatggtgaaaagaaggggtccagtttcaatcttttctatatggctagctaagttatcccagcagcattttttgaatagggagtttttccctattgcctgttgttgtgaactttgtcaaagatcagagagttgtaggtatgcagctttatttctgggacctctattctgttcctttggtctatatgtctgtttttgcacctgtaccatgctctgttggttattgtagccttggagtatagtttgaagatgggtaatattatgccttcagctttgctctgtttgcttaggattgctttagctatttaagctctttttggtttcatgaattttagaatactttttttctgattttgtaaaaagtgttcttggtagtttgataagaatagcagtgaatctataaattgctttgagcaatatggccactttaacaatattgattattcctatccatgagcgtgggatgtttttccatttgtctgtgtcatgtatgatttctttgagcagtgttttataattctcattgtagatatattttgactctctagttagctgtattactaggtattttattcttttgtggctattgtgaatgggattgtgttttgattttgatctcaccttggatgtttttggtttacagaaatgccactgattttgtacattgatttagtatcctgaaactttgttgttgttgtttttttatgaaatctaggatattttgggcagagaccatgtggttttctaagtataaaatcatattatctgcaaacagagatagtttgatttcctcttttcctatttggatgcatttttttttgtctgattgctctaaataggatttccagtactatattgaatatgagtgcttagagagggcatccttgtcttgttccagttctcaaggggaatgattctagcttttgcccattcaatatgatgttggctatgaatttgtcatagattacatttattatttggaggtttattcattcaatgcctagtttttaagatgaagcaatattcattttttcaaaagctttttctgcatctattgagatgaccatgtggttttttattttagttatttttatgtgatgaatcacctttattgattgtgcaggctgacccaatcttgcatcccaggtataaagcctacttgattgtggtggattagatttttcatgtgctatactggattcagtttccttgttgaaaatgtttgcatctgtttttctcaaggaaacagattggcctgaatttgtgtgtgtgtgtgtgtgtgtgtgtgtgtgtgtgtttgtgtgtgtttgtgtgtgtgtgtgtgtgtgtgtgtgtatctctgctagattttggtgtcagaatgagattggcctcatagaatgagttaggaggagtccctgatcttgaattttttggagtagtttctgtaggaattgtactaggtcttctttacacatctggtagaatttggctgtgaattcctctggtccaggactttctctggttgttaggctttttattactgattcaattttgaaacttgttactgatcttttcagggtttcaatttcttcctggttcaatcttgagagacttcaagtttccaggaatttatccatttcctgtagattttccactttatgtgcatagaggtgtttgtgatagtctccaaggttttttttttttaatttctgtagggttggtggtaatgtttcctttgtcatttctgattatgtttatttggatgttctctctttttttcttcattagtctagctcgggatctatcaatcttatttacttttttgaagagcctacttctggtgtcttcgattttttgtgtggctattgacctcttaatgtcattaagttcaggtctcattatggttgttttttatcttctgctagctgtggggttggtttcctcttgtttctctatttcctgctggtgtgatactggtcgttagcttaagatctttctaacttttttatgtgggtgtttagtgctataaactttcctcttaacgctgctttagctgtgtcccagagattctggtatgttgtaaatttattttcattagtttcaaataatttcttgatttctgccttaatttcattgttaactcaaaagtcattcaggagaaggttgtttaattttcatgtaaattgtatgattttgagcaatcttctttgtactgatttctatttttactgcactgtggtctgagattgtaggtggtatgatatcattttttaaaatttgctgagaattttttatggccatttgtgtggttgattttagagtgtgtgccatgtgcagatgagaagagtgaatattttgttgttttgggtggagagttctgtagatgtctgttatgtctctttagtcaagggtcgagttcaggtaccaaatatctttgttagttttctgccttgatgatctatataatactgtcagtggggtgttgaagtctcccactgttattgtgtggttatttaagtctcttaattggtctctaagaacttcttttatcagtctgggtgctcctgtgttggatggaaacaaatttaggatctttatgtcttcttgttgaattgaatcctttaccattatgtaatgcctttctttaatttttttgatcatttttggtttaaggtctgttttgtgtgaagttacaatagcaaccgtcaattttttgttgttgttgttttgttgtccatttactttgtagatttctctccatccttttactttgagtctatgggtgtcattgcctgtgagatacatgtcttgaagatagcataagctaggtcttgcttttttatccaacttgccactctgtgccttttgttgtggggcatttatctcattcttgttcaaggttaatattgatatgtgtggttttggtcctgtcatcatgttgttagctggttattatgcagacttgattgtgtagttgcttaatactgtgtcgatggtttatgtacttaaaagtgtttttatggtggctggtaatgatctatcctttccatatctagcactcccttaaagatctcttgtaaggcaggtctggtggtaacaaatttccttaccatttgcttgcctgaaaaggatcttatttcttcttcacttatgaagtttagtttggctggatgtggaattcttgtttggcatgtcttttctttaagaatgttgaatatagaacctcaatctcttctggctaatagggtttgtgctgaaagttctactgttagcctgatggggttccctttgtaagtgaattgccccatctctctagctgcctttaacatttttctttcatgttgaccttggagaatctgatgactatttgtcctggggatggtcctcttgtatagtatctcacaaggattctctgcatttcttgaatttaaatcttggcctctctaatgaggttggggaaattttattggatgatttcctcaaatatattttctaggttacttgctttgtctccttctctttcagggatgccaacaattcgtagatttggcctctttatataatctgatgtttattggaagtcttgttcgttctttttttgttcttttctctttatttttttctgaccgagttgattcgaagaaccagtctttgagctctgagattctttcctcatcttggtctcttctgctgttaatatttgtgactgtattatgaaattattgtagtgagtttttctatcaaatcagtttggttcttttttaaaatggctattttgtctttccactagtatcattttattggattcattccttagattgcttgaattggattttgactttctccagaattttgataattttcattcctatccagatcctgaattccatgtctgtctttccagccatttcagcctggttatgaagcattgctgaggaagttgggaacaaagaagacattctggctttctgagttgccagagttcttataatggttctgtctcatctgcctgggctgatattcctttaatctttgaagttgctgtcctttggatggatttttttttcgcttttatattctttgataccattgtgggtttgatataaggtgggttcatttgactggcttcatttctggaaaatttcaggggtccaaggctcaactcatcactcctgggctatggggtctatctttggggttctggtattgggtccccagctttgttctctggccccttatggttaggaacctgctgcactggcaggactgaggtgttcccagtctcctggcaacaatcctctgatgaggggtctagccaaagtactttcttggggcagtggctgtgcttgtgtgcacatacaagcagcagcctgttatatttgtatttattttatttgtattactaacatctaccttaattgtactatggacagagaatattgtcagtacgatacctactctttaaaatttgttacatcttgctttatggtctggcatatgatcaatattttaatataatctgtgcctgagaaaaatttaggttttttgattgcacagtgagatttttactattgatagttctaaagagagcataaaatatatttacctctttgttgtttccccattttctatgctcagaacatttgctttttatcataatttgataatattcacctttatcttttctagatttctgtgatttcctaccttcatttagcatttccaagccatctggaatttattttgttataaagcataggtttggtttagaatctaactttttgatttatgtatatctaaatggcataactccataaccattagcagaataattggcatgactgtgtcttagtattttatcatgtaacctataaaataatccagttgttaaatatgttttggtaggtttctgggttatctgtctcagctattgatacttctcatactaataccacactcttctctttgttttaccttaatagttaattttagcatctggtaggacaagtattattattcttatttttttaatggtgtgaactattccttgtagtttattcctataaatgaaatatagaatgattttcaagttaaaaaaatttatgcttaactattcataatagcaaagacatggaatcagggtaggtgtccattgacagtgaattggataaaggaaatccatgaaatcatgttctttgcagcaacatggatgcagctgaaggccattatcctaagtgaattaacactggagcagaaaatcaggtatcacacattttcacttataaatgggaactaagcattgggtacacatggatgtaaaaatgggaacagtagacacagcagaatacaagaggggagagagaaggtggggagtatgggctgaaacactacctaaagggtactatgctcactacctgcgtgacaggatcatttacaccccaaaccttagcatcacacaatatacccatgtaacacactcattctgagattgataattaattgggtaaaattaggtgaataattcttcttcatatcatgttacttctttaccattttaacaccattttaacaatagcacagagtttttgattaccttgtagaagaaaggacttttttgatcactgaaaacttcaaattatatcccagattttatcttcctttccatttcccctacaactattttaatttcccgttatcttcaaagttttgtaggatgtatttagttgaaacactaatgtagacggaagtttattaataaaaaatatttcttccaccaaacaagtttgtaagagtctgggttaaacaatattaaataagaattttaccactggaatttctctgaaactttaatatactaatgatcatattattgaggctgcccaatataggaataaagtcagcagcccttcccaaatttttgccctgacaaccagggttttccatggccttaacataatgtcatagagttgctttgaaaaataagtgagttaaaacccataaaatattttattgaggatttttacgtctattttcatcggaggtattggcctgtagtgttttttgttgttgttgtttgtttgtttgtttgtttgtttttcttgcagtgtctttttctagctttgctaagagggtgatgctgtccttataaaatgagtttggaagtgttccctctagttgtatcttctcaaagagtttagggagaattggtattaattctttgaatgcttgataaaattcagccataaagccatcttagtcctgggattttctttgttgggatatttttaattactacttcaatctccttatatattattggtctgttaaggatttctatttcttcttgatgcaattttggtaggttgtatgtttctaggaatttatccatttcctctagctcactcaatttgtttatgatagtctttccgatcctttttcttttcatacgcaaccattttaatatctccactttcatctctttatttatttgagtcttctcttttttagttagtctagctaagggcctgttgattttatattttaaaaaactcggttttcttgatttgtttgtattgtttttgtatttttcgttggtttatttcttctctgatttttaatattgccttccttctgctaactttgggtgtagttggttcttttacttttgctattctttttctagttccttgaggggtaatatttgtttttttatttgaaatatttgtttttttaatgtaggtatgcatcactataaaatgctttcttaaaactgggtctgctgtatcccaaacatgttggtacgttatttttttttgtcttgtctcaagatttttgtttgtctcaagatattttttaatttcccttttgatttcttttttgaccattggttgttcagaagcattttgtttaatttacatgtaattgtgaattttccagttttcctcttgttattgatttctagtttcataccacagtggtcagaaaagatacttgatactatttcaatcttcttaaattagttaagacatgttttgtggcctaaaatgtgatctgttctggagaatgctccacatgtgcttgagaagaatgttcattctactgctgctggatggaatgttatgtatatgcctgttaggttcatttggcataactacataactaatgtagctcaagttgaatgttcaagtccagagaatggatattctgtctggatgatccacccattgttgaagggaggtattaatgaactggacccttatcttacaccatacacaaaaataaactcaaaatgcattaaagacctaaaagtaagtcctgagattataaaattcctggaagaaaacataagagaaaagccctttgacattgatcttggcaatgattttttggataggacaccaaaagcacaggcaataaaagcaaaagtaagcaagtggaactacatcaaactaaaaagcttctgcacaaaaaagggacaaatcaacaaaatgcaaaagtagcctatggattaagagcacagatttgtgaattatatatctgataagaggttgatatcaaaaatatattagtaactaacacaatggcaaaaacacaaataatcagaataaaaatgggcagtgtacctgaatagacatttctacaaagaagacataaaaatgggcagtgtacctgaatagacatttctacaaagaagacataaaaatggcaaacacatatgtgaagaaaatgctcaaaatcacgaatcatcaggaaatgcaaatcaaaatcacaatgaagtatcacctcacacctgttaggatggagttttagtcctttctcgcattgctgtaaagaaatacctgagactaggtaattataaagagaaaagatttaattggctcacagttcttcagactgtacaggaagaatgatggtagcatctgcttggctgcttggggaagcctcaggaaacttacaatcatggcaaaaggtaaagggggagtaggcatgtcacatagtgaaagcaagagccagagagcgaggaggggggaggtgctacacacttttaagtgaccagatctcatgagaacttacttttttaaatgaccagacgtcatgaggatagtaccaagagggatgatgctaaaccatatatgagaaatccacccctatgattcaatcacctcccaccagaccccacctccaacactggggattacagttgaagatgtgatttgggtgaggacacagatccaaaccatatcagatggctaatgccaaaaaggcaagacatcaagtgttggtgagggtgtggagaaaaggaatccttcatacactgttgcagaaatgtaaattggtatagcaatcagggaacagtatggacattttttttcaaaaaaattaaaaatagaactaccatatgacccaacaattcctcttctgggtatacacctgaggaaatgaaatcagcacctcataaacatacatgtacccccatgttcattgaaacattatttacaatagccaagatataaaaacaaactaaatgtccattggcaaatggctgaataaagataaatatatagatatggagatcataatagcatttaactttaaaaagaagaagaacaaaatcctgccatttacaagctagatgcagctagaggacattatattaagcaaaataagccacagaaagaaaaatgctgcatgataaatcttataagtgaaaacacacacacacaaaaaaagtcaaacacatagaaacagaagagggcagtggtcactagatggaagtggggaaatgggaagatgtaggtcaaaggttgcaaaatagcagctagtaggatgaataaatctagagatctaaagtacagcatgaggactataattaataatatattgtatactggaaactttctaaggggtagattttaggtgctcttattgaaaaaaggaaactatgtgaggtgatggatatgctaaattgttaacctgtaccaagcatttcactgtgtatatatctatgaaaacatcattttatacaccttaactttacatggtaaaataatagtaacaaaactataaaacacttatagcagtgcctggaacatagtgaatagtcagtgcatatgagttgtttttgttattttctcaagttcttctctctgcctgaaatgcctttctccccatacccaaacatgcaaaagacctacctgcaatgtaacctcctccacaaaatcgttcctgattccccacatctcctcacctaatcatcatcagagatatattttctctcttctttgaaattatgtcaaataatccctttgaacttattatggacaaccaaagcatccacacacatttccaaattcccctgtgggggatctactgctctttgttaagaaccactgagaagagaactaagtgagtgttcagtaaatacatgttcattgattgttgcccagagtaggcatgaaaattcacaataagcaatcattgatttaccttttaagtaccactttgtcaaaatgaggtgaaaccaataagtctacattcaagtctacacaggtttatgattcttaccttgaagagtatgggtcaagccacttatgtcctacataattcatatattatttctaattagattttttccatatttcactggcagatagtgagcaatgcaaagtacaaagcacttccacaaattttgtggcaagacagactgaattgcctaatagggtgtgaagcacagctacatagaagatatatgaagcatattatcattgggagtaagcacagctccattgatttcatgaaacaaaacaaaattaaattgcatagaaactcaaagacatggtaaatatgggttttgagtctaatagacctgagtttgaaacctggctctattatttactagttttctagctgtgtggccttagactaacttcctcacctgtgaattgagtgtaatataccagactcaaagtgttacacaaagcttgcactgtgaagtgtgtggaatattaaccttgggtgcacaatataggaggcaccaaagaacttagtaatcaagacaaataatattatatttcaatctttttttaaaaaaaaatcaaatttaatgcagaactccacaaagcagaaaacatcaatttttaaaataaagacaagatcaaattctgcatgtggatgacttggcttcccttggccctctctaatcctggccctgaatgttaaggaagttaaacaaggtaataagtgaagtaactttggcgtagtccttgccttgaatattcagttataaactatgacattgaggaaatggccctttagtcttggtaaaaaaaaatccatagtgaataatgttcaaatacaaagaaacctaatctatttattgctctttgtttttaattcttaattacatacatagtatataagtatattattggtaaggttagcacccctttaaaactagaatttttctaagcatttatatgcataggtatatatgtatagaatacatatgatagtaatttttttctttttttatgaaactggtatcttgatatacaaacatatctacaagttggcttttgtttcattcaacactatgccttatcaatgcctcatcattgtaaattattgcatagagtttcataatatggatatactgcagtttgttcatttagtccccccgttgatatttatttagagttgtttacagtttatcaatattatacacagtgcttcagtgaacatttttatacctgcacgtagttttttttctaatttagctactgagaagtagaattgctgaattttataggatatgaaccctgatttcatttaaattgttaatgtttaactgccttagtggccattccaattgatggtcccactagaagggcatgacagtacttgttttaccacaccaccattgacatattatatcaaacgaattcattatttattaatcttaactatcaattaataatgagtatttaataatttaattaataatgaataatatttaatgaaataattataattaatcatttttataaataaatttataaaaacaccaataaacttcttataaataattttataaatattttataaagaatttataatttagttaatttgattaataatatttgataatagaatatttaattaatttaattgataatgaataatatttatataggtatatctacacatagttttagccattttctaatttagctactaagaagtagaattgctggattttataggatatgaacactgatttcatttaaatttttagtgtttaattgccttaatgaccattccaattgatggttccactagaagggtaagacagtacatgttttaccactctcattaacatatgatatcatcaaactaattcattatttgccaatctgaatgaaatctgatggtttaaaatgttatttcattgctgttcttttcgcattttcttacttgagaatgggcatctttttaatatatttatggggcatttgtatatcctgttctatgaagtgcattttcatatattttgtccatatgtacattaggtaattttgttttttttaaattgaattccaggagttagttatgtattatggatactaatatgttatctggtatattgcaaataatttaacttactatacctagtctactgctttttgtttagagtatcttgtcatagaggagtttaaaattttgaggaagttaaatttaacgatctgaatacatcatcaatatatttgtccagaagtgcccaatgctcacctccttcacaaagaaggaccaaaacaagtagataacagcaaattgagtagaatgtctgtgagagtacactggaattcagcaagaaaatgacagactctctgagacacaaaagcttgagatggcagcatacagacagaaatgaagcacccagccaggattcgcttggagccatgatagactcccctccctattatagggaaaaagtaagcaagaggctctcagcagcgcctattgccgctgtggatgcctgcaatcctagctaaaggggaactccacaatcctccaagctgtgaggtaagtataggcagctgccttaagtccatgtagctacattgcttcagggaaggacttcacattaagtcccctctcagccccttgggagctaggctactatggcatggcaccattttgagagaggagccactaccagaccacattcttccctgtactttaatagcccatgcatcaccacatcctgtgacccctcaattatcacactgagcccacacagaaggctgcaacaccacaacaccacctggacccagcagtacagccataattctggcacacaagcccacatagcatcctataccccaagtagaacgtaatccagcatagcagggaggctgcccacagtaccaagggagcccatgtgtgcactccctagaagctgagggcttgcctgccaggtgcctgcttccatcaccactccccctcctccagcgcagagctgctgtgtgccacatgagctccctagtgaccaatgactggctcatccaatgtccactactgctactgaacctagcacctccagtggtaaagtttctgcatactgcacaaactccccaaggaccaataattgatccttctgacctaccactactggcaaccccaccccctacagcagcagagacactgcacctaccaccactggcaaccccaccccctacagcagcagagacactgcactctgtgcatgtcccccagtgaccaagcactagctcacatggcaccctgtagaaagactttctgaatttaaaattaggtcttttaaaataaaccagtaagaaaaaaaaaaagaataagaaagaattaagaaagcctcctggacagataggacaccattaagtgcacaaatttttgcattatgaaaagtccagaagatgaagacatggggaaaggcataaaaaacccattcaatgaaatgatagtttaatacatgataagtctaaggcaagatgtgaatattcagatcaagggggctcaaaaattcccaaatagattcaaccaaaacaggtcttctaagcactttatactcaaatgtcaaaaatcagagacaaagagagaaatataaaaagagcaagagaaaagtgtcaagtcatatataaggaaattcccatcagactaactagaaattttttagcagaaaacttggaggccagaagagaaaggggtgatatatttaaagtaccaaaagaaaaaaaaaaaaacctgttagccagtagcactatacccagcaaagctatcctgcaaaaattaagaaataaagtatttctcagacaagcaaaaaatgagggaattcatcaccactatactaggcctacaagaaatgctttaaagacccctacatctggaagcaaaatgatgagaactaccattatgaaagcatgtgaacatatacaactcactgatagagcagatacacatatgagaaagaaaaaaaggaataaaaaattatcactaaagaaaaccaccaatccacaaagataaataagagagtaagaaaggaacgaaagaaatgcaaaacaaccagaaaaaagtagcaaaatggcaagagtaaatcatcacttattaataataacactgaatgtaaatatattaaatccccaattaaaagatgtagactgactgaatggatccaaaaaaaaaaaaaagacaagacccagtcatatgacacctataagaaattcacttaaccagtaaaggcacacatacactgaaagtgaagggatgtaacatgatattttacaaaaatggaaaccaaaaatgagcaggagtagctatatttacataagataaaatagactttaagtcaaaaactgttaaaacaaccatacaaggtcattacataatgaaaaaaggatcaattcagcaagaatgtatcacaattataagtatgtatgccctcaacaccagagcacccagatatcaaaagcaaatattattagatataaagagagaggcagaacccaatataataatagttgaggacttcaacaacccattctgagcattggacagatctagatagaaaatcaacaaagagacatcagtcttaaattacaatatagaccaaatggatctaacagacatttacagaacattaacagatacagaatacatattcttcttatcagaacatgtaacattatccagtatagaccatatgttagaccacaatacaaattttttaaaattgaaatcacaagtttcttttcaggccacaatggaataaagctagaaataactaacaagaaaaactttggaaattgtataaacaaatagaaattaaacagtattctacttaacaacattgagtcaatgaaaatatttagaaggatgtaaaaatgcattgaaacaaatataaatagaaacacagcatattaaaacctatgggatatagtgaaaactactaagagggaagttcataagaataaacacctacatgaaaaaaaagtagaaagatttcaaataaacaaccctacaatgcacctcaaggaaccagacaagcaataacaaacacaattcaaaattagtagaagaaaataaataatatcagaacagaaataaacaaaatagatacgtaaaaaacaatacaaaatattaacaacctgaaaagtttttctttcaaaacatgaacaaaatcaacaaaccattagctagactaagaaaaaaagagagaagacacaaataaataaaaaatgaaaaataaggcattaaaacttataccacacaaatgcaaaagattattagcaacaattatcaacagcaatatgtcaacaagttgacaaacctagaggacatggattaattcctggacacatacaacatactaagattgaaccaggaagaaataggaaacctgaacagaacaataaagagcaaaaagaccaaatcagtgattaaaaagaagtatgccaaaaaaaaaagaaaagcccagaaccaggtggctttactgctgaattttaccaaactttcatagaggaacatctgttcttctcaaactattccaaagcatttaagggaattattccaaactcattttatgaagccagcattactctgaaaccaaaaccagacaaggacgcatgcacacacacacaaagaaaaccacaagccaatactacagatgagcatacaagcaaaaatccccaaatacaagcacaccaaatccaatagcacatcaaaaagcctataaagaagacatggtcacaaagatggttcagcataacaattcaataaatgttatatgttcctttgacagaatgaagaacaaaaaccatatgatcacctcagtaggtgcagaaaaagcatttgataaaatttgacatgtcttcatgataaaaaaaaacactccctacaaagtatgcatagaaagaatgcacctcaatacaataaaggccatatatgacaaacctacccctaacatcataaatgagacaaggatatccactttcaacactcttattcagtatatttttggaagtcctacccagagcaattaggcaagagaaagaaagaaagggcatccaaataggaaaggagcaaaatcaaattgtaccagtttgcagttgacatgatcttatacatatataaatacctaaggactccaccaaaaaaaacttttagaattgatagacaaattcagtaaaattgcaggatacaatatcaacttacaaaaatcaatatcatttctatacaccaataatgaactagcaggaaaagaaattaagaaagcaattcaatttacaagagctaaaaaataaaacacttgggaataaatttaacaaaggaggtgaaagttctctgcaataaaaccttcaaaacactgatgaatgaaatcgaagaatacacaaaaaatgaaaagtcatcttatattcatggaattagaagaatcaatactgttaaaataatgtactacccaaaataatctatagattcaatacaatccctatcaaaataccaatgaagttcttcacagaaatattttttaaaattgtaacatttgtttggaaccagaaaagaccccaaatagccaaagcaatcttgaacaaaaagaacaaagttggaggcagtgcactacctgaattcaaattatgccacaaagctatagtaaccaaaacagcatggtgccagcataaaaacagacacatagacaaatagaacagaatggagaacttagaagcaaatccatgtatttacagccaaatgattttcaatagaggtgccaaggaacatacattggggaaagacagtctcttcaataaatggtgatggaaaaactgtatattcatatgcagaaagatgaaactcaacctctatctttcaccaaatacaaaaataatctcaaaatagattaaagacaaacatcaaacttcaaaccataaaacgactagaaaaatgcatagaggaaatacctcaggacattggtctgagaacaaaagcaaaattaggtaaatgagattataccaaattaaaaagctgcacagcaaatgaaacaattaatagaatgaagagacaacttgcaaaatggggagaaatatttgcacaccattaacctgacaagtaattaatatgcagaatatacaaagaactcaaaacttagcacagaaaccaataattccattaaaaatgggctaatgatctgaatagacatttctcaaaagaagacacacaaatggccagccagtatatgaaaaagcgctcaacatcactgatcatcaagggaatgcgaagcaaaaccacaataagatatcatctcactctagttggaatggctattatcaaaaagagtaaaagaataaatgcttgtgaggatgtggagaaaaaggaacactatacactgagggtgggaatctaattagtaaagccattatggagaacagtatggaggttcctcagaaaaattaaaaatagaaccactatataattcatcaattcccctacaggatatatatccaaaggaaaggaaatcaatgtatcaaagagatatttacacccccatgtttattgcagcacaattcacaataaccaagatattgcatcaacgttaagtgtccaacaacatatgaatagataatatcacatatatacagaaaagaatctattctgccataaaaagaattatatcttgtcatttgcggctacatggatgtaactggagataaatatgtcaagtgaaataagccaggcacagaaatataaatacagtatgttctcactcatatgtggaagttaaaataattgatttcctacaagtagagagtagaatagtagttactagaggcttggaagggtataagggagagctgaatagggaaaggttggttaaagcatacaaacctacaactatataggagaaataaagttctaatgtttcatatttttgaaatagctgtgtatttactccatattttgaaatagctagaaaagaggagtttgaatgtttctagcacaaaaaatgataaaagtttgaggtgatggatatgctaattatcctgatttgatcattgcacattgtgtgtaccaaaatatcactctgtactccataaatgtacaattatttgtcaatttaaaaaagtgatcaatatttttattgaagtattttttcacttgttttaaaaaaagctttgtcccctactaaaaagccatacagatagtttaatcagttctatttttatgcaataatattttatgattcatttttaagaatcagtttggctttttttaatggtacgtggtatggattgtttttgctttttttcatttatttcataacaaatggtcaattgtatcagcattctttaattgaaatttctgctttccaatacattaaattctaatgtatatatgtgtctgttttggaactctgttatgtttcattgatatatttgtctatttctatgccagcaccatgttcttttaattatgataactttatagtatgttagttttgcttatgagcgtcagatagtttttcacaaagaaagtgactcttgaccaggtattaaaagatgcatggacattcagcagacaaaaaaaaaaaaaaaaaaaaaaaaaaaaggaaataaggcattccagttagaagaaacatgggccaatacacagaggtatgaaatcaattgtatggcatatttaaggactctcagctgtgttgtatcactagaggacagttcttatagtagtccagggtgggttttgagggcagagaagaagattggggcatattatataagggtctttcattgctttgtttaaaagattctggaattattcttgaagcagaggagagttactgaaggcttttgagtaggggaataatataatcagctgtctttggcagaagtgtgaagatggtataaagagcttatggaactgctgtaggtattcagagaaagaagagagctctgcaatctggattagtcagaagaagctttataagggaactgctaaactgtgaaggaatgataggatgggttaatttaagggaatactctgattcatgggttcaggaggagaaacctcttatatgtttatttaatttatatttgtattattttttatcttatattttttaagaatcaggtgagttaaaataaatccgatattcattaggtgcagatatcttcccatgtaatttaattcaagccaaggtagtctttgttacaaaatggtgcaatgtggctcttttaagtaatcaagctttaaaatgtcaaataaagatttttcattcaccaaaagaaagcaattctgagagaatttttaaaaccattaaggacagacatacctttagtttaaaaggcagcttggaaactcatagtgaaggaaagagtaagtgggcaagcaaagcagaacttcaagttaaaacctaggcagaaattaaatattttatccaacaaaaaagcagagagtatatgtttgtgacttcactgttactcacttttagtaaagagcaagaaagtgtcaatggaacattttaaaccatgaaatgtaattgttttaaaactgtgattaatctgggatagataaaaccagagttctttttaaaatgattggacagcctgttgagagaaataggatacataaagcacaaattagaaaaccttcacagatatctgttgtttcccacttgttctatgtggaattgcatggctaacctaattatttactaactttaagtaatttattatacttaaaataactttaaagataaatattagtgagcatatagtgtggactgtaccagttttttcttggtttgtctatgtctaagaaaatccaaactgccatgcctgctattctagcttgatgattcaccacaaattacacggtggcaacttccggaaataaaggcagagttcagtagggacaaactcaactcctctctaggatctgttcttaaacttcatcccctgaaacatgggagaatttcacaccccttgtgccataatctctttgtgagtaaactgctattttgagccactgcttaaaatgggttggttctttatgctcaaaatattttaaagattttagaaagaaaaaaaaatatgggaaagaagcctgatggtgaactctcttttaaatcagttaattgtagggagcaaatagcttatgcagaaattacaagtttttaagcaaggagataaatattgggtaatattattcattaaaagaggtatttggggatgaagaaaacattctggaaatggatagtgatgatagtcatacaacattgtgaatgtacttaatgggcgctgaattgtacacttaaaatggttacaatggtaaattttgtgttatctatattttacaattaaaaaaatagtgcatgagagagagagagagagttggggtaattatagagagtttcctcaaaggagatattttcctcatagaaaaatacatcctatatatttccatctttgttaagttttagtttttcctttttaagtgcatggaacctgagtatggcgaagatgtttctgtcccatcctcagtccaggaaaaataccagaagtttaaactgaagtgaaaaagcctgtgagtcaggaatagatacggttttatcagagaataattatagttagcgagtgagtgatgaagaggtttcagtgcctaaagtgaccagcctcatgccaagctctgatgccccacactctcaatcagagccaacagatcaggcaggcaacaaacagcacttgtgcccaggccaagacctagggcaaattttcaaagctggtatgattcaaagtgagttccaattagattggggatctgattaagctaattagaatagataacagtctaatttattgcagtaggtgttcattttacttcaggtattttttgccttatgatgttttctttgatagattcattccatctagccatcaaattcatggagttatttttaatagagaatatatgtgaacagaaaagaggctgtctgcttgcctgtgtctcccatttgagaatatctcttactgggaaatgtaaagctaccatccgtaggtgtaacagccaagaatgcatatccatctttatgcattaagtacttccctagttggcgggttggatttggtttttaggatagaagattgattcttggaaaccatttcaataacagtgacttattttgttcacttattttactgagccagagtttccttcaatcagggtatcttttaaagccattttctctttacaaaatttgtaaagtcattcattaatgaagtatactttatatacaaggaaatatacattttaagtgtacagattgatgaggttggacaaatgtaactcataaaactaccaaccaaattaaggttgaaacatttcctttgtgcccctctgtaggcaatccccagcacctcccccatccttgccccaggcaaccactgagttttttcttgctatctttttaaaatatagatttgttttgtatataagtcatgcactatataacaatgattcaatcagtgacagaccacatgtacaacagttgttccataagattataacaaagctgaaaaattcctattgcctagtcacatcacagccatcgtaaaatcatagcataacatattactcatatgtttgtggtgatactgttgtaaacaaaccgactgtgctaccagtcatataaaaatatagcatatacaatcatgtatagtatatactacttgataatgataataaacaactatgttactgtttcttgtatttacttattctatacttttaattgttattttggcgtgtactcctaatacacaaaaaacggttaattgtaaaaacagcctcaggcaggtctttctggaggtatttcataagaaggcattgttatcataagaagtgaaatcttcacatgtgttgttgcacttgaagaccttccagtgggataagatgtggaggtggaaggcagtaatattgattatcctgaccataatcctgtgtagacctaggctaatatgtgtgtttgtgtcttcgtttttaacaaaaaagtttaaaagttaaaaaacaactaaaaatttgaaaacagaaagaagcttatagaatgaggatataaacaatgaaaatatttttgtacagctatacaatgtgtttacattttaagctaagtgttattacaaaaaagtcaaataatttaaaaattttataaaataaaaaagttatagtaagctatggttaatttactgttaaataatttttttaatgaatttagtgtaccctaagtatacagtgttcataaagtctatagaagtatacaataatgttgtaggctttcacatttactgaccactctgtgacacatccaagacaacttgctctatttaagctctattcatggtaaatgccctatacaggtgtaccattttttatcttttatgtcatatttttactttaccttttctgtttatatatacaaatatttgcaattggtgttacaattgcctacagtattcagtacagtaatatgctgtataggtttgtagcttaggagcaataggctgtacagtatggcttaggtatatagtagtctatacaatctaggtgtgtgtaagtaccctctgaaattcccagacaaaatcacctaacaactcatttctcagaacatatccccatcattaagcaacacataactgtattttagaccttcatgtacatggaatcttgtagaatattctccttagtgtttggcttattttgctcagcataaagtctgaactttatccatgtttttgtgtgtatcagcagcttttctttttttatcatggtgtgactataacacagattttatcagtttaacagcttatgggcatttgggtattctctagtttgggtctattataattatgtggctatgagcctttgcatacaagtctttctgtgggcatatgttattatatttcttgggtaaataccaagagtggaatttcttggtcatataggtatagttacctttataagaaacaaccaaacattgttttttgtttgtttgtttgtttgtttgttttttgtttttaagacagggtctcgctctgtcacccaggctggaatgtgatgttgtgatcatggctctctgcagcctcaaccacccagactcaattgattctcctcccttaggctctgagtcgttgggactacaggtgcatgccaccatgcttagctaattttttttattttttggagagacagagttttgccaagttgcctaggctggttttgaactcctggtctcaagtgatccactgctttggcctcccaaagtgctgggattacaggtgcaagccactgtgcctggcctaaccaaactgttttaaaacatagttgtggaaggggtggagcaaggtagccaaatagatggctccaccaattgtccctccttcaaggacactaatttaacatttgtctacacacagaaaaagcaccttcataaaaaacaaaaatcaagtgagtacttacagtacctgcttttaacttcatatctctgaaagaggcgctggaagaaggcaggaaagacggtcttgaatcattgatgccacccctcccccatcccctgacagcagtcatgtggcatgcacttgaaagtgcaggaattgtgagacattggattgaactcagtgctgccctgtctcggcagaaagcaaaacgaggctgaactctgctaatgccctcccatggagggaacatttaaaccagcctttgctagaggggaatcacccatcccagtggttagaacttgagctttggcaagcctcgccaccatgggctaaagtgctctggggctctaaataagcttaaaaggcagtctaggccacctggactgcaactcgtaggcaagttctagtgctgaatggagctcagatctaggcatcttgggggccaggagagctattgagataccagccaaggtggctaagagagtgcttataccacccctacccaaaccccaggctgaacagcttgtggctccaaaaaagataccttttgactacttgaggagaggagaaggaagagtgaagaggactttgtcttccatcttggataccggctcagccacagcagggtagggcccatttccaggccatctctcctggacaacatttctagacacactctgagccagaagagaacccagtgccttgaagggaaggacacggtccaggtaggacctatcactggctgactaaaaagccgttaggccctgaataatcagcagcgatatccagttagtatgccatgggccttcagtgagactctgagactagctggcttcaagtgagattcagcatattcgcagctggggtggttatgggaagagactctttatgcttggaaaaagttgaggaaaagtaaagggcactttgtcttgcaccttagataccacctcagccacagtgggatagagcaccaagtgggcacttagggttcctggtttatggttccagaccttggctcttggatggcattgctagacctgctgtgggccagaggggagaccaaggccctaaagggagagtcccaggccaggccccatccaccacaagctcattaaagagtcctcgggccttaagggaacattggcagtagcctcgtagtactctccatgggcctgtggtggtggtagccatggggtgaaactcctttgcctgcagaaaggggagggaagagtaggaaggactgtgtctcaaggtttgagtgcgacctcatctgcagtaaatagaacaacagacagacttctgaggttttttactccggttcctggcttctgaatgacacctctgggcatgcatggggcctgggagagctttgccaccctgacaggaataacaaaagcctggctaccttgaccacctttctgataatcaaattcagtcaagttgcaggatacaaaatcaacatgcaaaaatcagtagcatttctacataccaacagcaaataatctgaaaaagaaaccaagaaagtaatcccatttacaatagcaaacaataaaactaaatacctaggagtaaatttaacaaaagaatgaaatatctctgtaatggaaactataaaacattgatgcaagaagttgaagaggacacacaaaaaaagaaggatattccatgtttatggattgaaagactcgatgttgttaaaatgtctatactacccaaagcaatctacaaatttaacacaaactctttgaaaataccaatgacattcttcacagaaatagaaaagaaaattataaaatgtatataaaaccataaaaggtccagaatagtcaaaactatcataatgcaggagtcacattatctgattttaatttataattcagaactatagtaatcaaaacaggatggtactggcataaaaacggacccatagatcagtggaccagaatagaggacccagaaatttacatccacacatctaaatccatacatctacagtgaactcaatttggacttaggtgccaagaacctaccatggggaaagggcagtctcttcaataaatgatactgggaaacataaatgttcatatgcagaaggaagaaactggacccatatctctctccttatacaaaaatcaaataaaactggattaaagacttaaatcgaaggtctcaactttaaaactactaaaaggaaacattagagaaactctaggacatgggaataggcaaagatttcttgagtaataccccacaaacacaggcaactaaagcaaaaatggacaaatggtatcacatcaagttaaaaaacttcggcacagcaaaagaaacaatcaacaaagtgaagagacagcacgtagaatgggagaaaatatttgcaaactacccatctgacaagggattaataaccataatatataaggagcccaaacaattctatagaaaaaaaatctaataatctgactaaaattggacaaaagatatgaatacacatttctcaaaagaagatatacaaatggcacatgggtatatgaaaagctgcttagcatcattgattatcagaggaatgcatatcagaactacaataagatatcatctcaccccagttaaaatgacttttatccaaaagacagccaataacaaatgctggcgaggacacggaggaaaaggaactctcgtccactgttggtgggaatgtacattagtacaaccactatgaagaacagtttgggggtttctcaataagctaaaaatagagctaccatatgatccaacaatcccactgctgtgtacagaaccaagagaaataaaatcagtatatcaaagaggtatctgcactcccatgtttataatagcactattcacaatggccaagatttggaagcaacctaagtgtccatcaacagataaattaataaagaaaatgtggtacatatatacaatgaaatactcttcagccatcaaaaataatgagatcttgttatttgcaccaacatagatataactggatgtcattatgttaagtgaaataagccaggcacaaaaagattcactttgcatgtgttcacttatttgtgggagctaaacatcaaaacagctggacttatagagctagagggtggaaggatggtcaccagagtctgagaaacgtagtgaggggttggagggatggctaatggatacaaaaatagtttaaaataataaataagacctagtatttgctagcacaacagggtgactgtagtaaaaaaataatttagttgtatatttaaaaataactaaaagagtatcgttggattgtttgtaatgcaaaggataaatgcttgaggggatggataccccattctccatgatgtgattattatgcattgcatgcctgtatcaaaacatctcatgtagtccaaaatatatgcacctactatgtacccacaaaaattaaaattaaattaaaagtgaaaaaagcacatgaaacactttaaaaagcacaactggaatacaaatggaagattatataactatatcttatcaatgttaaattcaatgaagttgataacagtactgcaatcacataagagaatattctcattcttaagaaatacatactaaagtctttaggagctaaaagccttggtgaatgaaatattctcaaatggttcaggcaaaaataatatgcatgagcaagagtgcgaatgatgaagcaaaaaggataaaatgctagcaatagattaatatggatcaggagtatatgggtgttcttggtactatttttattattttcaacttatttgtaaagtttaaaattatttctaaatagaaagtaaaaataattcacataattttaccattttataattccaccagcagtggatgagaattacagttgctctacttccctaccaacacttggtatgatcaatgttttaaattttagccattataaatgtgtaaagtggtatgtcattgtggttttaatttgcatttctctgatgactaatgaagttgagcatctttcatgtgcttcttaggcatccctatatcttcttttgtaaaatatacatacaagtcttttttcccatttttattgggtgattttctttttattatgttgaaggggtttgttatgtatacttaatgacagttttttgtcaaatatgggtgtggcagatattttgtcctgatctacggctttccttttcatcttcacaatattgtcttttgaataatagaaatttttactttcgataaagtccagtttatcaattttctttttatgatccaaattttttggctctaagaaattatgttaagaaataataatgtcattattattattatgttgagttattaagagaatggacttgagagttactcagatctgagttctagtgacacaaccacttaatctagtggcactaccgtgaccctgggcaagtgacctaacatctttgtttctcagtttccccatacataaaatggggataattttattacctaccttccagaactgctttgaggaacaaactagataacatacatacaatacttaatgatgttcttggtacatagcaaacacttattaaacagtagctgctgttacttgcaaatgtttgtctttgggaccttatctttctaaaatctcctctctttttagctctcccaacttactcaggcaaccaagaaaatttctctacagatattgaatggccaactcgatgagggaattgtaacgaaatgattctaacatactttgaattttaacgagctactcaagatgatactcccctgaaaagaagggagagcatatgggccagtgaacagagccctgagtggccactgacaacctcaagcagcagctactcaattctggggacttgcttctttggtcccagggcatcacataactcataggataccatcaagccccatttcttcagacatggtttcctgtatttgattttgggtcttattctactctaagacattttccttattatttttaatatcctctcaaattcagaaagctcttactttcctgaccttgtcataattaacaatagctatttcttgcttatgagttgttacctacaatttcacataatttttctgacaggctgacaggctgactaattaacaaggtttgaccaccctctcaaatcagttggcaaggctttgggctttgacactgaaaaagttctttgaagcttagttaccattcttacctgctatatgtgaataataaatgcagagttgctgcatgtagaagtttgtcttcatcatgtgcttcagcattcaaagatatcttgacgctctctttaagggattatctgacagggattagatgcaattttaactcctgtcccatagataaacacctacttagagcattatcattaaataattttcacaaagaacaagtaatttttaaaagatactattcaaaacatattattaaccagagaagtctttccaagaaggccttaacctgattatttggagaccacattttcttaatgtatgtgtccattttacccacacttccagtaataaagatactcgctctctgtatctctctctctctcactcacacacacacacacacacacacacaatcacatgcacacattatacacccttaggcagaaagaacaagcagagggaaaaaagagtatatgagtcttcagttctcatcatttagctcccacacagaggggaacaacagacactggggtatattgcagggtggagtgtaggaggagggagaacatcaggaaaaataactaatgggcactaggcttaaaacctgtgtgatgaaataatctgtacaacaaacccccatgacacaagtttacctatataacaaacctgtgcatgtacccctaaacttaaaataaaagttaaatttaaaaaaaaaaaggtttcagttaagaagtatggttggaaatgaagttttctgctcaactcaactatctggttagggaggtagtgaagcatagcagaaagaatactggagtttagagtcaaaacagaggattaagttccctttacaccagttactatatgtgtgaccttgagtcataatctctctgattcacaatttcctcatgtgaaaaatcagtatagaaatgcttatgttacagagccattgaaataattggaataaaaccataaaatctttgtaaaatctaagtgtcctgtgacatttaaatattctataattctgtaagggaatatcagagaattataaatttatgtcctggaactacccaggtaagagctttcaattaggatatctgttgttatgagcacagagttgcgcgatccagattccccttcaacaaaagacttattgtccctgttactggaagtgtggtaagcagatagccttcagctttaacctcctgagactgcttcacctgcacaagagctgccttatgctcttcccatggaggtataagggaggaaaaataattttctctttaccctctagagttcttagtcgggacagactcctgtaatgaaagacagattaacaaaaggaaagcaaacacaagtttattaacttatacatttcatgtatacatgagaaaaaaaaagcagagaaattagtaaattttaaagagttgtcttagacctaaggcttaaatacagcagttctctgaaacagggaaaaaagggtatggaaaaggcctggttaagaccagaaggccaaataaaaaaaaaaaaaaagcactgttaaataaaggtaagattgattatgcggatttgagtccatgccttctccactgatcaagagtctctagtgatttggtcatccctttcttcttggcacaaagagggagacaccattacaaaataagatttcctttatagatgtaaatttctcttacaaaatggtaactttgcagagcttctcctgtgtctgcagtttctgaaaataaccagctcaataatccttatgcaaaagaggcataatttggagtggcatattctggtctccaacagttatattttgggatggcatgtccttaaccctatcagaggcccacatttaatacgtgattgaggccaagatatgaaggcccagcataaaagcagggagaaaagttaaggtgctccagtagttgtccaggagagagatgatggacacttggcctagaatagtgccagttgagacagagaaaaataggtacatatattgagaatatgctttggatgtagattcaataggactctaggatgagagaaagaatggagtaaatgatatgccataggtttttggcaaggtatgtagtgaagattttttttaggccatattaattttgagatgcctaatagacatctaggtagaaatttaaaggagataggtagatatatgaggttggaactcagaggagaaataagggcaaaaatgtagatttaggaataatctgtatgaggacatgggactagatgagatcatgtccctagaatatgggaagccagttctttgtcacttagttatggagaacagtgtttgttaatttcactcctataatagtgtaggagtcaacacttcattgactgtatgacttaaatccagcaaccagaccatttagaaagagtcctcattaaaatgaagggatttttggttgtgctattgcatactttaacctaataattacagagttcctactatgtgctaaggaatttgtatgcattatattatctttaatccttaacacatgtaaatgaacactactattatcctgatgtcacagatgaagaaaccaaggttcagggaagtgaagcaattttctccagattacacagttagtaaattatggagttgatttcctccacgtttaacctccacttgcagtgcatgataatacccagtaatagcagccattaatggatcacctagtaggtccaagtcctgagataaagtgctttatatggcttatctcattctaataaaaatctacttattatccctattttacagatgataaaacctgtccttagagatgctaagtaacttagccaaaatcttatagctcgtgagtgacagagtggggtttcaaatacacatttgtctgaatcaagaactttcatctcctctggccttagctgagtagaaaaggaaaaaaaattcccctagaaggtgatataaatctccccaaatgacaagcagatggaaagcataacattaaaaatgattggtattaagaaaataaatttcattggaaataagaagttcaaggtgattattaaaaatcaacaagacattgggaaagcatcttttgaattactttttaaagcggtcatctttaaataagcaatggtaaaaatatgaatctaatcttgcttctaaatctaaatgttttgtgaccatgaagcagagtgaacatcaccaaccaacataagattggacccatggccttggcttctgaggacagaattctcaagcacttagtggacttgaagattcttctcttagtcatgagaagcccaggagatgttctaaagctgaggagatttatttgattggttcctatatccctcaacataacatcaacatataagtatacctgtagtttctcttcttctatcactcattctttcggctcccaaggaagaggtttataaacatgtcataaatatatctaatcttaacaggcattatccacaacatgttaacagttgctctggagacaccaaattgtttttggacattttgaaagaggcttgtgtgtagaacttactgtggacaaatttatctctggaggtttttaagatatttaattgatctgcttgattttctccaacacttagcacagagtctgaaacttactagacacaattatttgttgatttaataaatgagacttcaatatctcaaggcaaaacagtgttcagtagtgtgaattttaaggcattgcgacaagcttgttgtttttaaaccagatatttctccttgatgtagtgaggccgtcctctggaataaggctcaagcccaaggtaaaacaaatcttattgcctgtgatcctttcaaaaacacagttctgaaaggctcagtacagaatttggtgaatattgaatagatgaaaataaagtctaaagcttttcacaaggcaggcatgtgttagtcaaaagggaagggggatatgtatagaatctgtatctacttggttttgttattttaagctgttgccagtcactgattttaggtgtttgacttaaaatattttaagggagtgtgaatactgagctatgattatttccccagagaggagaaagcctttattctctgtagctattactgtacacctcaggtactagtgatggggacattaagctgacccatgtgtgtagctcaccacattccctcagggtaatgctacgaagatacatctaaatattacttctcacctaaatgtgtgtgtgtgtatatggggggatggggaagtaacgatggttcagttcagtggcacttactcctcttctgtcatcactatcaagtaaattgaaatgctcctagtatgtatactttgagagtgctccagattggaagatgccatttgactcatttcaagtcacctgcctttttaatcatacgacaattataccaaatttgacattagcatgacaattaaatgttttaaagtatttaggagctttatatttatattaaatatgtattcagtagaagcacaataaataaggttcatttttataagctgaattaaaagtcaataaaaataataataataataataataataataataatagaagcatcagagactgcctaggattttcaaactaccagttcagccaaacatcatgtcctgtcggcaagtgtacatctaagtacataggagttgtcagacaggagctagaatgtgtttctcagcaggaatttttctgtcttctgtcattttcattctgggtgttataaatggtatgtgttgttgtatttcagttattatctttcaattatagagtctgagagtacataggattctttgaggttatctcttccagcttctctcccaataaagttatccttttaataatattcacagcagccatttagactgaatgtgtccagtgacaggaacctcattcttaaaaagcagactgttctgttgttgaaaagtgctgagtttcagaaaaggtgtttgacttaaagtatttctgtgttaggtaaaatctctttccttataattaaccatcgctaatgtatttactctcttgagtcatattgggtaaatctaatccttttctacatgatgactatagacatttttgaatacatctaccactgtccacccaccaatgaccaacctcacccccactaatctcttctcaagttttaaaacctctagttccctcatctgtttgtctgtccctcatgtgagtctgttttaaaaccttctgtctttgtgactacatagacctagttcaagtactggttgcttatgatgtgacctgtaaaatgggggaagttatttcaacctcatgagatcttatgagaattaaattgacagataatcctttttttaatattattggtcaaacattattctatgtgtcttacacatattaactcatttaattttaataacagtcctatgaggtagttgctattattattttcccaatttatacacaagaatattgaggcaataaacatttattcaaggtcacataactaattggtggcagagtaaggatttgaacccaggcagtctggctctagagtcttgacctttaatcactatgctgtactacctttattaagtgaggtaacacacacacacacgtatatatatatacatatataaatgcatatatttggaaaatggaaaaactgttttaaaaaatcctaaatttttaatttaggcctgatactacagatgtaatcaaataatcttagaggggcagtttttttcagttctgggaccaggtttcatttggacactttgtagactagatgaatctaagtaaatccttctgtctgtgatgcccacatgaagatcctcccctaagatatagtgacccattcatttatccaacatttattgagcactactacaaattaggcacagtgtcatctgttgtggactagatgtatgcaagtaaatcctcttgtctttgatggccacatgaaggaccttccctaagttatagtgacccattcatttatccaacatttatttgagcactgctaaaaattaggcatggtgtcatctgttgtggatacaatagatcatgaccaaacagatatagctcctgtcttcatggagcctagaatccaggtgaaagacagacattaaacaaataaacacaacaatacacgtatgattactaatagtaaggcattttgaaggaaaataataggatgtaataagaaacaatagcacagggaagttattctaaaattgggccagtgggtggctaaggaaaagcttgtccatggaaataaatcagagactcaaagggtgaattgaagttagccaaggaaaatgttgggatacagcattcgagaaggatttaaaaatattttgaaggccctgaagagaagaagaactttacctggtcaaggacctaaaagaaaaagaaggccattgtggctgagaaatagtgaaggggaaccagaatgactctaaatgaagttggaagattaggctggagctacatagcaccaggcgattgtgctgaactgatgctgctattaggagtcagcagaacaatgttgcagaattgtagttggtgttttggatggtatcttgagaggaggcagctcaaaagcatacagcaaggagactccagagactccaccagttgctgttataactcacctgaggcttatatactaacatgcaattagcctataaatactgataaaaccttcttattaatatcaccactaacctgttatctacatctacaactcccacctcaggttaccattttgtgcctagtttgtgccctcgcatcttccccagatattgtttataatcagagatcatctatacataagtattgaagaaaaggctattcagtgtgatttgcacaagtagcattcacccctagatatgggactggaatctatatactgagagtagggttggtaattattatagccacgtgccgccttttttctgccagtaacgataacatcaagcctcaaagttgagctctggagtcacactgacatggcatgatttcataactatggattaactctgctactaattatctgtgaccttaaacaaataagttaacctctcagccttagtttctgcatttgaaatgtgaaactaatgatacttatctaaaaagatggttgtgagaattaaattaagatacttaatatgtgggaaagaacctgacacaatgcctgatgggcagtagatactaaataaatgataaatttatttctttatgatatacaacagagtgtttcttttctacaaagtcaccatagggtgatccttcacatccaaatttatttcatttatgttatattatacttggacatagatatattgtttgggttttactaacctcaattctacagtatttttatggaaccatagtactagcatctgaaaggagccttagaaaactatttttatcctcatccttttagtagaaatagtgataaaggttcctaatcctgaaacatatacaacacatgcagacattcattcatacaggtagcaaaatgctaattaatctctttgtgccacgttctgtgctaggtcctggagatacagatattactaagcataatccatatccgcaagaagttcattgcccaaagggtatgacagatatgtgtggaactaactatattaaaagacaggctcaggtgtttggtgggagcacagaggaagaaatgaaatctgcctgtggatgtggtcacaacaactagcccttttattatgtgtatctgactttagtatgtatgctaacatttccagactcacttgcttcacagcaacttaaaacttgcattttatcttctaactgctgaactcattcttatttggagcttatttttctcagaacaatcaatcaagtctttccttactatccactctgtgctagggcttgtgagggataaaggagaagcagattatttgtccccaccctcaaggtgcctgaagtccagacagttgagagtgaaaagacccccaacaataaactactatttactacagagctgcctctgaatatgttcagagaagagagctcagggtgagttggaagaattagaaaaaaaaaaatcaatgttccggcagattcaaacagcagttcaggcttttaaaaactgcctacatacaaatatttagagattcatttaaatattctccactgcataataactcaaaagagaaaaacaagttcagtgtaacagtatctctcccaatgcttgttaatctgaatttatagcacattgatctaggagtgccttatttaaattctgttaaaaatcttagttgtaatattcctagctggtccaaagacagggtaggctaagcatgtattagtgaagacaatagacaaacagattctcaaagctgtatacatttcagcataggaggaacctgacataagaaaaaaacagggatgcaatgaaattctttgaagccttgctttttgttagatgaacctttgaaaagggtgttttgaatttttgaggtgcacacacattttatgtcagagaaatatcacaggaaggtatgtttggaaagaagctgatggggagtgagaaatgaggattgctgctgtaaggcattaatgagttggaagaaggtcaacaacccattttgaagtaaatctattatctgagttcagaatggtcccaggaggaacttgtactgacacacccaaaattccctctctagcctagagagatggaaaacagaggaagataaatctgatggtggttttccgggtacttcttactcctaagtatgatgaatggaagttttagaccctttggtttgtatggaagattttaaatataaacatggtcaatggcaaatgtgcttagaggtgataagtttatttttaaaatttttatagatttagtgggtacaagtgcaattttgttacatggatatattgtgtaatggtgaagtctgggattttagtgtaaccatcacccaaatagtgtacatcgtaaaaaggtgataatttttattagatttcaaaaaaacataaataattgaaaagttatccaagctagtcatttaaaatccattgagatattattttctacctttccttaaaattagtcctatctccttggcctagcatttctccaacttcagtgtacatcagaaacacctggagaaattgtatagcctgcagattcttgctcccccctcagagattctgattcagttggtatgtggtgtggcccagggatctgcaggtcaggaaaacctagtgcaataataacaggaaaaaagcttttcatttcatcttaaaaactgtatttattattgtctgtaatggaattgaattaaaaagcaaactggtcctatattttaaaaggctttctttctttagtaggagcttacatggcctttggaaaatcttataactgcaatttgggccagacttgcatttattgctttatcaaacaacaaaacaataactaattattatatagttcataatggcttatatttaaatattatcttctaatgaatatccttcttttattatgattatagatttatttcccaattcagaaaaagcgttatccattttacaaatataactctattacaagtagaattaaaaaatacagagaagttaagtgattagcctaaagtcacacaggaaccaccaaagagagaaggtgagaatctatattttcggaatcacaatgcagtattctgttaggcaacgctgctttcaaactagaaaatatagatgggagtttttaggaattgacatttgagccacagatactaaactgtttccctacctcactctgccaactttcatttccccttatccctacctaccctacctcatctacttcatcctgaagttcctttcccatagttacatatgttccttaagaatttatgttgttactaaaaatttgtgaaatgtcagaaagttgatctcttaatgccatgaagttgtgctgatcaccatttgatatcagatctattcctggccctaatgaatacagttttatcttatcattttgtgacttgggtgtgaataggcccaaaggtgtgcactgagcactgagcatgcatcccaggatcccactcataattaaagaagctaggtggcttcacaaagtcagctttctttggccattctacatatggcaggttcaggaatggcacctaaattgctgaaaccatcgagtacagaatctctgtgaaagtttactttctctgttcaggccagaccatgtcagcagaattcctttattttgctgcagtttgtgtgtctggggagggaggaggtgggatgaggtggggatgggaggagtattctccaggtgctaagtgtgccttttgctccttttgcaaatagacttgcaggctgccctgggggagctgcttttatgccatggtgcattggtattgtacccatttcattttttttctttttctttttttattatactttaagttttagggtacatgtgcacaacgtgcaggttagttaaatatgttcaaaaatgaagagacccagcttgcttaccatagctcaaaaaagagattagtcaatgaagcttgggaaaatcatgacttgccaaatccttcctaacttttacagtctgctgtctgctgtgtatgttgtctagataccaaatagacaggggcctttgtatccttggcatggctgttgttaaaagataattttacaaaaaaaaattgtaaaattaagactgtcatacagatataaaaatgaacaaacactaaagattttgtttaactcaataatgaggaaacgtgtggggtgttataaacagtcaaagggagaattcccaagaaaaaagaaagacacatttataaattagaaagattgaaatgaatgtggaaatggaagcacactggcttctttcaaagttgagcaggggaccacgcatggtggctcacgcctgtaatcccagtactttgggaggccaaggcaggtggatcacttgaggtcaggagttcaggagttcaaaactagcctggccaacatggcaaatccccatctctgctaaaaatagaaaaattagttgggcgtggtggcacactcttgtagtcccagctacttgggaggctgtagcaggtgaatcacttgtacccaggaggcaaaggatgcagtgagctgagattgtgccactgcactccagcctgggcaacagaatgagacttcatctcaaaaaaaaaaaaaagttgagcaggggtttgaacatttactggaagtttacatgtctgtggacaagaatcactctgcattgctctcagttttccacagtttagagagttgtaaaattgctcaaacacagtgaaagactagaatcagataacttgaagggttgtgatctaaaccatgtatagctttccattcaattttttttttctctacactacatttgggaaaacagcccaggtcttgatgagactaaccagtgggcttagaagcagtaggttccctgttgccaggtctccttgatccttgtatgcctgaactggccaacttagaaaaatgtttcttgagtcatgttttaggatgccttcagcctcctgtcaggctcttgtttttgtctttgatcctttgaaatggccatttggttctatgacagttgcaatgtgatggcaaggagacagaagaagagattagtgatgtagagatttcaaaaaaactccagaagttaaaaagtcccttcatctcattcagtttccactgcctattccctttcctcaaagaaagggagtaatccaaggtgctactctctcccattccatgaagccaacttgccacaacagtttgcttttgagttgatgaacttgctttcagtcttctatttgatatggtttcaatttttctcttctgtacatttcattcactgagcatgtacacagggatacacacaaaaaaacccacataaacacatgcatcatacacacaccacttaagaattaaatcttcatgttttcccccaaattatgtatccatctgttaaattattcatgctaaagaaacggagcagaggaatggctaatccaaaatgctagataatgcccaaatgatgtagtggactttggagtatgttttgtgtgtgtgctgatgtttgaaattagatgtgccttataaaagcaggcattggagtactggagaggaatgctttgagactgaaattatggtcctacttcaactaggtttgtgaccaagttgaattcagtttacctttcagcctcattttccaattctgtaaaatgagagatttgaacaaagtgatctctaaagcccccttcagctctgacaattccagaatattccagagattggctttaagccaacagtaaatcaaataagcaatccaaactcaaactcaaactcaaactcaaacccaaacccaaagggattttgggaagctattcagtttcccctcttggccctctgtttacctcttccctgtgaccttcctattgagagtaaatctctctaacattcaagtattcactcacacttttattcagtaatataaatggccaccatttattgagtacttactagtgcaggcaccctactaggcactgtatatgtattacttcaattatcacaacaaccccagaggtagataccattattcattcaattttatagatgcagaagtgaggctccaacatggcaaagagtttactcaaggaaacatagctagtaagcatcagtgctaagatgcaaattgagtctgtctggcttcaaattcagagcttttttttttttttttaactaaagggtgttgcttctccatataattatcagagttatgtgcaaacagtgaaaggcgctagggagaataaaatgttgaagattcgatctgtgcccttaaaggttttcaacaaagtggagaatggattattcatctgggtgttagggaaaaaaaatgaaaatggtctgaaaagtaagaattaattgtcaattgagtgaattaagtgtcaaaaaattgaaaggtgaagtatgagaagaataaatcacctaaaaaaaagaacagagatatcaagtatgacccattttattatcctatttattcacttctgttcaagtcagaggccctacttctgccataaattgctatgtgattttgggcaaaacctatttcttctctgggtctaggtttcctcattttttaagtgatgaggataactaaatggttgcaagttccctcgctgcgattccatgattatataataacttgaggctattttacattcaccactggaatttaagaatggaatctgaatgggaggatttcatgcaaggatctgatccaattgtggggtagaattccttaaagaaatgtgaatctccagaaaatcagccagggaatttgcatagcccttttgcacataaatctaattgtgatagggagaaaaaaaaatggtgcattccacaactatcctttgaaatgtgtctacggtatcctttaaaatgacacattataagttagggaacgttttcaggcaaataggagatgccagagaagtaaagatagatttagtcagtacatctggtacatctggtgaaatgaatagcccagccaaagggttaaagctgaatagcactaattgccgagaattcagattaggcatatttaatagatataaacaccccaaccatccatcatcccatctggtccttcttcatagaaaatggagagaaatggtgagggcatgctgccccgacagactctacttttctcagaacacaacccatctttctaccaggatcccctccattttcagaaacgaataaacaaacaaacccagactttgcgtctgcaaggggcaatatagtagcccagacacctattgactggaaatgtagcctctttataaaaggcaagatggcctggcaccattcaagcttcaatgccttatgaaatgagaaggtaagatccggtctcagtgcaagatttggcacttccatggccttcacattgtgataggcaggagtgataggaaagaattcaagcatatcaaaaatccttgtcctttttccttccttcagttgccttagcacgaaaccacaactaatctacctgtggactctggcttttgacttaacgaatccagcagttttaaaatcagtgtggatattaattaaagaagggagacaacccaaagtttaggtccccagaacagtcttccctcttcctcattagtgctccctcaccccctcctcttttgtatcttactcttctctttgattctcatacaatctttcctttgtcttcccttactctccccagtcctctcttattcctttcccttttttttttcttttctgcctatgccttaagcctgtctgaactcactatggcttaactcggctgacagccacaaaaaactaaagaagacaccggaccctgaccttcaggatggtcccatgtgatcctcataaactctctgagatgaaagtccctgcaacatgcttttatattctccactgaatctagggctggatactgtgcaaatggtcaataaactctttttagttaaatgtaatgggtgaatcactcttctaggcttccatatgtttctgggaataagacattttgtctttcgacagctgacagagtttgacattgacatggggactcagaatttggcctgcttgagagaccatagattttttaaatgttcctcttctatcagtattgaatgagatttgttgacagcatcaagaggaaagtcaaagttgtcattttttattgaaggtggtggagcaagaagttggaggaacttattctattaacaattcttggcagcaatcactcttctcttttgcccccatacagacgcctcacttttgggaaatgatttcaaatcttaaacaagatgttagctcagttttatttctgctgaatagaacagaagttttaatactagagttctgataggctgtgggctcttctaccctttcattataatgtactttcactgaggccatataatctaacttgtgtaaaacttgtcattattggggaattgactccaaatataacaaatcaagatggtcaacttgctcaactgggaaagtcaacatttaagacaaatctaatcatgcatgccagttctcaacgaggtgagtttcagccatacccagttgtgcaagttttacacaaaacccagtttatcttctttgctgcctagaggaaaggaatttggtaaagaactttttcttagtgctcatgtgtgaaggtacaccgtcaacacattaattcatttcactttcctcccagttagggaaacttcctctcccgcctctcagagagaaaagagaaatatgggctgtaggccaagcatgaagatagatcaagtgcattgagccttgagatgctgcttctacattcccatttttattgtttcattcgttggtaaacatttctttactgttatatagtcgtttagatcaagagatcttttagataaagggggcaaccaaaaactaatttagctaggttatgcagcatgttatgaacctattagagaatgaccatccataattccataagttcttacttaaggtgatttttgataatcgttctttgctctattttttcccaagggagatacaataaacccaaagtgataaaataattatcatctttgttgagtttgtctaattgcatactgatttcccacccttgtttattgatcttcaaagaatataaatacagaaacaactgcttgagtctcgaaaatttaaaaatgaaaggtcaacactaatagttctgttattgagccttatacctacttgacaacaggtttactagggtagaccttttatgtaggcagagcagttgacctatgcgatgtggacttaaaagccctaggaaagcttctttatcacttaagggttctcgcaccacttccactattggctaatgcttaaaatctcaccattaaagttttgattagtgtttatataatgtaatgcacatatatatacacacactcatgcacccactaaaactccctaagctgttcttagtgatttattccctaagtgtgaatgagaggtagatacttggttttggatttgagcctagggagaaaatatttggtgcccagcacctgaagaggctcacagaaggggttacatggagagatcagggggcaagtatatgaatacataaccaatacctttattttatgattttgcctagatttcactctaagaatgccaccaacagaagtcttttttactctgattttatttcctttccttcatcttctaatgttctccctgagagctaaggaaaaagactatgggcctcaactgagctcattttagggttgagagtgcgtcttctacttcccttatttgcctttcagtgtctacgtgtctgtacactgaaataaatcaattaatcatattgactgactttcctagttcaaaaagagaaagataagtgatagtatctgaaaagagtacaaaaaggaaaggtacattttcccattctaataatcaggcctacaattgctctcattaactctaagactaagccccctgcccacttacctccagtcaccacaatccctaagtaaacaatttgccatgagaaaccacacaaagaaatgccagaatctattcaaatgtagagagaaaatgttacaatgaagtaccttacattcttacactaatcactactgcttccttgggaaccaaataaaaaaggaaaaaaacaaagaaaaatgccaaaagggacaagcaggattgtccctttgtcaaataggatttgatgtacttaaattcaacaaaaacatattgagtccatacacagtcagataaagcagaaatggttcttgccctcatattctaatagttggagggggttaatgacagatgtcaagtatgtacataataatccttacaaaagttagagttgaaaatgcaataaaagaggcagaacttaattgctctggagttccaagtgaagaagttatgtcactagtagtcataatagtagtaacaacaacagtaattattactattatctattgaggcttatcatatgtcagatgccatgcaaagcacttttgtaagaattttcttatttaatttaatcctcatacaaacttgatccattagggatcatgattatcctcatgttctttatgaggaaactgaagctgagaaatttagtaactttcccatggtcacacagctagaaagtagtggaactagaattattccagagcttgtgttgataaagacttcacaaaagagacaacatttaagatggtctttgaagaatgtgttggattttaacaggaaaataaaaggaccaataccagcaaaaccgtataggttgtaaagcatatgtggcatgtttagaggattgcaaatggtatagtttccctggagcaaagcaaaatttgtggtgctagtgacagaaagagccaagtaaggaggaaaaccagtgtagaaggaaagacgatgagcatggctgacacatgcgataaccttgctcctgaatttcacaccaatattttcatcttcattgagaaagaacgaataggccaagaacagaattttaggacatgatcacactgatggggtaggaagaggaagagccatcagttatgtaaatgtaaacaaagcagttagaatattaagaagaccagaggttgacagtatggtgggtgccacggaaggtcagggtgccagaagaaggtgtttagttcctactttagtcaatgctataaaaattgaagagaatcaggatttatagtagattagcttgctaccagttattgatcactttctatgcttctggtactatgctaagcactttacaacagcaattgtctacctaaacttcagaaccacttgtgaggtagggactgttattttcccgattttaaagatgaggaaactgaaatttatagaacttaaaaaacttgatcaagacctcatagctagttaagaggcacagcctggacttaaacctaaatctgtttaactctgaagcttatgttcttaatctctaagatctatttccatttcatttttatttaccaggagttcacccttgagagagaggtttttggcagagtaataagggtaagagtcagagagcacagattgactagaagggagaggacagatattagaatgattgtgaaatgagtgggtggtaagacagtggaggttatggctatcaacttattctgtctatagtttagagggagtggcaaagaaaggtaaacaatgggagtgggtagcctgaggggacagaagagtcaagggaagtttcttttaataggggaggaatgaacctattgttgactgaagagtagccagtggagagggagaaagggcataatttatggaacaggaatgtggcagagaaaggaggaataagattcagaggacaagggggaaggttcaaattagaaagaagaaagacatttattaggtaacccatgttcttaaccttttctcctctccctgatctcatcaaaatgtgtctgattcagtaagcaccttagttgcctaagtataattacttattatacttggtatatattacatggactgttactcataaaaatataatatttaaaatgtgagatgactgaaacactaaatataattaattaggaattataagtaatgaatgaattaaggtgccagcgtattagataatgatataataaatatgttttatctctctgatagttgaattttcacagaaatgttggaaacagagaaaaaatttacaaccccccaccccaggtgacccttagatacagacagatgttagtgtgaaactgtcattcactcagcaaacatttactgaaagtcagctatatgccaggttctgtgctacacactggggatacagaaataaaggacagagttcacatccccaaagatctcacagcctagtggatgaggcagagaaatcaacacagtataatacagcttgatgaatgctgtgattgaggtaaaaaccatgaaacactgttgaactacataaggaggcagtgggcggggttcagggaaggcttcccaaaggaggtgatatttgagatgagttttgaccttctactgttgcttttatagggatctgcaaaaagggccaggaattcccccaggtgtcacattacaggcaacagctgcaactcactatcctggcttcatcctcagtgtctgacatcaaggtcactgagccaaaagtcttaggtgggggggagtatacaatggcactaagtctaacctctgggctattgggtcataggagaagatgagggctataggttccagattacaatctgaataaatagccttctcttttccagggttgggaaagtaagaaagtggaaagggaaagtggagaggagctagaagaaggaaggaaggaatagctacctctttattagatctttctgcctgctaggaagaaagccttctctctgcatatacaccactcatattgttttgtttcaatctttattcttgggtgtttttccacatgaaaagggcagtgaatatatctcacctcagtgcagagacatttagaaatgaaaaacaacttcaaccaagctctatttctccttctttgaaactggaagactgattgtaggtcagtttctattttatctgagccacttggcccatctggaatagtcactctaggaaatcgaaaactaaatttaaattttacagaggaaattttgaagtgactccctcaatctggtcagacacattctgttgcattcctctgtccaggcataacactgagcctctgacgaaaatctgaatgacaattgtctgttcttagtattaaattatttgccccccccatttccattaatttgcagactcaggcatactatagcaaagactcaacttgaactaattgccttttaaatttacctctcatgttcctttccttagcaaatgagaataaccatacattgaagcaggaaagactatggttagacataaggaaaaacaacctcaaccaagcgctatttctccttcccttgaagctggaagactgattgtaggtcagtttctattttatctgagccacttggcccatctggaatagtcactctaagaaatcaaaaactaaatttaaattttacagaggaaattttgaagtgactccctcaatctgatcagacacattctgttgcattcctctgtccaggcataacactgagcctctgacgaaaatctgaatgacagttgtctgttcttaatattaaattatttgccacaccccctcctcatttccattcatttgcagactcagacatactatagcaaagactcaacttgaacaaattgccttttaaatttacctctcatattcctttccttagcaaatgggaataaccatacattgaagcaggaaagactgcagttagacataaggaagagcatcatatagctacaacattgagactggcagtactagaagacattatggaacatttttaaagtttcttcttttctttttttttcttttttctttttttacttgtttgtttgatgttattcttgctgtttgggcagatgggttgttcataaaagaccacatgattattaaagacaatttgaaggggtaaagagaaagccatttatcctggatggtttaccagtctgaaggaggaagacaaccttttacctcaaaaattatatgattttactctctgattttcaggtgacctcaggtccacattagccctgcaatgcggaaagttttttcttgtaccagggacggactccttttagagattcctttaatggtgtggaagaatcataattctaatcaacatgaaagcatttgaaaggaaccactgcttcaaatatggctattcaagagaaaaggaaaaagaaggcattaaaattctaagaaattaaaactgttggagaaaattaaattgcaattgagttaaatcttgtgaaaaaaatgaaagaatttcagttttggtatcaggaattttgtacatttgtgggcaccatgtatggtgcagggtagatgttattctgaaaagaacagatttctttaattcatatgctgggattcacttgatccatctcaggcttttatgttgacctgggttatatttttttcttattcttttcccagaatcatccaggagttacgcccagtggaaaaagaatagagaaaaaattacattaatgatcaaattggtatttcatctctaaatcttaactggcacatagaatgtgtaataatttagccatagaggaactctaagtagaaatataagttctattaggggagccttaattttgttttttatgcgagtatttcccagttagtattaagttataaccactttggtattacatactaagacctagtatggatgttgtcaggtttgtgctgaggagaaaagtcagtaaatatttcaaatttaagtcactctgcatatctccatgccttatcaatttactatttgaaatcatttatttcttaaattgatcttataccattattgtataatttttaatccttacctaagagccatcaggaactcaccatattgcatgggacacaacctgctataactctccactgggcattttctgtacagagccaagctaaatcttgctctcgtgaaatcaggcacaagtaagatgtgaacatcggtgcagcattcagaatgtcaccattaaggtgatactgaaaagaaattctaaaagggtaagtaatagatgatctagtacacatctgaaagcagaggagctctgtgcttcgaattaaatataatactttataaaaatggagagcctaaaaaatgatgaacccttgtagaaaactggaattaattactctccataaaaggttttaattttataatttcatttacctttacagaaataatcgtcactcctcatctttattttagaataaccatccattctcaactttatttttactaactaaaatccccttattaggctactctccttacctttcctttcctccctgcaccaaaaaaagaaagaaaggaaaaaggaaacaaaaaacacattcacacaaaaaagccaaaagccatgcattttaaatacccaagacatgaagcctattggcagaaatgacaagtaccgtatggtctcctatttttcatggtcctctgtgaggtcattggtttctcattacagccagtcaagtcatgtcaaacttggagtctgcctcttaccattatttatattaatatctactaaagctccaaagatattctgtgaaaatccaaaactctacctatctgcatatctatctatctatctatctatttattattttttctatctaactgaagactataggaattgcttgtgttttttgaaatatataggagggaaatttagtagctgttactgttgctataactcatatctaaactcatttaggtttgtgttgggaatttgaattagagacaattcacttgaaaaaaaaatgaattagcaaaaaagttagtggcctggcttctcaggaatgcctaccatcagcagggaccagtcacacatttacttccaaacacctaccctaggacccttcttccatctctgtatgagccatgacaaaaattttcttgctatttcagtctattttctttcgtgtgggagctacaaataatgttgcaacaggctcaaaatacccacagccattgaggcccagttgcaagaggatcctctaggacagagttttgtgtttgaatattaaactgttgagatcgtttgttttcactgtgcacagatatgaccaaaaagactggggttgattaacaagctatttgcctaaaagtcccaaaagtttttaaaaactagtgcaagcattgatcattaaagtacacaaattatgtatgtgtgtgtatatatatatatatatatatatatatatatatatatacacacacatatacatatatatacacacacatatctatatatatagatatagatagatatagatatagatatagatatagatatagatatagatatagatatagatagagagagagaccgagagagagtgccaaacaggtttgcccatttgtgggttttcctctcctccagtaagtccaggctcttgtgtttcccaactaatctattaatggctggaactgattgacaactgcaacaaagccagtgtaagcactgtgggagtcctaattgggtagttctttataaagggaattgatgactgagtaaatatggtattgaaagtagatggtaaacatacaaaaaattaagcacaaattagctagatttagagtataaatacttacgattggaggacctgagaaaggttttgaaatttattcagcaaataaaaacgtgaggccattgggaaaatagattttcttgagttgatatgtcaacccacaaaagtacttaatttgtgcttgagggctttttattttattttattttatttttgcctggttagaatatgggatctaacaattcatttctaagtaaaatctatgagtttatttgttcattcatttattcactcagcaaattttctctatgccaggcactctgctaggtaaggggtacagagaagaataagatgtagcccttgtctggggagctcacatctattaatagtagaaaccagaaacatgactagacaatcttgatattcaacaatgactataactgacagcagatcctccataacacggggaaaggctggatacaggcagatttgttgggaggctacttcagtaatctagacaataagcaaagtgaatgtgaactaaggtaatgacagagataatggagagaggagtaacaaatatttgaattattatttaaaagaaataaaacctctagaatctaaggacttgatgatagaggtggagtgatgaggaaaaggaaagactccagaaggacttctgttgactgactgggacagcaaggtaattagaagatagttacatcaaccaagatgatatgtacagaaggaatatatttatacatattggtaatacctgattatttgttcatattttggttttgaggtgcttggtggatcacccatatatggacatccagtatgtaattgaaaacatgggtgtggagctcaagagaaaggcatggaccttgatgtttgactgtgatcctataactgatgtttacaaagcctatgcctctgctttcactttctgaccctttttgagtattgtccctttttaacctcgcaaggtttcttcaagttccttattccctcacggtattcactgactgcctagggatccctactgacgaagaagggcaaaacgtgttaccagatctctactcctaaatagcccccaatggtctggatccttttcccccatattccctgcacagccccccactcctgccctcactcctgccccatcaacatttacctatcctgcaactcattccctcacagccctgctaggtggttggctaatctaaataaattagtttatactcagacctaagtgaccaattctggttttgtgcatcatacttcccaagtaatatacagatgcaaagaatgtaggaattgcaagtggaattgtagaatatcagagaagcacttggtgtcaattgggttccttcagtgtttcttaaacaacatcattaaacatcattacacacatataattcagttatttaacaaccctacttttagacttttaatcaacctgaagtcttcgtttcaaatgaattatccctcaccaactgcatttccttccctcagacccacaacacataaccagcatttaattcctgatctctcttattcagctttgtaatttattgctattatttcccagtaaaaccctcattggcaatcaggcttcagggcgtccacaaagacgaatttctactctattcacttgtaactgcctgttaagcaatcagtgaatcctagaagatgagaaatggaattgaccacagaaggttatttaacccataccttcttgttagaaaagaaaaccaaaacccagagagatgacaggactgacccaagctcacacaactattcgtagctgattatagctggaacccaagtctcctgacacctaagccagttttcttcttactatgtaacaattgcttctgtgggcatgctgccatcatatgctttgctcaaaacatagtctccttacataccttagaattaattatcttgactgacaaagctctgtcctccataatttccctttgggcttttagaagcctcagcgtgcaaccaaatacaacttttgtgtttttcaaactgacttttcaatggataaatattcctctatgccaggtgtctcatctcttatcttggcaaggattccatgtaagctggcataactggtgtgggccctacagggctgaggtgggtgataggactgtctatcacctacagctgcaggtgtttgtaacggtgatggtgtgtacaaagttgaaagttgaaaattgtatacagagagctgaggtaaataaaccagagaaataagtctaaatagattgttgaataaaaaagtgcctaaggcaagcattagaaccagagtttagaaccatttggatctgaaagtcagaaaagagatctggttgaaacgggcaagcaggagagcaaagacccaaggcagaattctgttcctgaacctgggcttttgcatgttgcctttagcatattacagagatgatccagatccatttaaaggactagtgacagggacagaaacaataccacaggctgacagaaaacaagtcaaatgagtaccctccctggatcatgcttttggccctctgcttctttgcaagaatcagatgcaagctgatggtcccagaattttatctgctcaggcctagaataagtttcacaactggacaaagttttacacagtgtcagcggctgggcaagctcctgttggcactgttcatttgccacctttcatgtccagtcagtccttggcacctctgttgaaacccctcaagagagtgccatgtatgctggtgatctgatcccacccagtgggaacactttctgatgatgacttgtctgtctcatattgacattgttgtcttatggttcaatagcacatattaaagcaagcttttttttctttctttctttctttatttttgagacagagtctcactctgtccctcaggctggagtgcagtggcacgatctcggctcactgcaacctccgcctcccaggttcaagcgattctcatgcctcagcctcctgagtagctgggactacaggggcgtgccatcacgcctggctaattttttgtatttttagtagagacagggtttcaccgtgttagccaggatggtctcgatctcctgaccttatgatctgcctgcctcggtctcccaaattgctgggattacaggcgtgagccactgagtctggccaagagcacatgattttaaaatgtcagaactctcattacttgggttttggtgtttattttgatgagaaaatcaatattaagggtgtgtcaggcattagcaaggggaaaaaggtcatgaggatggcagctcagaagttgatctctctgatatcagagataagatttttaagacaatcaagatttccttttctcccaaacccccataaaattaaaagtaaaaattgataaataacatcataaggtttgtcaagcaagccacagcaacctcattcaggaatcgtttctgctaaattttctggtaaagaagtagggacaaaatgcccactaacttctaagtgaaagcaagaccctcatattgttctgtctgaactcctttttggctagtttctactgttattcttcaagttcttgttattttcttattttttttaattatactttaagttctggggtacatgtgcagaacgcgcaggtttgttacataggtatatatgtaccatggtggtttgctgcacccatcaacccatcatctacattaggtatttctcctaatgctatcccttccccagcctcccatgcccccccaacaggcctcggtgtgtgatgttcccctccctatgtccatgtgttctcattgttcaactcccacttatgagtgagaacatgcagcgtttggttttctgttcttgttttagtttgctgagaatgatggtttccagcttcatgttcctgcaaaggacatgaactcactgtttttttatggctgcatagtattccatggtgtatatgtgccacattttctttatccagtctatcattgatgggcatttgggttggttccaagtctttgctattgtgaacagtgcctcaagcaagcttttccatcacacctgtagcttcagaaacaattctcaggtttgatgtttgtgttttcagcactccttttctaggcagccatgcagcaagtcctgtgtcatttattctcatgacatgctggcaaatttctgtcctaaacgtcccatcatgctgtattttttccctctttgattgtgtagttcaaggctgccatatccctaggaagctttgtccaatgggcccagcctccaacctgccataacaatttccttctcccaatacactgtcattttgtattcctgggttgcttttgtgtatattttgaggagttgagtgtacttcctctaatcaaatagtaaaatctgtagtctttgatagcagggaccatgtctaatcttagctacgggccaaaagtctcaaatgcaatgtgatcagacaatatatgtaaataagtaatatgaatagtcttgataggtatggaaacaaaatagtgtggaggataaatgcatctgacagtatttggttcccatttgagttctgccatttattagctgtgtgaccttcctcaaggtagttgatatctctgaaggtttggttgcttcatctgaaaatggggtatatctattgctaccccacacagttttattaaacaagtttttaaaggtatctcaggtaaagtgcttttcacagtgcctgacacataatgagtattcaatacatggtagctaatattatggttggcatttatcaggttaattgcccaaacatgtgaattattatgtctgcggtcgctggcatgggtaatctgtggccttggcctgactcatcactcccaagatcattattacagttgtgctactatctccagcatatgttcaactttattctctctccccttgtgctctcccttgcccttctttacttcaagtttcccagacaccttgtctcccactccagattttttttcctatcatgcccatgacatggacctgatcccatactcggtacccagaagctttcctaagctgttctttttgctttagtggtgaacctggggttgaaggaagctcttcgttgtgttcagagctgcttagcactccagggtaaaggcagggttgtattacatgaagctgaaattacatcatagcaattggcgggagggcaagtgtgtgtgcatatgtgtgtctctgtctggatttgtgtgcattgatttgtcagtgattttgtgtagctttgtccaatagttcaaaccctgaggcttttcattctctgaagaggggctggattaggaagggcaaaggcttataattaatattctttttcttaatggttgtaatagcaattggctgtatttgccagttttgcttttttagagatagccgttttaggagccatttaaagaaattatcccatttttataaagtgtcatcaaaccatttatattactttgtgggaaggcagactgctgttggtcaagcctattgagtcaacatcaatcactgaatacctatttttttacctaatcaatcaggtgcagtggaagatataaaaacaggtaaggcaaaagccctaccttcaaaatagtttggttagtacaacgtggataagtgtactttctgaattaggtcaaaagcctcaaacccttaatctatcccagcctatatccccatgacagcaatgaaaatctgcctctcagttctcttactgtgaggagtgtacttgagtgacagccccagctgctaagttctgaatctgccactgcattaggggccatacttttcacagactgctcccagccagtgactaaggacactaggacaggcccatttctgggagatgcagtgttaccagccagcctttgctcccaaagctcccaagatggtggtgggccgctcccaagatggcggcaagccttttgttctctgacttggggttcttggcctcagggattccaaggaatggaaccttgggccatgcggtgagtgttatagctctattagaagccgtggctcacggaagagaactgtggaacccagcgactagtgtttagctcccgggcacttagctgcacaggaacaatagcaagcctctagcctgatcgggagtggcaatgagtgcctcgctggatcagaagcgtagcggacaccctgccagatccggaggggtggaagccagcgatgggtctgtgacaacagtgatcagcagtggtggacagcgagcgaaagctcagctggagccagaaaaaaacaaggaccagaagagtatgcagtttcaagatttaatagagtggaaacagagctcccatacaacgggaggggacctaaagggggttccctctaccggctcgaaatgcctgggtttatatcccgatcattgtccctccccctgtactctcaggcttagatgatttgattatttctttacctcctgcttttagcctaattggtattttagtgagctccctttactacctgatgcgtcaggtgtcagctgagttacaaaccccgtgtttaaaggtgggtgcagtcaccttcagcagctaggcttaggaattcttagcctaggaaatccagctagtcctgtctctcagcaggactcctctgatggatggcttttactctaggacttcccattggctttgccaaaactttttaagaattgttctgcagtttaagactcattaactaactctccattcttccctttctcctcaatagtcacaacagtatcacaatattttggctctgccaggctcctttgtctctctccccattttccctcacgggttctttagccctcagcaaatctcttgcaggtatgatcttgccatgacatctgcttgttagtggacttgaaccaatatatcatacaactctatactttgacttgccaatgttgcttggtcacaagttaaacctgatgagcagtccaatgactcagtagccatagcacaatgtaagaaaaagaacttgcaattattacttcagttctctaagcctttgctatatcttgcagtgttgttgggaagaattatgataatgtaggcaaaatctcaataacatggtaagaacttgatacgttcattcatattaatgagaagataactgtcctactaatggcagttcttatgaagcagcttcttaaatgaatgacagccttttctcattaagaaaactgctagataatatacaaaagggaatcaggaatttttctagtacccagaattgtattgttcttttatgatagaaatcatgagcagtagaacatgttcaatacaggggtctgggctcctggaaattctgcctgtggcttaacttgctaggaatatgtccagtttcttttctgcaggttgtctcaggctgatatggaattagaatttttaaaaacaagataaaaactgaaatagagagaaagaatgaatttcaagttctagatgcaacttaataatcaaatggatatgcttaactaccctcaacaacttcaccaggtctgtgatactacaagtaatcagcagagcacttcacaaagtgaagtgctttcttcacaaaaatagaaaagaaaggacagattctccttccctcagggctgcatcactattgcattgtagagtttgctatactaaggaagaagctgttaggtgtttaacgtagttggcactgagctattgtaatgtattctgttttccaaggcaacaaaactgtgattcttcctttggcaaaaggcacaggcaagctgatcactaatttcacttacttgccctagtgtagggaatttctgtgaagccactgaaaaggtcagggaaggaataacagggcaaggttaccagtgcactcaatcccaagtgtcagtgtggtcgcagagccctaggctgaaggcaaagaagaatacagtacacctagtggtccctgagggtaagaagagtctgtaggctatttaaagctggggttaaagcctttcagattgcctaagtaccattttctgtgttaatggtagatgataataggaagctacaactgaaagttagtgtacatccaatatgcaactgagggcactatatcattatttttaactttgtgctttgcatattttctatgtttctagataaaaagaaatgtgtcaagatttcgacaataaatttccataacatggtcacctttatcctctttctttagtctgccaatatattcactcagggcccaattctgttttccagaatttgttaattgaactaaatcctttagccagcatcagtcaagcaaaaagaggcaaatagagaaagactgctaaccatgacccacaggcaataaaagatcctaatgagccatttaaattgtcaagtaaagattacatgatgttcgctatagttttagcatttagtgtatttggtttctttccaacttcttgataaaacagttagtctattatggtatttctaatgactcacagttaactagagactttgattaaccagaatgactctattatttccaatactaaataatagtcactacaaacttgaaaacatattggccaggctcaaatcacaatgtaggtaacttctcaacaaatacttgagttgagtgcatatggaagctacagagaggcagaggtcagacccaaggagtgtaggaaatctgcctgtgggtagaaatggaaatgtttaaggagtggggcaaagaagctttgtcctctgtaaactacagaggaacattcctgtcatgtcaagggaaaggtcatatgctttctctggaatttcccataagacaagagattgaaagacatgtaacaggaaatataccgcacttaggggtgcaattgggcattgtcttcccaaggaggagagaaaagatatctcaagtcttctgaggtctttccatccttcagaaagtaaggaggaggagagaggtagtagggccaagcacgcagaacactggtaaaagaccagcattccgagtacagcagattatgatataggggctaataggagctgtcctcccctaattagtggtgttggtcaaggggcactctttaggccaagatttcttaacctcagcgctcttgacatttcaggctggacaattctttgctgtggagggccatcttgtgcactataggttgttttgcagcatcccaagctttgacccactgaatgctagtaacaccaatatccccagttatgacaaccaaaaatgactccagacattgccaaatggtctctggaagtcaaaattgcccctaacagagagccactggtttatagggacatttgaagacatacccttatggtaatggaggacgatggcactttcacagcgtggttgagttccagctattactctactagggaataagaccaaagttctttatgtgtttttgtttgtttgcttgtgaccagggttcctgggactcatattcttcaaatttttaccaaatcaaattggtggggctggggaaaatgcttgatattttttgaaaaatgtgacatttccccaaatcttctctttctagatatagcactgtacttctcttcttaaagaaacatggcattttaccttgaattggttatgactttctaaaccctctgacagttagtctttgtcccttacattttgggaaaatgttactttatcatttgaaggcctgggatttttccctctatcattagctctatttgggttactgaggagagctaggaaaggcaggttcagagttcaggaacataacctttgcctgaggctatgtaagttggtaaagcttcctgtgtcagtgacactttgagtaaattctccctttatgtaactatgcaatttacccatgaagacagaaaaaaaggttgatttttgtccacgtcagaaataattcttctgcacagttcaactccttagagaaatactgttttttaggttaagtaagattttccactggcatttgtcattgagaaaaggaaaagaagctagtttttaaaatattcttggccttaggaacctaggcggatatatgctcttttttaaaacagttagagctttaattgtgtgactatttggcatgaaagacagcaaggctgtttttcttattataaagctatcccacacagacatgataaacagcaggaaaatcagccgaagaatgaaaaccaaggggaattaagattgttcagcccatagaagagctggctaagaggtgacttagtaatggtcttctaggacctgaaagacaatcattaggaccagatgctccacatctgcagagagggtggagacacaggaaatgacactatagcaggagaaagcttaaggaagaatttcctggcaatgaaggatgtcaaacatcaagaatacattactttagagattatacaattacctctgggctgttttacattttggtttcaaacaggatagattctgtcttgtgtgagatggctgaggtgaggttttgcatgaagatcaagagaatggacaaaatgatatctcaagattcttcttagttctataattctgtgaaatctgtatctttatatattatttgcactatgtcccccaaggtgctcattttacaatgtgctatttgcattatattttcacttaatggggtttcaatttctgttattcctagttatggaaatttattatgtgacttttgtaccctcttggattgttgaaaactgcaactctgcctcactgttcttctattttccaatactgtattttctccttttgttaattctctcacttttcagtcatgtgtttactcccctgtgaagacctcctgaaagcaggtgcacgctttgcacagtatttagcacaattagtgttttaagccaatttaataactaattattgttttataatttcaaaatgtaatgcagtatgagaaaatgtgatcccatacaatgatattctcatataatctataaacttttcacttgaccttcaccgagtatatgcctttagagccacatttgcagtgtctatgtcaaaataaccatttggttcagtaattttaaggcagggggtaggtggcttcagctagaaagagaaactgtcaatccacttaattggcaactttagattaaaattatcatttgattgcctgaatctttctttgtactaagttgtgttggctgacatgtaggtatgttatatgcctgtcttggtaaaagaacctacagatccatttgattctagcaagaacccatcaaatgccagaggctcctcactgcctaaacaaaattcttaattcatcaacctcacactcaaggttcttaatcttgacatgaaccttcctctgctattttgattcctcagaatgtgtcctcttttctaactaaactgttcctgtcatgttatgcttatcctaaaatccactgcttgctcagatgctttctattacctgaaaattaccatcctctccaattatccaatcttctttctcttcattttactgaaattattatcattgtcatcatagatactacttgttggtggctgaccacgttaagacactgtgataagccttcaaattcattatcgcacttagtatttgcaaggacactatgtgatacagattattgttcagagttcatttctaatagcttctcttccaagagaccttttttaaccagttgaactccagtaatgcccccttctctgaacggataatacttattatctttaccacttattaatcttacttcacagtttctctcataatattatttccatgagtaaactgtaagacttgaagggaagaactgtggcttatactaatttttatagtagtgtaaatgcaaaatatgtaataaacccacaataaacatagtactgtatggaaggatgaaaaaaaagatggacaagtggatgggaagggtgaccaggatcaggtcaagttacaccttgtggcatcaatggtatgttatcgcttcattaactaatatttattgggcatctactgtatacaaatactgtgctgtaatctatgagggataaaagagaaggggaaaatactgcttttgttcacaatatagataggaagacaaaacaaaagccaaacaaaccaaaagaaacaataccaacatggtgctgaactgagcagcatgatatagtaatggaatacggaaaatatagcttctgaaatccctaaaatatatcctcctttttcagtttccttaggaaatttcagttttcttcagaaacttgaatttcctcctttaattctgcacataaaaatgcatgagaatgtgacacatcaaaataagagaaagaatttgtgatgctgaaaaatggaacctcgacccattgtttggcatagtaatggcatcacagatgtattataaaattgaacatttctgaaactcaattagtgtaagaatccaggcaaagaaatttaaactatatctgatatagcaatgatattttatgcatctgagactgtgtggtcatttttcctccctcccttcttccctcccttcctccttccctcctttccttccttccttcctcccttcctttttttcttcctttcttccttcttgctgagactttttcttttaatgcagtagacagtagtgttattttttccctgtaagtagaacaattttaaaccctaggaaaaaagtgaaaaacatgttcccttcctcacactcaagcaagtattactcatatgaagtttaacttgaaggtatatctttaaaatttctcaagataaatactccttcctctcagagattaaattgttttgacttaaaagaaccagggccatccactgttttttgtgtatgtgtttttgcttgtacatatatttggcaggaggatcagtgaggaggctgagtatcagtcttctttataaactggttttgagtctcctttgtgattgtcaaagtatgtatacaaagtgtggttgtgtgtgtgtgtctgtgtatgtgcacacacacaaacacacacacacacgcacacaccctttatgttagagaattgaattgctacaagtaacatacttcaaaagtgcccaacttgatccaaggatgaaaaagaagccacagaaatctcaaaagcaagccctggagattccagcggcttggctgtgagttactcatactttgacctttgaggtgatggctgaaactgaatgcttaaatcttttaaactccacactccagaagaactttgtgaaatattgtaaactcctgtcaatatttctggaggccagcagaagatagaaattaggtctccctctcctctacccaaatggaggaataagagctaatttttcttttaggccacttagctcctctctaggtcaacactccataggctcaacttctacttttcttttatcccctttaatctcttaccttagcctgtgaaacatgaaggtttaaatctggattgatgagatgtttctttgatattttgaataaagtttataatcaatattcagtaataatatggattatggctatagtaatttgagaagttgctaagtggcttgccttcaaaactgtatcaaatatggtcctatttgactattttcagtcagaatattttaaattaaatatttaaaagtcctcagccttcctttctagtcctccattgcttgtgtgccagtatctattaccaaacaggctaaaaacatcttattttatttgcttttctgcaaataagctccattttaatactgcaaccaaagtcatgtttctggcatttattgacttcctgttttagaatagtttcccttctttgcttttcagaacacaccactatggctttcagatacacatcaacttgttctcctgtcatcagaatttgggctgaaagaaaatgaatttggaaaatctgtgagacctaggtacagatcactctccagtttaattctccctccctgctcttcccacttatcccattgacagacaatccctggagcaagggtaggcagaagcccccgggaagtgtgaatttttcaagaaattttagatttggttgaaatggtggaaaatcctcttgtggttctgagagtgaagattcttcaatatggccatgctggcttacaccttttcatttggtactttaaaactttggatgtttctttctgccgtaagcctaacataagtgatattaggtcatacacttgatctgttcctaaaaagtgtccaagtatcacttttctgtgctggaagcaaacatctatttgggctctaaatcaggacccaggcacaaagtaccaatctttagtctgtgacagtggaaacttatggggcaccccatctctcccaccatataacatctcatcccatctcatcccaacccatctcattctgtatacatatataatttctttaattacaaaataatcatttctatttctgaaattgttttctgtatttccaattatttagtgacttttggcttattaagctctgtaatctgttgctcttcttatgttccaatggacttgtttggctgcaaaaatgttataaacagtcttagcctattttgcaattatctgtattacttgaatgtcagagtacaagtaaaacacatttttgatgaagagaattcatttaacattttagccataaacctggatctttgaaaaagcatgaatcagacagtagaatgggtcacaattatatcactcttcattttggttttcagtccttctaaaagtgatattttgttgattaaggaattagaccattggcatcaacatggtatatctgacagcacccttcctttatcattgcagttatcaggttttcttgtctttgcttttatacattttttgtttaatttttgtgggtacataggaggtatgtatatttatggagtaaatgagatgtttttatacaggcatgcaatgtgaaataagtacatcatggaaaatgaggtatccatccccttatgcacttatcctttgagttacaaataatccaattacactctgtaagttattttaaaatgtatggttaaattattattgactatattcaccctattgtgttatcaaacagtaggccttattcattctattttttggtacccatcaaccatccctacctccctcccaaccccccactactattctcagcctctggtaaccaaccttccattctctatgtccatgagttcgattgttttagttaacaggttcttgtcggaattgaaatattgggagattgtcatgtaccttttaattttaatttcccattttaaaaatcttttattgttgtagaggttagcaggtgatgggagaaaagagaagcaagtgagttctacatatgcatacccccattatttgtattatctttgttttggagtagatacatgaaaggaaaataattgccattgcataatagcaagtcttcatatcacaacctgtttggttatttttttttactactattcaacaagaaagaacatatttattgagcacgtattttgtgagaagtactacataatgtgctctaggagaccaaaaataactgagatacagactatatccctccaaagaatgtattgtccagtagttgtatcattttttagtacacactttacctttgttttattttcctgcaaagcaagagaccataagccctaaccaatcactcatttgggtacctgtcaagaagtggtatggtttctggaggactttgtggcaatatcttttgctcgagaggtcttttggttctcttctctcttttcacagggtgtacagttgacaaattttgcaaagaatatcacaggttcctctgtctctcaaatcaagagtcttggttttagctgcacaagaagcacatattctctgttctaaagaaagcaataactcattgttcagaatattgtttattctacttctgactttctctagactcatggatcacacataggttacatataactttccattaatatctttgaccatgacaaactattttagatttcttttacctttgcaaatagagtccatttcctccgtgtcacatttataggccctacaaaatctatgatcacactactactatgactctgactctgactactcctattactactactacatacacacgcatgaacacataccctgcacactcatgctattcctgaaaagagcatgaagatatatagtggtagaatgatgttatctgtgatgtcaaaataaaaaattgaggacatccctatatattcctagccatctttaatttattatgagcctgtcatttagaaatttattctaaattctccttgaacctaattgtacttgtactttcagccatttccatcagttggtatatcaaactctgtgtgtctactacctacagtgggaagtataagtgttctgtttaattttcataacattatttctaaggaaattcatctctttgggatgtctcagataatttggtgaccaactttgtgttttctcatccatctgtatcttgatattgtgaacatgtaccttactcagagctatactttcttagacttgagaggtatgtcttactttgcttctatctcccactagagagttcagcatgtagtggtgtactaaaagacctgaatcaacacagtcattatcattcttcttttgttgagatggagtttcgcccttgttgcccaggctggagtgcaatggcacgatcttggctcactgcaacctccgcctcccggttcaagcgattcttgtgcctcagcctcctgactacctgggattacaggcgcccacctccacacccggctaattttttgtatttttagtagagatggggtttcaccatgttggccaggctggtcttgaactcctgacctcaggtgatccacccacctcggcctcccaaagtgctgggattagaggcatcagccaccgcaaccagcctatcctcgttaatccaatggcctattatagtagctatctatcatgtttggaagcaccaaattaaaaaaaaaaaggactttctaaaatctacttaaatagatcacattctgattaataagattattataacatggctggccgactggaccttagagtataatactattagtctatgtgaactattaaagtacattaataatgtataagacccatccttctcacagaaagctgcatagactaagaagttagaaaaaaaaaataattaactcgcccctcctccagttacacacagttcagtgtggagagagtgactccatttgtttaggggaaagtaagggaagagaacaagagtctctgcttggtgatccagggaaatgcccaagaccacaaaagcaatacctccacaagtacgcaagagccacagtataactgggctttgggtgccccctaaagcagatatgactatagttacaaaaatcttgcattgcaacacccacatcctttaaatgcctggaaagctttctcaagaagggtggacacaaacaagctaagattgcaaacactaaaataaataactctttaatatccagacactgactaacatccacaagcatcaagaacccccagaggataggcacagtggctcacacctgtaatcccagcaatttgggaggccaaagcaggtggatcacttgaggccaggagttcaagaccagactggccaacagggtgaaacctgtctctactaaaaatacaaaaaaattgccgaggtgtggtgcctcacgcctgtaaccccagcactttgggaggtgggcagatcatgaggtcaggagttcgagaccagcctggccagcatggtgaaaccccatctgtactaaaaatacaaaaaaaaaaaaaattagccaggcatggtggcacgtgcctttagtcccagctacttgggaggctgaggcaggagaattgcttgaacttggcaggcggaggttgcagtgagccaaggtcacgccattgcactccagcctgggtgacagagcaagactccgtctcaaaaaaaaaaaaaaaaaaaattaggtgtggtggcacgtgcctatagtcccagctatgtgggcggctgaggcacgagaatcacatgaacctggtaagtagaggttgcggtgagctgagatcatgccattgtgctccagccggggcaacagagtgagactctgtctcaaaaaacaaaacaaaaagaaaacaaacaacagcaacaacaaaaaaccaccaacaccacccgggaacacataaactcaacaaatgcactaaataaggcaccaaagaccaatccaggagagacatagatagagacctttcagacggagaattcaaaataactgttttttgaatccaagataacacagagaaggaatgcagagtcctatcagataaacataacaaagagattgaagtaattaaaaagaatagggacgggcgcggtggctcaggcctgtaatcccagcactttgggaggccgaggcgggcggatcacgaggtcagcagatcgagaccatcctggctaaaacggtgaaaccccgtctctactaaaaatacaaaaaattagctgggcgtggtggcgggcgcctgtagtcccagccactcgggaggctgaggcaggagaatggcgtgaacccgggaggcagagcttgcagtgagccgagattgcaccactgcactccagcctgggcgacagagtgagactctgtctcaaaaaaaataaataaaataaaaaaaaataaataaaagaataaaaaaaattctggagctgaaaaatgtaattgacatacagaagaatgtatcacattctcttaacagcagagctgatcaagcagaagaaagatttagtgagcttgaagacaggctattcgaaaataaatactcaaaggagacaaaagaaaaagaataaaaaacaatgaagcatacctgcaagatgtagaaaatatcctcaaagggtaaatctaagacttattggccctaaagaggaaagagagagagatattggggtagaaagtttattcaaagatttaatgacagagaacttcccaaacctagaagaagatataaatattcaattacaaaaaggttatagaacaccaggtaggttgaacccaaagaagacacctcaaggcatttattaatcaaactcccaaaggtcaaggatgaagaaatgatcctaagagcagcaagagaaaagaaataacatgtaaaagagcttcagtatgttctggaatcagattctcagtggaaaccttacaggccaggagagagtggtatgatatatttcaagtgctaaagaaaaaaaactgtatcctagaatagtatatccagtgcaaatgtccttcaaacatgaaggattaatactttcccagacaaacaaaagctgagggatttcatcaccaccagacctatcctacaagaaatgctaaagagagttatttaatctgaaaggaaaggacattaacaagcaataaaaaatcatctgagggtacaaaactcactgctaatagtaagtacccagaaaaacacagaatattacaatgctggaattgtggtatgttaactactcatatcttgagtaggaagatgaaaagatgaagaaataaaaaaataataaccataacaactttccaagacatagtacagtaagatataaatagaaatttaaaaaagttaagaagcagagggacacagttaaagtgtagagtttttagtagttttcattttgcatgtttgtttatgcaaccagtgttaaatttttatcagttttaaataacagggtataagatatcatttgtgagactcatggtaacctcaaaacaacataaaacagatatataaaaaataaaaagcaataaattaaaacacatcactgaagaaaattgccttcactaaaaggaagacagaaaggaaggaaaaaaggaagagaagaccacgaaacaataaaaagacaaataacaaaatggcaggagtaaatccttacttatcaataataacattgaatgtaaatggactaaactctccaatcaaaagatgttcagtggttggatagatttaaaaaaaaacaagatccagtgatatattgcctacaagaaacacactttagctataaaaacacacaaagactaaaaataaagggatggagaaagatatttcatgccaatggaaaacaaaaaagagcaggagtagctatctttatatcagaaaaaatagatttcaagcaaaaattgtaagaagagacaagatcattatataatgataaaggagtcaattcagcaaggggatataacaattatatttgaacacaacaatggatatcccagatatgcaaagcaaatattactagagataaacagagatacagcctcatgcaataatatctggagacttcgacacatcactgtcagccttggacaggccttccagagagaaaatcaacaaagaaacattgaatttaatctgtactatagaccaaatgagtttactggatatttacagaacatttcatccaatggctgcagaatacaatttattatctgcagcacatagaccattctcaaggatagaccatatgttgagccaaaaaacaagtcttaaaacattcaaaaaagttgaaattatattcagaatcttttctgaccataatgggataaaactagaaatcaataacaagaggaatttggggaactataaaaatacatggaggctggtctgagaatctcaaatattgtagctgtctaatacttatcagtttctaatttctgtccgctgattcacagagtagcttactactttcaaaagagaaagagcttgaaagccattctgcattctttttctacttcccagttgacactggagttgctgcagagggttccctttaaaactagttaaaaagtattccataaaataaatgcaatatttttcatcttttctttcttttatttactaaagatacggacttactttcaaagtctattttcttctttactgcaaagtagatttggcaatcctgagctagatccattccattacaaacttcagataaaatggcagcaatagaaatagattattaaatcattagccagttgtctaattacactgtgaaatctaaagcatacctcctttattgtcactcacagaaactttccctatcttagcaaaatcttcaatcagtgtttatctctcattccttttcttctacactcttcctactttatcttccaccaaagccagaattttcactgctctcatgcttttttgtttctgtacatcagaagctcttccagtgatacttacagaatgctcatgcttatgagtgggaatagcatctgaaaagctttgttagcatgacatctctttatgagctgattccacatcttagacagaactctcagaatctccctttgtaaaatcttagatttttacactgacctttatgttatatggcttgtgttttgtgtacccaatctcttattggatgtgtgactaatgtgagtatcatcaactgatacaaggaaagatgcccaaaataaacaagttagccatggtagtgcttttgaaaaatatacacacattatttgaaactcctcccctcaagaagtggagactagttcctctctcttagagtatgggctgaccttaatgcacttctaacaaatagagtaaaacaaaggcaggtgtgtgtcaccttggcgattcgatcataaaaggtactgtgtcttcctcctcactggctctctctcaggtcgtttgcgcagagggaaatttacagccatgtcatgaggacatttaggtatcctatggagaggcctaccatggtgagaaactgaggcttcctgctaacagccatgtaagtgagccatcttgaagtggatcttgaagacctagtcaagacttcaacctcctaggagatactgaacagaaccagctaagccatacacaaatatctgacaaacagaaactgtgaaataataaatgttgattattttaagtcactaagttttagggtaatttgttacatagaaataggtaacaggatattcataggtttaacaattagcctatcacatctctcaaaaatggtaaaggggattttctatatgatacttacctatatagttgacccttaaaacaacatgtgtttgaactctgttggttcacttacatgtgggtctttctccacaaatatatcagaaaatttttggagagttgtgacaatttgtaaaaactaggagatgaattgcttaacctagaaatatcaaaacaataagaaaaagttatgtaatgaatgcacaaaatatatgtacatcctagtctactttatcatttacacaaatataatatacaaaagtatattacgaaaagttaaaattaaagacactgtatcaaaaaagtttaaatttatcaaaacttatacaaacacagatcatacatggtgccattcccagttgagagaaatgtaaacaaatataaatatgcagtatcaaactataactgcataaaattaactgtagtccatactatactactataataattttgtagctacctcctgttgttattgcagtgagctcaggtattgcgaatatccacttaaaatgctgtgtgctgccaatcatcttcatgtgagcaattcctctctcccgtaaattgagtatcacagaaaaaagtgacctctggtgttattcatgtagttttcattgattttagggcaataccataagctttggataataccatgagaacccatatgaattgccacaagtgatgctggaagtgtccccaagaagcagagaaaagtcttgacatgacaggaaaaagctgaattgcttgttatgtacgatagattgaggtctgcagctgcagttgcctgccatttcaaggtaaaagaatccagcttgaagattattgtaaaaaagaaaagaaaagaaaagaaaatttgtgaagccattgctgcagttaccaaaaatgttgcactttttgaaaaatgcctttttatttagtattgaaaatgcagcttttaggtaagtgcaggattgctataagaaaggcatacctataaaatctaacatgatttaagcaaaagtcaagtcaatatatgataacttaaaacaaaaggaagcatacaaagttgaagaatttaatgccagcaaaggatggtttggtaattttagaaagaggtttggctttaaaaatgtcaagataacaggagaagcagcttttgacaaccaaagaggcagcacaagtttccagatgccattaagaaaatcattgaggagaaaggatatcttcctgaacaggtttttaatgcaaatgaaagtgccatattctggggaaaagtgccacaaagaacatttgttggtaaggaagagaagcaagcaccaggattaaaggcaggaagagataggcgaattctactcttttgtgtaaatgcagtcaggtttatgataggattgctcctatttataaagctggtaacccctgaacctttaaaggaaaagataaacaccagttgccagtctgttgattgtacaacaagaaggcctggacaatcaatgagaacccttttcctggattgcttccatcgatgctgaagtcaagaagcaccttgtcagtaagagactgccttttaaagttcttttgatattgaacaatgcccctgactacccagatgcccctgtgagttcaacaccacaggcatcatagtggtctactttccccaaaacagaatgtctctaatctagcctctggatcagagggccataacaacctttaaggctgattacatacaatactctgtggaaaagattgtcaatgctatggaagaaaacctcctcaataaagagggtgtcagggaaatctggaaggatcacaccatttaagatgctgtctttgttatagaaaaaaccatgaaaacaatcaagcccaaaacaataaactcctgctggagaaaactgtgtccagatattgtgcataacttcacagaatttgtgagagaaccaatcaaggaaatgatgaacaagatttctctttcttatgattttcttaataacattttttctctagcttaaattatcagaatacagtatataatgcatgtagcatataaaatatgtgctaactgaataagtatgctactgataagggaccaggcaacagtaggctattagaagtaagttttagatgagtcaaaattatatgtggatttctacctgcgtgtgggcgggggattagcggccctaacccctgcattgttcaagggccaactgtagttgataatcagtcaagccatcaagcatagtggattttcatactttcacccttgtcttgaatagttatagcccaaggagctcagccttacataaaaggaaattttatgagcctttattttatgcgcgtgcgtgtgtgtgtgtgtgtgtgtgtgtgtgtgtgtgtaatttaagccaccttaacaaagcatcttattgtactgtttttcctcctatcatttgggaggacaaaaagacaacttacaggagaaaacctgttacctctttatggatggaattttaaaacacttgatcttttgaaaactatattcaccataatattatttaacattacttgtttttctgaaaaagacaaataacaagatattttctttcattttgacagattagaagagattaaatttcactgtaaattgtttgctgagtgactgaaataaaatattaattcactagctgagtatgtgtttattgaactggatttatctttttgtcctttcaatagtttttatttttgtttttttgtttttttgtttttttttttttgttgttgttgttgttgttgttttccgagatggagtctcgctctgtcgcccaggctggagtgcagtggtgcgatctcggctcactgcaagctctgtctcctgagttcatgccattctcctgcctcagcctcccgagtagctgggactacaggcgcccgccaccacgcccggctaattttttgtattttttgtagagacggggtttcaccgtcttaaccaggatggtctcgatctcctgacctcgtgatccgcctgtctcagcctcccaaagtgctgggattacaggcgtgagccaccgcgcccggccgtaatagtttttaaaaatgggtttttttttttttttgctgttttgagcaaacatgaagtacaaaatacagaaatttttactttccccaactcaaaaactaataaaaaacccacatagctttataatctattgcgggatctggccagcagcccacaatgcaacagggctctctctttgttcccaggtggataggcaggtcgagaaataatagacacacacaagatagtgaaagctgggtccaggggggtcactgccttctggtcccgtggtgccaacaatgcactgaatataccagcatttattattaagtttagtgagggcgggggtaggttagtgagggatttagtgtcatttgattatgaggtgagatggtcacatggggatgaagtaattctttaacataacatctgtatgcagaagtacagtatacagagaaaggaatttacaatatagtgtgtgcatcggtaatttctaacagagccgtaaaacagaaacacagtctttccataacctattattagcaagatattaatcagcagtaacagttgcagcaaaagctggttacaaacaatccatagaaacaggacttgaagctagacaaccagttagaccagaaattctcagaaggcagtatgccttaaccctaaagaagcctagaagagccgtggcaagatgagggcatttatagtcctatcttatccatatggacaggcgcccctcatgtgtccatttataggctctccacaagggtcgcattccattcccagagctatgaacatctgcttttctgggataggaatcttggtgatgtgaaacctccctgactgcacgtccattcataggctctctgtagggggaagcacatcacgcgctgttggctcattctggcagtccagcctggcattgtctttacacaatcctgcatgcaactttgtatttacaataatcaggagcatttcatcttttattccatagcaatagtttcagggggtctccctacatctcccccttttctctgatttaaatgaaccatagcaatcatagcttggcactgatcacgactggattgaagaatatttttttccaattttacatatgaacaataaaccaatagcacaaattatacacagaacaaaattaacgatagtggatcctcccaaagattttacccattgaatggggttgaggttagataacccctcagagataccgtctaaaacttcaggaccgggtaaagcagttaagtgtgcttgagaggcctcaaaaatctgttgttttagcttgcttatgtctaaacttaaattgtcttcacttctttgtaaatggcgttttactgattcccaattgtgaacagactcattatattgaaacagagttatacaaaaatcagaattattccaatcacattgcatttataatctatgttctaaactcaattctatctcccatccatataacagtttgtcttagatcattaatttgattggccaatttttgatcaatacctgactgagaattccacatccaagtagaatttttttgccatttatccacaaaatgaacagtttgaatagattgatgtaatgcaactccagcagtagcagcagtcacagtaacagcaatcaagcccattattactgcaattaatgtaaaaataaatcgtttactccttttaagagttttccgtagaatattattaataacatggatagaaggggaagattcccaaggcctgtgtaaggctacggggagccaaataccgtctctggctctgactattaaaatactatgatattgattaaaggatgagtcaatacaagtatacaagtaacaattaacacaggtaattatgttggtttttgaactaacatgcatctttcctataataacatatatggtgatttaacacaacttttaagtggtatagttttgttggactccatatagatagtatatatattttgggatggtactcctttttgtgaatatggggtggggggaatgggttgtatgagaggtggtggggggacattagaacgagggggtataagtccttataatctttactgtcccatctttgaattgaccttttgacaattgccatagtgatatttttggctgtatggaaatagtagtgtaaatcaatctgttgtcttagtttttgaggtgacaaggtggatttacttataacactttctccagcccaaactctcataccagtcatagctatggttaatctccataattctgaatgttcaggtcctaagtggggaacaacgagccttggctttggaggggcaacccctgcccctttccacttaagaggaaaaaaggagttaaatctacaatataataggggagggttgtcactacttttttgataagtaatatcatagagaaaatgttgacaatctctatgaccttgagagcaatcattagtaatatgacctttgggagcccaatcaacaatggtgtagtgagaagaattaaataacacagttccttctgaactaacacaatccttccatattaatttgccagcatttgaagacaagttgagaggacatgcaggtcctaaaggcttatattgggatgtgtgaatataatcagtgattcctgttttgatctgccttagaggttttaatgagagccctgataccaagtgtcctaaaggagggacagagtgaccagacggtagtgtgaccacccatgtttgaatatctaataagagacatccattagtgggtcccaggcacaaaggtggatacctaaaacctaaagcgatattgaaaggggttccttcttctgaaggttgggcaggacaaggatcatctacagaaccaggcatccaaataccgtcattaacatagacctcaaaaggagcatccatccatgtcatggctcgagtaagaggaggaaaaggaatataggcccaatatgtatagttttaacagtctgtggggttaaagagggtggaaggatctcattttaaaattatctaacattattttaatagcaagctgcagctcacaattagttgatctctttgtgatctttaccatgttttcaacaatatttaaataaaaataagattacttatttttgtgagttatgtggattccaaaataagttagagtaaaaagcagggtgggtgtttcttaaccttgtacaaaaaagcaataaaagatttcccatgttgattatttctcattcattacgctttctgggattcattggttcaagttttctccgtcttctgcacatgtgcttaatatccccaaaggatgtgaaaggggtaaacattttatattaattatgtatagaaaatcctggcttgtcccacccacaatttcaccttggtaccccatagccaaatacctgagacttcatttcttagaagataaactcaagcatcacattgtcctggtcttgcggcattcttctcttctttttccacccaaagcaatttttctaattaatttttaaattttgagatgaccattttacaatcacatgcaggtgtaataaataattcagaaagatcccatatactctttacccagttttccccagtggtaaactcttctggaactatagcacaatctgacaaccaagatactaacattgatacagtatcataacacagaacagttctatcctgacagaaatccttcatgttgcacttctatagtaacacccatttccctcccaccactatcccctatttaacttctggcaaccactaaacttctctccatttctgtaattacgttactttgagaatgttgaatttgtttatttttctaaaacttttacagtgctacattttacatttaagtcctcagtccattttgaattatttttattatataacttgtgagacttagttcacggttcattattttttgcctatggatgtccagtttttctagcaccatttgttgaaaagcctgtctttcctccattgaagtacttgaagtacttttacatttttgtaaaaaatcagctgggaatatttgtgtggctctatttctgggtttcctgtatatatatatatatatatatatatatatatatatatatatatctccaccagaccacacagtcttgatgactaaagctatataataaatcttgaaatcaaatggactgatttttcctacttttttttttttgcaatactgttttagctattctaagttctttgacttttcacataaatttagtgtaatcttgtctatatctttttttttttttgagacggagtctcgctctgtcacccaggctggagttcagtggcacgatctcggctcactgcaagctctgcctctcgggttcatgccattttcctgcctcagcctcctggtagctgggactgcaggagcccgccaccgcgcctggcaaattttttgtattttcagtagagacggggtttcacagtgttagccaggatggtctcgatctcctgatctcgtgatgcccccgcctcagcctcccaaagtgctgggattacaggcgtgagccaccgcgcccggccaatcttgtctatatctaaaaaaaaaaaatctaactggaatgttgatagtaatgcattaaaccattataacaatttggggtaaattgacatctgtactatgatgagtcatccaattcacgaacacactgtgtctatttatttagatcctttatgattcatttattcagtgttccatatttttgacatacaagtccagcacatgttttgttagatttacacctaagtactttattttttcaatgattgtaaatgacactatatttaaaatattttttggtgtgtgtgtgtgcgtgtatatatattatatatatataccatacatatatacataatatataatatataatatttattatttatttattttgagagagagtttcactctttcacccaggctggagtgcaactgtgtgatctcagctcactgcaacctccgcctcccaggttcaagtgattctcctgcctcagctcccgagtagctgggattacaggcacccaccaccacgccctgctaatttttgtatttttagtagagatggtgtttcgccatgtgggccaaggtgctctcaaactcctgacctcaggtgatccaccggccttggcctcccaaagggctaggattaaaggcatgagccaccacgcctggctggtttttatatttttaattggtgtctatgaattgattgcttagtttataaaaatacagttgattcttgtatgtttatattatatcctgaaacattgctaaacaactctcttattctaggagttgctttttatttttttatagattccctaggattttcaacatagacattatgtcatctggaaatagaggcagttttatttctttatttccagtttgcatgtcttttattttattgttttgctttattgcactggctagaacttccagcaacgtattgactaagagcagtgattttcagctgttgataaggggtcatttggctctgtctgctttcaaaaatttgtctttgtgtttagtttctagaagtttaaatataatgtgtcttggtatggatttctttgtgtttaccctgttagaggtacacccaactttttaaatctataggtttatatttataccatatatgggacatttttaggcattatttatttgagtaccaacatcatttccttttctccccaggactccaatggcttgaatgtgaaaccttttgttatagtcacacaggtcctagactatctattcatttttttttctagtctattttttctctactgtccagaatgagtaattactgttctattttcagttcgatggtttatttcatctatcccctccattctgtttttgagcccatctattgagctttctatttcaattattgtactttttaattctggaattttcatttcgttctttatatttctaattctttgctgggactttctattactatactgaggctttagacttgattcatgtatcttcataattgtttgctggagtttttttattatgactgtttaaataattgccacataattttaacatgtctgtcatcttggtgttggtatccgttatctttgttcatttttttttgagattttcctatttttggtataactactagcttccaatgtaaacctagacgttttgtactatgttcttatttaaatcttctattttagctgtctttctctaatactgctccatcagggaaaatagggaaattagctcattgttgctaggtgaaggtagaagcccaggttccccactcagcttccactgacagccaaagtgagagtctcctaactactactacataggtgagagttccaggttcttccatggtctccactgataccttggtggaggtggctttattattacttggcaattgtgaaaggcctcctccgacagaacccctgtagggggtagagggatgtctcattacagctgagtcggggtagaagtccagacttctcacatggtgtctcacatagatactgcaaaggggcaagaggagtgtgattctcattaacaacaggcagggattaagtcttagctttctatttggccatctctgataccatcccaatggcatgctagacaacttgttacagcatcctaagagtgaatgtctaggctctctagttatcctttgctggcatgggcagggatggtaccatatttttttctgtgatgtttggttggactataataattattatccaaaggctttctatctttctaggcttccccttttttagtcttttagataggaagagcagatctttgctgggctttttatgtctgcgactgttgccatttctgggtttctggcttgttcagtaacaagtctggtgtatatgagacacaaagaagacccagggacctaaccactgtgtcatcccttgtgtcctgtagtccttagcctgtctgccttcttctccctgtttttcagcatcatcttatgtttgctttacacataatatccagacagcttagttgtacctcgtgggaaaaataggagatattatagcgactctatcttcccagaagcataaggctttatttctatttttagttttagttctggggtacatatgcagtatgtgaaggtttgtaacataggtaaacgtgtgccatgatggtttgctggacctatcaacccatcacctaggtattaagcccagcatgcattagctatttgtcctaatactctccctacccccatcccactcgctgacaggccccagtgtgttgttcccctccctgtgtccatgtgttctcattgttctgctactacttataaatgagaacatttggtgtttggttttctgttcctgcattagtttgctgaggattatggcttccagcttcatccaagtccctgcaaaggacatgatctcattcctttttatggctgcatagtattccatggtatatatataccacaatttctttatccagtctaccattgatggacatttgggttgatttcatgtctttgttattgtgaatagtgctgcaatgaacatacacatgcatgtatctttgtaatagaatcatttttatttctttgggtatctacccagtaatgggattgctgggtcaaatggtatttctggttctagatctttgaggaattgccacaccgtcttccacaatggttgaactaatttacattcccaccaacagtgtaaaagtgttcctctttctctgcagcctcgccagtatctgttgtttcttgactttttaataatggctgttctgactggtgtgagatgatatctcattgtggttttgatttgtatttctctaatgatcagtgatgttgatctttttttcatatgtttgtgggctgtatgaatgtcttcttttgagaagtgtctgttcatgttctttgcctgctttttaatggggttgtttgtttttacctcaaaaatgtgtttgagttccttgtagattctggatattagatctttgtcaaactgataaattgaaaaaattttctcccactgtgtaggttgcctgttcattctaatgatagtttctttttctgtgcaaagctccttagtttaattagatcccatttatcaatttttgcttttattgcaatcgcttatggttatttcatcatgacatctttgcccatacctatgtcctgaatgttattgtgtagattttcttctagggtttttatagttttgggttttacatttaagcctttaagccatcttgagttaattttttaataaggtatgaggaaggggtccagtctcaattttgaacaaatggatagccagttctcccagcaccatttattaaatgagggattatttccccattgcttcttttggtgaaatttgtcaaagatcagatggttgtacatgcgcaatcttatttctgagttctcttctgttccattggtctgtgtgtgtttttgcaccattaccatgctgttttggttattgtagccttatggtatagtttaaagtctggtagcatgatgcctccagcattgttctttttgcttgggattgtcatggctatatgggctctttttggttccataaaaaaattagtttttttctaattctgtgaagaatgtcaatggtagtttaatgggaatagcattgaatctataaattactttgggcaatatggtcattttcatgatattggttcttcctatccatgagcatggaatattttttcatttgtttgtgtcctctctggtttccttgaacagtggtttgtagttctccttgaaaaggaacttcatttcccttgttagctgtattcctaggtattttattctctttgtagcaattgcgaagggggggttccttcatgatttggctctctgcttgcctgttgttgttgtataggagtgcttgtgacttctgcacattgactttgtatcctgagactttgctgaagttgcttatcagcttaagaagctttggcgctgagacgatggggttttctagatataggatcatgtcatctgcaaacaaggacattttgatttcctcccttccgatttgaataccctttatttatttctcctgcctggttgcctggccagaacttacaatactatgttgaatagcagtggtgagaaagggcatctttgtcttgtgccagttttcaagaggaatgtttccaggttttgcccattcaatatgatattggctgtgggtttgtcataagtggctcttatgattttgaagtatgttccttcaatacctagtttactgagagtttttgacatgaagggatgttggattttattgaagaccttttctgcatctattgagataatcatgtggtttttgtctttagatctatttatgtgatgaattacgtttattgatttgcatatattgaacaagacttgcatcctgggaatgaagccaatttgatcgtggtggataagtttcatgatgcgctgctgcattcggtttgccgtattttattgagaatttttgcatcaatgttcatcagggatattggcctgaagttttctttttttgttgtatctctcccaggttttggtatcaggatgatgctggcctcatagaatgagttagggaggagtccttccttttcaagtatttggagtagtttcagaagaaatggtatcagctcctctttatatttatggtagaattcagttgtaaatccaactggtcttgggctttctttggttggtaagctatttatgattgctttaattttggaacttattattggtctattgagggattcaacctattcctggttcagtcttggagggtgtatgtgtccaggaatatatctgttttctttagattttttactttatttgcatagatctatttgtagtattatctgatggttgtttatatttctgtggatcagtggtgatatccactttttcattctttattgtgtctgtttgattcttctctgttttcttctttattagtctagctaaaaatatggaacacttcatgaatttgcgtgacatccttgtgcaggggccatgctaatcttctctgtattgtaccaattttattatatgtgctatcaaagtgagcacagcataaggcttctaaaacgatttttaaaaataagaattgtgtccacctgggtacctcttccactggtagaaagtaatgagctcatttaagatcactgaaacatcacaggccagactagagctcattcacagtagcttccatctcatcgtagtttgatgcagtctgttggtaatgataaatatttttctagacacaatttctccttgattggttagctggaaggcaggagagcttttcagtctccctaggtggactgagctgattatgaagagaccacagaaaacttgtcttttccttgatggcatcagactcaatagaatccgcttagggactatacacaggaaagcaagatggggctaactaaaataatgtaggaaaaaggtattctcttgtacctgatgatccccctttggcaaaagggaatctctgtcacttgaacatctatgtctctaaaggaacctgctaaaggttactgctacaaatattgggaaattggttttaccattagattttgcttgataccacattgcatgggctgcttcccaaggtgcaaaagtgttagataaatgtcttcttcaataattacatagtaacaactgaatgtgtaactacatgacaccttgtcaaaactcaattacatagtatttttgttttcctcaactagtgctattatatcagagaaacagttatactaaatcataatgctttagtgatgacatatttatttactaaatgatcaggtatgacatgaaatttcttcttaaattatatttaacaagatacatagtaatttcatcattttctgctgtttgctatgtgaagtaaacctccaattttttaaagtttccagtgtctcttgtggttgttattattcttgtttttgtttattaaaagtgtttattaacacttctgttacatttaaaagacatgttactctttcattggataatgtaaataatttagtttagttttgtcttcctgtttccagctgtgtgttgaagatattttcaagttgataacttagattacaagggaaaattgtcattgaacactgccagatcaaagaaaatgtcactagttctaacagttgctgagaaattgaccctctttgaatgaaatgtaagcattggatcccacagtacaagtaaaacttctttaacttgaagattttattcaataagcatctatatatactgcacattctaaagctcacattacttttctcattctgtgttatttaaaattctgtaatttcctctactcctaatcaccaggctctatagaacaaacaaagagaaatacttgcattaagttgcagacaactttaacaatctgattttacaaaagtcagaaagtatttttttcttggtaatccttatttgaaatgaagcatttcaatagcaggcaaacagcattgttgacacactaatccaagctctctcaatctcagtactgttgacatttaggatctgaaagattttttttggtggaagaaggggctgtcctctgctgtttagtagtacaccactggcctttaccagctaaatgtcagtagcatttcccaccagttgtgacaacccaaaatggctccagacattaccaaatgtaccctagggggccaaaattgtccctagtatgtatcctctaaaaaaagattaaatggaagttaaataatgttctgatggagattgcagtgtagtcaaattctaccacatattagcctattaatgaagtgaagctattcgagaagaacatttcctgagaagaaagctgtatcccctgcccatttgtagttaagtgccaatagggagtttatgtgacctcctgaagctccaattctttgcctgatatcaaaagtatggttacgttatcctgtgcctagtaactaaaaccaagagatgttgacaaatgtatagagaatagaggtgaataataaaaaaagagagaaaacacaaacaatacataaatattagtctgtaagattcagtactgacataaaatatgagtaacacatgagcaataaactttttaaaaaaatcttgtgagtacataggaggtgttgtattatggggtacattagatgttttgatacaggcatgcaatgcctaataatcaaatcatcaaaaatggggtattcatcccctcgagcatatttcctttgtgttacaaacaatccagttatactcatttagttatttttaaatgtacaataaattatttttgtttgtaatcaccctgttgtgttatcaaatactaggtcttatctattatttctaactactttttgtatccattaaccatccccatcccccccaaccctcattacccttcctagcctctgtaaaccacccttctgctcagatgaacagtaaatttaatggaacatatagacactcacaatgcattttataggagacctggtgctcatagctgttcttcaggttatgaagtctattgccactgattttttttgtcttttcctgacttctgaatagttgatactaggagtcaatagggtaatagccaaagtttaagatcaaaagtctctgatacttgaaattgcaacccccacccaatccctgtggagagccctaaggagataccaggtcttatcagagagcaacaattctcttgtctttctttggcaaactagagagtaacaaaggctaatttatattgcatataactaaaacatattataattttctataacaagcagaaacattagttttaaaatatgtatgcacaataaaaaaatgcataaatgaaaaaggcaagatattatttggttaggggatggattacagcctccaaatatgtcaaggaatggcttgcagaaaagtttctcttttttttttttttttactatcatgtgatagacaaagtcatttcttaattacttttcacagcttctaatcccctagacttgtttgctatatggaatcataatgaaagatgcatgaacaacaagctatgatactataatgacacttgaggctctacttaagttataatccaagttatatgtcatggcagatcaagcacttcttttgtaaatactttttgttaaatcataaagttccttactagggggaacataactagctctatgatttaaactcagaaaggtaaccaggaattaaatatcttgttaaaagttcactttcagaaagttcactttcagaacaaggtaaaatcatgactttcatacagacacaaaaattgattaaggatttattttattcatatggtatgagggaaccaggcagatattataactggttcaaaataaaagtcaaaagagctaaaatttttatggagtaaaggaatgttgacaaatggagacaaaactggtttttccaaggtgaagtggatgaaccaaatgtctaacagacagagtagaatttatatatcagttaccttcaacttacaagaagttgcaaaataattcagacaaggaacaatgaacaatgaacagaacaatgattttgcttaaatcaggcctaaaggctagagatgatgtatcatttcccaccaaaacatatcaatttttactaaaattcccctcctttttgatcaaaaaagcctgaaaaattatcttgatcaaaaaataagacatatcatcagactggacctaattatttatgaaagtgcagcaagtgtgctaatttgccatatggaccttcttaagtttattttgatggatgttttcataaagaatctcagattggacttttaaaagctctttattatgtgtggacctgaggctaggaaacaaggattttgccaatagtatctacaaatgtgggtgaatttctttctttctttttttaattttttgagacagagtctcgctctgtcacccatgctggagtgcagtggtgcgatctcggctcactgcaacctccgcctcccaggttcaagcgattctcctcctcagcctcccaagtaactgggactacaggcataagccaccatgcccggctaactttttctattttaagtagagacggtgtttcaccatgttagccaggatggtctagatctcctgaccttgtggtccgcccgcctcgtcctcccaaagtgttgggattacaggcatgagccaccgcacctggcctgaatttctttctttttaaggttctcaaaacgtcctaaagtccctggcttgccaggaagtgaccttccttactcatctgtaagtctgagaaccctggaagccagataccatgccagttttcccaagtttactttgtaagcattggctttataaagtcagctttggtgccttaaaagtatctgttcatatctaattgaataagcataattttcacatataacatcctaggcaagtccttggttgtataaccaatgtttccaattattctccagttaaaggagaataaattcttactgcaactatgcaaatcactacattgctatgaaaataaaaatgttcgataagagtttctgaattctgaaggggtcaacaaggagaataaaatatcatttataaatatttcatttcagtttataaaagcagagtctactaaattattataagttgtagatagtgtaaaagtacaaaagtgtgatacctttcctcaccaatcataagggtaacagccaagactcctataacaaaagataggttaacaagagacaagcatgacaaatttatttaatcaaaatttcacatgacacagcagccttcggaaatgaggacccccaaaacctagaggaaaccatctatatacttaggttcaataaagaatggatagccacgtagaaatgtgattagacaaaagagtatgacctaatggtaatagattgcgtggggggatccagcaaggcctatctgttcagagactggttgacttctctgtgtagcattccttcttcctcagtatgatacacgacctctctggaatgaaggtcttcaagggaaaggggaacagggagagagttacctttctaggtttaatggcttgcttttggggagaggggttctagttttcatgaccctctttggagaagaggaattctggtttccatgacttgctttgggggagaacaaggaggaggagacaggagaatgtaagaaagatcagaaagaccttgcttctgaggcctttctagtttccttcagttcgaagtattcagtatgccaaggtgccatacttcggggtatcatgttctgagccccaacaatagcataaaagacaaaggacttccttatacatcttgaaaagaaaacattaaaacatcaacaatattatttaaaaatttacatcataggccaggcacagtggtgcacgcctataatcctagcactttgggaggccaaggcgggtagatcacctgaggtcaggggttccagactagcctggccaatgtgacgaaaccctgtctctactaaaaatacaaaaattagttgggtgtggtggcaggtgcctataatcccaactactcaagaggctgaggccggataattgcttgaacccagggggcagaggttgcagtgagccaagatggcaccattttactccagcctgggcgaaagagcgaaactctgtctcaaaaaaaaaaaattatatcatatcattcagtcttatataattattcttgctccataagatcttgtattagcagaagcctatacccaaaagtacctgttgtaatccttttccatgaggctctgagacagtcatccttttttaatgacgaagcactgaggactgtagttgattgcatatgctttcaagaaaggatcagagtaaaacaaacaaaaaaaatatctaagacaaaagactatggttagttattactgatagctttcaaaagtgaaaggtctaatgagcatttgttgtaagaaaaatgcagctgacaataaaatttggttttttctttgacatgcaatacaagatagttaagcctgccgaaaaaagttttagacaaaataattataaacagtgattaaatctattattaaagaagatagtgaagattacatctaaattataaaaatagatgaatatatcctttacagagaaaaaatcttgagatatataagtctgaaataatatgcaataaatatactaagcatatagtaagaatatgccaaaaatatgtcaatattaagtaaaaagattcagtaagtatggaatacaccacaaacatctgtatattaataaaactccatagttaagtgatgtgaattcctatttgaaatctagtggcctagaagatgccattttcaatttaaagtagcaaagttgtaaccaagttaatattttttaaaataactgaaattatgactgataacactatactgctgtcatctaatatcagacaaaacaccactagcactctgataaataaaaatatatatcatggacagcaagggctttgacaaatttcttgaaatttccctagcagtataccatttctgaaatatttataccaataatattttagccacacaaatttaacttacagaaggctcagcatcttttctgatttgaaaactattctcatagaactcatcagcagtaacatatcaataaacctaattatttttaacacctctcattttactagatgaaggaaaaaatctttgtgccattgcacagggcctaaaaaggtaattttagttgtaaaagataaggtgaaagctttattttatttttttatatgcaggattagacttggggaaggcaaaaataaaaaacgtcatggtatttgaacatttaagatacaaattggatcataggtgcctgagaaataatacttaattattcatttcaaaatgtcaataaaacattaaaagaaaacttagaagataacgtgattgtaatgaatgtttgtttttgtgaggaaactttgttttcttgaatgaccaaggacattatacagacaacataaaccatagaatcttattgtggtatgacacaaatctttgttatctaagcagattaacgggaaacaacaacaattacaacaataaaaaataacctttcttatagtaggtgaaggcaatgaaccaaggagacaggcctatcaatttaagcaaactctgctaaggtttttaacacagttcataacttttcaaactcaggtattataaagcaagggaagtaaaatgtatttctaccttttgtctatcattatactccttcatcttctggaataaactgacactttactctaggacccatatcaggatgtccacaaggtcagaattaatttcataatattattagtaacattcaatgtgttcattgttgctatctttgaattcatcaataagtgtgcattttaaaaattccccagtttcaatttccaatatagtaagtatcaatagaacctacaaaaaaaaaagctctatgtggtcctcaataagctttaagtgcacaaagagatttgaagagtaaaaaaacagaataaaaaaaaactcctttaggaagaaactactcctttccatggaaaataaaaatacatcaaacacagttgtaattctctgaaactattactcctacatagtctcattcacatatattaattttaaccaaagcaatttctacttcacagagtaaacttccttgcagtgcatccttgcaatctagcagagctcatgaatacacataatacaactttctacagtcatactttatatgatttctcaaagttgcaaaatgaacatgttcattaacagacccaaatatatcatctctctgtagcatatacaaataagaagcaaaagtatataagcttaatattatgattagtaatcaatattttggcattctatcctacttagaaatgatctagatatccaatgactatctattaattaacccaaaaggatatcaactggggtgatcattccaagatggccgaataggaacagctccagtctgcagctcccagcatgatcgacacagaatatgggtggtttgtgcatttccaactgaggtacttggttcatctcattgggactggttggacagtgggtgcagcctacagagggcgagctgaagcagggcggggcgtcgcctcacccggggaagcacaaggggttgggggatttccctttcctagccaagggaagctgtgacagattacctggaaaaatgggacattcctgcccaaatactgcacttttcccaaggtcttagcaactggcagacaaggagattctctcctgtgcctggctcagtgggtcccatgcccatggagccttgctcactgctagtgcagcagtctgagtttgaactacgaggcagcagcctggctcggggaggggcgtctgccgttgctgaggcttgagtaggtgaacaaagcggccgggaagctcgaactgggtggagcccaccacagctcaacaaggcctactgcctctagactccacctctgtgggcagggcatagctgaacaaaaggcagcagacaacttctgcagacttaaacatccctgtctgacagctctgtagagagcagtggttcccccagcatggcatttgagctctgagaacggacagactgcctcctcaagtgggtccctgacccacgagtagcctaactgggagacacctcccagtaggggctgacagacacctcatataggcagctgccctctgggatgaagcttccagaggaaggatcaggcagcaatatttgctgttgtgcaatatttgctgttctgcagcctctgctggtgatacccaggcaaacagggtctggagtggaactccagcaaactccaacagacctgcagctgagggacctgactgttagaaggaaaactaacaaacagaaaggaatagcgtcaacatcaacaaaaaggtcatctacaccaaaaccccatctgtaggtcaccaacatcaaagaccaaaggtatataaaaccacaaagattgggagaaaccagaggagaaaagctgaaaattcaaaaaatcagagcgcctcttctcctccaaaggatcgcagctcctcaccagcaacagaacaaagctggatggagaatgactttgacgagttgacagaagtaggcttcagaaggtcggtaataacaaacatctccaagtgaaagtaggatgtttgaacccattgtaaggaagctaaaaaccttgaaaaaagattagaggaatggctaattagaataaacagtgtagagaagatcttaaatgacctgatggagctgaaaaccgtggcatgaggatttcatgatgcatgcggaagtttcaatagccgattcaattagaagaaaggttatcagtgattgaagatcaaattaatgaaataaaatgagaagacagggttagagaaaaagagtaaaaagaaatgaacaaaacctccaagaaatatggatctatgtgaagagaccaaatctacatttgattggtgtacctgaacgtgatggggagaatggaaccaagttggaaaacactcttcaggatattatccaggagaacttccccaacctagcaaggcaggccaacattcaaattcaggaaatacagacaactccacaaagatactcctcgagaagagcaaccccaagacacataattgtcagattaaccaaggttgaaatgagggaaaaagtgttaagggcagccagagaggaaggtcgagttagccacagagggaagcccatcagactaacagcgaatctctcagcagaaaccctacaagccagaagagagtgggggccaatattcaacattcttaaaataaaagaattttcaacccaaaatttcatatccagccaaactaaggttcataagtgaaggagaaacaaaatcctttacagacaagcaaatgctgagagattttgtcaccaccaggcctgccttacaagagcttctgaaggaagcactaaacatggaaagaagcaaccagtaccagacactgcaaaaacatgacaaattgtaaagaccatcgatgctatgaagaaactgcatcaattaacgggcaaaataaccagcaaacatcataatgacaggatcaaattcacacataacaatattaaccttaaatgtaaattggctaaatgccccaattaaaagacaccaactggcaaatttgataaagagtcaagacccatcagtatgctgtattcaggagacccatctcacatgcaaagacacacataggctcaaaataaagggatggaggaagatctaccaagcaaatggaaagcaaaaaaaaaaaaaaaaaaaaaaaaagcaggggctgcaatcctagtctctgataaaacagactttaaaccaacaaagatcaaaagagacaaagaaggccattacataatggtaaagggatcaattcaacaagaagagctaactatcctaaatatatatatgcacccaatacaggagcacccagattcataaagcaagtccttagatacttacaaagagacttagatgcccacacaataataatgggagactttaacaccccactgtctgtattagacagatcaacgagacagaatgttaacaaggatatccaggacctgaactcagctctgcaacaagcagacctaatagacatctacagaactctccaccccaaatcaacagaatatacattcttttcagcacctcattgcacttattctaaaattgactgcataattggaagtaaagcactcctcagcaaatgtaaaagaacagaaatcacaacaaacagtctctcagaccacagtgcaatcaaattagaactcaagattaagaaactcactcaaaaccactcaactacatggaaactgaacaacctgctcctgagtgactactgggaaaataacaaaatgaaggcagaaataaagatgttctttgaaaccagtgagaacaaagacacaatgtaccagaatctctgggacacatttaaagcagtatgtagagggaaatttatagcactaaatgcccacaagagaaagcaggaaagatctaaaattgacaccctaacatcacaatcaaaagaactagagaagcaaaagcaaacaaattcaaaagctagcagaaggcaagaaataactaagatcagagcagaaatgaaagagatagagacacaaaaaaaaaacccttcaaaaaatcaatgaatccaggagctggttttttggaaagatcaacaaaattgatagaccgctagcaagacaaataaagaagaaaagagagaagaatcaaatagatgcaataaaaaatgataaaggggatatcaccaccgatcccgcagatatgaaaactaccatcagagaataatataaatacctctatgcaaataaactagaaaatctagaagaaatggataaattccttgacacatacaccctcccaagactaaacaaggaagaatttgcatctctgaatagaccaataataggctcagaaattgaaataataatagcctaccaaccaaaaaaagtccaggaccagacggattcacagccaaatactaccagagttacaaagaggagctggtatcattccttctgaaactattccaatcaatagaaaaagagggaatcctccctaactcagtttatgaggccaacatcatcctgataccaaagcctggcagagacacaacaaaaaaagagaatttagaccagtatccctgatgaacattgatgcgaaaatcctcaataaaaactggcaaaccgaatcccgcagcacatcaaaaagcatatccaccacaatgaaataggcctcatccctgggatgcaaggctggttcaacatatgccaacaaataaatgtaatccatcacatacacagaaccaacaacaaaaaccacatgattatctcaatagatgcagaaaggccttcaacaaaattcagcagcccttcatgctaaaaactctcaataaactaggtattgatggaacctatctcaaaataataagagctatttatgacaaacccatagccaatatcatactgaatgcgcaaaaactagaagcattccctttgaaaaccggcacaagacaaggatgccctctctcaccactcctattcaacatagtgttggaagttctggcaagggcaatcaggcaagagaaagaaataaagggcattcaattaggaaatgaggaagtcaaattgtccctgtttgcagatgacatgattttgtatttagaaaaccccatcgtcacagcccaaaatctccttaagctgataagcaacttcagcaaagtctcaggatacaaaatcaatgtgcaaaaatcacaagctttcctatacaccaataacagacaaacagagagccaaattatgtgtgaactcccattcacaattgcttcaaagagaataaaataccaaggaatccaacttacaagggatgtgaaggacctcttcaaggagaactactaaccactgctcaacgaaataaaagaggacacaaacaaatggaagaacattccatgctcatgaagaggaagaatcaatatcatgaaaatggccatgctgcccaaagtaatttatagattcaatgccaaccccatcaagctaccaatgactttcttcacagaattggaaaaaactactttaaagttcatatggaaccaaaaaagagcctgcattgccaggacaatcctaagcaaaaagaacaaaactggaggtatcacgctacctgacttcaaactgtactacaaggctacagtaaccaaaacagcatagtactggtaccaaaacagatttatagaccagtggagcagaacagaggcctcagaaataacatcacacatctataacaatctgatctttgacaaacctgacaaaaacaagaaagggggaaatgattccctgtgtaataaatggtgctgggaaaactggctagtcatatgtagaaagctgaaactggatcccttccttaaaccttatacaaaaattaattcaagatggattaaagacttaaatgttagacctaaaaccataaaaaccctagaagaaaacctaagcaataccattcaggacataggcatggggagaacttcatgactaaaacaacaaaagcaatggcaacaaaaggcaaaattgacaaatgggatctaattaaactaaagagcttctgcatggcaaaagaaactaccatcagagtgaacaggcaacctataaaatgggagaaaatttttgcaatctacccatctgacaaagggctaatatccagaatctacaaagaactcaaacaaatttacaagaaaaacaaaaccccatcaaaaagtggacaaaggatatgaacagacacttctcaaaaaagacatttatgcagccaacagacgcatgaaaaactgctcatcatcactggtcatcagagaaatgcaaatcaaaaccacagtgaggtaccatctcacgccagttagaatggtaatcattaaaaagacaggaaacaacagatactgaagaggatgtggagaaatagaaacacttttacactgttggtgggagtgtaaactagttcaaccattgtggaagatagtgtggcaattcctctaggatctagaactagaattaccatttgacccagcaatcccattactgggtatatacccaaaggattacaaattatgctactgtaaagacacatgcacacgtatgtttacttcggcactattcacaatagcaaagacttgaaaccaacccaaatgtccatcaatgatagactggattaagaaaatgtggcacatatacaccatggaatattatgcagccataaaaagggatgagtttatgtcctttgcagggacatggatgaagctggaaaccctcattctcagcaaactgttacaaggacagaaaaccaaacactgcatgttctcactcgtaggtgggaattgaacaatgagatcacttggacacgggtcagggaacatgacacaccagggcctgttggaggatggggggcttggggagggatagcattaggagaaatacctaatgcaaatgatgagtcgataggtgcagcaaaccaacatggcacatgtatacctatgtatcgaacctgcatgttgtgcacatgtaccctagaacttaaagtataataacaaaaatttttttaataaaaataaaaaaatttaaaaaatgttatcaacttaacgttttaagttatctaaagatcttggaaattatcttcaagctgacatactataaaacataattactggttaaataaagtttgccagaataattattctgtttgattaaacacaaatttacattcttcataatcttcaaccttaagtagatgcaatattagcttattccctcagtaaatctgtacaactttaggaagaacatgccgaagtataataaaatctacacttctacttaataatgataaatcagaaaagacataggtcttttattaagccaaaatattaagctagtctcattcaccaagcacttacctacattatgtgaactcgaattcttaaaatgttttgaattggtttctgaattctgtgagaatacttttaaaatctaacataccaaaaacattagaaattcaatttccttattttctgagaattttaggaatattctaattacataagaatttaaccatctctataagcgaatcctctaagatactttatattctaatttattaatatcacccaaacatagcaaaatattataccctgtcttagtttactcaggctatcaacaaagcaccataaactgggtggcttaatcaacaaaaattttttcctcacagttctggaggctgagaagtccaagatcaaggtgccagcaagataggttttattctgaaggtctcttctcttgacttgtaggtagctgccatcttgctgtggtgcacatgacctcttctttggtcacagtcctatcagatcagggccccacccatatgaccttatttaaccttaattgcctccaaaagagcctatctctaatgcagtcacattgagggttagggcttcaacatatgaattttggtgggacacaattcagtccatggcatatccttacaaaaaaagaagtaaagttccttatgaagtacagacacttagacatgcagacacagtaagagcttatggcatcaattctaaaatatcagccaggagccaagagtaaactcagaagtatataactcattggtccaaatcaatcagatggtctcttcccattcttcaattcttaattgaacttgagcttaaaatagacaaacaaacaagcagaaaagactaacaaatcggattttctattgtccctcagccaacaaagatcactaaaaaccattaatccacttacagagatcactaaatagtcataccacaagaccaaattctcaatgggaagcaacttattggccataaaccaaaacaaaattagtagagtgcaaaataaatattacaaaaacagtgtcagcatagttctattgccactttggattcaccttcttagagccaagtaaagacatgcttggattaaactgttaaaagataattttcagaaaaaggtaaaatcatggctctcatacagatataaaaataaacatatcctaaagattttactcatatattattaaagaagccagacatatgttttaactggtttttaaagtcaaaaaatcacaaatgtatatagaataaagtagtaatgagatgaaatgcaaatggaaacaaaactgatttttttttatgaagaagggtggcatagggtgaagaaaagtcaattaattctccacccagtagcacagactttaaaaattccagttataacatagctgaaagaaaatgagcagatctagaattaaacagggcacaagttttccactgaaaaatagatttctactgaaacacagtatttttttctacaaatagaaataatttggaactattttagaatatattttataatgagttttattgggaatatttcagattccattcctaatatggttttgtacaggttaatcttcaactgagttaacataccctcatagatagtagagttaacaaacatcaccattactatgaccactaccacaacaatcgttacaacgattcttagtctgcatagcactttacatacattaattcacttattccccacaactctgagataggcactaatattatctccatgttacaggcaaataaacgaagacacagataactgaaataatctgtccatgcttacagagctagcaaatgttgatagctagtccactgagatgtcagctagctatttggagactctcacctgtattttaataagttgattaatatgatctacaaaatgcagaagctaaatttcctgaaattgttaactgaggaacattatagcccaggtgctgtgctaagcacctgaagtatatatgtaaatgaagcaacatccttggctttgagttcccagtctagggatggagacagacatgtactcagataattacaaagcaatattcaataacaaaagctagaattaaatgatgcaggggcacacatttcaaagaaatgaatgctgaatgaaaaaaaaaaaaaggtgggagagatgggcaggattgaggttggtgagggccttgaataccatgctaagcaactttgactttatcctgaaggccagagggggctatcgtagggtattaagcaaggaagtgacataatcaggattccattttagatagattgctctagtagcagtatggaaaaagaattagacagtaagcctatatcccaagagaacaatatatcagttatctgataataaaaatacaaaaccctcaaaacgtagtgaactatttatttaagattcttctgtggatcagcaatttgggctgtgctcagctggactattcctctgctgttctctcctgggcctcatccagaagtctgatcatttgtgctagctctttcctggtcctctctatacccatgggttttcaccttaaaagggtagcgtattcttctttacatggtatggcaaacagaataatggctccgcaaaggtgttcatgtcctaatccccagaatttgggaatatattattttatgtggtaaaagagacattgcaaatgtgattaagataaggatcttgatatgatttagatttttgtcccctccaaatctcatgttgaaatgtgattgccaatgttggaggtgggcctggtggcaggtacttgggtcatgggggcgaatccctcgtgacggtcttggtgccatcctcatagtaatgagtgagttgttgctctattagttcacaagagtgctggttgtttaaaagagcttgacatctctcttacttccttctctcttgctccttctctcaccatgtgatatgcctgttccctcttcatcttccctgacgaatgaaagcttcctgaggcccacatcagaagcagatgctggtccatgcttgtacagttggcagaaccatgagccaaataaacctcttttcttcataaattacccagcctcaggtatttctttatagcaacataaaacagactaacacagaccttgagttgaagagattattctagattatctgggtgggcccaatccaatcacaacagtccttataagagagaggcagaaggatcagagtcataaaaggagatgggatgacagaagcagaggtgaaagagttggagagagatttaaatatgctacaatgatggctttgaagctcgaggaagctgggccatgaaccaaggaaccgaggcagcctactgaagctggaaaatgtaaggaaacattctccccctaagcttccaggaggaaagcagccctcatgacactttgacgaatccactgaaagcagttttgggcttctgacttttagaactataagataaatttgtgttattttaacctactaagtttgtggcttttgtcttttataacagcaataggaaactaatacacatggcattctcagggcaacaagagattaaataaaagcagaagctacaagcctcctgaggccttgctcagtagttgcacagtgttacttttgccctgttctgttggtcaaagcaagtcataaggccagcccagattcagggataggaaaatagaattcatctcttgactggaagacctataaagaagttgttgcctcttaaaatgcactgcaacaagttagggggcaattagagtaacgcaggtaagacatgaaaaggactttaaggtgctataggatggatggtaaggaatggagaatttcaaaacatacttagtaggtaaaaccatcaaaatttgatgattaattgaatgcagagggtgaggaagatgaaacatatttgatcctcacatcaaacctgtgaagttaagtaaacattatcatctacctttagcagaagaggaaactgaagcccagagaggttaaatcatttgcttgatgtcccatagcttgaactagaacataaaattcctgacccatgatcttttcttctggttggactatgttgcttacatatcccttccccttcctcatcccctcctgagatctcatattaatggacatatgccgccacttactcttccatctggaatgggtacccttgttcacttctattcttgtgactttatgtaactggtacagcaacatcaacaccttccatgtcagctaatatagaaaaatcaaaggagaaactaataataaaaaggcagatccaaataagccactttttagtaatcacatcaatagaacactacacataatatgatgaattgattaagatttcatttgggaggctgtgatttgtaaaggaaaaatgacctttaaggcatttttcccctggaaatgagactagttcctctttatctccttgtgaatcattagtgagctgaggaatcaacgaacactgaaagttgaggaaggttagcttcatttcttaagagctattatatcatgtagctagtttccttagcaacagtgtacatatctccccacatggtatcttgaaaattgcaaagacaaatatggtaggtgccattcttaaagttatcaaaaaactgcttctaaatgatcctactttgaatttccatgtaaaaaacttattctaattttttgtctaatcattgtagacaaggactgtaacattttataaatcaatggatacatgaggtagttaagcaacaaaaagaggtatcgtattttcagggaaaaatgtgtcagatccaaaggaaactttcagattggaaatcctcatgccaccaaatacagaagatcatgtcttttagagcatgaatattatttgcatgaggcttacagctagatgatattagcctatggactttttcctacggtaggaaatctagccaatataggataagtgttcaataaatgctggttgctattattattataattggaaatttacagaaaataatctaaaaatagaattgcagctgcttccttggtatgtattatccatgcatagaaactcatggtgtgtttaggcctcaagttacaaaaaagtagctatagtaacaacataaaagctaccctttatggagcattactatgactcagacattgtgttaggcatcttaacgtaccatatcatttagtcatcacaaaacattgtacaatagatactactaccttcacaattgtataaatgaagaaattaaggtgaatagaataagtgtcttgaccaaatacccacaactagaaagtgagaaagctggaaattgaatccagagatcaaatccttttctgcctaactcaaatgccatgttcttagtcaattgctctttcacctgtgctgcaatgtctgcatacaatattctctaatgatgtttcatctaaggccaggaggacagttagaggactgggaaatagattcccacttaactgtgacttctctcccaatccttttaattccccacctcatgtatcctgactctgctctggaaaatttaaatgcagcctgctaatattcagtatgtactaggaatgtgcaaagatgtaagaacaggaaatggttcccttcttgaaggagttcataatctaggtagagacattaaggataacacattaaataacgagaatcatagatgactgaataaaaacagtatcaaattggtcattttaaaattttgagacatgtggcgctttagccacataaatcagtaaaacagaaaggataggtcagcccaggactagggtgagggggcctggcacagctggagggcatgattctggatggttagcgatcattccagtgtgtcttatttaaagagatgtgctatctgaagggatgtggttgatctggactatggtaaatagccaaggagcaccaatctggtgtttaggactggtaatacttcaaagcagatgaagtgctaacaatgtgtttattgacgatgaataaatataggacaccacatccaccccccccacaaaagtaataaaatcgagggactagaaaaaattagagtgtcatggtcctggccaaatggactggagttcaaatccatccatgagggaatttgtaagaattttgtaaacatggcagggagaagactgtgacttagggcacatgtgaatacctagggctcaccttaaggataacataggctagccctgttatctggtttcctctccggggaccaggaaaaacctagccaggtacccctggatacgggtttctgggagccaggtgtagctaaaacagggtatttactttaggtggctatgttagtccactttgcattactataaaggactacctgagactaagtaatttattgagaaaataagtttatttggctcatggttctgcaggctgtaaaagcatagcacccacatctactaggctcctgatgaggacttaggaagcttttactcatggaggaaggtgaaggggaagtaggggagtaggtttgtcctgtggtgagagaggaagtgagaaaaagggggggaaatgtcaggctctttaaatagccagttcttacatgaactaatagagctctcgagagctcattaccacgagaatggcaccaagcccttcataagggttctgtcctcatgacacaagcaactcccactaggccccactttcaaccttggggttcacatatcaacatgagatttagaggggacaaacatccaaactatatcagtggcctaaaccaacatagctcaaaaaaaaaaaaaaaacaccaaaatttcagtcaaggaaggaaggcaaagttcttggtaaaaatgcattattaaatgccaatcctgaggtttgaagcaggactataagtgggagaaagaataatgagattaagtggcagaggaatcagcagttgattaggcagtgctcagagtgggtagaagcaagctatttagggctgcgatgtgtacggagagagattgattgacccttttgtttatatgatgccagctgactgcttgggaactatagcggacatggtagcttaaagaatatcaagacaggaagatgaattccagacccacccatggataggatggactgttctaatgtactgtctgctgaagtcagaattggcttagaaactgcaaaggcatattatggcacatgcatataagtacacctgaagattgaatcaatattatgtcttattcatatatacaccactggcatgtttgagttgtgtacaaatgctgttatgatgaataaaataccaatttatgttaaagcattagtgaattagtagctatttttctcattatatatttttcttcaaaattgcatagtaaaaataagagtggtaatccagggaattcttgacattgttaggaccagaatttagaggcccttttctatggaatcactacattaattatgtagttatataagccaacagtttttccctcctgcttcctgagattcagatcagacaataaggatttggttcctaccagagatgtttaagggaggggagtagacacagcatcagactgactccaagtgttgcttctcccataacttgtcatcttctacaatatttaagatcttttacattacacaatcatcatcattgttgtcattgccactatcattatcatcattattattatctgtatttgtataacactctgcactttgcaaagtgctcttatcttcagaggtcgatttgcaatgaagctaatgaggcataagccttacaaaccccctccaaacctcctagagtagctttagcaatgcttttatctgactatatgtttttgtaaagctttccgaagatattttaactaaacttaacttagacactttttctcttgtctggtagcattggagtgaccatgaaaattttagggctttagttaagtaaaatttgagttggtgaaatatttaatttgggtttagtaggacattttcagtgcacagtcacctctgtatatagttagattatgctagccaccccagtatcaaatgacttccaagaaatcatcctgccacccactgtgctgactaaaccaagggccagaggccacagaaccagaagtcatttcaggataataacatgtccttaagtgattggcaacagaagtagaagtgaatgtaagagaaataagctttgaaatatagagagctaaaatcagtctgtgaaaaaatactttatatctaaaagaaaattgagagaaaactgatttttaaaatgggtaggtgttccccaaatttgacagcaattctcaaactttacatgacattagcaataacaattataaacctgaagaaaattcctaaacttattaataaaaaacaaatctcaatcaaccatgctagaggaactattgaattccctttccattctgtttatagaaaatattacgaagttgtcatatgaagagaaaaacaaagtatatgcaatacaagtataagttataaaagttattattgaagtatgtcaggcagttaattcatgaaaatatgtagggttttttttctggattttgtgatgtttgtggcatttatcatcttttaaaatgtgttacatataccagtttattttctcatcctaaaaataatcaattttatacttaattttgtatttgtaatcttgcattcttcttaagacaatcccccttgacttgtataaactttagacacacaaaacctggattaatcccggtgcatgcattctgtcacccaactgccacaatattcctagacaaattatactttacagattagagagatgcacctcactcattcagtctttcagcaaatgtttatgagagcctactacgtgtcaattactcttccatgctctagggatgtagcgatgaacttcacacataaaaatccttgccttcctagatctacattctagtgacattataacaaggtatatagataagttgttatttattctgtgtcatatgatgtaaaatgagtaaataatcttggactagaacccaggtgttttccctccagttaaattctctttctttgattatcttaatttacatggctcttgcttcatcttccacattcctctgtgggatgggatttgtaatccatcatcttctaggcttggacacatctctgctttccctgtgaccttctcaagagtcctagtacaaagctagatgcaattcttagagaggcttatttatttttaacatggcccaattttatctcttttggatgaaacacaccctgaacataaaacttgctgtgcctttttgtccttttctctaggtcactgcttagatttttttgagtttccaagttgcagtcagctcatgttgcagagaacagattcttagccatcaatttttgccttctaggtaaaagcgaataaattactcctttcaaatgtcttcaagcagctgctgaatttttctcaggagtatctgttgttttgttttaaatatattctgagttttgttttttgtttaccaacagaatttttctggctggcaatttcttccacttttcattaattgtggaagtggttggtgttaataagaaagggtaaattctcccaaggatatagaacacagtaaaaacagcagtataaattggtgagggctaagttgttcagtaagagtcactttttctgcattactttcggctccatcactgcattcagagaaaagtgagtggtgaaatcaatttcctatataaatttggcagagaactgaatctgaaaaactgaggcaaaagaggtctattttaagcttaaattattggagataattgagtcatgtaaccacttcattctctatgtttagacagaagcttagacatcatctgattttcttcaaagatgtacattgtaaaaacaatttccctaaataacttgcctagtcttccaaactcaatcctgtaattttattcccttcattccaacatagctgtctgtcattctcccaggcaatgggggttgaaattcttgaaaagcacttaagtctcagtgggacttcatggtgacattttgctaatgtgccttggtaaacaaaacatcctaggttgtgaaaccaaagcctacttctatggcgttgtttttgttttaaacatgtcattaagaaaaaagatattactgcttcagtatttctttgatttattattggtctagaacttgtttattagactctatttagtaataacattcattattttactacccctttatttcatagagaaatatgataaagatctcttaatgatcatgttgatttgataagcagatgaaaggctaaaatttttaaatctatctcataccactaggttgacaaaatttgaaaactttattatccagatgttcttttcaatgctcccctctctactcaagtgctccccagtggtgcttcaggtttaccacccataactctcctcctgctcctctggacctcatcaatatttcctccagggtcacatgtcctatctccctttgggacttcatggcaggtgccctaatgaggatcttaaaaatgaattgaggtttgaatgatgggaaaaactatctgctattcctcttcccctgggagtttaaaaattttaataaaggacaactgaaagtaaaatgcattaacctgagaaaggaatgatagatggaattttgggcactatgcaggccaattaggtttgcagaaggaatgaagggtatggagatgtaagagtagagttcaaacctttacatcataaaacacatagatagtgatctataatgcacaaatacgtgcctacccttgagacaactcaagggtgattttaagtccactcatttagacattttccatctgtttaagaaatgaattttcactataacagctactgttcattaaacaaacaggtacaaagagtatttattttttaatatattgcgacattgaattcctgcaattcctcttaccagcttctcagttggtttaaaatgtgtatgtcattccagtctacttagatctatatcaagctaatcacttcagggcagctgtagattgatgtcccaagccagggaggaactggccacttacctacctgcctgcctgcctgccttcctgccaagtagagcaattgttactttttagctctctcatactccataatgacagttcgactccttaccaatttatttgatcattttaagagcatcttcatagatttcaaaggaaaaactatatccttgttttttgcactgatatcatgtgcattgttgtgttgttgttgatggttgtttgctttttcttttgttttgctgtgttttcctcttttcagaattttgttcttagattgcaagagtgacctctagtgtgaaacatctgtatagttattatctcaagctccagggcctcttatccagccttaatttccataggtatttgtgttatacaaaatataattagcaagacctccacaaatatggcaagttatcatctaagaataaaaactccaagtcaggttttttcttattactactcatttattttattcttaaactttggctaacaaagtacagctgcattctggggattctgggatggcaaaggcaacacttccaaaaatgtctttgcaaggaactagaagtaaattacggcattctttatgagctgggtgtatttgactgcagaaaaaaatgttttgcaggcctcttgttgcccctggcattcctgttgtgaataatcggttggtgcactcccctgttctctttcttctccagaaaaaggaagtgttttccttaccaccatactgggtagatgcaaggcacaaagaacacactgtattcttcatggggaaaattaaagtcgacttaagcatatgtcctgccctcacacaaggccagccagaaaatttgcagtatggtcacgggcattgcttattccctacacgaggtaaaatagaagctttaactgcctttcaagagctagctccccttgcaataaaaataacaacccctcatattggcatagtgctttaaaacttacaaagcacttttattcataaaattttacttcatcctctgaccacctttaggaagtaggcattattagtcccatttcagtgatgaaaagtatgaggcccactggggtgcaatgacatgtgcaaggttaaacatatttagtaaatggtggagttagaagtctttggactccaaacttagtgtacattttctcacagattcctcagagtctaacaatcagactttggcaaaataatatataagattttcaaaaataaaaacagtctgcattcatatttctatgagccttgaaaagagaaaagatgatctggttgtaaggatcaaagaaggtttttatggagcaggttatatacttcagtctttaacaaataagaaaaatgtagacagatgaggaaaaccatttcaagctaagcaaaatcagggcaataggaaagtatagcacatctataaaaaatagaaagcacttcaatcaatgtttctaagtgtgggaaggttgtaggaaataattctggaaaagaaagttaagatcaggacctgaaaatcctctaattctagaataagttttcttaatctcagcactattgacatttgggactagattattctttgttgtgggggatgtcctatgcactgtaagatggttagaagaatgcctggtctataccaccagatgcccataacaccacatccctcagttttgagaagtaaatatgtcccagatattaccaaatgctccctctggggcacaacttcaccctattgagaaccatttaaattggtagattatggggaccttttcatattttgaagcaaagttgtgtaatgaatacacctatgcttagggaaaacaaatatggcaaaagtctacagaaaaaaaatggaaaagggaagaggttgaaagccaagaaaaagcccctcaggaagatatgacaggggtctcacaatgtaagggccacagatagctgctatattggaaaaagcattaaacttagaggcaggcacttggactacattgcaagctctgccaacagtcagtgtgtgttcttggacaagtcatttaaaactgtgccctctatttctcatctagagtgagaagatgagaggatgagacgatgatctcaaagttcccttctaactgcattagagaaagatatgcaatgctgtaactaactttatctgcattcattcttctccatatgtcttttgaaagaatcttggtgggtatcaaatgtgtgtttgatttctctgtgtaaagataaacagcataacctcactgtctcagattaagttggatgaaatgacaagtcagaaatagtgaaaaatatgaattattaagtgcattttaaagacatgtagttatattactttcaagtacatgaagtacttagaacatagatgttgaagtattgcttaggcgaggtctcttggaagctagtttagttcattaatttagcatgtactgaaagcacacaatgtgcaaaacactctgctaggcttttcagaggttaccaagatggattagttatgtgacctgccaaagagcttacagtatagtaagggaagttagcaatatacacaacgataatacaaagcagaatgttgtacattccaaacaaattgtatgtgcaagtcttatatacaacaacaggctgatttttagattgcttagtcatgtagaatacagcttaaatccaggttttaaaataatcaaatatatatttaaaacacatacacaactttttcaccgagttgctaaaatatttgagtaagaaaaaatacaagctaaacaattatccatcaactcaactaagatatctgcgtaatatataactgaattgtaatggtaccatacataggctaacctcacttgccagtggagccttaacaagtagacaaaaatggttggcatcaagcaaattgcttatatttaaatggttgttttaaagaacttgtaataattctcctttttaaagtatttaaaatattaaatatactttaaaaaatcttgtctatgctattttgtcccttgctttgggaatctttgttctaaagaagcagcaattttcttttcttttaaattttatttttagttctggggtacatgtgctggatgtgcaggtttgttacataggtaaacatgtgccatggtggtttgctgcacctatcaacccatcacctaggtattaagcccagcatgcattagctatttttcctaatgttctccctcccaccaccccacccaccaacaggagaggcagcaattttaatgttaaagttttactatatacgatgtaaccaagtgcaaattctgtaagaacatttttcccgttgagctgttttctaattttaatgttaaagttttactatataccatgtaaccaagtgcaaattctgtaagaacatttttcccgttgagctgttttctatggtgttccttcttgctgtatcttcaggtgattagcagagccaaatagcaaatgtacaactttggtcaacagattatatctgagataatttttgatttacctactacatactcatgtgcacacatacactatgtaagagggctgtggtaaaaactgatgtaattaattcagggagagaatgccatgtcatttggggtgggggggatgactaataaatagatagatgatagatgaatagatagacggatacagatagatagaaaataaaatatctgtactagtagatatatatgtgtgtgtatgtgtgtgtacctgtatatgtaggccaaagataaaaaaatacagaaaaatcgcagttactcaggaatttgttgtacagtttgtacagaaaactaaactgtgagtgtctttttaacttgagagcttcaggggaaagaggctgttttttaatcagatttttgactacagaagtaaatacaagacagtgtgagaaatggaccaaagtggaagaatattgaggtccctgttggttccagtcaagtagagagatgggtgtaacagaacaattgactttgagatattttccccaactatgtcactcctggtctatttattttacaaccttcatactgtgggaaatatggaacagtataaggcacagtcctggccctaggaagtttataaaagttcagaagactgaacaaaaacaagtgataagaaaactaccaatctaagacatgctatgaagctatctttgataaattattcttagtgacacaacaatccttgaaggcagagactgacatatttaacgtatccccaaacacctaggaagggatcttgcccattgtagatacttgttatatgtttgttgaaatgaagtggcatgcttatggaacaaaatataaaagcttagaaatacaaaatagagagatcactgttttcagaagcctatatgcaagatacttatgaagtaattaatagtgtgactggaaggttgtagtgtgtgatttaattttatagcatttagtattttcatattaaaaaattacagctttatagaagcttataaaggaaagggcagggaacaacttattgaagacagaactagatccagaggagaggaagagtagggatgactgaggagacaggatagttccctgtgaatttggaagagaattttgaaggagagagagaaaggattgttgagcaactgctttgaggactttgagtcagtagatgagtagtgaggaattttagaaatctccgctgttaagcaattcttattgcttaacaattttcccactatttgagaaactgctaaagatacacattaattttcaaagaaaaaaatgcacattacatggtaaagaatggagaacttccttattagctttatcccatactggaaaatgattgggcattatttgatgagactagccaattgttttaccaaggaaggaacaaagagtagtggaaagttccagtgaggaagggttgtgtaaactagcaaggctgagtgactagaatagaggcagtcaaggatactcataggaaaggcaagaacaatgatggagttgggaatccattcctagcaggatggctggctcagttttacaggaggagtaatgtaaagacccagagctggagagtacatggctcaaggaatgcggataaagccctggaggatacaagagaacctcaccaactttgtgaattacattcaggccattcctgcctaagactcagaagctgacttctgacttttcttgtgagcaatgatgggtctttacttttttaaattatgcccttcagcagaggcagcaggagaggtgacttctttattatgatattgctaactgcaataattagctttaatatcctttattttctgtcatttatgtaacctcctgtcttcaaagaacagaacaaaaatattcaaacttattaaatggcatataactgctacactctcccatagtggatacattgaactcatttccttctctcttcaggaacttatggacatggggaaagaaagattacatacaattcaagataaaatccaaatttcaagcaaaaagagatggtgacaatcgtagattggtatcacctgaatacagcactcggaatgatttccacaggcatataaacattgaggttcttttctcccattttgttgttgactctgccttgcaagaatttttgaaaaggcaactcagatcagtttggctcctcttccctttcctttctccctcctccttctttaaaagggttagcaaatgaaagggaaaacttgaacttcaaggccattatttattatttgtaccctggttcattccaaaatggattggtgaagaccggcaaagatacatttaatgctgcaagagaaaaccgatttaaaaataagaaaaattagtcgaattgaactaagcgtttgagaatcaaacaagtactattgagcacaaccatgtgccttgcagcatgctagttcctctaaggaaatgaaagtgaaatataagatatggtttccatccttaaagactgtaacatttatttgggaagaggaggcaaacacctgtgaaatgcagtatggaggagtgtttaggatctttggctctagagtctagctgtctgcttttatatttctcccacttacaatgtttgtggcttcaaacaagttaacttctttctacttttctctgctcattgtaaactgagaataataataccttactccctgggtttctgtgatgattaatttggtcagaataccttaagcacttagcttattttgttgtaataattatataaagcaaagtgcagctaaacttttaacttcctgtgacatgtataaaaatgggattcagagaaagcagagtgtgcattaaggaagtcagggatggcttcatggtatcggtggcacttgagctatattttgatggatgaggctttaagtgagcaaaagtggagggtaaaggcatgccaatcacgtaggctacaaaatagagtataatgaatggcaagaccagagggatttgtcatcaaaggaaattaatagtctaaaagaacccttataatacttcagaaaatcaatactgtgacatgaatctgatcagtaatatgtggacagctttgcgtttcattttctcaactaggcattaaaccttgatatttccattttctaaaggattaaaggatccttgtgggattattttgaacatcatttctagagtcacggtgtgcagacagccaacaagacttatcaaagtgaatgggacctatgttaaaactacagacacatattattcatttattttttgaggatattttaaaaactttccacagctgtgttttaaatctcactataatgtccagaaaacacatcagtattttcttcagtcaccatataatacctggatcaatcttcagatatacaataagaattgccatgtttgtattgattcattttttttccaaacttgtacagcaggatttaactagcaagtcattcctagtaccaaaagttgtgatcttattagtaagggattcaaagtacttttgatgatacagaagttgggaaagtgaaaaagatttctgtttccaatcagatgttctcaaatgacaaaggtgacctcttttttgggaagtaatggttactctgtgttctatttttactactctcttgtctagctgctagaatagacctaactttgtaagctttaacacttaattccatgtagtgtagagccaagtaaataacttttgaaacaaatgaaaataacaactttaaatatgaatttaatatggactgaaaccatttttcaattgatatgattgtatagattggctactctacaaacctagatttctaaatcaatatgggaatttttagtttctttccttcacctaacacaatacaaagaatcatgtgtatttaattttaaactattaattcaatccaaatgaattattttgcaactatatgcacatttgaatacacacatacaacatatttgcttgcttcaactctcctgacatctcaatttgctgagtataatttggacttgctagtatagtgagttaatatccaaggattttgtcttttccatagggagcttttaaaaattcctttgtcaagctgagatatgaaaaacactgggtcaaagaaagcagggtcataagccaagatcagcagagccaacagaagcagccagggtcaggttaggtggagagaacctagggttcaaggcaaggtagggtttataggcaggaaacccactatgaagtaaacagaggttaagggatacacaggaactgggattccaggcacagaaagcaagctgattcaggccaaaaaccaaatggcccagggaccttgacgctaaagttaaaagctacctgaggcacagagatttacatgctttttattttgcagaaggaactaatgactggcactcgagagctaggactaaaagtgacacagttcatcccacttggaaaattctaacactctaggccagctacaaaatatgagaacatcagacctgaaagagtccttagagattctctcagttgaccctataatttttagaagaagaaagtgtggcttattagaggaatgggcttgtcaaaaaaatcaaagcagtatagtggaagggctggggctataacgttgacgtcctaacactagtactctttacatgaaatgtctttgccttgcctacatttggtacccttaaatgtgagatatgactgagaaaactaggatcttaagactctgagccacactccttgtccaaaggaaatgaaaaaggaaaaaggaagcaaagttaatgggcgggatatgtagtaacaatgggggttttattcattcaacctagataaaattcagtaacagaaacttctattgggattggggcaacttggtgacacaactatgtaagtcttataactaaacaattcctcatccagtggactttgtaactcttatctgattgagccaattgtgtaccaaaacaataacaacaataacaacaacaacaatactcctttaaccaagaaaacaatgctctgtctcatcttactttgaggtctgctgctgtgctacttccctctagcacaggcaaataactatgaacatattccccaccatccccaagaaacattacctggcttcacacatacattctttgaaaccagaaatagtagaaagtttatgggtctcagtctctctttgtctatctctttctctctcccaaatcattattctattctaaggttactcaagtattttctcctggtcttcttccttctcagattaattagctttggtagccactgtcttatctcacggtcactgttgtctgggtagaaaatcctacttttttttttttttttttttcggtttccaccatctgggataactaactcatgtctttctgcctcatcaacttttcatctcccttgtatcttactggaagaaataaattctttcttccttcctttagcttcataatagctttatctcaactataatttagaatttacctctgtgactgtttcatttaatttagaaatgatggggagagggctcttctttagaataaagaatttaaaagggctttataaaatcactctgaaatgtcaaacttcttttttttagtagattaaacactgtactacatattggaagacattaatttctgtaaaacaacatcaaagctggttcataatttgacctcagaaaagtcagttaattcctatctgagcctgtttctaaatctcaatgattcattcagtttgtttgagataataatctcagagaaagaaaggaccttggtatttttaccagtacaacattggctgcaagtgggtacttgatatattggatgactgatagaaaaggccagtgtgaggaatgatgaactaccttgtgattaaattacactgatatacatataaatatatatatatatttatatatatatgtgtgcatatgtatgtgtatatatacatacacatacatatacatatatagatatatgtgaatatataggaattttattttcaaaatgagagaatatatgtttctctccctctcagtgaagctacacccggggatcactggctttcagctttttccttcttaacatatagaacagatgatacgtactgtaagaaaaactattaatgggtctcttagtccattttctactgctgtaacagaatacaacagagtggacaatatagaaaaagatttatttggctcacagttctggagactgagaaatctaagagatggcaccaacatctagtgagggtcatcctgtaatagaaggcatcacatggcaagaacatgagtgtgcaagtcagagagatgaaatccagctgaattcatccttttactaggagtccactctctctctctcaataatggcactaatcctgtgataatggcattaattgattcgtgacagcagagcccttattacctaatcacctcttaaagatcctgcctctcaacactattacattggcaactgaatttcaacatgagctttggaggagacattctgctcttggtccctcaaaacttatatccttctcacaatgcaaaatacattccttccataccaatagccccaaagtcttaactcattacaacataatctcaaaagtctaaagtctgaagtcttatctaaatcagacatagatgagatttaaggtatgatgcatcctggggcaaattcctccatctgtgagcctgtgaaattgaagaaggtatctacttccaaaatacaatagtgggacaggcatacaatagacattcccataccaaaatggataactggtttcaagtaagtccaaaacccaaaatggaatacaacatttaatcttaaaactggagaataatttgctttgcctccctgtcccatatcctgggtacactggggtatgtggctgggtcctcaaaccctcaaaccctttggcagccctaaccctggggcttttatggattcagtctactcagcaattctcacaggttgtagtctcatgcctgtagcttttggaggctggtgttatatgcttgtggccctacagttctggggtctctgaggtgaccccactcctacagccacactaggcattcccctagtgggaactgtctgtggtagctctagccctgtggctggttttaccctagggccctaggctatcaacagcatccatgcacacacaactcttgcattttgcaagcctgcagacttaactccatcaagacttatagattataccttccattttggcaagtctagctacatctgggccctcttgagccatggctgggtggctgaggggtgctacgctgggattcagggagaagagtcctaaggtggccctgagcagtgagcctgtatcagtttattcccacactgctataaagacactacctgagactgggtaatttataatggaaagaggtttaattgactcacagttctgcttagctggggaggcctcaggaaactaacaattatggtggaaggtgaagggaaagcaaggcacatcttacatggtggcaggagatagagagtgcacagtggaaactgccacttttaaaaccatcagatttcatgaaaactccctcattatcatgagaatagcatggggaaaactgcccccatgatacaatcacctccaacctggtccctccctttcaacatgtggtgatgccttcccaatagtcccccaaagtcttaactcattccagcattaactcaaaagttcaagtccaaagtctcatctgaggaaaggcaactccgttccacctatgagtctgtaaaatcaaaagaaagttagttacttccaagatacaatgggggtacaggcattgggtaaatgttcccattccaaatgggagaaaatggccaaaacaaagaagccacaggccccaggcaagtctgaaacctggccaggccatcattaaatcttaaagctccaaaatctcctttgactccatgtctcacatccagagcatgctattacaaggggtgtgctcccatggccttgggcagctctgcccctgtggatttgcaaggtacagcccctgtggctgccttcatgggctggtgttgagtgcttttagccttttcaggtgcatgatgcaagatgtcagtggatctatatttctggggtctggaggatggtggtcctcttctcacagatccgctaggtagtggcccagtggggactctctatcagggctctgaccccacatttcccttccacactgctctaacagaggttctccatgagggttccactcctacagcagacttctgcctggacatccaggcatttccatacatcctctgaaatctaggcggagggtcccaaagctcaattcttgtgttctgtacacctgcaggcccaacaccatgtgaaagctgccaaggcttggggcttgcacactctgacacattttaaaaccatcagatctcatgagaactccctcactgtcatgagaacagcatgggggaaactgcctccatgatccaatcatcccccaccaggtgcatccctggacacatggcaattacaatttgcgatgagatttgggtggaaacacagagccaaaccatatcagagcccatggaggataccccaggcctgttaccccaaacagttctgccctgctagagcccctgagcttgtgatgggagaggctgtctcaaagatcttcaaaatgcctttggggtcttttgtcccttgtcttgatggatggcacctggcttgtttctatgcgtattaattcctttaacaaatggttgcttggccacactttttgtattctcttctaaagatgccttttcactctttaccttgccagcttgcaaattttcaaaatttttctattctgcttccctttttaagtattaattccatctttaagccatctctttgctctcatatctccctatatacaatgaaaagtagccatacagtagcctgaataccttgctgcgttgatatttcttgtaccagatgccctagtttatcacttttaagctctgcattccataagccctggacacagacacaatttcatcaccttctttgccactttataaaaaggatagcctttactccagttttcagtaccttgtttctcatttctttctgatacctcatcacagttgcctttactgtccatattcctaccaacattctggtcataaccccttaagtaatctctaaaaagatcagactttccctacagctctcctcttctcctgagcccttgtcagaattctctttatggtctgtccacatcagtacaagatttttctagccttttcctccagattcgttcagcctctgctcattacccagttccaaagccactcccacatcttcaggtatttgttatagcaacaaccccactctcggtaccaatttttctgtcttagtccattttctgctgctataacagaagaccacagatggtgcaatttgtaaggaaaagagatttatttggctctcagttctagatgctgagaagtccaagagcatcagcacctgttggcattaggtgagggtcatcccatggcagaaggcacacatatgagacagagagaggaaatccagctcaactcatccttttctcagaagcccactctcagaaaacactaacccagttccacaataacattactccattcataagggcaaagccctcatgacctaattatcttccaaaggtcttacttctcaacactgttacattggcaattgaatttcaatatgagttttggtggggacattcaaaccataacaatgaaacatgcctcatatacaagttatgactttaccccttaactcccattcaaaaagaagtatactggaatgcatatgtgtaagagtgacataatataatggtgacttcagctctcctgtaaatttttaaataactaattcgttaacttcattattaccattattagcaacaatcttcttaaaatatgtcttacaactgaaagtagcatgctccagtgttccatgtgttctgacactggcctgctagactagagcatgtggttcagggcactctcacaaatacagataaaagatttgtgccctgattgtggattatcttaaggaagaaataaacgtcttgaaaggtgaagctacaaagttaaatacataaagcgcagcaggaaggtgattagttttcacattggcatcacaactatccattcttctttttatcttatgttgaaaggccatatcaaagtgtgggcccagggaagaaaggatacattaacagtaacattaatataaactctatgtttaactccttggtaagactggtgaaattaaaattaacttgattacgtaggacaaagatacacaatttatagatttttgtggtagaatttcaggcacctagtcaataaggtagaatgaattgaaatggtaaagatcacctcttgttctaactacagagaaatgctggtcaaaataaggcaaataatttacatgcttagcccagctggaaagcaagtaagggaaattctcaggccttagtgataaatagggagctcaaagtaagagaaaggagtataaattgaaattgaagatctcctggagatatcaaaaccaaatgtggatattcagggtacatgggcttgagtttaggatctatgtgaagtatggagttagagcagatcccagcaaaaatctagaaaactgaatgatttacaaaccctgaaatctatgaaatggggcctagaaaactctgcttattgattcaggaaagtgtacagaaaattcacattcactccagggccatagctatgaatccaaggaaacatttaagagaaactggaactctaaacctgtaccaagcatgggtgtggactctaaattcacataactcatatatgacacaagcccccaagcaaagaaattgacagaaaaactggttccaaaccagtgaaacttgtagggccttggtagaagcaaccttggaacttctctaagggaattcctctataaccctcagcatgtgggactaccacagaaaacaatccctgctgtagatgaaaatacagcaatgaaattataaacctcataagaaaattaaccaccatgatgttgcttcccttgacacaatggaaaaaaaaactgcataccaagaagtagagataataggacaatttaatagagactttaaaagaggttgaaaattgtttaaagagaaaaacagaatggagaaaaattgtttgtcaagaaaagggcagtgatggttatctgtggcctttacaaaaatatctgtctcttgtgtttatttaacaagaacctgtttaatgggagagtaaaaacattcctcccaggagaaattgcagcaatagtcagtaccttatgtgtagtgccaagaaaagagcagtcattttttgatagaccacctcaaggaggccccattttacacagtgccttcattctgatttcttgttctatccaggcccacagccacttggatgcttcctactcacactgaagtggatcttgccactcagccaccaaactcaaataccaatctttcctggaaaccccagacagacatacccagaaataatgcattaccagctatctaggtattaatatttcttaatccagtcaatttgacacctaaaaataaccattatagtttatattacctaatttttcttaaaacatgtaaaaatcagaataaacaaatttctgtgtaatcttaataacagtggagagtatattatgatacgtcttctcaccaaccaaaaatttacttatacttttgattaatgttagtttcaagggcaagttcaagttagcagtgcttaatattctcaaaaataaacaaaaaagatagtcttttcatttgattttttcgtattatttcataagaaggaggcagcaaaaataaacagttttaaaacctgtgtaacaaacagctttgggaacatagggagaccctgtgtggtcccagctacttgggaggctgaggtgggaggatcacttgagccagggaggttaaggctgcagtgagctgtggttgtgccactgcactccagcctgggtgacagagtcagaccccttctcaaaaacaaacaaacagaaaactgagtaactttgtattcccacttttgattatactttgaatttaagtttttttctagaagccctcataactatttaaaatttttcccaggtacaatgataagatgactagaaaaagagttgaaaattgggtcacctctgagttttcctttggatgttaaatggtcgcttcctgtctcccactgataatcaggagtcatttgctcatttctttttctctcattctcaggtaagcctctgaacatcccctgcaaagcattcttcggattcagtggagagtctgggccaatgatctactggatgaaaggagaaaagtttattgaagaactggcaggtcacattagagaaggtgaaataaggtagagagcttgaattgcttatctttctttgctgtcttacgggattctgctcaggattttaattgcaactccaaatcattccattctctaaaagctgatcttatggagagaccaaggatgactgccttaagaaatgccaatgtgtaagcttctaacataagtaggtctttctcccatttaaagattatgtcaccagggtataatgaccctccaaaagctgcctaagcaaattcctttgagtttctaaagctaaaaccactggtactccaacagtcacagcaaaggtccagtctttgaaggtgactcctcagaccactgggcaaattgtttattttctacctgggaacagacaaccttcatatgtcataagtgtaaaactgcagtggcaatggtaagctggtcttcagccaaaataactgttaactcttgttgaatactgtttatttttcccaacatctaatacttatcctgaaaagactgatccttcaatttagtacatgtttagacctcttttcactctcctgttacacaaataattctctggtttatagataccaattctattggttttctaattctatttagtactttctcatttgtacaaaaaagatataaaaatataggtaacctttctcgcctcactcagtttgtgaggtttctctttggtttcagagatgatgatgtgtagtgtatgttcctgattctgataggaattgggattcttccctcttcactcccattaagaatcatgcagtgaaaattaatctaaaatttcagtataactaatgttaaagtttattccttcagttttcttattgaatatagagcagcataaatgagacaagtatgctttgtattatttactatgtttaaatgttatttataattactctcatgacagtttctctccatgtgtctacccaataactcttttctaggggttcataactttgaaggtctgtgaaccccttaagagtctatgcaaaatatttactataggagcatatttctaggcaaaatacacatgaaaaggtgtttgacatgtttagtaatcaaggaaatgcaaaccaaaaccacatgataccactttatactcactaggatgcactaggatggctataatttaaaaagtcagattataggctgagcacagttattcaggcctataatcccagcactttgggaggccaaggtgggtggattgcttgagctcaggagtttgagactagcctgagcaatatgataaaaccctgtctctccccgcttccctgccaagaaaaaatacatatatatgtacaaatcttagccaggcatcgtgctatgtgcctgtagtcccagctacttgctacttgggaggctgaggtgggcacatcacttgagcccaggatgttgaggtggcagtgagtcatgattgttctactacactccagcctgggtgacagagcaagaccttgtctcagaaaaaaaagtcagattataacaaatgttggtaaggatatgaagaaatgggaaacctcatatactgctggtaggaatagccctcctagggatataaacaaagtaaatcaaaacatatatctacaaaaaactggtccatgaatgttcatagcagcattgctcataatagacaaaaatgaaaacaacctaaatgtctatcaactaaggaatgaataaataaaatgtggtacattcatacagtgaatattatttaaccataaaaaacgaaatattggcatatactacaacctgagtgaaccttgaaaatgttctcagtgtaagaagccagaaacaaaaaaaacacatactatatgattcaatttatataagatgtccacaataagcaactttatagaaacagaaaatagattactgggtgcttagcgccagtggggaggaatggaatatagatgtgatagctaaagtgtatgggtgtgtttttgtgtgtgtgatagaacacaacataatataaaattcatcattttaaaattcacaatttaatggcattcagtacattcagaattcatacaaccaccaccactttatagtaccagaacattttcatcactctaaaaggaaacgttgtacccatcaagcagtctggggcttctttataagataatgaaaatattataaaattgaccatagtgatagtttcacatctgtgaatattctagaaaacaaagaattgtatacttttaatggatagattatgtggcatatacattttatctcaataaagctgtttttcttaaaaaaaaaaaaacccttgaaattaattgcctgacacagaacagattttcagaaataaataatggatatattacaaatgattctaaagtattaattgccatttgtactttgaagtttgtaattagtaacactttattaggcaattttaatttaatatttatttgaaatcaatacaactgaattcattttaaattgttatagaagatacatatttaggattactgtcaacgtatctgtgtataaaagaccttaagggtcacttttcattctacagaacaagaaactggtcccaaaatggatatgtgataggtacactagtatatagttagtagcagaagttccatcaccaaaaagctcagagatatgttttgtgatcaaaggtactaattatatgagcctaaggtaataatctccctttttgtatgtgtgactgcatgtaacttttaaaataaacagctttatcagagtataattgacatataataaatcacacaatttaaagtatgcaatttgtaagggcggattgatatatgtgtacacctgtgaaaccatcacccacaatgaagataacatattaatcacccccatgtttcctggtgcccctttgaaatccctccctcccgcccttctccaacaacagggatcttctatcactataaatcagtctgccttgtctagaattttatataagcagaatcatacaataggcacttgttttgctctggattatttcatgtagcacaattattttgagatttctcccatcttgttatatgtgtcaatagttcataccatttttattgccaaatagtattccattacgtgattatacaaaaattactcttctattcacctgttgatggacgacatttgggttgtttccagttaggactattatgaagaaatctgctaggaacattcatatacatatctttgtatgcacatatattttcttttctcttgcctgaatagctagacatggtgtgcttgaattatatagtagacataaatttaatttttagtttattctttaaataaaatttaaatcatttttaaacaaacttttttagaataatttttgatttataggaaaatcatgaggatagtatatagagttcctatataccccataccccgtttccccaattatcgacatcttaggttcttatggtacctttgtaccataagaatactgctcatgtctaggtattcaggcaagagaaaaggaaatatatgtgcatacaaagacatgtatatgaatggtcatagcagctttcttcataatcgtccaaactggaaacaatccaatgtccatcaacaggtgaatagatgagcaaattgttgtatagtcatataatggaatatacttggcaataaaaaaggaatgggccaggagcggtggctcatgactgtaatcctagcactttgggaggccgaggtgggtggatcacctgaggtcaggagttcaaggccagcctggccaacatggtgaaaccccgtctctactgaaaatacaaaaattagctgggcatggtggcaggcacctgtaatcccagctactcgggaggctaagacgggagaattgcttgaacccgggaggcaggggttgcagtaagctgagatcatgctattgcactatagcccgggtgacaagagtgaaactccatctcaaaaaaaaaaatcaaaattaatacattgttattaactaaagacatttctttacacacctttctttagtttttgcgtactatcccttttgttctgcaggattatttaactttttaagaatctgcctaactgtattccaaactggttataattttacaaaagaaaagtgaggcactgctactctctccagcagcaaatgattagagttggtgggagacaaaacatatatacatgagttggataaatcctgaacaagccaccatattaggggccaaatgagtcaaccagctaggaaatgctataggaagacaacctttcaggacttgcaaaatgacattgtttaactgattttgttacatcctgtttctccaccaaatcccccagtaaaataactatattagcagtgacggaaagttccaggaaatttattttgaaaatttcacaagaccctactagctaactaaagtcaccttcatagaagtgccaacaaaaaggcagaaattcccagcctgggactacaggcacataccaccatgcctggctaagatacagtcactcattttgtaatatagtcaggagttgcctaatgatggggatacgttctatgtaatacattattaggtgatttcattattgtgcaaacatcatcgagtgtacatatacaaacctagattatagcctactacacacctaatctatatggtatagcctattgctcctaggctacaaacctgtacagcatattattgtactgaatactgtaggcaactgtaacaccatggtaatatttgtgtatgtaaatatatctaaacaaaggaaaggtacagtaaaatacagtgttataatcttatggggctacctttgtatatgcaatatatcattgactaaaatgtcatcattccacttcatatgtcttgtgtgatccatgatctatttggaagcttgtgtggtttctataattctttcagtctagagccatttatgctaatacaggaactaattaaccatgtcttctagcctccaaagtccttgaaacaaagcatacaagattttatacagcacagcaaattggaacaaatccagcattttaatagaaaaaaattgctaatcatactatttaggtgaaccaagagaagattcacattttttcataacccatatattttctccataaggaagagttctgacggcagaatactgagaatttttaattaggggattcctctcaaaggcatttctagaaacaaaatttatttctggatgcatggcccttattcagtgctctctctgtctgtacaggacattgttaaaaaataccttagactggggtaatttataaacaacagaaatgtattagtcaaagttctggaggctgggaagtcaagatcaagatgcctgtagatccagtgtctggaaagggcctgtgatggctggggtagccctgaaaatctctagaattccttcttctatcgtcctaatgaataccctctggcttccttatatctatactaatcttatcaaacgttttcttggccacactcttggtgttccctatttaacacactctttcattctttgcaacatggctgggctgagaatgtcccaaatctttaaattctgcttcccttttgattataaattttatctttaattcattttcttctctcattttaccataggcaatccagagaagccatgccacaccctcagtactttgcttagcaatttctttcactaaatatcctattgcaccattcacacgttctaccttccacaaagcactaggacatgaagaaaattcagccaagttctttgccactttataacgaggatggccttcacttcagttttcaataacgtgtttctcatgtaagtctgagcccacataaaaatggcctttactgtccatatttctatcaatattctgatcatgaccacttaagtaatcgctgagaagattgaagcttcctctacagttctcctcttctattgaaccctcaccagaattgctccttacagttagttcatgttgatataggctttttctagcctgctcctccaaattattccagcctctgttcattacaaagttccaaagccattccacattttttggtattttttttaaccagagcaccccactgtcagcaccaatttttgtcttagtccatttgggattctataacaagataccttaaatgggtaatttaaaaacaacaaaaatttatagcccacagttctcaaggctgggaagtccaagatcaatgtgctggcagattaagtgtctggtgagggcctgttcctcgtggatggaaccttctgtgtgtcctcacatggcaacaagggcaagggaactcattcatgcttcttttataagggcactaatcccattcatgagtggggagccttcatgatttaatcacttctcaaaggccccacctcttaatactatcacgatggatattaggtgacagcatatgatttttgggagaccacaaacatttagaccatagcaagggcattgctttgggcccatttaaaaattgaatcatagctcttgtgttgtgcacacatttcaaaattgcattgtgtaatataaccaagcagtgaggatgtaaataaatagctctcaggcagttgacttgtggagaagcttccccagaagcactgggtctggcaggagaactagcccctctgcctaggttctcaatttcctgtgcagcagcttgatcctagaaatgtgtgttacaactttttatttcttagtttgccacagaggaatagaggacttaaaacaatacctagtaaaaaaaagcttagatatttactgagagcttgatgagataatgtcacttggacttcagtaagtataacatctgtactcagcatttcccctgctgcttgaatagcattttagatcaaatcctgtctaacattttggagttctcatttgtttgctctctgggtcagtttcaccactgtggtcccgagcctctcctgattttcagcccattgccaaagcacttagaccccactttgggcatacagattcccctttatctccctttaagcagagattggcacagttctcccatgcctctgatgttgctaagagactaagccacaaggaaatctgaacccaaatgtggtaaccattcacaactgctaatctatcccacacaactgcatcacaaccctttcactaactccagaagatataatttatagagatggtaaaataattttatgtgtgcagtaacataagatgtaattgtacaagtttggttatttatttctacaattttaaaatcattccaacaatctgctctctgccaagctctaccatgtttattcagagaagtcaaataattatttcgaggaaacctagtaggaatcataaggggaagacttcttactttctgtccttctgttaaagcttaatgggaactgctgcaaaggaggatcagagagtacccgcacaatgtcctttggggataatgattctaggaaggccacctcagtcctgtaccactacagaacttccttctaatcaatcttacaagaggcttgagaattttgttttaaggaatttgctagtgaggtatgtattctacatagctaatttaaaaagtcagaaaaattgaaccagtcctattaaataagaaataatagtattatagattgcctacagggttacgcattgcatctgattgtcaaaaaagactccacgaatttcaagacaattgctttgtcccaacagagagtcattttcaattataaatctcactttacaaatcgccctatcaatacctaatgttttcttcctcaggcaatactataaaacagtttaccaaatcttttctaagtcttgacctgaaaaacatattcaatttatcttaaggttttcagaaaagcttactaaaatgcaaataattttatttaccttcagttcctgaaaggctgtgagctgaatatggtctttgctggtttgttttagttttggtttcttcactgctgctttttaccactttctggtcttcggtttcattcctttaccttaacatcctctccttgcatgactgaaatgctctaataaagagggaaggtgatataagcatgaaaatttttattcttaaaataaggtgagtctatcttaaagaccaaaactaacctaataatgacccactctttttaaaaagcaatatggagctgtgaatatgttgtttgtccctaaaatacagaggaaataattggactcccaggcagtcctagggaaaatgatgagatgtattttggcaacttctcacacaatttttaatgtcttgaaggaccccacatgtccttggttttcccaaagttgagcttcaaaaaagtattttcctttcttctactctcagctcatcctactggaagaagaaatacagatcaatcactttgctttaatttaaataggtttcaaatctcatcacacctgtatgtgaatgtacacattataaacagcatagttttacctagggccgtccttaatttctagttaactaaaggtacatttttgaaggagtggtgaatactattgatgattccagggttggtcttatccttgatctatgcataaaatactaaaagcctacctaaaacatgtttgttgtttctcttcatttattgagcagattttagatgctcagtctcaactatgttgtgttgggttgtaagctactctagacaaaaacctataattagtaaataataataataataattccagttcatccttttatagtacactgcatattgcaaaagcatttcacatcttaaaacatattggatactcataataaccatctgagataaatactattagctttattttgcagataaagaaactgaagtttagagactgaggaagagctgctgccctttagtgattgagggttcctatagggctagactgaattcatcaaagctagcaagaatcctcaattgtccagaatgttttgttgtactccagatttagactataaaaagtcaaaatctgtcggggactgaaagagtgaaaatcagtgtggactgagaataagcagccctgctattaatcaggctgggaggacagacagataaagccagctgcaaagttagcagaaaacactgtttctcccaaggtcatgcagcagttgtaaaatgccataatgaccccctcctcctttgagtgactactgctttcttaccagtgatgccccaaacctgctttgctgcttacattaactaccagggatacccaactgctaagctatccttgccccataagagaacccagtccctagttaacccccattttttccaatcctgcctcagaaactccaaccaatccaggatttacccctgcttccctaaaacctcatcagaatctttcactgtaaatgtaaacattacaaaactttcttccttccttcaatcaaggattaatccatagttcctctagaatgcccctccctcaatgcattgagccaataaatctgattttgtcagactctgggcatgatgctggacttggagtaataatgctttaatggggaggggggagcaaataacaccaagaaagagatcttgtttaattgaacattttaatttttttaaacatacctcccatccttaattttatcaatcatcattcctggacaatgattactcatactcaggataatgacccagaaactctgcaagacacctagccatcaaaggaggactcagaatacttcaagggaccatttacgatgaatgaaaattggtcttagaaattttataattatttacctcaattaagaaaccaacaggactttctatttaaatttcaggtgaacagaaaattcagttagccagaatttccatccctgagcaattccactaaccaagatttcactaaaatttcattgcatttgtgttcttatctgaatgttatgttatcattcccttcagcattgcttattttagtttatgatctttaggacagcagggagcacctacatgtaaatattagtacaatgtctggtagagcagattgctgtttacaaataagtactttttgataatgaggacagcagaagtgctagtagtgatattgatgatatgggcagatattgaagagtataaactctctggtggcagttcaacatctttataaaaaattcaaagtagcatgtcccctggaagaaactggaaagtaatttggaatctgcctgctaataaagtatttacttgtttactttctccttttattgccttagttaaatttattagaggaagtcaataatgagaaataatgcacagtagtttgagacggtatttgtttattaatacttcccagcttaccacattgccaggcatatataacttttaaaacatctgtttaatggcattgaattgtactaaaatgtgttaatatagtgtcttgctagcattacacacacactgtaatttttagagcagatttaagttcacaacaaaattgagtggaaagtacagagttcccacattacccacaagactccccccactatcaatatccagcaccacagtggtgcatttgttgtaatccatgaacctatattgacacatcctgatcacccaacgtctatagtttacatttagatttcactcctaatgttgtaccatctatgggtttcaacagatgtatgatgacatgtatccaccattacagtatcatacagatgagtttcactgccctaaaaatcttctgtgttccactttatttatctctccctctcccagaactcctggcaactccttatctttttactgtctccgaaatgttgccttctccgaaatttcaatagttgaaaccacacagtacatagccttttcagagtggcttctttcacttagtaatatgcatttaaggttcctacatgtcttttcatgacaaaatactttaaaaaatgcattcatttattcaatgtgcctttactgagttttcttaatgctaccagcaccatgctagttgctagtggtacaaaaattaaagctacagcacaccataaacaagtagttccagtaaaacaccttttgaagaggcaaagaagatttatttatttaataagctttatttttcacaaatagctttagggttacaaagaagttaacagataagaggatacatttttttttgaagagttgagcagaaagtacagagaactctcatatagcccctttgcctctcccagtttcccattttgttaatgtcttgacttagtgtggcacatttattacaattaatgaaacactatacattattgttaaagtccatggttgacagtagagttcattctttgtgttatacagttctatggtttttgacaaatgtaaaatatcatggatccaccattactgtatcatacagaatagtttcactgtcctaaatatcccagagctttgtctattcatctctccctttctcctcaaaaactcttggtaaccaatgatctttttttagtctttatagtctttatagttttgccttttccaaaatgtcatacgtttggaatcctacagtatgtagccttttcagactgacttctttcacttagtatatgcatttaaggtttttccatgtagttctgtggcttgatggttaatttctttttatcaatgaataatattttattgtctggatgtaccacaattgtttacccatttacctattgattgacatattggttatttccaagttttggcaattatgaatgaagctgctataaacacttgtgcaagttttcgtgtagctataaaaagtatgattaatgcatcatactgtaagacaatgtttagctttttaagtaactgccaaaatatctttcaaagtggctgtaccattttgcattcccaccagcaatggatgataatttctattgcttcacatccttgccaaaatttgatgttgtcagtaatactgggtttcagtcattctaataggtgtgtagtgtatgtcattgtctaaatttaaaattccctaatgacatatgacattgagcatatattcagatgcttatttgttatctgtgtatcttctttgattaggtgtctgttcagaacttttgcccatttttaaattaggttgttagtttttttatggttgagttttaagaggtttttgtgaattccatgtagaagtttcttaatctgtatatgttttgcatatattttctcccattttatggcttagctatttattctttcaactgtttttcacaaaacagatgtttatgattttaataaagtccaacttatcaattgtttttttcatggactacatttttgtcgttgtgtctaaaattttatcagcaaacacacaaatgagaaagagaaagaacacaaatattaccagtacagaaaacagaaaaccaccaaaccacaatataaaaaagcaagagacgaaggaaggaaggaaagaaggaaggaaggaaggaaggaaggaaggaaggaaggaaggaaggagggagggagggagggaaggaaggaaggaaggaaggaaataatacaaaacaaccagaaagtaattacaagatgacaggaataagtccttacatattaataataaccttgaatgtaaacaaattaaatatcccacttaaaagatatagattggctgaatgaattttaaaagtaacctaaatatattctgcctaaaagaaacacatttcacctgtagagacacatatagactaaaagtaaagggatggaaaaaatattccatggaaaaggaaatgaacagtaagcaaaagtggctacatgtatatcagataaaacagactttaagtcaaaaacagtaaaaagagacaaagaaggtcattatataatgataaagtgatcaatttggtaagggatatagcaatggcaaatatttgtgcacctaacacaggagcacccagatatataaagcaaatatttttagatctaaaaggagagatagacatcaataaaataatatctggggacttcagcactccactctcaaaaataaataaattatctagacagaaaacaacaaagaaacattagatttaaactgcaccttagacctagtggatctaatagacaattgcagaatgtttcatccagcagctgcagaatatacattcttctcatcagcacatcaacattctcaagaatagaccatatgttaggacacaaaacaagtctcaacaaattttttaaaattgaaatcatatcaagtatcttctcagaccacaatggactaaaactagaaatcaataacaagaggagctttgaaatctgtaggaatacatggaaattaatcaacatgtccctgcacaacgactgagtcaatgaagaaattaagaaataaatttaaaaagtcgagaaacaaatgaaaatggaaacaaaacataccaaaacctgtgggatacagcaaaagcattacttgtttataggtataaatttgtagtaaatacagttaaaagtttatgcttacatcaaaaagtagaaagatttgaaacaaaccacctaacaatgcacctcaaggaactggaaaagcaagaacaagccaaaccccaaattagtagaatgaaagagtagagatcagagtagaactaaacaaaatagacactcaaaaactacaaaggatcaacaaaatgaaaagttattttgaaaaaataaacaaatttgataaaccactagctagactaaccaagaataaaagaaagaatacccaaataaacaaaattagaaatgaaaaaggacacattacaactgataccacagaaatacaaaagattatcagaaactactatgaacaactatgtactaatgaacccgaaaacctaggggaaatggataaactcatggataaatataacctaccacgattgaataaaaaagaaagtgaacccgaacagaccaatagcaagtaatgagattgaatcagtaacgtctcccaacaaagaaaacagtataaagacttcttaaaaaaacaaaaagagaagtaccatatgatccatcaatcccactactgggtatttatctaaagaaaatgaaattagtatctcaaaggcatacctgaacccccatgtttattgaagcactattgacaatagcaataatatggaatcaacctaagtgtccatcaatgggtgaatggataaagaaaatgtagtatatttgcacagtggaatcctattctgccataaaaagaatgaaattatgtcatttgcagcaacatggatggaactcgaagtcattatgttaagtgaaataagccctgtactcacttatatgtaggaagtaaaaaaaattgatttcatgaaggtagagattagaatgatgattaccagagcctgggaaggatgtgagtgtggggcttgggggaggaagagaggttggttaatggaaacaaacatatagttagatagaaggaataagttctgatgttcagtagtagagaagggtgactgtagttaacaacaatgaattatatgtttcaaaatagctgaaagtgaggacttgaaatattctcaacacactgaaatgataaatgctcaaggtgatggatatcctaaataccctcagttgattattgcacattctgtatatgtaacaaaatattaaatgtacaacataaattaaaaatattacgtattaatagaaaataaagtgatattgatatagctggttaaacatctactatatttataacagtttttttattcattgctcttattatttgtttccttttttgttctccatgctttttctgccttctctggttttaattgagcattttatattattctattttttcttctctcttagcatgttatatggtttgcttctttgtactcaccaaatctcatgtggaattgtaatccccattgttggaggtggggctggtgggaggtgattggatcatgggagtggtccttcatgaatggcttagcaccatccctttggtgctgttctcatgatagtgagtgagttattgtgagatctggttgtttaaagtgtgtagtgtgcacctccccacccctctcttcctcctactcctgctatgtgaggatgccttgctctgtgtttgccattccctgtgagtaaaagctgcctgagggctccccagaagcagatgcttctgtacagcctgtggaacggtgagccaataaaacttttcttattaattttacccagtctctgatatttctttataacaatgtgagaatgaactcaaacagcatatcaattatattttcaaatttttaattgtatctctagagtttgcaaaatacatttctaactaatctaagtccacttccaaataacaccataccatgtcacaagtagtgctggtgcatgataatggagtatttccaattccaccattttttaacatttctgtcattaatttgcctatttataagctataattaccaaatacatgattgctattattttgaacaaactgttgcctgttagatacggaataagaataataaaataaaatattttattttgatttatccctgctctaacactattctttatgtggatccaaatttctgatatatatcactttcattttctctgaaaatcttttaacagtttttccaacacaggttgactggtgacaaattccctgttttagtttgtctgagaaagtctttatttatccatcacttttgaaggataatttaactgaatatcacattctaggtttgtaattgttttatttcaacactttaaatatttcaccccactctcttcttgcttgcatgatttttacagagaagtctgatgaatttcctattcttgtttatctataggtgtggtgggtatttctttttacccctctggcttctttcaagattttgtctttaattttatgcagttagaaaatgatatgcctaggtgtaggttttttggtatttattctgctttgtgttcttggagcttccttgatttgtagtttggtgtctgttaataattttagaaaattttccaagcttattaattaaatatttctactgttcctttcttctatttctggtatttattatatgcatattacttctttcgtaattgttcctaaactcttggacattttttacattattttttgtccttttttctctttgaatttcagtttaggaggtttctattgacatatcttcaaatgcattgattctttcgttggctgtcaacatattttgatttctagagtttccttttgatttttttcttagagtttccatctctggttaccttactaatttgttgatatatgttgtccactattttcattggagcccttaatatattaatcatagttatcttatatttccagtttggtaatttcaaaatctctgccatatctgagtctggttctgaatgtttgctttgtctcttcaaactgtggggattttttgttttgttttgctttgctttgatttttaatatgccttgttacttttttgttgaaagccagatatgatgtattgggtaaaagtaactgaagtaaataggcttttaatgtgagattttatgtttatctgactaaaagttagactgtgtttactctttggtatagctataggtgtcagaggctgaaattccctctagtgtttttgttcttgtctccactgtcttgtttgaattttcctcgagattacttcttaaatagggcctgagctttgcaggttttttttttgcaaataaaatcccttattattatacaggagcctgattgatgttgtggaacatatttcaaaattctatgatgtcactgcctttagtgagcttgtgcccctggtatgttaccttcataagtgtttcttagcttcccccatccctttaggtgagaggaaagctagagtagtcatttcccttctcccaggtgggctaggctttggtaaaacctaagtagtttaggtcatgataaagtggtttcccttgagagcaagcttttaaaaaaagaaaagaaaagaaacaggatcttgctctgtcacccaggctggtatacagtggcacaatcatagctcactgcaaactctaactccaaggttcaagtgattctcccacctcagcctcactgggaatacaggtgcacaccatcaagcctggctaattttttaaaattattatttgtagatatggggtcttgctatgtttcccaggctggtcttgaactcctggcctcaagtgatcctctagccttggctcccaaggctagaattataggcatgaaccactacactgagtcaacaagcatttttaaaaggaggacaaagtgctctgggctcattttaaaatggtcacttttccctttccccctgccagaagcataagggaacctttttccaatcttcacagtaagaacttagtagcgcttatgtaggcaaaactcacaaaattgtggggtccccctaaatataggtctcatggtgtttttaactctcaagatagttcatggtgggtctccaggaatttatctattacattataagtgtttgtggtggtactggctttgctcctggggatctcattccagtatgctgtgattctctgcatttgcctttctctcaactttctggggcagaagtttgccctgtgacttgttatttgagggatttaagaaaagttgataattttcagtttgttcacttttttctttttgtgagaatgagaggaacaatttccaaactctttatagtattaatttgtactaatagtaccaatctaaataaaattttggaatatagtgatgtctgtcacctgaactggttactttctattgtatcagtgttcactgctactataacttgcctttaatgttaatatttagacccctctggttactacccctccctcacttgccatggatgcatgcatatgtgcaaactcatcaaattgtatatattaaataagtgagtttttttgtatatctattgtttcaataatcagtttaaaatgtatgtggttcttaccctcccacataatatcaatacttggaatgagatacttctaaggtcatatgaaatatatcccaggattcctcccttataacctcgactctgaaaccagtctctttaatacctctctttcacacattctgcaaaaacctactcttgtcttctattctggaaaaccctcccttcttttcatttagtgagaattttcttaagcattttttggataacttagtcaacagacatactgttgtaagcatgagtgtaccaccctgctttgccttattctttctgtaattttctgcaactgtgtacatcgtgtctcctcatttaaattttaaagtttaatggaagaagggaccacatcttttaatgtttctatttcttgtatgccaaatatatagcccagagccaggcacttactaaatattggaaaagaatcatttatggattgttatactcttcacggaattagaaaaaactatttaaaaatgtatatggaatcaaaaaagagcccgaatagccaaggcaatcctaagcaaaaagaacaaagcctgagacatcacattacctgacttcaaactatactacaagaatatagtagccaaaatagcatggtactggtacaaaaacagacacatagaccaatggaacataataagcaatgccaccaatcaacaaccatctgatctttgacaaagttgacaaaagcaagcaatgaggaaaggactccctattaaataaatggtgctgggattattgggtagccatacacggaagattgaaactggactccttacaccatatacaaagatcaactcaagatgaattaaatacttaagtgtaaaaccaaaaactataaaaatcctgaaagacaacctaggaaatagcattatagacatagaatctggcaaggatttcatgacaaagatgccaaaagcaattgcaacaaaaacagaattcgaaaaatgggactaattcaatgaaggagcttctgcacagaaaaaaaaaaaactatcaacagagtaaacagacaacctacagaatgggagaaaatatttgcaaactatatatctgacaaaggactaatatccagaatccataaggaacttaaaaaaattaaaaacaaaaaaaaaactccataaaaaagtgggcaaagaacatgaacagacacttttccaaagaagacatacatgcagccaaacaagcatatgtaaaaatgctcaacatcactaagcattagagaaatgataatcaaaaccacaacaagataccatctcacaccattcagaatggccattattaaaaagtcaaaaaatagcagatgttggtgaggttgcagagaaaggagagtgcttgtacactgctggtgggaatgtaaattagttcagtcattgtggaaagcagtttggcaatttctcaaacaacttaaaagagaattatcgttcaactcagtaatctcattattggattattgggtatatacccaagggaatataaattgttctaccataaagatgcatgcatggctatgttcaccacagcaatattcacaatagcaaagacatggaatcaacttaaatgcccatcagtggtagactggataaagaaaatgtgctacatatacaccatggaatagtacacagcaataaaaaaagaatgagatcatgttctttgcagcaacatggatggagctggaagccattatcctaagtgaactaacacaggaacagaaaaccaaataccacatgttctcacttataagtgggagctaaatattgagtacatttgaacacaaagaaggaaacaacaaacaccagggcctacttgagagtcttggagggtggcaggagggtactatgcttattacctaggtaataaaataatctgtacaccaaacccctgtgacaggcaatttataaaacaaacctgcacatgtacccctgaacctaaaattaaaattaaaaataatatatttgctagaaaattatgactgctctgttgagtgatttgtagtcataaacaccattttgatctttaattccaaaaaacacaagtcacctatgtttttcaggagctgataattaagacacctcatatatattaatagatgaaccaaggatcatttttcaaatcctctctccagattctttctgcagcctgtgaagagctgtttttggaaactgcattagaagaaggaaaggcttggtttggaagaacaggatcagctttccaccctgtgcctggcagaggctatggctgccctccatgtgaagcttcaaattaaaatgaagttgtggtgcctacgcagcttctggaactacagggggttcttccacagcaggttacacagagctaaaataattgagtgtggtgttgtttaccaacatcagggagaaaaacagcaaaagtcaatataaaccatgaaagtagtaaattcccaattttgtcttggttaggtacatgttgggagagaagagaaaaagagaaactacaactttagtcaggaaaaataaaaacaatttatagaaaaactaaccataagatgtggtctcccaaatgcagttaagaaaattcttatacttgtctggttctgtgatggtacataaatgtaaagggcttgagattttagtatgagagactcagattttagaaactccattccaccaacccaactttaagcccttcctgctctcaaatgggaagcagaagaggttaagccaagccaatcttaaatgtcagtaaatgtaaatacaaatatttttggagtagctaaaatacaatctaccttcagataatgaaatgtttgtgtttaataacatacctttacatatgcatagtgctgtttacttttcaaatcactttaacccattttacccttacaacaaagttaaagtgcgtatggtagttattttacagtttcaggatgagttaaattaaggcaccattgagttaatgatttgtaaagaccaagctggagcttgttgtaattgggaggcgggtacttagagcccagtttttttctaagcagtcatgtttccaattttatgctgagtgccagtaagtcatagggatattccctgcatttataaccaggtgtccaaaaagaagatgagaattacttctgcttctccaatttcccatctaaaatatttcatgattgaaaaatatatgtatttaagaacctactccagagctaaactgcagggttgtcaccatgtagacccatgatttgctccttctttggccaaaggcaagagaaagaaaagagaagttgacagggtacccattttcatctcacccagaaggtagctggtcgttgttgacagtataactctccaaagaaacaggaggcgcactcttcaggaaataacccaagcaattcagcccctctgcaaagaacatctgttcctggccatacaagatcctttgcagctttaaaaaaagcaaggctaggagaaaatgttgcagagggcttctcctgtgagggcagaaagcagagggacagatggggagcagtgtctggagaaatcagggtcatgggggtgttagcatttttgggggattagggctcagagcacattactgcattggacaaaagccaggagaaaagcagagagcaggcttctcactaatgtatggagatagaaggccactaaaaatcttcaatttgcttctcataaggcaaccatattcaaggcccccttctttacacctttacctcactactgtcaaaactctaacctctaccacaaaacctatactcctacagattttttcccttaatgccatgatgcaaaaatccaattagtttccatgatcttagtttagagcttggaacccagtgtttcctccttttcaccatacaagccatgctgactttatttatcaaagcctagtggcatgttaatatttctttttttttaatgccagaaatgttttacgatttatttatttatttattatactttaagttttagggtacatgtgcacattgtgcaggttagttatatatgtatacatgtgccatgctggtgcgctgcacccactaactcgtcatctagcattaggtatatcgcccaatgctatccctcccccctccccccaccccacaacagtccccagagtgtgatattccccttcctgtgtccatgtgatctcattgttcaattcccacctatgagtgagaatatgcggtgtttggttttttgttcttgcaatagtttactgagaatgatgatttccaatttcatccatgtccctgcaaaggacgtgaactcatcattttttatggctgcatagtattccatggtgtatatgtgccacattttcttaatccagtctatcattgttggacatttgggttggttccaagtctttgctattgtgaataatgctgcagtaaacatacgtgtgcatgtggctttatagcagcatgatttatagtcctttgggtatatacccagtaatgggatggctgtgtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgggcagtttttcatgtgttttagctagcagaaggcaagaaataactaaaatcagagcagaactgaaggaaatagagacacaaaaaacccttcaaaaaattaatgaatccaggagctggtttttttgaaaggatcaacaaaattgatagaccgctagcaagactaataaagaaaaaaagagagaagaatcaaatagacgcaataatatttctttttgccaagtgaattattcacttcttttcttttccatcttatcttcatgtcaagagccactttttgtgttttcttgtagaaggtcccacccacacatacacccagccaggattctccacgcccatcatcagagacctgtgtgagctgtgtgaccatctgtagtcttggcatggctgctttctccccaaatcaagccaattcagccaagaataccgtctttatttcaggcttctcaaagagcatcttggagaaaaagaagttgaattggcactcatctttgactcagttgtggaagctgacctggcgaattatacctgccatgttgaaaaccgaaatggacggaaacatgccagtgttttgctgcgtaaaaagggtatttatttttataactataactatggtttgcttagctatcaacaactattgaagttagagatatttcctggctttattttatcatgtagtgtaaacctttattaaccattttgtcttttcaaggaaagatatttctcttgctctgcatattagcataaaatacctatgatcttcaataccattaggaagtggataaatgaaatgaagtattgtcatatgttaaatccagtgatataaattgtaccttagttataagtgttacataaaatttgatatatatttgacattcaatattttctccacattttgccttcttatatcttatattgcttaaatgaaatgcaagagattttattattggatgagaaacacagttgcttttttattccctgactaaaaaataaaaaaataataatcccatataatatgcttacaattgttatcataaaaattataaaccatattttatgatatgacttggtattaagagatctttatcaggtgcatatatttctaaatattttggcatccctttctcaagttggttccagacggggtggaaattgtatataatgaacaaagaaaagaaactctaaatttacatataaaggagataaaaaacagatatacgaacaacaaacaatctcagcagctagagtagcttctgaattggctcttaccttgctatggcttttgattgctacaaaagggtaaatactttttgtatatgtacatccggcaaaggctttgcaaatgtagcagaacaaatgttctcaatcagtgttcttgttgcccacgttttagagcaataatagaacagattcaatcagcaaggtcacttagttgtacttcctggccaggatggaatttatattttccagccagccctaatacttgacaatgacaagcagctcttgaagaagcagagaggaatcattattctgaaaataaggcgtttatatctctagcaccacttcgtactccattagacttgattttatcttaaaataaaggcatatttaagtgtaaagaagtctaaaagagaaagtaaagtcagaagacccagattcaggagatcctggttcagtaggactgacttgtcttattagactccctaaaccttagttttcttatctttaaaataggattaataatacctaccttgcagagtcactttgaggttcaaataataatgatataatgggtgtgaaatatgccatgaccaaacagtctttattattatactgaacttggataatttatcctaggtaaccacttaggaaccacatgaagggcaggtattgatcatgcccaaacaccttgtggcaaggatcactttgtttctgttcatctcagtcttatttcgggcttagagatcctccaatcagagcctgctgctatacctctgtatcctcagagatatcaacttgagcagtgtctagctagtaataagcacttagaacccattctggtcaaataaatggctaattttttcttttattaatgaagacttagctatagccagcactatgataggtgctggggaatagaatgctgaataagatagacatacccaggtcttcttggagcttatactctttggaggagtgagaatgcaaagaaagaccaagattaaacattttttaaaattccgcaaaagatacatagtgttataattaaaaacctgctatgaggaaaaataatggggggtgtcttatcaatcagcccatgtggacagaaataaccttatttgagttttaaaataaatccatttctctttaataagtaaagcaacacaaggcagcccctaaaaatttctaaaaatttgacactacaaaccaagacacactgtaatactctgctaccacccaaggcttctacaagaaaactggtctaagtcatgttaactgacaatgttaattctcatcttccaaatatttaaatattggagttccccagggttcaggtcccctcttctcactcattcagtaggtgatttcattctatctccatctcatggttttgcttaccacttatatgctaactactcccaaatttatatctagcctggacttctcacctgtatactcaattgcctactaaacaactcttcttagagatctagcaggcatatcaaatttagcttgtcccaaacaggattcctaatttctcctgcctacaaacctgatcctccagtccccttctccatctccatcaccattgttctagttgctcatgccaaaatctttggagtcattcttcactttctcttttttctactcacatcctatatctactccactagcaaatcccatggcttaactttcaaagcctatttagactctgaacacttttcccaccttcactacccacatcctcttctgagccaccagcaccaattacctggatcatggtaacagcctaactggtctccctgcttccacccttttcctctcacagtctattcttatcacaacagtcagaaggatcatttaaatatgtaagtaaggtcatgttattcccctgatcagaaccctccattcacagttccttccctttccactaagaatgaaatcccaaaactttatcatgtcctataaggcactacacaatctgttcttacatctgatctcattttctaccacaattttcctcatacattataacactagcctgctttctgtttctcatgttcaccaaacacagtcctgcctcaggtcctttgcacttgctgtttcatctgtctggaacactcttgcctccagctgtctccatgactccctccttcccttcatacagatttctacttaaatgttaccttcttcataggtattttctgtccatcctatataaaatgatattacctttcattttctttttcttctaacctgtctctacttatttttgctttgtctattactattggatattatattacatatttgtttgcttcttgttttcttcccccccactaaaatatggaatactggagaacaggaacttttcttgctgtatttactgctgtatctctagtgcataaaacataataagtgctcaaaactatttcttgaatgaaaattctcctcatagaggacaagcacaatcaggtgagcaatagataacagggattgataaaaagaagatttgatctgtgattttgtcatgactaatgtcttccctgaattagctaaatgcattttttcttttcaagtattgtttactttccagggttcgcaaactcaaaagacctcaggtcccaggaaaatactgaattttttaagaagagggctggatattagacaaaatcaaaacatagaccagagaaaacatgccttgctttaaaagggcaacaactactttgttctataagattactgctgtttttgctggaatatatgcccagggatatgagagctttgaagttttcaagtgaagctgaaagactggatatgatgtcttttaatttttaaatattagtattcatttttgaaacattgtgtgatccaacaaaaccaattttttggcccatagtataccagtttgtactctccgttctaggtagcagttaaatgatttcattgtgctttacaaaagtatgcagttaatcttccctcacttggtctccttaggagcttctgacaatatagtggaagcccaagaaagagcaagaatccttatggaactgtcataatttttttaagtcagaacaagctctggcttgttttgagaaacttaagatatttcctttggagttggaccttttaagctttatcacatcatagcctggcctcattggcagtagtattcctacttggaatactagtatggcttgttttatggaacaataacttcttgatgagctgtaagtcaaatatttaaaatgccttaagtgatcatcatggagaagaaacatgatgcatcctttcattaagtgaaaagggctattgtaaaatgaaaactcacatctaatatatccaattaacaggatcaagttttgtaacctatccatcttcttacctatctgtcttctgtctgcacctaccacttccttattctcaggtgaacaatttgccagtaagtgcaactagcatttcagtaagaagttcatcctaaattttttctttggtgagccaagagtctgaacttaggttcaagaaattctgataattatttctgtttctctgcacatacttcctttctcataaaacaggggcatatcattgaatctctctctcttcattctcagtgctgctgcttcactctgtcccaccatacctgaatagaaaactttctaagcctactcaggatgctataacaaaacaccttagactgggtaatttttaaacattacaaatttagtgctcacaatcctagaggccgggatgtccaagatcaaggcaccagcagattcatgtctggtaggggcctgttcctcatttttgtctgagatatcagaatggccttcaccattcatatttctactaatattctgatcacgactatttaggcaatctctaagatgactgaggaattctctacagctctcttcttccaagccctcaccagaattgcccttaaggctcttttcatggcaatatacctcaaatctcttctaccctctatccattacccagttccaaagctggttccacaactttaggtatttgttacagcagcaccccacttctcagtaccaatttctgtcttagtccatttgggctgctataacaagataccttagactggatagtatataaacaacagaaattgattgttcacagttctggaggctaggaagaccaagatcaaggtactaacagatttggtatctggtaaggacccattttgcatagatggcactttctttgtgtcctcacatggcagtagcagcaaacaggtttcctcaggcatctcttataacaggccccatttatgaaagttctaccctcatgatctaatcacctctcacatgcttccctcgttttttattttttatttttttagaaacagggcagggtctcagtctgttgcccaggctgaaatgcagtggctcagtcatagcacactgcagcctcaaactcctgagcccaagtaattctcccacctcagcctccagagtagctgggactacagacacaccaccatgcccgactaattgtttaaattttttgtagagacagggcttcactttgttgacctggttggtcacaaactcctggcttcaagcgaccctcctgccccggcctccccaagtgttgggattacaggcttgagccactgtgtctggccaggcctccctcttatataatcaccttgggggttaggttacaacatatgcattttgaacaaacattcagaccatgacagaagccctcaggtgggatctcctaacctgcttcccaacttgtgagtcagaggagcaagctcaaacattccctgcattccctctctccagtcccttggcttcagttgctatttgtcccattctataatgtctgatctttgtgttcacagtgaagaaataggtgggttcaaactaagaaggtaaaaagagctacacatgtactttgggtgcctagaaaaagttacaagcccataaatatttgctgttcttgctacagctctctttgtgaagcatatacaagacacagcccaactaaaataactttccattttttagtcagtaaatgtccctagaagtatagatcctgctgagattgaaaattgcaattgaaaatagaagacaaaagaaaatccaggtgtcattagggtgatggcaattctgccctctgattataggatagatgtttcccttttgatgtgactgcctgggctgaatcaaagaatctggttgagtctctgggcctaggttcacagttttcaacttgaacagccatcattacataatatctttcaaagacatttttataaaatggaccccaaaatcacaaaggtacttttttcaccatggttttcttccataaatttactgctgaaaaaatatctgctacttgagagcacaaattgttcctgctgctgaagttttccatctacctaatagcaactctactctgtaaataacatagaaattgctgaaaaacttcccattccacgacttttaaaacatttgaaagctcttctgaccagagagagagacagaaagaccaaaaaatttatagcataaagtgaacatcttaaaacaggaaaaaccttttgaatcaagtcaattaatgccccaagatgaaagagaagtcagttttcagagtaacaaagaaaactgtattgctctatttaaaattggcttttaataatgtataattgatggtgtatataagatggtgagaaaacaagtaaaaattgtgatttgcagcccacagagatttcttaagaaagcctgctttatccccaacataggcagaggcagaggaaggtagtggttcctggagagccacgttttacatagagggcaggaagcattgctaattatgtggtgaaattttttttttacctgaaattttgtggcttagttttttaaaagaccacctcctgcagcaggcatgacagacacatattccaatttcctacccctattcattgtgtgtgccctcacaatattccttgttggcatattttgtccttcacagcagccccactctcttcctttttctatccttccccctctctccatactcaaaaagagtgacatttatttgtgtttcttacatttccattctatgactctcctgattggctgttctctctctctctctctctctctctctctctctgtgtgtgtgtatgtgtgtgtgtgtgtgtgtgtgtgtatatatatatatatatatacacacacacacacacatatatacacacatatatacacacatatatatatattcttttttataaaatataaactactaaatggatcttgttatattgagcctggctaatttctcttaagcaataatcctgtatagacataagggacattcctagagaaaggttgacagtctggctttcaagagtgacagactgtcaatggtcagcaatttgattttgacagtgccccagaattgatccatccaggaagactgactgatgccaactaaactcacaaggaactgatgtacaaactagattgtctctctcttttccagtttccagttacatggtaagctgaattagtactaaaatagtcacttggtaattatgtaattacgttaaagggaggttaggtaatcttgtaggtaattttatctaattataatgagaccgataatgtccctgtggaaaatacgtctctggtctgatgtctctcagattcagtatttttcctatggacattgctgaactcacattctagattctcctctgacttcccattttctctaaatttcatgataccataccatcttttgatgatacactctttatatttattaatatcactgattaactacaggttaagtcactgttccctgagcctgggagacattatgtcttcttccattatattttgatttaattgttccaatgctcagagttctagggatgcccccctggagcagcctaagtctgctatcaggtaggctggtgttggctgaagaggccaagtgattagcctggatttctcattctgttttagctccattgggcatattatatcacatatatattattacagtcatttattcaaataagtaggggaaatggataagctaattttacctgcttaccttatattggattatgttctactggggttaaatgaaacagttaaatcctgcaaactcattagattttatttgattctgaaagtaattttatgatgttgttctgcaaaagaatagggcctgtggcctgagaagtactagatggtaatcttgctaaaccaataagataattaaacagaaataagaaaatattggccttggacccagaataaagtagctttaatagttccctgaaatacatttagagcaaaagcatatatgtgacatcttagatgcgttcaaaacgaattgagagcaactattccttttcagatagacttaccacttttaatagtaaattaatcaaattttaaatagtttattttacaaaaatttgattcatacaaatgtatcaagagcaaagctactgcattaagcaagaattttctggaaaggaaaacagaatgttagtacatcttatatactagaaatatgggaagatcccaagtgttgctgatttaattaccttttcctgtttattctgttcgctccagatttaatctataaaattgagcttgcagggggcctgggagcaatcttcctcctccttgtactgctggtggtcatttacaaatgctacaacattgaattgatgctcttctacaggcagcactttggagctgatgaaactaatgatggtaagctgtcttctattgttcaaattccattaaacggcatgcatttgtgattatgtaagagaacttccctatttttagaaagtataagctgaaatatttaggggtaaagggctatggcaagttacttacctttaaatagtttagaagacttaccaagaaaaagagaaaagaggagaatatattgacaataggtaaatctgagtaaatgctatgtatgttttttgaaatggttttatttttataatattcctatacatttgactttatttccaataaaaagtttaacaatgagacattagttgctcaggagataaaacaattgctgtcaaatccctcccccttagtaagaagcaaattaagaatcaattccaatttttttcagaaaatgcaaacttaagtacagatcatttatagccattgctgccatctacaaaacaagcaatcatgcaagaaacagattgaaagctatggagacaatccttttaaagctcaaagtacatgtatctacatattttgaatgcttatagcaccattctcaaaggtgacctgaaagaataaaaattcagagtgtagctcataattttcttatatttgctgtttatgaattttgaaaatcttatgagtgaaatatcgataaagcagtgtactgagctttgtttctttgaacatttaaaatgatttaatttttttcaagagtacaaactgccatgtttccaatcaaaatcaataagaaatcatggcatgtagcttcttatacataaagttctcatcccgaaactgctgtaagccttggaaatgtgtatagaatgccacaggtaagccaaaaattttttagaaagtagtccaatttggaaaacattagtttaaaaagacagacttaaaactgagttttcattgtaccaaaataagtaaggttgaggcttttgtttatttttttgagttggtggtcttacctcaaaaaagagaaattcacagttttgattttaattttatagtgatagatgtaatgtcaaaatttttgaggaatctgattttggtcttattgttactattatgtgaatgatcatatgggtgggttttaattgactttcatattttcatagtaaattacagaaattcttttttttttgttaactgcaaagcaatgtgtgttttttgttttgttttgttttgtctttttttttttttttgagacagagtctcactgtcacccaggctggagtgcagtggtgcaatcctggctcactgcagcctcgaactcctgtactcaagcaatcctcctgcctcagcctcctgagtagctgagattacaggtgcatgccaccatgcctggccaatttattattattattattattattattattattattattatttcttgtaaagacagggtctcaccttgttacctaggctggtctcaaattcttgcattcaagtaatcctctggacttagcctccaaaagtgctgggattacagacattagccactgcacctggcgtgaaatgctttttgatgagtacatatgcatgctcatttgctcattttcaaatctacacatttactcagcaattacagcagccagtttaaaagtactacagactcttattcagacatatcttagaaatgaaaaattaaggcctattccaataattattgtatacactgacaatatatatggaaatatgatcaattaccctcagttcttcctctatacaacagttaatattgaaaaatcttgacttcttatctgtacacagaaaaaaaaactagagagaatgtgttactgagggaaatgtccctggtttcccaggtgccagcaagtggctaaactatccaattgtgaaggtaaaagatgtattatctatgtaaaagaacataaaaggggccaggcacagtagctcacaaaatctcagcactttggaagacctaagcaggaggattgtttgagcccaggagttcaagaccagcctgagcaacatagggagacctcatctctacaaaaattagtttaaaaaatattagttgggcatggtggtgcatgcctttggtaccagatagtcgtgggggccgagtcaagagaatcgcttgaatccaggagttcagggttgcagtgagctatgatcgcaccactgcactctggcctgggcgacagagtgagaccctgtatctaaaagaaaaaagaataaaataaataaaaatatgaaagggaggcttctgtgattaatatgttttgagtcctgataatatgcagtttgttaatctctaagattatacaatttattatgttaatctacaataattaattaccttcatcactgatacccaataacctagactaactgatcagttgtagtacatatttgtaagattaattttatgctgatatgatataatttttcaggaattaaatattccactttgcatctttatctgcaatgtggctcatggtttcaaaggtgtccagtaatatagagcattttgattacataattttatgtattgattccaaattcattgtttggggggaaatgcaatatggggagagggtacttcaagtgttttcattaggaaggatggttaaaatattttatttttctgcatagaaccttggactttaagtatataacctctgtattagcttcagtggaatactaaaaagtcaacatgtatatggtgaaaatgaataaatgaattttaactgccttttggaaatctacagttacagaatgccaaatgtcatccagataatctatcaagtttttcatttcactattgaaatattttgacataacatagacacaacttaattttaaccatatgctttttcttcatgctctatgacaatatctataatagtatttcctaaaagttattataaaaatgcctgattttgtataaaataaaatccatccaacaaactttaacttcttagccatgtttaaaatttaattcattttatttcaccccaccaatgattgcttcatttatttaacctttcagtttttcagtcattaaatatttaagtgtctactaaatggcagggactatgcatgacgcatttacttatattcttcatctggatcaacactgcagtcacacacacacacacacatactatagtaggtagtaggtatataataatcaacaagattacacagtatttgctctgtagaaactaggagtttagcactctgtttagcacagctgcggaacaactgagttataaacacaaatggcttcttgatagggaacaggattcgaatcagattttaaaacagaaaaggacagacgtaacaataggaaaattcttctacaaaacgtttcgttatcttccttataacttctctctttattaggaacagcatacctatggtaaccactgtgccagccctcttccttacactgttctgtctgcattgtgctctatttcctggttcctcagatgagcttaggcagcatgatttagcacaaaggaaggctcattagccttgcctagaaaagtggtgctgctgaacagccttttggtttagaaactattttcaggccttgctgttaaccttatttgcatcatgttgttgattttgctttatctatcttgctcctctttgtgagcaacagctgcagctattcatgaggttttcttggctgtctacataaggctgaagtgcattatttaaactgtagcatccgtgtcactgctggctcactagctggtatcctagagcttttgggacatctgacatggtggctttgagagctgtcttcctgctctggccagccaccataagctcttcacctttagttcatcttaaagggacacgaatgaaaccagaagcattcattttttcaacgaatggtgtgcttctagaatgcgaggtaaaatttataatccagatgtgttgggtgttaatacgtaccaaggacatgcatgctctttgtcacatcttagaaaatgtaagtatagaagtactttctaggggtaagtctttgtagcattgaactgcaatatcagaatataggtggagccagtaaggacagaaccaagaatatgtgagtttagtatgtttggaagacaaataaccatagtacaagcaataggacaggagtctagaaggtctggtcagatgggtaaagaagtcaagtagccattgcagatgctcaacaaataattgttgaatgaattaataagtggttcaatttagggaggtttgtgaaataggaaagttatcaaagtcagagagagtaacagggtctggtctgacattatggagtttgaggcagcaacactatctatcaagaacaatgaaatatattctgctcatgtgaatggagctatttgtcctttggcctattttattcttccagctgtgtatcatcggcagccctgagtcccaggtgagtaattatagctggagaaagtcaggggcctgcaggtgtatcctgcacgtgattggaacaagggcagaggtgctaggattaccaggaggttcttacattagcattgcttatgaacattctcacttccaagcagaattttatgcacaacagtggaatgcgcccaacttgtaagcgaaatgatctcaactacccagggcagtccttcatgtacatctgcttccaggcaatcaagtaatccaaccaaggtttatggaagccttttgcagccagaaaagatgctaaagagtattaaccctttctccttccttcaggcaccatcttaatacaaataaccagaatttcttttgtttcagagtggtgaaggctaaaatcttactaaaattagaacaacataatcctacttcagagatagggaggtctcatctactcctaaaagagggtatctacagcacatcatatgtctatcatttattcctccttcagcatgtagaatgaaatcatggtgtgggttatgctggaagtaaatgagtggctgcttcattttataaattaccttttggtcaggttttagatatgttctaattaggtatgttttaatagaaaatattgatgtgtttgagaaacaaatcctgaaatttttaacagtctttcgcagttattatttgtaagtaactgggtttacgaatagttcacatgagtctgtgctcactacattaacttaaaaaaattttttttaataagggaattttgaaaatctcactataactttttcagtatggatgtggcccatctaaaaccttcagaaactaatacctcaagtagctatgttcattaacattttgcaggaaaaaaaattgtatgcatacatgcacattttctctctggagagactggctctgagccaatacagcaaaaagaggaaaaaatacacttgcaaagcacagttaactccctgactaaatgtgtggagggaaaatctaatttggcaatactggacggatgtatattttgaaacaaaggcttcttttggaagcttgtgtcatattagttggccatgaactgaacaagaataacaggtaacgcacttgtataaaacccagctgctgtctctaatatttggtaatgaactgctttttgtatatgaagatgatgacactaaccaactggaactatggcatgtgctgtgaacagtgtctccaggagcaaggctggattatttcaatcttccacactctagggcccagcccctgttggatcttttgcacatatttgtgcaaacaaggtatagtctgtggccaagtaacagagccaagccaactggaaaataaaggggttaaatccatgactttggtctatttagtcctgcattcaaacacactgagctaatcattcacacatcattgagtattacaaatgcatatagtcactgaaagtcacaaataataattctctcttttattctgttctgactataggtggcccattgcataagtttcaattcatatatgactaggttattttgaaagggattagatttcctataacatggcatgtgacttatttttttccaattattaaagacggtcactaattattgtgctattcctgcctcttagtactcaaagagaacctgttaatagttacaacccttttgttgttctttatgtttaagacaacaaggaatatgatgcctatctctcttacacaaaagtggaccaagatactttagactgtgacaatcctgaagaagagcagtttgctcttgaagtactgccagatgtcctggaaaaacactatggatataaactcttcatcccagaaagagacctgattccaagtggaagtaagtactttcaaattttgtgtttaaaacgttctgtttcttttaggatgttatgtgaaggcttcaaacatcagagccaagtatttagacagttgtttctcacagtagagtttcttaaatccaaatttttcccatatgcctgtgttctgactttctagcacctgaatatttttaaaggcattctcactaatattttgggtatgatttctaaattgtgccataatggtcatttttattatattgccttagtatcctgaaaagcattatgatcttttaaaaaaatctgtaaaagttagttaaagccttttcaatatatttcagttgcaaagctggtcttctgtcactgagggtctacttatacctacaattattgttactaatggctttgaatctatgcctttcaaccttgttattcattatgccttgtcacttatttccagatttatggaaaaatccacttaaaaaggtatatgaggccattgggtacagcactctcactgtgtacttaaattattttcaagacacttgaatgctaggcttgaatgctatttttaagttatgctacacattgaagactatattgaggctttcagaataaattcagtttcaaggcaaaatatgtagttttttcccattaacatccagagtgcatacacatacacagtaaagtataaggggaacacagagaaatctaagacatagtccctgctctcgaagagcttaaaatgccattgaggaaaatataagttctagaacttatttgcatataagtactaatatccttgagaggggaagattgaactggtaactacaaatcataacatgttactttcaacatgtgataataacaaaataaaaagcttatattaccagtacttgacagtgtataaaataatttcacatacattacttcatttcatttttacagtaaccctgtgttgcgagagagtaggtacttatatcctcatgctgaggaagcaaaccccaaaatcgtccaagatcaaacagttggcaaatggttgagctggcagtggaacctagatttatttgactttggttctcactctgctagatcatgctgctcctcaataacatttattcagattaccagcaggctgccttggtcactaagctgacaggagacaaatggaaacaaatgggttttgattgttcatctcttttcttagcgttcatttatgtctgtgtatgttgatgtgtgcacgttagtatgcacacttagaaatgcatggaaaggaacaaagaaggcaatatttactggtttattttttcctgctccacaaatgtaagaattccccaagcttcttatcatggtccttcattcttttctttctgcagttttccccatactatcctatatttattttttccccaaggaacatcctgataccccatttttacgacttgaaatactattctacatttgttgtttctccaaggaacatcctggtacctcagagtcatttttcattcttctgtgtctttctcccaaattcagtgtcccttgcatttttttcattctcatttttccatcctagtgtaggccctaattatctaactccttcaatgttaattatccctctatcttccttatctttcctcccatccattcagccccactaatatcaagtacatctcctcgatcatgtcacttctgtgttcaacaaatgaatcattcactatttactacaggataaaatttataacccttagctaaacacttatacaatcttttgccagcccagatttatctcctaaatttgtctcctaccacttcctctactcatactttccactctagccaaactgtgcctttgatatacattgtatgtccctgtaatgcatttgttcatgttagtcctctatgactttgcaaatcctacttatccttctccatatcattgcctctgtgaaaagtccataataatctctccagctgtagaattcatgatgtataatcacttatttgacagtaaatttgtactcctgtgacattttgcattttaaaataattttactagcttttcatctatttatgtcttttctagccagcaagattataaactccatgaggacagggattatatctcatttatttttgtatccctatagtcatctagcagaagacttgagctcattagatgcttcatagatgtttattgattttgtttgaaaaatgtcgtcaggatgggcagagattttatagtccatagaaaattcttttaatgctttaaaatcagactgagtaggggcttggatcttgggtcctcaatggtgcacaggaagactccttttacaagtaagccatttgggacaactatgcagtttttagatgcaaccactggagggtgtttgattttaatccttccttcctgaacgaggaaattcatgttctctgaattccgatttgcgagtgtaacctgcagaggctcttaaaaaggccctttgacaatttttcttttccatcaacattttagagttagctgagcagtcaccatgtcaggattaacgagtttttccttggcatttttagcatgcattcaggaagtcaatgaagtatatgaataatatacttgatttacacatgaatgacagagtagaacattttggacttggtgtatatgtgctattaaagaagcttctgtggtctgtattttcaaccattggtacagatttaacagcttatattatataaatacagacacattcctgttgggggggaaacctagttacagtattataagctgtgtttgtccctcacatctcatttaaaacatgttgacctaagactactccttcctctgaaaactagcaatgaggcctttgaggactatgaaagcagacttcataaaatcattcttgatccacaacaataattttctatgaatcaaattaatgacatctatgacataaacccattcatatttaatgtcttcacttttgatgtatcttcagtctttttgtactactctcacggtattccaactcaacctcatcaacacacaaacctttccaatgtacacagtttcgaaagtacatgaaaatctctctctctctctctctctctctcatataaccaagaattctcagaaaccttggttacaaagatgtcactttccaaggtgagctgggggtgtctgtaccacccatgccctaccaggaatatgttgtcctttggccattgtgaaccagcagagatggggagatttaatgcaaatatttttcctaaatgctgaaactgagtgttccgatctggacattattttcctggcagtgactacctttccattcttgagcctgtggccaggatcttccttatgttttctcaggttgggtgcctaaatatggcaagaattcttactttccagtaaaagtttggtctgtcttttcccagactagaaacatctgtccctgagaatagcgaaagcaactttgttgccaacaggcatctgaatgtcagaagtgacaggcaaccagaagaaagccagatagaaaacaccctattcaaactgcctagagacacaaacttgagaagtagagatttttctcacccatgcagctgctggtttttgtggtataaactactctacacagagcacattgtgttcatggggcctagaggatccttgaggaatgaacagatgtgctctgaagctgacatgtgaccaacagaacccagctgtgcaattgagatcctgagattggggacatttttggatgagtaccatttatgcttttgggcctatcttatctcagtgtttctgtagagattaaataaaaaccaaaaatgtaaaaagttattgaatcaggctgagggtcactggtcagatggagaaaatagcattctaaaactaaaagtagaaacaacccaatcctgtactctttgtttccctttaaaagtaagaaagtaaggtgctgaaaggtgcatatgcaatatttattaacaattataaattaaaccagttttggatgaagctttagaaaaagctacagatgtctaagtggactttgaagagaaaaaaaatccttggaaggtttttacctcaatttccccttctatttatagaaagactatgaggatccctatgtgagttgttcatgcatgattgcattcaagaaatacactagaaaactaaaaatattatcatgcttatggtttattggccacatctttttaaattatattcatgaatttagcctcatgtgtcgaattatcttttcatttgtctttatgctcaattttccatgaaggaatcctaagactttcagtaatttaagggaaaaagtataatgtctgattacattcttgcatttggtagactttcctcactaatctaatcttcaattctttaatgcttagtactagccatgtgattgtgctgacaatgaaatgacaaatgactagagaatacatctggtgtcagatgatccctagtcacttctgaagtgaggcatgcaaaaaaacatttttgtacatggatctgtaagcattcattgccactagttcctctaatagccgaacagattggacaccatttaattaagttgtctttggggagtaataaaatcgttttccagacaatctgatgtgtgtgacctaaaaagtttgagggaggggtgacatgaacaatcatggaaatttaacatattgtgtgaactttactcacatggaataaaattgaacgtgtccattatccccttcatgttaaagtcaagagagaaaaaaactgtacttcaatatgtccagcaatgtactgaggtcaatagaataatatttctcatcaaagtttgaggtagaggttagagttgattatgtagaatttcattcaggaaatctgctgtttgggtggcacaaagaacaggcatctcaaacaaacaaacaaacaaaaaaacatagtataaaaccaggataagattgtcttaagtactggaggaaacacagaaaagactgtaagtagtaagtggctttgttccatgttcattaaggctgcaccagtgagaattagttacactacaagcttttagggcttcagaagagagaaagaaagaggtggagggtattttgcaggtttgctttctttgctactctccactttatgtttctttcaatcttctctaaatgtgtcccattccctacctctactctctgtgaagaggtgaagagagaagagaaagaagacagaaatgtggacagcattcagagtggattcttcacaccgtcatgcttccccactcacccacaggtgaaatgtgaaagtacaggattcattactagcaatatagcctccaaactcagaactgtaaatacacacaattccctgtagtcatcaggtctcagcaaattcatgttagctgctgagtcaatgattaatcaaaattaattaggaccctcatactatagagaacaaaactcctgcctaagaaatttagctcagctaactgtgaattatcaagccaagaatttggaaggggagagggcaggaaaggtttttgtaggacaagtaatatcacacatatttagaaaggctcccagccaggcacggtggctcacgcctgtaatcccagcactttgggaggccgaggcaggcagatttcctgaggtcaggagttcaagagcagcctggccaatgtggtgaaaccccatctctactaaaaatgcaaaaactaactgggcgtggtggcagatgcctgtaatcccagctacttgggaggctgaggtaggagaattgcttgaacccaggagacgaaggttgcagtgagccaagatcacgccactgcactccagcctgggcaacagagcgagactccgtctcaaaaaaaaaaaaaaaagaaaaagaaaaaaaaactcttcctatacacacacacacacacacacacacacacacacacacacacacggctaacttaacattatgtagcctcagtctccatggcaaacaacagacacagaatcttacatctgtcagagacagaatcaagacctaaaatctttagcaacatcagccaagatagagtcaatgtgtgtaactatgccagtaggttagtatttagaatcattatataaaactcagatagtatttttagtgatataaggtaacccactgtaagcctctagttatagcaaatgtgtgatattttccccaactatgtagtggtgaataatatatttttctttgatatataggaaacatatgtaggcttgattttaggtcttgatatattaacctataggttttataaatattgttgatagctataaattagctaacgttcaccaaaaattaatggagtattatctgttttgatgcatcctgtctcaccctaatggtgtgtctttttaactaataatagctgctgtgcataactgtgaatttaagcatatcaaattactattatatgaatctggaaagtaataaattatgcttttgtttacaggctaagtatctgtcttttaacttcttaaaaaatatatcctatatgctgctgataatgaccttgacattagtggaggtgtcaacacaaaaataatttataaggagctaattgattgattagtttgagaaatcagatggttagtaggcaggagtaagaccacatagaaattcatgaatatagagttttttctcccatgtccttcttgcctacatctgcagtagactcaatggcctgagaattaagaaagtactgaattcttttggaaaagtgtatgtttcccattagaagcaatttcttttgtggctgccattcttcctgcttctatttcctccttcagtttgcctttttccttcgttaatgaatggcataatttgcttttaagtcacttttctagatctaattctatttctcctctaaatgcactagaattttgttttatacaatggcccttgaaagatattttaaaattgaatttgctttgtttttaataaggctttaggtagcaactttctttgctttttacaaatactggtgctactggcatgatgtttttttcatttctctaataagtacatatcccaaggagagtctagtggcaaggcattgtattccagaatattttcctaactctctgtcaactcccagcagagacaaaagaaaaagttttatttcatttgcacttataatgtgaaaaaattaattatatcaatttaagcaccctatcaaaactatgttcaaggagacttttttctttctctaattgttgaagattatgaacaggttaaatgtacttggctttgtttcatgtctgataatctgctgtggtttcgcagactggtctagagaaacagaaggctatcagacacagccccttttggtcttttctgtcatcacaagttacatcaaaccacagcttgcaaagaaatgacttagtgaccttttatttaagggatatcttatatttttatgtggaaaaagtcttttaagggattcttgctactcagttgctaaatttgccggaacaagtcaaggcaagatttagtgagtattcatatgtgctgtggatttagggatttttttttttgaaaaacgtttctttattatctcttcgtggtaacaagcttttaaaaacgttttctgaaggtttctaaaatgtctcccaaaaaaccacaaccctatgagggcaaaccccactgcctgtcagggactactactaactatgggctggcaatgtcttaacttgatacctgtttctgcttagattatttggaacttttccaaacccaaccaccctccttggtctttaattcaggggtggcaaaacttctttgtaaaggtccagatagtaaatattttaggtttcgtagattatatatggtctctgttgcatcatatcttcttattcttctcttttacaactctttaaaaatatataaatcattcttagctcacaagccatacaaaaacaggacatgggcctaatgtatcagtctccagatcacagtcattggatgcagacatacaaccccagggtgaaggggaaactggggcacttgcttgatagaagccagcaacaattccctggctaaagattagcaagtaaaaaatatgaactctacctatttgatttcttcctcatttacttttgttttctgtgatggctaggttcttatattttcccaaagacaacaaaagaaaacttaagaagagaaggaagaaggaagcagagggagataggatagagaggaagaatgggataggtaaaaagaaagagcgagaaagaaaacaagtaaaaagaaaagagaataaaagggcagaaaaagaaagggataaagacagaggtagagagggggaaatgggggagaaaaagagagaaaaacagagagcagccagaatatggaagctagggcacagtctcgccttcttttcctaagagccagtcagctcttagaggcacctccccagctgctttcaaacattgaggttgctgcccagccactgatcatcatcccaagaagtgaaatgtgggcttcacatctgaaaacttccacttggtttttcaccaagtgaaatggaatacgagattcagggcccaagcaaatggctcatgttttctttgggacactggggctgtgtctacccagggaaaattttgatatactgactgactgactctagtgcatatgattaatgtatacatagggcaaaccaggataatttagaccttttttcttctacaggaggttttcagcaggaattatctggatggttgcctcaactctccactaggctttgccagaataagcacagccagtagagtatgcaggagacagggaccactccctctctccaaggttccctttaactcccacaccccgtgtagctaagtatagtgggacctgtactgacaggcattccttctgggggcaaatgtaaattctgtctaataagtctctaagaagccccaagaaccctaaatattgcatactgctttactgtcagatggcaaaatataatagatggatgaaaggggagaaccatacttatggagggaaaatgttaccctgttcctttcctcatcccaaaaagaagctagcaaagccaaagcccatgacatcccagtcaaatgaattactacatgtgcgtacagtttctcttataagtgtggatacctgggttgtaatttcttttctttaagttgatagactcatgtatagatatagctttagtttctaaaagcatagtttaaaagtgcatttgaggctgaggacagaggattgtttaaggccaggagtttgagaccagcctgagcaacatagtgagaccccacctctataaaaaataataataaaaaattagccgagcatggtggctggcacctgtagtcctagctactgaggaggctgaggcaggaggattgcttgagatcaagaggtcgaggttgcagagagctgtgtttgtgccactgcattccagcctaggcaacacagcaagactctatctcaaaaaaataaaaaaataaaataaaagtacatttagactaaaaactaacacataaaaattatgttgttcctagaggtacactttatgtgacagagtgttactgacaaggtttgtacaaggtttaatttttttaaatggaattacaagctgtaattaattagggaacaatactactcaaagtaaccccttggtaaattattttgtgaagaatgattctataaaattaataatgaattcataattcacctggtaaaactgtatcttcattgactcctgcactgatatcatgattctgggtttgggttttgttctgttttggaggaaaggtgaaaagaataatgagaaaaatgcatgatagtttattttactgtatcttacagatccaacttctaatgatgaagcttcccacataacttctttctttttgggagcagaaagaaaggaagaaaatgaagagtcagagctgttgatacattgggaaaatatttttccactctattgaaacttcctacctttccttcccttctgtttcaccagttctctaagtgataattacagagtgataacttctcaattactatttctgtggtgtttttttgtttcattttgtttttgcagatttcactgcttattttttcccctgaatgcataatctctaaaataaaacaatcaaaattcttaaaagttccctctcttcttagacactgccttatcccgacagatacagtcattgtaactactgcatgagaaagatcctgaaatgtattaagtcaaaacccaaagaacagtaacaacaaattgttaaatgggcaattctatgtgtatctcttaaaagtttcttatttatctgtagggtataaagaaagtttgctcattttcacttgtaaaagttttcttgctgccaagtagtgaaaataaaaccttagaaaagagagagcatctgtaaaatatgcatctgtaaagtaagtttctcttttcaaattgcttgtactgagctgtttggtggccccacaatatgtgctgaatgtgactccttgaaagcagtctgtaaccttgggcagatttgtgttgacaaatgttgctatgcttctttctgtaagcactgcttctgctagagggcactgtacattagacaaggccttgtgttctgcttcgtaaagacagctctctggtgtagcacctgtgtctaagtctccatttgttaacacatgtgtgtgtttccctttttggcagataagactttgggaagcatgattccaaagggattatttcatgtgataaataaatccggagttagttgagtgtttctctaccatgtaaaagccatagataacatattcacctcactttcagaattgctccacaaagtagggcaaatactttcttttcagttggtagactccttcactgttcatttcacaccatcccccacctccgactctactcttcactcttccttggaacaaaagcagccagttccaattaaactcatgggcacaaaccacttccctatctctgggtttgaagggcataatggagaacctaagtttgcaaatgacagaaataatcggagaaacaagctatgattctaaaagagattttccaccatctctatatcacagttatctctcaagtagttagtatacatagccccctccttgtttagtagttgaaaactaggggccatacatacagttagtatttgtcaattacaataaataatattaataaaaataaaattaaagaagaaaagcaaacaaaacccataaatacagtaactctgcatttattaaaaggatccatttctcttttcatcggctccttgattagttgttcacttagagtactagcttggaagcctgacttgaattaaatgattacataaataaaaatcactgaaatacacctaagctctgaagaagtcagagtttatgttagccaacaaaacactgtaagtaatggtgagggaaaagaaaataacgattataagcagtttttttttttttcagttttaaggaggggaatgtaccatacaagaaaagaaaatgtgatggactttagtgagagactggatctttgctatactagtgtgcaaacctgatgctttagagactggcaatgtctttgttttactctttctctctttctgtgatttgtagcatacatggaagatctcacaagatatgttgaacaaagcagaagacttattatcgtgctaactccagactatattctcagacggggatggagtattttcgaactggaaagcagactccataacatgctagtcagtggagaaatcaaagtgattttgattgagtgtacagaattaaaagggaaagtgaattgccaggaagtggaatcactaaagcgtagcatcaaacttctgtccctgatcaagtggaagggatccaaaagcagcaaattaaattctaagttttggaagcacttagtatatgaaatgcccatcaagaaaaaagaaatgctacctcggtgccatgttctggactccgcagaacaaggactttttggagaactccagcctataccctctattgccatgaccagtacttcagccactctggtgtcatctcaggctgatctccctgaattccacccttcagattcaatgcaaatcaggcactgttgcagaggttataaacatgagataccagccacgaccttgccagtaccttccttaggcaaccaccatacttattgtaacctgcctctgacgctactcaacggacagctaccccttaataacaccctgaaagatacccaggaatttcacaggaacagttctttgctgcctttatcctccaaagagcttagctttaccagtgatatttggtagtgaaaaatctgaattcctctgaacagctagataagcatagagaatttctgttataccaagcataaagtacacctaataacgttgtgttaaaaaagtgtttgaagaaaaaggtacaaaaatggcttttatacttaaatatttttgtttacatttccagaatagtggggg
